United States Patent 8,067,671 (METHODS FOR GENETIC CONTROL OF PLANT PEST INFESTATION AND COMPOSITIONS THEREOF) - sequence listing, part 13

SEQ ID NO: 12218 - DNA, 1366 bp, Heterodera glycines
  misc_feature (46)..(46): n is a, c, g, or t
  misc_feature (94)..(94): n is a, c, g, or t
tcatcattctcggcatcgcatcgtttccgtccaccgctgcgcaccnggatgaagagttcaccgaaagcaattggcggcggcggcatttctttgnatccgtcaacattctctgctgctggcacatcaaccggcggtccctttgatgttgccgaaaacgttcatggcatcgatcatgttacgcataaaccatttaattttttgcgcacgaactctgagcgtgaagcggaggaaaagcggcagcaacaaagacagcaacgtgaagcgattgtgcgccataatgagttcataatgatgggaggaaatggatttgatgatgaagacgaatccgatgtggactcggacatggactcgccaagaaatgtccaacaacaaagttacaacgacggtggtcatcgccgccttggcaaaagcgaaagcaaaaaaaggttggcagaaaagaagcagcagctcgcggaagctaaagctgaattaaaaatgcaactgagtgggctcaaacaaatacgacagtaaaatttttaaggcttttgcatttgggaaaaagaaatacaaattttgcccaaaaaatgggtgcgcgggtcctttcgcaaaatcatccgcgtcacctttggacattttgtaaaatgcgccattttaggctatttgttaatactgtagtttgtccccaccccattttagaaaaaaaatttcaaaaatttttttgtcataaaaacaagtttccaggggttttgggggtcattggtcacgaatatgatatccatttcggccaattccgaaccccggacccgatttcgaacaaaaagtcgaaaattcaaattttctaatttctgatttttagtctaactatttaattgttcttttattgcaaaattggtagcttttagaatgtatccatgtatttaaaccgattttgagccaaaaatgcgaaattcgaaaatttgaatttccgactttttgtttgaattcgggtccggggttcggaattgttaatgttgctaaaagcaatcaaaatttgcattcttgtcatcttttcgatagccacggtttttctttattagcctgcacaatttcgaatcaaattaacaaatttattataagttatgggctttttcaaaattcgaacaaaattttgaaattttgcaggctaattgagaaaaacctgggatatgcacctcagaggcgttggtttaaaaaaataaatatatttttatttatttgcgttttaattactttgaagccccaccaaaaaatcaaattttcacagagagagcgaaaactatgaacgtagtatgcggcgcaaatcagtcaatgaattctccgaagttttatgacgaattcgcgagtatgcgcatgggcgacaacagtttct

SEQ ID NO: 12219 - DNA, 1884 bp, Heterodera glycines
taattacaaattttttagaaaaatgtttgtaaaacatcttaatggcttaggagaggcctaggctaaggcttaggcctgaacttttgggcgaagcctaggcttgggcttggttgggcctaggcttaggtttaagcttaggctttattttgtaagttgtattgtacggctgagttgtccatcagctgaattttgtcctcagctgattagtccaaaaaccaactcaaaatttcaattgaaaaactttttggagaagggaaacaattcggggaggggaactgctgatcccggcggggcaacttaaggctctaatgcattttatgagtccaacaaaccgacaatacctggtttttatacgataactttgttcatgttcgaataaaccctatatttttggtatcattagaaagcacaaagtcagaaatgtaaaaatacgagaaaacaacagaattctaacatttaaagaaagttacaaacgaaaataatcaacaattaatttattagtcaaatatttcttggcaattgccgaaacgctgatattttatatattttagcttctttagactttatgccaaaaagatagggtttgttcaaacatgaatgaacaaatatttaaataattaaagttttagcgctgcacgcactgctcactgaacgcgcccgtcggctgtttgctgcgggccccgggcgtgtctttctgcgcgcaatttccgtattgagcaagcagatgaccgcgaatgagatacgccaattcgccgcatattttgcatggtttccgttctgcagcgtgcatgagaacccagacacaattgaggcgaacggaaaaggcgagctggcggcgtatggcacgcaatttgacatgaaaaaagcggaaatggatgacgcggcggatttcgagcagttcatgcaagaaatcaaaacagaattgttgaaggacagcggatcgaggcacagttttgatggcagcgtcagtggccggcgccgcagtgttgatggcgccagcgcccggcgccgaaccattggtggcgcatgcagcgggcgccttagtgttgatggcgtcgccagtacgatgcacagcagcgtaattatataattaagcctcaatttatcataattaagccataattggtttataaatattaatataaattgaaaaaagaaaaaagtaagcaccctgtgattgagtttattgttcattttttaaatgaaattaaaagaaaaattctgggatttaaatatttaattttatattcaaaaagcgagaatcggttggagtgtgttttgtggttataatttattttttcattgtcgaattttaaatttaaattttaaaaagttaattttataaattttaatgttcaagaaaatgttttttaattttcaaatttccctaaataattaaaatgtcaaaagtgcacgttcgcgcacaggtgtttgaaagcccatgccgattggatgggtgcatgaaaccttttgaagttgccggtccatctaaaaactaattagggcgctagttttaccgcaaaataaccgtgcccccttttgatactttgtactgtactatttccctaccgtaatttcttaatctcttagtcaggcaaccgtttgatgaggagcaaatccgtgtcacagacaccaacccgctcgcttacaacgtcaaaattgagtgaggtagatgtggtaatttttttgcaatgcctaatttggacaaaaaaattattacaattttttaaataaaaattttgattaggaaaccatacaacaactggttgagcgttattcaccgccgaatgactcctgaaaagctgattgattgcattgattacaaaagaacatcctctctatccaatcctagacgcatgagatttgagatttttttttgagaaa

SEQ ID NO: 12220 - DNA, 4488 bp, Heterodera glycines
  misc_feature (3411)..(3411): n is a, c, g, or t
aatttccgaaccatgggcgagtttggacatttggaacaattgtgatggatattgaaaaggtgtcggaatttgcgggagaaaggttttcgagtgattgtaaaagcgagactgtgcgggaaaagaccgatcggttcaatctcagacaaagggccgactttattctgagagcaattaggaggcatttcgccaaaaataatttagggaatgccaatactaaaatatttataaattgaaaacattttttaattcaaggaatgccgaaaaaaacttgccaaggtggagcaaattattctgagagaaattaaaaggcattttgccaaaaacaaaagatttatttaatggactgaaacattttttatttaaggaatgccgagaaaaacttgccaactccgaattgagagagacgaaattgctgagcaaaaacggggaattgaatgcagagaatgtgagaaaaataaaaaataaaaatgaattatttaaaaaagaaaaatggcaaagaaggggtaaaaaacagaaactttcaaatttttaaataaaattcagaaggcgcttaaagcagagttggagaagcagaagatgatgacggaacacagtgaacttaaggcgaaagtggaaaagatggagcaggaaaagcagcagaaattggacaaaaaatacggtgagaaaatttaaaaaaaaaacaaattatttccattaccgtattcggatcctactgttaaaatgaatatttcaaaatgatttcagtttcattcgatgtgttcaatgcattggtggagcgaatcaaacgtttggagaaccagcagctgaagcagaacaaagaggaggacaaaaagggtaaaaataaattaatggacgaacttttatttatttgtgataaattataaattttaaattaacattaattagctaatcagttccaattattttcattttttgttgttcaattggagactcttttagcagaggaaaagcagcagaaggaaagtgttggtcaacagaaattggatggaaaatatgccgtggtggacaaaaacaatgttttgggtgggcacaattggcaaattattttaaaaattgtcattaataaattggcgctatttaataaaccaaggttctgttctgttgaattttaacctgtttcaaaagcgtttattagtcaaaatacattatctaaatctaaatgttaatgagttaatttaactttcgaaaatgttatttgaattgctttagtgacgtcatcgggcgaccaatcgccgccggcggttgtctcagcgaaagttgcaaaggtgggaaggaaacataattatttcacaaatgccattttaatttcaggaagtgcctaattcgaagaaacaaaatgattgggatgccaaagtttgccacaaagacatcgaaatcattggggaaaagcaattgacgatcaattgcaagggcaacagatttggtaattaaaaataaattaaataatgtaattaattaatcacttttttaattaggatggagctctgtttttgcgaaatttcccatcacaaacttttgtcgccccggcattttctacttcgaaatgaaagccatcaatttggaaaggtgggcatttggaggaagaggcaacctttattaggaccagggttgccagattaaaattttaaaaagcctcattttgggtcaaaaagcctcatttttacaaaatattcaaaaaacgtataaattgttcaaatgttatatttttgattgtccatgatcgatttgagtaattttttgttagaaataagcattttgtgaaattctgagcacgagaaatcggagttgattttttgctgtgttttttccgaaaaattttttggtgaaccagggggtccggcgagtgccagataggcgccgcccgggagaaaaattttcgtaatttttaatgagatttgttaacagatttgtccacaaaaatggccaaattttaggattttgatcaaatttttaaggaaataaaggacttttaggggctggcggttccgataggcgccgccaggggaaaattgagaattttgacaatatttttagctgattttcattaaaaaattattaatttagtggttttttggaaaaaattggttcttttctggtttttataaaaaattttagcaaaccaaattattaaataattgtaaaacattatgccaatttatcaaaatttaaaatattctgaggattttccccaaaagcctcaaaaatcctcaaaatttctaaaaagccacaaaaatcctcaaatcctcattttccaaaaaaatcctcattgacctatcaaaaagccacaaaatgaggataaatcctcagacctggcaaccctgattaggacgtattattcatcatttaagggaataaatgtaaaaaatcatttctttgcgtaatttttgaattctttattaatttataataattttaacagttttgccgcgattggattcgccacgaaggaagtgccattggacggttcaattggccaaattttgaacagttacggataccgaagcgatggctcatttggctgtaatggcatcaatcggccgtgcaaaatgccatttggccaagtgccaatgtcattatttgacgtttcaatgcaatcggcggacgtggcaatggcatataaatcatcggagttttccactggtgacgtggtcggatgtggccttttcttggacactcaactgatctttttgacaaaaaatggccaacgaatgggtgggccaattaaaattaaaaaacaaattaatgaataatttaatttttaagatgactcatcgtttttcatttcttctcccgccaattctctcaattctctgtttccgtgcgtttctttgtgggcgggcgacaaaaccgaggcgaactttgggcccaatttcaaattcaatttggccactctttgaagaaaacagaaacaatggaagaaggcgataattttgaattaattatttattattatttttgctctttgtttatttttaatttttgttttgtaactgaaatattattttatttgtttttaattttattttattaaaaaatgctcttgaattttttgtgtgttttatatatctgagaattttgtccattaatatagtgaatacaaatatgattcaacaaatttctgttatccaagcctctacatctttcagtccaagtttttggactataactttttttattctcaacgaaatcaaacaaaaattcaaaaatttcaacttttttgcaatttttacgttatacttttttggtaattatttagtcgcgaatcaatagcttagaaacagcttaaaacagtaagcttttgaatgatatcaagattgttggatttggttgagaatgataaaagttatatccaaaaactttggctggcgcctaaatggcccctactccttnctatgtattcttgagggagtgatcctgaatgtgatcccaatgaaattcctgatagattctgatgaatttaaaaaaggacagggatggacttagaggacgggaccccgaaatttaatccctttgatcccgtccggtctttattacaaaaaaaataaatgtttaaaaatttattttgccttttaaatgattgcaggcttttccctaaaagtgccgacaaatatgtcttcctaaccagttgaccaccgggtcgcttgccacactcccttttaattcccctttcttcttccttcttttttggaaaaaatcccgaccaaaagtgcttgtcctccctttttagggcacttcccggacccggacccaaacaaccctgttatcattcgaaagcacagactttgtagaggtgcttaaacatattcaatttttgatttgacccgttttaagatgtgcaaaaagcgttcaaaaattggacattcaaaaaaagggtgattttttgtcagtttttcgaatgtagttcgaacagttctgaacattttggaaaacccgtatttttcccttatagcccttgagaaactgaatcgtttgaccccactcgcgccccgtaaaactcgctagaaagtctgaaattagtttttaagcttggatcatgggtataaacttcttataggaggaattggtttacgatgaattcttaatacactggtggaaaagtctttaaacaaaaaagcaatttttgtatattggttaataaaccaataattaaataaagcattgtgggcaattgtttatgtatttattagtccaatagatcggcttcatatcagcaccaaaaaatcgcggatcaaaaatagaatgtaagtgatagggtcaacgaggtgagagatggtcaaaataatggcggaaaagtctttgaataaaacttaaaaacaatttcaagggggctcttaaaaatctcaaataattcatgcatgcttatcttttgatgctgacgcaaatgtcttttacaccaacttgaacagatcactcattcatagtgatcgggacaccccaaaatacactgaaaatcggggaaattttcga

SEQ ID NO: 12221 - DNA, 2371 bp, Heterodera glycines
  misc_feature (2280)..(2280): n is a, c, g, or t
tgctttaaacgcctttttcgatcatttctctcactgcatcaaacacttccttctccaattattctaatttgatcacttccttctccgatcactccgattttctctctgatcactaatttctgtttaattcttcggctgattattccatcattctttctcatctgttagctcttctgattgtcttccatttgcttaaggatgtgactgcgatcatcttttgtgtggcaatgtccgaatatgaccaagttcttcacgaggacgaaacgacggtggcattttaggattaaattcaatgccaaaatattaggatcaaaaggaatttagttaaaatttaattttcttcgtgtggaggaaaaaactcaaaaattcttaatggtaattacagaaagactgaattttttcataaagattcaatattttttaagtttttgttgacaatttcatattttatttaatttgttgcgaattattttaaacggttaaccgttaaacgtgggcaatttgagaagaagaaatagagaaatagtgtgtggaaagaaaaaaggagtgaagggcagacgcagaagggaaatttattctctcaaataaaaaaataatgcaagcattcacatctcccatgtggtctagtggttaggatttgtggttttcacccacacggcccgggttcgattcccggcatgggaagagatttttttcaattcttttttgtatttttagcaattattatttatattttatttttttatatatattttaaatttaaatattcgcctttttctcttaagaatcgaatgcacgagtcgctgaagctgttcgactccatttgcaacaacaaatggttcaccgacacttccatcattctcttcctgaacaaaaaggaccttttcgaggagaaaatcaaaaagtctccgctcaccgtttgcttccccgaatataatggtaaatcaccaattaatgattaattgccctaattaattaattgttgcctaattacctgtgttttctctgcctttttaggccgttccgattaccacgaggcgtccgcatacattcaggcccaatttgaggcgaagaatcggtcgaccaaaaaggagatttactgccacatgacctgcgccaccgacaccaccaacatccaatttgtgttcgacgcggtcaccgacgtaattatcgccaataatttgcgcgggtgcggcctttactgagtgagcggtggtgccaccgacgtcccttcgtctaaaaagtgttttctgtgctgccgaatctgtcgctttgttaataattttgttgggatggcaatcggtcggctcagtctcccaaatgatcgaaatggtgatcactgatcagcaagcagcttttcaagccgttcttcgcttcgttttctgctgatccgtccccccccccaatgtctgtcgatattcgctcaatccgccgccaatgcaatgcccgcgactttatccgctaatctttttgctatgtcaccacagactgacccaatcattcgtcgttcgttgtgtatttatcggctttatccccccaaatttgataaattcccacaaatttcgccccttttcctttcccttcgcttttaataaataattgttttattttacttttccaaattgtgattcagaggccatttgctgattgtctgtctcattaagcaacttttttaaacgaaagattaaataaaggcaatccctctgaaaggatttcttttcattttaaatgttttagtcttttgcttttattttcttttcccttttttcaaaatgtcatttctttctttttttcaccactgaccacaaatgttttgttttccattctcagctagtctttttcttcttattttcaaattcaatttttattccaaataaaataaaataatttccaaactttttctttcgttttgagttttattgaatttaacaaaatattttccaattttttctttatggatttacccataatggcacaagtgctaccgttctctctgtgcttctattttcatacggtggcccttttcccattggcacaatgccaaatttggcacttttcgtctctctctctttcttttctctttctctatttccgtcagctgtaccaattttttaagattttttatgtttcctctctttttctcataatattgtgctgctttatttcattttatcatttatcacaacaaatttccgcgtaattttttttatttcgctcgcattttggcatataataaaatgagtaattattataattatttttttcatttttatattccanataattaaaaattattcccaaagttttttctttcggctgacaaaataagcgaatggaataataaaaaagtacaaattatggccattttata

SEQ ID NO: 12222 - DNA, 1456 bp, Heterodera glycines
aataaaataagaaatgtttcaaaatttccaaaaggcctttaagatgcaagtgtttctcaaatattttcaatttggaaatataagtttcagattatagattaaataattgactttatttatggctatacagtgatacaagtttgtaggactgggtaaatattaaacgtaaaaggttttatgttgctattactaagccccgtgacacaattcacgcgagagaattgccccgctccggtatcctgtatatggcaggatttacagtatatgcagtatacaatttaaatgccatagattgcaaaaatcagaatatttatttcggctgcttatgtggggggcgggaatttgtggcattgtgacgacggaaacgcggaggagcgggcaccgcttttcattatgttattatgtatttaataggttacagacaataaacgaggggagagagagagggggcggaaaagggggcagcgaatgccacggcaataaaattaagaatcgtagtcttctagttttttattagcattaattcggctctttgaatattttatgatttttcaaaaatttactaactatcaaattatcagacaaattactgtctaccacttaaacattataatgctatttaggctatcagggattgaaaaaacttatgtttgaacgcgatttggacatatgcgcaagtgtcgggtaaccgccccccccccctcactttgatccccgcgctcccctcgcgatgtttgttgcatttccctaaaaattcggcccaataaaacttttaagcgtttccccccttttttggccttttcgatcgcctctctgatcgatcaatcacttctgctgctgctgccgccgttccgttctgattgctccttatttggcctcttatcagctgattccttcttctcccccttccatctctttttttattttgtttattcccttttttgtttttgttttttaattacccctcatattttgctaattcactttccatttttgatggattagctgttcgttctgctgtccctatccctcaaaatgcttttcgtcctccgtccgcgacgattcttccgtttcccccccccccccttcagtaaacaattgattcattcattcattcgccgatggaatgaatctcaaaatttccaacttttcaattcgactgacaaacaatggacaaatcaaaatcattcattttgtggtgtaaaatttcgcataatttgcacaattttctgtataaattcagaaaaaaaaactaaaaatagaaaaaagggaattctgtttcagtgttttggcccattctaatcactgatcagttgagccatccgattcttttgcttacacttgttcatttctgatcactgatcaatgtttttccttctttatcaccgttatctgatcactattgctccacgatccgtatcgtctctctgtctgatcactctgattagttcacttt

SEQ ID NO: 12223 - DNA, 1057 bp, Heterodera glycines
catatttttgttggatcaaattgctgccagccggcattttgcccgatttgttgtccgcagtgccttttgccagttgtgagcggtaattgttgtggcacgcgagcatcgacacgcggctgccagcagaaagtgccaaaacagagcatggaacggctgcgaatttgaagattatattattagtgtttaattgaatggaaaggaattatgtaaaaatattcagcagtcggagtacagagttttgagtcgagaattttcggtttttttggggccctagagcccgggaaatttcatgtagcgaatgaaaaatctgatttttttttgatcccgattgcaccgaaatatacaatttgctaatctaatccctaaaaaattattaaaaccgataatgtgaggtgcaaaatcaaaatgtgatattatatttaaatgatcaattgttacacaagccgatttaaagcaatttgcaaaaggttctggttttcgaccccaaaatctgtttttttcggcccgatgtttctgattttggaaaatttttgatccgagccctgatctaatatgaaattttggttttttatttatttttcttccaatattaaatttttgccttcattcctaatttcccgattctcttttaccgcaccaacaactcctcatttttctattatccgctaattttttgacatttcaattattaactaaaattgttatttttttttaaattaattcaccgatgaatgcaatgagcaagcagagaacaaatttagaaggaaaatgctccattttttatgtattgttattgtaggatttgaataatttggaaatgaatggagacggacggattggaggattaaagcggacagattatgaatggcttaattaagcatttttctcgcttaaatacggacatttaggttgaaacaccacataggaataaaacatcattctaaaagttaagcagcaaaaaattatttgtttagatgttcgtcctcgccataacgtgtccatggttaacgccatttatttgccttttaataattttatccgttaaacggcggaaaat

SEQ ID NO: 12224 - DNA, 1214 bp, Heterodera glycines
  misc_feature (23)..(23): n is a, c, g, or t
  misc_feature (1195)..(1195): n is a, c, g, or t
gtttttgacacatcattcagcanaagctgtgcaaattaagtgaatgtgtttggcaggaggattaatgcgaaggaaattaaaattttcaactatcaagaacgtggcataatactcaaaagttggaaatccaatagcaccacggcagaataaacaaaaaaaattgcaatattgattttaaattaactattttcatgccaaaaaattttaaaaaatttaaacaaaaaaaggatttactaataatttcaaaataatgaacaaaattgatttaaataaatcaaatgccgtcaaattcaaacgcccattttttacttgtttggacttttggccatttgttaattaggctctttttttcatttgttgtagctaaagaattgtcctttatgctgtgacattagaaaatggaaacccatgaaacagaaaatagccatttacaatatatgaaatatcgaaagatggtaagtgacagaaattataccaggcaatttgcaatttgcatctgaccggacatttggacagggcagcgcggacgtacgagtattttgttttcagtaaaatccgaaaaaattgctatcgtttgagctcacatgcttagaagctaacttttgattttggagccgaattaaaaattgtttctaatcatgtaaagctaccgattgatatgataccaagattgtcggatttgattgataaagaatatccaaatgccacttcttttgaataatcgtatcacttcatttttttgtttgcccgagcaaatcactgtctacctacagaaatgatgttacattagtggtgcccatcaaggttacagtatcccagtggaagttacagtcacagtatcccttttccaggtttggttcctcgtctttcctctgctccaatgatcagtacggcttcgtgttgtacggatcgctgaggtgggtgacgtcactggtgaattccatgcgcaatttgtccataattttatcggcataattagcagcagcatccttttcgccaccatttttgtcataatatcgcacaaattttgtgacacttgactgcccaacaattgtccattcgcccgtcaaaatttcgtgaagataagcagtgaatgcgccatgagtggacagaacaatgtgctcagcttggaaaagcaattaaaaaaaccaacgaaaacaaacaaaaaatgtcagtcaattaaatttaagaccanaaataaaaaacataaattt

SEQ ID NO: 12225 - DNA, 1366 bp, Heterodera glycines
aaaatgtcagtcaattaaatttaagaccaaaataaaaaacataaatttctaatttatttttaatttatatgcacttaatgtaaatttgtcaaaaagataattagataaaacggcttatttgcataattagggatatttggtctaaatttaataaaaatttactaattaactttttatatggaaaaattgggcctactcataaattctaaaataaattaccatttttattgtctgccaatatttggccaattgtttttttaatgacccatttacaatcgtcttcttccacttgcttcacagattcaagtgccgatacagttctgaatttattgatgaataaatttttgccaaaatgctgcccaaaattgcaaaaatgagcaaggcacaagaagctaaaaaaaggcaaaacataaataaaataaatgaaaatttaattaaagttgacgacctcggccaatcctggctcaatatttatgctaattgcatgactttttgcttcagcgccgcccaaaagtccaatggctgtttggacggaacgtgaaaatggagaggaaaaaactttgctgatcgtaacattttcaaagctaattaaattcaaaattgtatttttcaaaattttctgcaattcaccgctttcccaattcctgggattgttgaatgcccagcggggacaatgggatgtcatccctggccaattcgtcttcagtacataattttttgtcaatattgtcctgtcgatggccatgcctgatgacccacaacgattggataacagtgggacgtttatctggaaaaaaaattaaaatcaatttatttgtacatatgtattttaaaataattttttctttatttaattatcaattaaaacaattttcacacataaataatttaacctaatgtccacagttgagctgcatttgtaatatcactttccatatatttgactttaactttgcttaaattgagctcaatcaagtccaaaatatattcatgatcaccgtaaatgttaattgactaaaaaaaaataaaaactatttttgacaattccctaagaaaaccaaatgttgtgatttttaaacttattagagagttattttataaaaataaactaactaattaacaaagctaatcccactttatatttaaatatttgattataataaaattacattttctttgcatgaattttttaaaaattccaatttttgcttcagctgtattacgatgtttacaagaacattgttataatggctcaatttgttttcgtatctgaccaaatcgagcaccatccctttctcttgcagcgattttacaatctgttaataaagttaaattaattgcttatagttcgaattgtcgggttagg

SEQ ID NO: 12226 - DNA, 2049 bp, Heterodera glycines
gggaaaaatttttgtattttttaatgcgatttgttaacagaatttgtaaaaaaatgaccaattgattaagttttgggtttttaggatgcttaacatgaaagaaaaaaattggaatattttttaaaattaaaattttaattaaaataatggtaaagaaaatatgaagaatattctatccaagtggggaattgaacccaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccggtaccggtaccaaaaaaaccggtaattaccggccagtaccggtaccggtaccggtaccgctcaaccctagatataatataattttattggaaattaaatttaaaataaattattcttagtcttagaaggaaatgattaagcattatgaattaataaatcacatgcttactgatttttgtctgaaaattttatcatgatctcttcactattttggcattttcttcactatttagttaatggcatttttcttcactatttagttaattatttgagattttttttcactaaaatttccaatccctagtcgtaaaacaaaaacaaaaaatgcttaattgttagaatattcattaaatttatccgaaatttttgaatttctgaaatagatctttaaaataatggaaaaatgggctttataaaaatcatagatacatatttgctttgccttttattctgataattttttttatattaaatcaatttttcactacatttatgcattaaaaagatttaatttctaattcctacttttaccatccatgggtttttactattcttatttattcatattaaagtaaaatcattgttttaaatcaatgcttaattttataatctatattttacgcatttcaaataaatgatgattgtatctattgtacaaaatgttgtaaattctatacaattgcgtaaattttggctaagaaattttcaaaattatgcaacatatttgaatgacattcaggaatattgaataaactaccggacgggaccgagatttcgcgtgattcttgtggggttccgaccacacggaatccgtctcgaatcttttttaattcatcgggattaagaaggacagggatttgatcgggctacgagtcggaattaaaaaaattatatatattattaaaatttctagatcaggaagaaagctgaatttatatttccaaaaaatttcgtgtccttttatgttaaagcaattaaaaattagaaacattatttttcccaatttggcgtttttggcaaaatttcacatccgattgataaagtcaagaatttattaaattaaatttgttaattttccaacaaaagattatcgaatatttatcgaaattaagtaacaaaaaattgagatgggcactgctgcacttttcgatgatgccgtgccgcaacaaagcgtgcagctggcaaatgccgtacttggacaacgccggcgggcggcgaacggtcggcggcacaaaacgggcaacggaaagagaggaaaaagggcacaaaaagttgccgaacgattcggcgaacatcgatgttgaaagagaacagaatgatgggcgaaatgctgttcagcaaaattgaaatctgtgaaaaatattaggaaatcttttttatattaaaatatgtctaaataaaaaaaattaagaaaaaaatccaggtccaggaaaaacccaggctcttcgggatctggattcaggccctggacctggaattttgaaatttgttttaaaaaataaagtaatgtttgaaaaaaatcaaataattgcttgcaaacttttaaaaatgtctaatttagaataataatatgtttttaaatctattaaatcatatttgaaaacttgtaaaaaaacactaatta

SEQ ID NO: 12227 - DNA, 1108 bp, Heterodera glycines
gtcatgcttttgaaaaaaaccattagtggtttttttctgtgacttttggcgggaggcacttaatgtgtgtcatgcttttgaaaaaacattagtgtttttttctgtgactttagtgtggagacaataatgtgtgtcatgcttttgaaaaacattagtggtttgttctgtgactttagtgtgagacactaatgtgtgtcatgcttttgataaaacattagtggtttgttctgtgactttagtgtgagacactaatgtgtgtcatgcttttgataaaacattagtggtttgttctgtgactttagtgtgagacactaatgtgtgtcatgcttttgaaaaacattagtggtttgttctgtgactttagtgtgagacactaatgtgtgtcatgcttttgaaaaacattagtggtttgttctgtgactttagtgtgagacactaatgtgtgtcatgcttttgaaaaacattagtggtttgttctgtgactttcgtgtgagacactaatgtgtgtcatgcttttgataaaacattagtggtttgttctgtgactttagtgtgagacactaatgtgtgtcatgcttttgataaaacattagtggtttgttctgtgactttagtgtgagacactaatgtgtgtcatgcttttgaaaaacattagtggtttgttctgtgactttagtgtgagacactaatgtgtgtcatgcttttgaaaaacattagtggtttgttctgtgactttagtgtgagacactaatgtgtgtcatgcttttgaaaaacattagtggtttgttctgtgactttagtgtgagacactaatgtgtgtcatgcttttgaaaaacattagtggtttgttctgtgactttcgtgtgagacactaatgtgtgtcatgcttttgataaaacattagtggtttgttctgtgactttagtgtgagacactaatgtgtgtcatgcttttgaaaaacattagtggtttgttctgtgactttagtgtgagacactaatgtgtgtcatgcttttgaaaaaacattaatggattgttctgtgactttcgtgtgagacactaatgtgtgtcatgcttttgaaaacattagtggtttgttctgtgactt

SEQ ID NO: 12228 - DNA, 923 bp, Heterodera glycines
gtgtgtcatgcttttgataaaacattagtggtttgttctgtgactttagtgtgagacactaatgtgtgtcatgcttttgaaaaacattagtggtttgttctgtgactttagtgtgagacactaatgtgtgtcatgcttttgaaaaacattagtggtttgttctgtgactttcgtgtgagacactaatgtgtgtcatgcttttgaaaaacagtggtttgttctgtgactttcgtgtgagacactaatgtgtgtcatgcttttgaaaaacattagtgatttgttctgtgactttagtgtgagacactaatgtgtgtcatgcttttgataaaacattagtggtttgttctgtgactttcgtgtgagacactaatgtgtgtcatgcttttgataaaacattagtggtttgttctgtgactttgtgtgagacactaatgtgtgtcatgcttttgataaaacattagtggtttgttctgtgactttagtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtgtcatgcttttgaaaaacattagtggtttgttctgtgactttagtgtgagacactaatgtgtgtcatgcttttgataaaacattagtggtttgttctgtgactttcgtgtgagacactaatgtgtgtcatgcttttgaaaaaacattagtggtttgttctgtgactttagt

SEQ ID NO: 12229 - DNA, 1377 bp, Heterodera glycines
aatattacataattttttgcgctaaagcaataatatttttcaatataaatttcttttttattttatttttgatggcatcatttgagacgagcaaagggcggacattggattgagaacaaatttcactgggttagggcacactaatttttaggtactgtggcagttataagaaaaaagaaagaaaaacattttgcttgataaatttggggaaaattacgccgccaaatatctatgccgtcaacggatctgatcaatcacttttcgctttcatccgccattccgatcacttttcctgaagacattttgtcttccgctcccatttcaaacgcgcttcttcgtcatcattcgactcttcatcattttccgcatccttctgcgatagtactccatggccgccgttggttgctcgtacacggcaccgctcggcccgcattgtttcggacatttcaccgcctggccctggccttgggcaccctggctgcccggcagcccgatcttgcccggctcaccgggcggaccgtccatgccgcgctgtccgcgtgcaccggcctgaccgtccaagccttgcggaccgggcagtcctggctgtccggggggaccgggtagaccagcatcacctaaaatcaaaaatgtattgatatatatatacagtaaaatttagataaaccatatttttatttttttcccaaaaaaaaaaaaaattacccggtggtcctggttcgtagcctgaagcgccatccgggatttcgggcggtgagaagccgggcggtcccggtggtcctggtggtccgtcttgccctggtgcgccgggttcgcctggtggcccagggtaaccgggcaatgcttcaccgcttgatctgccgggcaggcctggctggccaggtacgccgggtggaccggacgggcccggttcgccaggcgcaccgcctgggcacggtcggcacggtgcctaaataatttaaaattaaattatatgtttagaaaaatatggaaaaagtatacaatatatactgaattagaacccactccctccccccagaaaacctttcttttgagggggggttgaaaaattaagcccccgagggttctatttcattaaatacggttataatttttaaaatataaatgaaaaggtttttaaataacatataattatttatttttagacgactcaaattttaaaatttgtaaattcaaaatttttttaaaaatattgtatctagtgagaattaaaaatattttgaattaataaatttattttgaaatttaaattttgctattataatttttttatcggcttctaacaaaaaacttttgcatggttttcacgaagcgataggccccgaggggaaatcccttactcacatgcatgatcag

SEQ ID NO: 12230 - DNA, 3588 bp, Heterodera glycines
  misc_feature (3503)..(3504): n is a, c, g, or t
  misc_feature (3560)..(3560): n is a, c, g, or t
tcggtgcaagtgctgcctctaccatagccatagtattcgtatgcgtgccgtttggtacgattccctccgctggtgccgaacaaatcggccactgaagctagtgcttgggcattgcttctgatctgcttcaactcattcttcagttctgttgctgagcccttgtgaacaaatgaaaatttaaaaggaaaagattttcgtttatttttgtataatcaaaatgttttctaattaaaataaatttttgttataaaaataaaataaatgttcattcttcaattttaaataaaattaattaatctcgttaaaataatatgatcaaaaaaaaaaattaaatgaaaaggaatttacttagtcaaactaataaatacattttcaatttcaaaaaaattttcaatttaaatttaaaaataaaatatttttgaaatattaagtttcattgaatatcattaaaataacaagaaaattaatgtttaaatgagaactgacttggcattggccaatctctctgtacatttccattctcaaattggcaatataatttctcatcatcggcagcgttacagaaagggacagcagtgaaacaagtgcaaaaagcagcgaaatgtggcagacaaatttgtaggccttgattttcggttgaaaatccattgtttgaaggccaaaaagctattgtaaatctgaaattctgaatttttttaaatttttaatttgggtatttattacataaatttatagcgatgtacgaagtcaaataaaaaagaaaagcattaaaaataattaaattttaaaccaaatagcgttaaaaatatggataattttactattcaataaagttattaattaattaaataatttatatttatgttatttaaatatatttaaaatttttaaattgtctttgcaatgtgtttgaacccggaacattttattcagactttgtgtaattgcattaaacttgaggaacatttatttatataatgaaataaattataacattttttattttgaatattaattatgattattattttattcgcaaccctttgatgcttttatacaaaaattttaggcgccaccgacgccaccacaaatttaataaaatgttggccataatcatttttggtggtggggctgactgactgaacaaaaatgaagaaaacaacaaaataactgaatgcaatttggtccaatgctctccccattctaatagttgcgcatcaatccccttagggcaaaagaattttcatttttttaaatttttttttaaatttcccccagggcaaaaattgctttgcaaattttgaagtgtgccccaagcagcacagaatgagaaatgatcatcaaccaacccgacttatccattattattattattattattattgcccattaaaatgtggggcagccccccattcactcacattttctcccgccctttttttgtccatgtcaatttttttgtttcacatttttcaatccgtccaattttatggccggctcggccgcccgcccgtccgccctccgttctttctctccgtaaatgttttttttttgttaatgatttttttgtttcaaatttttatggccacgcgaccatttttgggcgggagaagtgaaacaaattttcgcactgcagcacaaagtgttgtttttttgttgtgtatcacctcatttcaatgccaattggtgtaaaagcaattaattaattttgtcgcaaagagttcaaatggaaaaatgtgattaatacttttaaatattttatttaatattcaaaatgagaaaatgcttgaaataaattaattaaaatgactttttgggttgtatgaataggtaatttacaagaatattaaaaatccttcgaaaattttttatattttttttactgatttttattagaaatgaaaaatacatcaaaaaattatttaaattttttatttttattggaattattaaaaaagtttaccaaaaagttttttatttgaattcattttaatttgtaagatttatgaattaattaatactaaacagtgtcacaaacatgtcttgataatttactcttttatcttcttgattaattgttggcatgtttatcacccacaaatattcataaaaaacgtttagttatacggttaattatgtcaattagcttctgtttcatccctcttactatttttaattacctgttaattagcatcccattaattattcaaaattgattttggttttattgcctcaggcacaggctgattagcacgtaataatggatgatttgtcgttctctgcccatttgtctgtcaaataagatcccccggggcgctgcgcatcaaattttgtgcgcaattgagcaacataaaaaccgccatttaaaaatgcaatttgttgcgatgtccaattattttttaaattttgcaattgttaatgggttaaatgaacacattgaacattttaggtcttaaaatttttttattttgtacattaaaactatcagaatgcaataaataatttaattaaggagtttcccagccggaattatataggaaattaaatgcataattttgtacggtcatttggaaaaagagggaagtcgatatgcattttttaaaattttatttattatatcatttttagaaaagtcgttaatgcgagatcattagcagaagaggctaatacgaaaatggcaaattttattgagcaaatttctgagaattttttttttttatcggtgattaaattcatttaaatcggtcaatcaaaagaatatgaaagttctatatccccattttccgtaatattggcttgaaataaagccgttttataacgggatcacataacttgctccttgtcatattttcaccctaacaaaaatattttttaatataatttttcaattaactaaaatatttcctaaattaggtaatgtctaaaaatgtcaattaaaaaaatacaaaatttgattagcttggaaaaaaattatggcgttttaaactgttttaggctgagttggtggtaccgcatctccaccattggaacgcccaagtgaataaataaaaacaaacaaacatttgattttgttttaaggttttataaacaatttgtggccgtcagtaaatttttacatttgatcttcttcaccattttgttattaagtcgacttgaaactggtttaatgtctttgaaatgtgcctaattaattaattaattactgattgttggtctctttatttgtgaaaaatatggacagcaatttattcaaataataaagaaacatataggtactttcatctcttttatacaaattctcgcttttaattcccgtttgttaattggcggccacatttgactaatattgaatttgttgggtcgccttcgacaataaactaataattaattatcttatagccacgggcaaataattttaatcgcaaaaaaacaaaaaaaataaaaaattacaaaactgaaaaattaatagaaaacaaaaaataacttatttacttatttcaaannatattttttgggctactcaaaaaaaagtataataaaaaacaaaaatttttaattanaaagctttggcaccaatcggcagctatc

SEQ ID NO: 12231 - DNA, 3237 bp, Heterodera glycines
ccctcttcattgaccttaatcaaatttcaataggcaaattcatgctttaaaaggataattttgagttatttaagccaaatttaaaggcttttgggcttgttcaaattacagactttttactagacatgaaaattttaaaaaatacccccccccccccccttagcccgtcaaagtgccctaaactggtgaagcactgagggggcggggggtagtgtggaggtggggctgaacaaattttcttaaccaatcaaaattttttgccggcggcgcctctaaaaatcctcattttttcttaaaaattggcacaattttgcccagcggcgcctatcggcaccgccgtacgccttttccccaaaaaattttcttgaaaaagcgcaccgcaaatcttaaaatgggcaaaaatatatggaaatccaatccatgtaaatccgggccctaatcatgggcaatcaccgcacatcaatgaacgccttctgcaccactttgctgatcacaacggttccttgccggaaatgccctcaaagttggcactgtcggtggatgggtggcggtccggtgaaataggaaaacgaattcgatttcgtaaaaatttaagtttttggcgcaaaattttgggttttttccaatttcgtaaaatttcacatttttacaagtgctttttctatttttgccaacgaatgccgtcctgtggcttattatgtggcacaatcggtccccttttgattttgaaccaaagagacaatgtgacctactgtatttgctgatgcttttgcagtggtactgtggcctcaaatggcaacaatcgttccaattgccgatgccatcgttcaccctcagcgtttggcacatttgacggagaacaaattcaacaaaattgccgaatcaaaacccattcattcattttggaaacaattcaatattcagcaaaaccaatccgagaccaaacgagttatagaaattttttattgtaaaaccatacgatcgatcggatacagtacgagtttttgatgaaaaaatatttttaaaaattcagaaattttcattttttggaaatttgaaaattaaaaagaatttgatgatgagcagcgttttagcgcggcttaattcaataaaaaagtttctctgtgcttcttcgggctttacaattcttaccagttcagccgcacgcgtagaagcagtgaagtggggctgaattttgaatatctatcaaaaatctatgggatgaattgttgggcgtgtactgcacacaaatcgtctcactgcctctgctcttctctagcttctctgtatactgtagcaaaatgttcactcttttccttgtgtttagccttctaacttatcacttaactgtgacgtaaaagattgtacaggaaagagaagaagaagaatgttgggggatagatgaacaaaacataaggaaaagaagcgaaacgatagggcatacatagaaaatgacccccatttaccccatacaaaagttttgtcagcattttctaatcaaatgaccgttcggcacccttttcaccccaagagggccaatggcaatgaagaaaactgtaggctgttttatgcctgtgctccaagcttgctttgcttgcatgcgcggaattaagcacgactccgtcgatgagcctgctctaaggcggcgccacgccgagcattttgcgagacggagatggcttagatggctaagtaacaggccacgctgagccgaggttaatcctcgtaaatttttggcccggggaaggctctgtccttcccttaaatgtcctttggttgtccttcccttccaaccattgaggcacaaacgagcagcagcagatgagcacgattgtgtgcttaaaataaaagaaccaaattcggcaattgagcaagaaaaaagcccgaagaagcactttttgaattttcaaaataattcatccaccgttgaaagccgacattattaatgaatataattaaaaaatatatatattagtgaaaatcattttattggaagagagcggcattagtgggtggccactggccagccaatggcttcggccagcagtggccggtggtggtcatttgtgccaaatgcttggaggaacattagcacttttattgattcgtttggccactgacaaaagcaggcgcttcaaaatgaaaagacacgagcagagaaaacagaaaagaagcagagagaacaaacattcggtgaaatttgataatggggaggagaagcattcgaaagcatcaactttttgattttttatggttttttcactgtcacttttgtcacccctttggcattgaaaactcgagaatcaagtcgtaatgccatccatccgccagctgaaaatccaatctttaaagtaatgctttggctaatttattccgtcaaattgcaaattattgggcatggaatagctgatgaaagcggaccgacagcagttcgtgttttgatgcttcttcacttagcgaaagctcttcattaaaatttgccataaaatttttggctcgtaaaagccaactaaatttatttggtttaaattatttcctaaaatattatataatttaaatatagacaatctcggcttatcctcaatgaaaggcgactgatacggtacttctttaatttgatcatgttactgtttttgctaatcaaaaatttgtctgacattcccaaaatatgttcattcacaaatttatcggcaaaatggtgaatatgaaaattaaaataaaataaaaataaaattggttttcaataattgttcgcttttttgtcgtcttaaatgtcaatcatcatcagaagattgaaaagctaaaaagttttaaatcagcatcaaaagttagataaactttaattatttgaggtttttctgtgctcttaaatttgaggttcaaattttccttcttcaggcgcataccgtattatctctaattatcccccgtctccatttatcccatcgtatctaattatcccctccccccttttctgaagaggttgagaataatcccccgggggataattagagataacacagaattttttcccgcacatattgcttagtgcgcacacttttttggagataaacattttaacaattttggcatttttccggtgtactgtatttcatatttgattttacatatttatgtattatatttacgattttccttatgggaaaatcaaatcactcttcctcctcggcaaataaaaaaatattaaaaattggaatccaatgcaaaaatattaaa

SEQ ID NO: 12232 - DNA, 3786 bp, Heterodera glycines
  misc_feature (3760)..(3760): n is a, c, g, or t
tgcttcctccagtgattgctccaatcctgatttcggtctcgttcgtctcgctcgttcatagcgcactactgggttggctctttgtgctccctgtattggggtgttgtagtacgggaacagcgcccatttttgcatgaggtttttcagatattttttgagaaatatcatgacgatttttcccaacacgtagtcactttttatatagatttctgttttcaagcttttgttaattattattcggggttttattttctaataagaatttcattttttgccctttttcaagcgcaattttggaatgcgaccgattcattacagggacaatcattttgccctcattggcaatagcaactgtcggctcgacgtgcagatcatttgaattatccgatgaaatcagaagctcactagcttcatagttttcattgactcccatttccaaaatcttcgttgaccgtggctcgatggttgtaccgtaaattacagtaagaagatttttggaattcagtactgaattctcaaattcaaccatcgaatcatttgcctcgtcataaagcttaaagcccaattttccaagtccatttgtgccgatcagcatgtcaaaaccgatcgaagcttttgtcacatgcacagcgattttaacttctgatttgagaccacgactatgaattggcaaattcactttgaacaaacatggcaccattttgccgttgacatagagaacgcgcacgtttgtttgcgacggttcaagggagtcgaaatccaaatttttctcttttaccaattggtaaagaaaattggcacttatcagtgatatttgggcaccaccatcaagcattgagtccgtttccactccaaacgtcgaggttttcacgaccatcacttttccgatgggaggaactgcctcattttcacgaccaacaacaagtatttccaaaaaatcatcgacttctggcgcaatttcgattttgccaaggcaaagatccgttgtcacgctttcttgttgctcgacgatgcaattttgtcgaagaaaattcgaagaatttggtttcgttgaaccaaaatttctatttgaattttcaaaagttttgttcgaaacgtttacgggttgggtttgggccttattttgggcgtttgcctcaaattgtttgggccttggacagttccgcgaaatgtgcccgacttcattacaattgtagcacttccacagtttttgctcaaaacttggattgttttgtctgatcggtccattatttggttgaaatccgggctgccgatcacgaaaaattggttggaattcgtgctgccgttgatattcccgattaaaattagggttcttgaaactgagtttcattccgatcagtctttgacttttccgcagccacaaaacgttgcgttgcgcgctgtgtcgattccgcacgcgctgctagcgaaacaaaatggtccaaagacattcgaggcgttcgaatgagttccaaattaagtgacaaagttgggtcaccaattgatcggatcaaatatttgatggagaattcgtctgacaattggaaagaaagaccatggtaggctctcttcaccaaccccgaaattcgacctgccaaatcatcaatcgattcgttgggttttcgtcggacctctaacatcagctcatcaaaagcattcaagttttttgagtccgtttcctccaactgtcgcatcatttcaccccgaagcagttcatactttatcggaatgactgctttcgccgcttcaagagctctttcagctcggccatacgctttgctttctagtcccttaattcttttttcatccggccaactgtcggtgtaagcgtcgaatttttggctttggggtggcatcatttggttttcgtaaaccggaaaattttgctgctgtcgcgccactggacggtacaaaacactgttttgttgctgccatccacgctcttctcttggtggctgttgatgcatttgcctcggaatctccgttgggtgcatcatttgacgtccatcctcaaaaagatgtcgtccaacgaattcgttgtgttgccgttcgaatggcaaaaagccgaagtttgtgttttgttgttgccgcgctaacgcaggttgttggcgaatttgaatttggctggagcgaaaattttcgtgctcccggtaggggccaaaatcctcataaatttctcggtgccggatttggttgcttacaattggaaagttgtgcaattcgccattaaaatttattggcgtcgatgtacgcccaatgagttcgctttgcgaaacatgacgcgaatttggcgccgtttcccgaaccaaatttctgttaatttgctcgaaacgcctattttcggtgccactctcaacgaatctcatccttactccttcttcacgcaccaaaaagcttccaaaatttggtcgcaaaacttcacgcaaaccttcaacaaagtcctcgtgaccaacattttcattgcgaatttgctgctgctcggcgccattgttgccaccaccgtttgctcgcggcggtaaattcgattggatggacacatgcaaaaggcgccgccgaatttcatcgtcatttgctgctgctgctgccatttcactaaaatggtgttcgttttcctccgccgacaaactcaaatttcggttaagtcctggcgagatcggagcgttaaccaatggttcattttcagcatgaactccttcaacctgttgttgttgctgctgctcttcaaccgctgcgttttggttttgcgcaaaggttcgcaaattcaacgctctttgtcgtgtcaatggcggcgaacgaattatcatttttgcacctgtttcaggtttagcaaaaaccaaacaaaattttgctgtcggcagtttttcactttttcgtttgatggtgtggcgattaggacggtgaatagtacggcgaatgcgaaagttcggctcgaatttgttgcaatttgaaaacgttcgactcgaatcgttttgttgccctttgtcctggctcaggacttttcaactccactttcttcttttcttcaaattcaactccaacttcttttcctccaactttttttgaaattcgccctggctcagggtcaattcaattccgttgattttgttgtccagttcggacttcaaacaaaactacctaattccgatctcgcctttccccgtttacctgctgttcctcaggagcgccaaataggaaagaataccgttttccttcaattgaattggggggtggagactagagcccggaaatttcaaatttgcggatcccgctgcgggactggaactcaaaattttttgcgggacgggatcccgcgggattaatcccgcaaatcccgcaatcccgcaaatcccgcatttaaaatttgcgggatcccgtgcgggattgcgggattttggaaaattcgaaaaaatttcaattaaatttaaaaaatttccaaaaatcaaaaaatgctgaaaaataaatttttaggggctgtcgggatgcattaaaaggggctgatgggtcgactaaggtttttcgattggatccgacggtaaaaagttgatcggaaatcaaattattaacgttcataaatttgactatttttttttcttcaaaaccacttttttgcggtgcaagaaatcgggaatttttcaaaaaatatacaatataataaaaaaatttctaaatattttaataggctaaattttttaattcttaaccaagtaaaaggtatttcacaaatgtttttagtagagttcgaactgggacctggatccanggcctggatttttcctggatccaggt

SEQ ID NO: 12233 - DNA, 1064 bp, Heterodera glycines
cctgggcctggatttcctggacaaaaatccaggaaaatccaggtccaggaaaaacccaagctcctcgggacctggatcaaggcctagccctgaattttatgaaagttttcttaaaatgaaaataaaggttttgcatttcatgttggacctggacctggatttcctggacaaaaatccaggaaaatctaggctcctcgaggtctgggctaaatcatggccttgatttaaatgttttaaattttttttttgaaaaagaaaaaaaggtttatattcaattaattgctttggaacatctaaaaatatctaatttataataataatgtgttttcaaattaatttaatcattttttaatacttcaaataatacattggttaccagaaatagtaaattctaaaaattttgtccaggaattccaagtttttttttcgtgtttagcctaggcctgggcctgcatttcctgcataaaaatccaggaaaacctttttcatttatttaatcattttttgataactcaattacattgattaccagaaataataaattctcaaattttgtctaggaaaaacccagtttttttcgtgtttagcctggacctggattttttcatagacacaggtccaggaaaacccaggcctggatccaagtccaggtcggtctctagttgtcataatttttatttattttattattattaaggttgacatttggcaaatgcctaaaatttctgtgcagggtttagagctctgacccaaaattttttttctctgaactttgcaggttattagaagctaaggaaacaatggataccaactccttaaaatcccagctctacatactaattatcctttaataatgtgaattggcaatggacgaattgagccatttgacgaattgtctgtccttcaccgacgaattttccaatttattgaccgaaaacattgatgaattgtcctttactgatgaattgtccgttcattttttcgatagattatttgtgtcttgttgacgaattgtctgttctcaccgacgcattttccaatttattgaccgaaacaatgatgaa

SEQ ID NO: 12234 - DNA, 4540 bp, Heterodera glycines
ccaatctttgcgaccaaatggatcagccgcgccttctcgcaattgaggaaggctctaaatgggcaaacggcaaaactcatcaatatttcacacatatgtgacatatgcgaaaattgcttacggtaaattggctgacaaagaacggtgcgctcgtaactccttggcaggctcttccggcttcagaggttttggcgtctcaatttgtgctgttgtctgttgcgcaccagccatggactgttggaatttgaagctgggcttctatgccctcctttggtgacaccgacaaatgccaaattagcataacatgagcataatagataaaaaggtagggataattctcttttatatgaactgatgcgaacaaaatatctccactattaaacatcatcctctcttattgaccaaaaatgccaaaattatgtaaaaccaattaaattggctcctatcaaaaatgaattacctaattgcccaattattttgaggattttgaatgatttgaaaattattgtggaaaattttcgaacaaattttttcacgatggtttgtggtttctaaagatgaatgaatgaaaaacgaaaaaacatacttcataagaatttgtataaaacccaatttattcgagaatttatttatttaagacaaattatcttgtcataaatggattttttggtaatcacccaatttttcagaggcaatttttcaaaatttaccctaaaatttgttttttttcacccctcattttttgccattcccaaaaagctagtcaaaaaaaagattttcagtgccaatgttggcattgtgctttcccccccccccattggcacccttccaatatgatcctcctcttccttctgctgactggctgggttggtccggcattttttcaactaacccccctcttgccagccacatcatccgtaaatttttcccatttttctgattttgacaagctcataaattatgcgccaaaacagcgtggcacgcgccgtccccccggggcggtgccacaaaagtccaatgctaatacatacaacacacacagagcttattattactatgagatgagatgagatgagatgaacggcctgctggtgagaagaaaagtatcgcatcgccaatgatttttcaagccgataatttgcgccattttttcccgcattgttcccacgcttttcctccctcattatgctttggcaacatttcagtgtgccgctgtcaccccaccccctccctcctcgcctatcccttaaaagattggcacatttttatgaatgtgccatgagaacggcacaatgtgagaaggggattgaaacatttttaagggggtaatttaattaggaagtagtccctttcttatcccattttttaaaaatgaaaactcaaaacttgagtttatctgcttatacccaccaaacagggataagtcgccgccccctcctccgccccgaaaaaaatgtcgatttacgcgacgcccaaaaatttcgggcggaaccttaaaaattttcggaaaaaaaaccggtttaaagtaacctcgcccctcacggaaaccaatgttttaatatgctcgagagtctcggtcttgaaaatcagggaattttgaaaactttttgactcggaatttgcaactaattaaggctgataagcattttttgtgaaaatttgctttttttttttttgccatttctccaggcgctatttctgtgtttcataattctccaatttttgtatatcacaatacttaatatattttttttcttgtgcagctctaatttgcgatttcacatcttgctgctgattgaagcgcctcaatgttacgctggtaaaaaaaagagagcaccccttcccctgagaaatttttaaaaatgttcaaacttagaaatttttgaaattaaaaatattttttcaatattttttagtgggataatttttttttttttgtaattttctaataaaaagtttttaagttttcagttaaacattttcaaaattaaaaaactaaaaataaattttccaaattttaaataccgtatttgctcgattataacccccgcccccctcgaatacaaccccaccctcgaatacaaccccctttttgaaggggttgaacaatagagagcccctggggctctaatcggttttcatgtgctcattttggcgtacagaattttcattgaaaaataggtaccaaaatattttatgactcctttcaagggggcagaaaaacgaactctcggatttaaattcagaaaatttggtgttgccaaaaaattgcagcccttaattgatgatgatgagtttaatgatcattaaatcctaaaataccgcaaaaattcttttacaaatcaaattaaaaatgtttttttattgctttaatttgtgattcaaaaatcgaatcgaatttgatcaccaccgaatgatctgtctgatcagtggcataaaatgcggtgaactgatcaaacacactttgagaatgaatgaatgaaaaaatgaaatgtggtggcgttttggtgacgaaggacagaaaaaaaaattatttatataagaaattgatcagtgtcaaccctctgaaaatcaatgctctttcattaagcccctgcttaaaactgaactgatcacatgcacaagtaaatttttgggtcaatttttagaattttaaaaatttttctttttaaatttttcttattagcgatttaattagaaggcttgaatttatctaatttagtgggcagtttgatttgaacaaaaaattttattttaaattcgcatttttacattttacaaaaaaaaatgataatgaaaatatattatttcttagaaattcaaaaaatttttttttgcatttccaatttaaaattttcttattagcgatttatttagaatgtcttaatttatttaaattattaaaaatatattttaaatatttctttttatttttgttggacagctttatttgaacagaaattttttatttttttaaaattcacatttcagccatgttaatccaagaattttcttggcaaatcttttacagaaaacactttggatttggcaaatcccaaaagttttttatttaaatttttttttaatttaatattttagcaatggcattttcactctcatttaaggtcatcggtgcaccggcgcagttcctattgggagccggaccaacgagtgcagcaacggtatgccggcagtggcacaacgccaacaacggcaccactggtgaacgcggcaacaaaatcggtggatgacagcggcggaaatggtgaaacaattttttgatttttgatcttttatcagggctaaagccactcataataatatctggcctagtttttgcattgtctctctgatcactcacgaatgcctttgatcagatttaatcattatatctcgacattcgaccaaatttttgccaatcggcaaatcttttaatcatatctgatcactagggagtaaaattatatggaaatccatatttttttcctggactgtgggggcctgaaaggcacgaaaaacatgtttttagcttggtttgaagcttctaggatggatttctatatccatatttttccatatttcgcgatttatgtccatatttccatatttgtccatattatggcatttttatccatattttatgtccatattttggcatttttccaaaaaacctctattaaaactgcccccaacagataaattggctttttgaccccgaaaaaccggaaaatttttcaaaaaccagtttttagcaaaatttttttgaaaaattgaatgaattgaaattttattaaaaattgttaaatttatatcaaaaataagcaaaaaaaatggaaactttcggttttttggttgatgttctcttaaaatgttttttttcttctaaaacgagttcttatacaatattcagcgattttagatgtattttacttgaatttaatgaatttaaagaatttaaaaatttccacactcaaattggaaaaatttatgtccatattttgccattttatgtccatattttcgatttttggtccatattttatggccatatttcgtgattttatgtccatataattttattccctactgatcacaaatgctataccgattgttagtaagggtttgaatttttataggaagatgattgtgaaaaaaatattttattttgaaaaaaataatttgccattattcataaatcccttttttctatatttaaaataaatccgaaaatttctcattttttgtcaaaatattgaaaaaatggcgccggaaattgccgttcctatttaaccaatgcgttttttcgtaacaatttccattttctaatgcaaatttttctcatttcccaaaacattttccgctcatttggcccttttccatttgtcaaggccacaaaaggacggacccatgtaccccaaaagtaattaggccagaaaaatttactcgtgatttgttcaaggaggacgaaaatttcccgaggttcgataccgaaaagtccggagacttttctcgagtcgttgcttggctccgagactctcga

SEQ ID NO: 12235 - DNA, 2515 bp, Heterodera glycines
  misc_feature (36)..(36): n is a, c, g, or t
caaaagctaataatgatgatgaagggtcggtcatcncatcaaaagatatgagacggacattgtttttgagtagttggaatgagttgtatataatgcatggtggatggagtatgacgagaggaatatgttacgggtaggaagaataatattttggtatggtgggtataaatgtaaatagaaagcataggaatatgctacagttcaaaagtgctacttagctaaaaaaaattacggtagtaaggttaaacacattgtacaaatcttatcagttgagaaagcatggcatatttaataagtgattttgcggtaagaccattccatggccataaatttgaggacacacgacaaaattaaacaaacggaaagaattaatcacggtcattattaacatttcatatatgattatcatcaaaatttgtgtgctaccgcaaaaattctttcttttggatgataagactgacagacagcgaaagattattttgtgagggcaactcaaaatggcaataggtatttctacaccacattatattttttgtacaaaaatttttaaaattttaagggtgggattaaataagatccaaaataaaaatatttaaataaattttaaaaaatgaaaatttttaggatttaaacaaaaagttaacgagcagagaatgtatttcattagaaaactatttattgtttaatctaaataattaataataattttcaatttagcttcttaaaaattaagggaataatggtctaagaaagtaaaaaaaaaagtcaataagtaaagaatattattaataaagtattcttttatatatttaataagaaaatacattttggaatttaagttaaaagcagattttaaaaaagtgtattcaaaagaacggaaacgcagcgcggtaacgagtcgcgcacaaatgccctatttccgctagaaacagcacagcacgccaatcagtcagatcggacggacacgacgacgaatgtgtcgtgtggcacaaattatctgcttttttgatcagcaaacggatcaacaactataaacaaaaaaacagcaccatcggtggacacagtgtgcgcgacttccctaccccgggggctctcttcttttactaattacccaattagtgagttaatgagtgacacccaacaacatacataacagatcaaaaaggaggaaagagcatgatgagtgagtaaaaaatgagactaattgtaagtaaaacgtcgtcgcctatgaatgaatgggcaggaaggaattgctttacgctttttctcccaattacggacccccccccccccccgctccatccccgccgggggttgtcgtcgtcactcactgccccgattttttttgggccgtcaactcttatcggctgctacgatctgtgcggcaccgtcgtcggctgtcgcctctgatcggctggcagaaaagttccgaccccgcgggggcggcgggggactctttcgctattttttgcgtgtgtatgttttatcagaaaatgaatgaatgggtaattaatgtaatgggatggacggatgggttgtccgtccagcagcactggtggcttttttctgggaaactttatgcaaaatattattattgttatatcgcaaaaacaaaataaaaaatctacggtattcaaaaaagtaaaaaaaaaaataaatgaaaattattatttgttttttaatattcaattcaattgactaactgcatatattaattacaagagctcccttttaaaaataaagaaggttttacttaattaaaaaaagatatagctatttaattgaataaaagatctttaaaaaacgacaattagttaaatttagggcagacgcaaaaaaaagaaaagccgcgcttttccccaaaagaaataaagaaaggattgattttgttttgggcaaacacatttattaatttgttgacatgcatttggatcaaatttgtgtccaaattgttgtccaactccttcccaaaaggtgtctctccccgctgtgtatggcgtataaaataaaacaaattcctttcccggcggcgttttggccggccaataaattattagtataaattattattaattgttattattcattcatcaaattttgtgtcaccatttacacaaatgtttccatctgcgccaaagtgtgtgagcaagcacagtttcgctatgttttgagcaataaatttttcggggcttttggggggagggggcaaacggcggacggcggacacaaatcgccggcggcgcaatgaaatgaatggatggccccggtcggccatttcatcccatcccttcgtttcttcactttgcttcctccctcttcgtcgtcttccttttcacccccaaaatatgtgtctctccaaaggttgatcggtcggttgtccaccattttctgtcctccccttcccccagcagaaggacggacaaactcaatgactgtccgtaagttattggcgcgaaaaaaaaacttttttgaaggtgagaaaacgccatttcgtggagggggggggggggggggg

SEQ ID NO: 12236 - DNA, 2764 bp, Heterodera glycines
  misc_feature (2753)..(2753): n is a, c, g, or t
acgaatgttttgggggcctaaaagagaagaattggggagaaatacggagaacacccaccccacaacaacccccgaagggtggtgggcgaaatttgggggaggggggagaaatgcattcatttggaagagtggcgcgagtggtggtggcaccaaaaaagacggcgcgttcggatggtcaacagtcatcagtgagccaaaacatctttttttgattggttaatgagcagtaatcggcaaaaaaccattcaaaaaatcatttgttcatctctaaatgatgtgctgccgattgggtgcactctcggaaaagagcatcagtttatgagcagcagaaggacaattttgttgggtcttttgtgtcatgcgaacgaaattcagcagtttaagggcaataaaattggaaacctttaataaaatttaatgaccctgttcaaatttgcgcgtggcctgggtcaattcggcgcgaatttttccgtgtcggcctcagagaatgcttcttaccaaaatttttcaaaaaaatacaagcctataaaggaaaaattcttattcaaccgggaaaaagcttagcattttcgtagagattagaatgtttactaagaaatgaatgttgtcccatcccatcagggaaatgagattttttgcatcagtattttcatccagataatataattaagtaaatgatagtaaaaaaaaattcacgcaaaaaagccgatttcttgctcttaaaagggatacataaggattaaccaaggaatgaatgttaaacttttcattagtccatctccgccgggggggggggcgtacttttgggcgtcagttttattaaccaagcaataaacatgatgaaaatgatggtgataatgatgaatgtgttatgcgtttgaaccaatcacagctggatggatggatggtcgctgcgcgggaacaaaccgaagaatgtgcggagagatcagagacgaatcgccgagggtggcgccaatccaaccaaatttgccgattttgccaccattcttgaccccacccatgtcattagccagtaaagacagatagcagcagcacttcaacgtcaagctgtgcacacatttagaaaatgggggagggagagagagagagagaaactgggagtgattgaatgattgttgattggaatgttaacacaatcaaataattggatttgaatatttaaatttgaaaagagaactgacaagagggtggtgaaaagtacagacagcaaaattttgaaactcaaaaatgctaataaatgaataaaggcaggggtggcatatattttttggaaataaattgcattaaaattctcaaaattttctcggcgacgcctaacggcaccgccggaccccctattttaccatatttttgaaaaatgaagaccaaaatggcaaaaatagatagtaattttctgatgaaaaacggctaaaaattttgtaaaacacacccctaaaaatcaaatgaaaataaaccccgaaaatcgaatttttgacatcagccccccaaagccaagggtctggttacgcccttgatctatgtacattgacaattaaaaattgtcttaaaaaacaaaaaattcgataaatcatttttcagaattagaattaattcccctctgatcagagcattgcaccactcgcaaatggcggaatgcccactccatctgcacaatttgcttacagtactcacttcacgtgtcattcaaattcgcgctttgggcatccaattttcgcgtggaaacgccgcaacttgatcgcctaacgcacaatgaatgagtgaatgaattgcatatggatgaaagggtgtgaatgaatgaatgaatgatcatcatcactacctctcttaaattacacaaattgcttggcgtcgtgtctcaaatttgtgccgcctttgccacccgcgccaattcaaaattggcgtggggtgggagacaatgagaaaaagaacaaatctgtgtccttgcgaatgcgaatttgaaagcgacggaggaattacatgggctgtgaataatcggggaaccgaactcatctttttagggagattttctggaagaattttactgaattggaattttccactgcccatttgttgtgccattaaatcaaggataaaaaaagaagaaaaggatttgcgcgtttaaagaatattaataattaaaaaaccaagacgtttatttcaatgtccatgtaaatttatttataatttaaaccgaaaaatttaattttgcacaaataaagttcaagttacaaaaattatcaaaagattacagtaggggctagaaaaagaaaatatgagatcagaaactgtacttttttaaaaataatattaacatctgtgttttttaagaaaaaaatttatcaattaaaatcagtgaagcacaaaaagaaagaatttcccggattatagcgctttaggtcttcaaatcgcatggaaagtcattctgacagaattatgctgtttatgtgattctaatcttagacttttttccatagattaaaatatttttcccagtaattattttcagaaacaaataattaatttctttgttgccaaaataaacaactattaaatttcgaaattactgatttttgtatattatgattacttggtaaagaaaataaccaattttaaaaaaggtggggtgaaaaaacagtaaaaagcatctttagttataaagagggctttattaaaaaaattggacaactcttttcgtgaaatacggtaattgcattaaaaaacttttcaagcanaattggtttat

SEQ ID NO: 12237 - DNA, 2784 bp, Heterodera glycines
  misc_feature (93)..(93): n is a, c, g, or t
  misc_feature (112)..(112): n is a, c, g, or t
  misc_feature (186)..(186): n is a, c, g, or t
  misc_feature (189)..(189): n is a, c, g, or t
  misc_feature (192)..(192): n is a, c, g, or t
ttttttcattttttaaatttatctcctttttttattcattttttattcatttatataaaaccacccttctcaatttccaatttaataattttnaatttcatttccatcttcncacacttttcaccaaattcctttttaatttttttaaattaatatattaatatacccctaattcctcacttttcnctnctnctcaacaaaaacttttccatcagattgtccatcgttgtccaaactaattgattcacaattaacttctgaaaatcatacaaaatttaattcgtaaacttaaattaatatttattttcacacctaccaaaactcaatttactttctacggtttctttctctttttctcattacctccatctgttggtgtgaaatcgccatttgttgaattggtcgaaattgacatttttaaaggtattgaaaattcaaatccttaaatcattttcagatgttttttaatatataattattatttcgttaaaatttcaaagaataaagaaatgagcatttatttttctgctgattttttaaatattttttagggtcaattaagaataaattgaggcaaaatgatgacccataggaattattcatatttaaatttgccattaaaaattgtgacctaataattgaatggatgaatgaaaagaataaataaaaatgaaaaatataaaccaagtaaaggacaatcagagaaaatctcctctgattgtcctttgtttccttttttgccttcgactcgttttgctttgcaacaaaaatgattaattttgtgaaaatgtgtctataaaaaaattactgaactcaccccttgagtcgaggtcggcgaaagttatacattccgaagaattgtatttttataagggaaaaaattatttttcaaatttggattttttttttattaattttggccaataatttttgaaaaaatttatttattttttgccaaatatttaaaaattgatgaattttattgtaaaatttataacaaaggtcattaaaaatttttaatcaatcgtttaattgttatttagaggaatgcaaaagttaagtgaaaataaattttgtgttggaatggtatggatcacttttcaaattaacccggcgattagcatttcggccaaacaggcattaatttggctacccgacatatgaggacctgacatttaaggacccgacttattattttgttaaaatggtatcgaataatgaaatgagcattcattcttctgctgatttgcctaattatttttagagtcaattaagaataaattgcggcaaaatgatgacccatagagaatattcataatttgaatttcccaatttatttcagcaaaattgtgacctaataatgaatagataaatgaacaaaaaataataatctcatgattgtttttggccggttccttttttgccgtcgactcgttttctttgcgaattaaaagtgattaattttgccgaaaatgtatctacaaattggggtagggtagaccccaacaacactccgagtcgtggtcggggtaaaaaaaaacatacacaccaaagaacagcaggaaaaatttttgtacaaattttggatttttttttccaaaattgtcaatttttagttcaaagcgcaccccccccccccaaaaaaaacagcgtgaaaaggaaaaaaagagaaaagagatggaaattaaaattaatatttttgtggtatcattcaatagctaattgttttccaaaaaaatttatttaagttaaaaaaaaagttataaagcattgaacattctatgttttttgcattgttcatgcattataaacatatttttctttaaaaatcgagggaaaaaaatatgagtaaatgagtgtcaatgataagcaaaaagctcatcaggatttatatattttttagggaggggacggcataacggaaaagtatcgaattggaattgttagtttgattaaagaatacaaagtcgaaaatctcttttgcttgcaaaaggccttatttgagaaagtctaatttaaaaatattcatattgtaaaaatacataaaaatgaccaatgagcagtaaataaatagcaaattcttttggtcaaattttattgtattgacgaaaaattcgttcacaaaaaagagatagtcaattttgcttttgtatttcctttttctctcaaaaattgtttagtgaaaatggtcctcctcctcctccgttggcattttcgccttcgttgcgaccaaaagtgccaacatttgcggatgggccaaagccggcttgccgtttgccataaaatccgtagggatagccgtagccgtaaccaccccagcccttaaaaagaaattaattttaaaaaattaaattttaattagggacgaggaaaagtgaatgtcaaaagttaaatccgacaatttttaagatttaaattcatccgcgaaaattttaataatatttcgtacataataagcttgggtctgctcaatggccatgccaatacaaaggacgagcagaaacagtgaaagcctaaagggatttttaataattgggtaattaatgacggatatttacaatttaattgctgataaagccattttttgaatggattatttgaattttcgggaaggaatttgttgttgaaaatgttttgaatgtgccacaacaacagttccatgcccttaaatacttccaattttggcgcaacaaaaacaatttttttctgccaatttctttctcaagtgccatacaataaaataacaataaaaaaattattccaaaaataatcgaataaataaat

SEQ ID NO: 12238 - DNA, 915 bp, Heterodera glycines
  misc_feature (13)..(13): n is a, c, g, or t
aaattgttttttnttcttagtgaattaattggataaatctaattgtttaattttatttgacataattttttaagagttatttctattaatttccagcagaaaatcgcatttttccactccatgaattaataaattgccttctcgaatttttgagatttttgtcatgggttttttcctttgtttatttctttatttttaattttataattattattacaaattcttaattcgctttgcaaaacaatacaaaaaattttttgtttccaaatctattagcaaaataaagctttctattatttaaattaaaacaatttctagttttatgtattaaatagcgattaattacgatttaaaataatttgcatggcccatttagtctgatttccattttccgcccttcccaatttgttcgttagtttttgaatttaattcgaagctcttagtttgaaggagtctatagttcttgttagtagggccgcaacttttagtgacgaaaaatcccaaaatagttaactaaaatagtgagtaaaaatgccaaaatagtgaagaaatagtgacaaaaagtccgaaatagtgacgaatagtgacataattttcagccaaaaaataagccaaaataatttttattcactgattgcagttgcaaatgagtaggactgggatttttaagaccaaaaaacccaaattagttacctaaaaaaatttttaaaattaaaaatttttgccaagaaagtaaatttttgagaaaattttttttcatttcataggagtatattttgaaaaattgtagcttgattcttaagggtgtattttttgaaaattttttaggttgattcttaggggtgtatttttttgaaatttttttaggtcgattcttaggagtgtattttttggttttattgcattttgttaagg

SEQ ID NO: 12239 - DNA, 2382 bp, Heterodera glycines
tccgccattcgttctgttccgctcgcgttcgttcggtccttctaaggacatggcaaagtgccaaggtcgggaaaatgttcactctgttaatacgtttataatgttattctaaattaaaaagattctcccacctccaactgtcggattttgttcaatgcttgttttaattcctgttgtgaattgtccaattgctgctggtacacgctggcaaccgaaacatcgctagcggcgccatgcgtcgtatcggtggcgcccattgtgctggccccggaggaggaccccacgcgagagaggggcgaggcggaaacgctgccgggagatgcattcattgtcagtgctgacgcagccgcctgctgctgttgattttgcatattctaaaaggcgcgaaattctgataatttaaataggaaaacaatacgaataaaaaaagcagcagcatttagtagttcaatcaaatttgaccgtaaaataaccaaccctaactatgattttcagcaaccttttttgaatttagcgacagaaaagcaaccctaaacacaaattcacattcaaagtgatcaccgcaaaaagcgccttcttggagaactcgcgggttctgttgtgttcttcggccaattgttgtcgcagttggtccaactgttgttcgtattcactatattaaatgttgttttattaaataatactttttaaaaacgcactccttctgtctcttcaagtcgttctctaagccggtgcatcgctgccgaagcaattccatctccacggaaatgccgcctttccccgtcgtttctgccaactgagtctttgccatttccacccgaagctgaacaaataaatgctatttgagacgacatttttgagaattctcccactttcattgtgccaatttcactgtcgcgctctttgagcgctttctgcaaattgagcaattcctcgtcctttttggccaattgccagcggattccatccgcctcaacagcttcctttttacgtccatacgcgcgttcgtttagaggaacgaagggatttccattgattgtcaggggggaaccgttccgcgttggatcgccgtctttggcgcttggcggaagttccatcgacgaattctccagcgcgacactgagctcgtcaagcaccgttctgacaagttcaaggcccctctcacgttcatcactttaaaattgcaattgacagccgataataatttagtacgaaataaaggcaaaaattaaacgaataacggaaaaagacaattgaaaaatggaaagaacttacaaaatatggaaggcgacctgttgctgattgtcaagacgtcctgcgaatttttccacttcacctcgcagaaattcgagcagttgctgcgcgggaaggccttccgagtcgacggcgctcagttgggagacggccattgcgcagcattcgttcagacagcacatgcatttttcaagtgcagcaatcgcggaaagaatacgatcagaaagctaaaaagaaaaaagtggaagattggggaactctttggtaggaaaagaaatcaatggatgtatggggaaggcaattgcaccaatccgatgaaaccatcccgtcccgtccaatgtacctctggaccaaggatgaggtcattctctgcagggatccgattcagtgcccgaatggtcagtccctcgcattcggtgagtgtcgccgaaagtcggtcagtgaaggcgagaaactccacttcgacagctggcaaagatcaaaaaaatattttcaaaaaattccatttaccttccaccgaagtgggcaggttgctgtgtccgctgctgttcatattctttgccatcagagacgaatgaattgtcgaggcaaccaattccgacgaagtacccgaactcgtcgaatcggaagtctgccaatgtcagaatttacaaaagcaaaattgggaaaaaatttatcagtgcatttgcctgtggtgtaacgagaaagtttcgaagtcgttgagtgttgaattgggcccagccgagtccctccttcacttggaccaatatgttccgcaggtcatctcgcgcattgtacgactcagtgctcaaattggcggagaaaagacgctaaagacaaaggaatctgttttcatctgtgcatatccaatgggacacctgaaagtatttgacaatgcgttccaattcggccaccgatgtgttctcatcaaaccgattttgacgcaaaaggccaaaatattggtccaacgacttctcctggagggcaatgtccaattgaatagtggccaaacgagacaacgctttatccgcatttggttgcttcagaacgctaaaaaaattaaacattcggaaatatttagacgcaattcgaaaaaagaaaatatatggtagaaaaaagtttttgtct

SEQ ID NO: 12240 - DNA, 1723 bp, Heterodera glycines
  misc_feature (40)..(40): n is a, c, g, or t
tagaaaagttttgtctgttaagggtgaattattcttcgtntcttccttacgaaatgtcttctgcaaaatgttgtgaacacgtgcaattggtagccgaatcggcgcacatgggcccattgttcagctttgtgcgagagagtgacgtgctcacggcgtagtccaccgggcaccggcggatactttcgctggagaagacgcgccaaagacaacgctttggcggacattcgggggaacaaaacacaaagcaaaaggcagtcgttgtcccctgaaggaaaggccaaaaatgagagaaatgagaaaagaaacaatttgtgcggtgtgtttggagggaatgaaggagccaatcgtatgaatccaattgacccctttggcattcggtccttggcaattccttgggtttctttttccttgactcccggacataacaaatgaatgcgttggatttgttatgcttcagcgcaaggcaattaaaacacttaaattcaaaaaacaaaaagttaccgccgggttttgtgaaattgtcgggcaaaaaactgcgcaggtaaacgctttgctgtttgaacgactccaaatcaatggaacactgctccatctcgacaacctaacaaccaatgtatcaactatcggtttaaaaatgacttatttacctccgaaaatgttctgttaacattggccagcagtgacatttccgcgcccgcattccgcgacttttcctcgtcccgcgcgtgcatcgtggccaattcgtcgtgcaaattttgcacccgttcgttgagttcggcagttttttgtcgaaatttgacgattacccgttcatagtcaaccgcacggtcttcccagtcggaaatttgatgtttcaactgaaaaataagggaaacagatttttttcaaatgaaggaatatattttttaatttccctataaataaaattgtttcttaaaaaatcacattggaaatggcgatcatctgttcgtccagctgctgtttcagcgccttttccgtatcttcttttccctcaatgattgcttcgttcaactgatgcatttcctccaaatcggaaatgtccaatttatatagcctaaagaaagaaaaaaataattattataacagaaaagacggtgaaacatattttatctgttcttcaaggtccaaagttttgctggttaaccggtcgatcatttctgccgcactcatttgattgtcgagcttaaccaatgactatgtaggttattgggcttcaaatgatcagatggagtgaggggcgggggggggggggaagctctgccacacctcccaaaaaataaatttacattctgaggaaaaaattttttaattgtaaggctacccgcaccgtcggacgactttaatccgtttaaatactaattgtaaatggacattttttcaataaatctgcttaaaaaaatttctccgtggcactaacatttttaaacacattatttggtaaagatttttgaggcctaagagcagaagaacttttcttttcgtccgttggtgcaccatcccccaaaattattttctgaataggggcccgtgcacaagtgccttctgattataatttaaaaactaaagaccactgacctcctcctgtttgcgggtcaattgctcgtttagctcgtcaattttttcgcggaatttgaccaaagcgaattccaacttctcccacattcggtccttctcctccaactggtactccaacttaaattat

SEQ ID NO: 12241 - DNA, 1653 bp, Heterodera glycines
accatttcctcattaatcacacgcattccctaaaatttgattgttaatctcaaccgatgtggtcgttttacgaaatggtaaccgcaatttaacgcaattccaaaagaactttgctgactttctttttgaatcgttcttcacaatccctccatttccttactcccaattgtgtgatttgttccaaggcttgttgcagctgttgctgacaatgagcagtgtccaattgctttttgtccgttgacccaatgccctcatcttttgaggctgtggccgtctgctgatttgacatttctaccagaaaacaaaaacacaatcagatccagaaataacaaacagaattaacggttcggaagttccgagaaattgcaataataacaaatgacatatttagtcattcgcgccatcgtatttatttacgataatcgctgataaaggatttaaacaataaattggtgacagaaatatatttaggtatgacgtcattcactggttgttctccgcgaagcccataaggtcgagcagtgccgctttcagatttccttcgtgctgtatcagcttcttctcggcgattattctggacacttccaagtcgtcaacctaaaaaaatgcttaatgaagagagtctaaaaatgatcttaaaaatttacaagacacaaaataaggcgctatattaaaagtgaccagttttgaaaattttttcaaaaggggggaccctttgttttgcaaaatttttttgtgataaaaaaccatgataatttgttatccggggttttaaaggtcgctaatcacgaatctgacatgtattttgactaatttctaatccctaacccgaactcgaataaaaatcgaaattttgaatttttcaaattatgattttttgttcaaatttagattaggaaatcggaattgatcaaaataattgaaagaatcgtgatcggggaccccaaaaacctaagatgaataaatttttatgactatcacaaaaaattttgcaaaacaaaagggtcccccctttgaaaaaattttcaaaatcggtaacttttacagtagcgccaattaaacctttcatcgccaagaaaattgacaaaaatttttgggatggtaaagccggccaagtgaagagcatcggacggaagaatgaggaggagggaaaagaagacggagaggagaagaaagaagagaaagtcactggggaatatgcccaattccatcggaaaatgaattgatatattaggtaccttttatttgcatgatcaaactaactacctaattacatctcaattagcattaatcagtaagtgaaaagcatcgagcaattggcatttagcaatcgaataaaaagacgaaatgccaaatattagaattactattcaaaaattagaacaactccttttgcctacaaaaatcatttttaaaatatttaaaaatttaaaaaagtaattaataattattataagtgtaaaatatcaaatattagtataagttagcaaaaataatagatttaaataatttaaatgtttaaattaattttggtagtttattcattttccacttttattacatgatatttatcgtttacattcaaattcacaaataaacaattaatgtttttgttggctctgttaactttttctgctgctgttcttcccccta

SEQ ID NO: 12242 - DNA, 2251 bp, Heterodera glycines
  misc_feature (23)..(23): n is a, c, g, or t
  misc_feature (32)..(32): n is a, c, g, or t
  misc_feature (2234)..(2234): n is a, c, g, or t
gtatttcatagttcccaaaaatnttgatatanttttttcctccgagaaaattgtttaatgaagtcgagatttagtcaagttaatgatgtttagtttccgactttgaaatactgtcctgactatatttatttttagaatatccctgaaaacagaaaacaatgattttaattttaaatgaactttaatttattttcaaaatttagttaattatatatttatttaaaaaaacaaatatttttggtttattaaaatgaacgaagaaaagcgacgacagcttattgaaagagttcaacatgttctgcctactaaacaattaactgaattcaacatggaccgatggcttgaaagctatggggaggttataaatttgaaattttttgattatttaattaattaactattttctggtataattgtaaaaacaattcggaaaaattataaaaagtatataaaaaagaaatttgaattttttattttaaaaaatgaagaaaatttattatattatttgtataaattcaaaagatttttaataattttattatttcaggacattgatttgtgtgaaaagatggtccattattatgtgaaaaatcgcaaagtgttaggcttcgacggtaaaaaaaaatatagcaattattaaaaaaaaaaaaaattaaccaaacaaaatttaagagccaaattttgtcaacggattttattcaaaagcaaatatacaaaagttctgcgacatttttccacaatcaaagcaagtattaattgaatcactcaaaaaataatattttaattaatttatattaatttaaaaataattaaaatccattaatttaaaacatttaggcttcaaaaaggttgggtcaacagctatgataatggcattgtgttcgtggaggccggcattgctgaaccatcaaaagtgttttagaaatattgcttaaaacatttttaattgttatttcaaaaaatggaatattaatatggttgagattttttatcttttttcttgagcattttcggtagaagcattttcttcatccaatttgaacttagaaatttaaaagtatgctaaaaatacatattttgggatttgggacataaatcctatttttggactttttcataagttttactaatttcccaatatttcaaaaaaccgtcgcttcataaaaataattagctcgcaaatttaaaaattttagagattaaaatttatttcttattttttacaggctgcaaaattgatgagaccaggcgaatatttgagcgcattctttggctttcttgaattgatgttacaacatgtgttggaacaagaaaaattgacaaatcggcgatcatgggccgtctgtatattcgacatgcaaaatgtgtcaattttacagtgggttaacccgttggggccaatgactcgatgttttgaggtcagaaatataatttttaatttatttattcattagcaaccattaatacttgcctgacccagacctggcttttttagacctgatttttaaggattttttgcctagatacaggttttggaaacccttgttttcttgatatatttgagaatgggtatttcaggtaacaaaatgtttttttcatgttacttcgacctaggccagcctagtttatattctagcctaattttcaaggtttttttgcttaaaatccaagtccatgttttaacaaatttttattttttagtaaaagtttgagaatttgttattttggtgacaaatattttatttcaaattatcgtaagaagattaactagattaaatattattatcattctaaaatgatttggtgaaggtttttgtgagcataaaaggcagactattaaagaatattttgagtatcaaaataataacaaagttatttgatttagttgctaactaaatataatattattatttaattgttaaatattattgcttgtttcaattaaaataactgttatttaattaatgaaattaaaggcacgcgttgcgcttgccatggcctattatgctgaaatgctctctaaagttgttattgtaaatccacctcatcttcttaatgtgttgtttaaggtaaatttgaaacaaaaaataaataataaaattttttcaattaattaagattatgtcatttctgttgccaaaaagtatttcaaaccgattccatgtggcgacaaattttgcggaaattcaaaatggatttccccagacgctgtcccggttggatatggtggacanaaataattaaagactct

SEQ ID NO: 12243 - DNA, 2984 bp, Heterodera glycines
  misc_feature (10)..(11): n is a, c, g, or t
  misc_feature (31)..(31): n is a, c, g, or t
ttataaatannttttttgattaaaatttatnagaaagctcggcataattgtgggagcatcattcaatttcggtagtaccacatgaacatcacacattgaaagcaggcgaaatttttgctcgaaaatttgaagccaaaaagggccaaaagttggtgtacgaatatttggcaaaccgtaattttgtgatcagattgcaaaagggtaattaataatttaattaattatcatttaaatattatatattattttttcggttttatcttatactagtaagaccaaaaaattcgcccaaaagaataaaagttttttttcttaaatttttctaaattctactaattatttttcaaaatttttaattttcatatgttgaattatttttgctgttataataaaaagcatatcactttttattaaacaattactttatactaaatatatttttatttaatgaatattgtgacatttttgcgtgcttttaaatattttctgaattaaaaaattttttaagccaaacaaatttgttgcaaataattttattattttttaataattagatcaataaatctttttatttagaaaatggcgattttttattaccattttatcctaaaatgtgtacacctatcttgcccgaagaaggcgctgtccaaattgatgaacattcactgatcaaatttgagctgaaaaatttgagcacgattttctcgctgaagcttcgcattgccattaagctaattgattaaactgttgtataatttaattacctaaattggataatttaacaacaaattaaaaattccgtattttcaagaaatcaatgcgattaacaaaaccatcattttaagtagagtagagcgggaccgggaccaaaacacggacaactgagtaccgaggtcccggttttgaccgggaccagtcccgggttttttcccggttttcccagccaaaaattcccggtttttcaacccgaaaaggtcccggtcccggttaagctcaaaattcccggtcccgctctactctaattttaagttcattttattctctaaaattaggcaaaattttgcaactaaaattaagccgcaactgaggaggtcaacatcacaaaataccaaaccaattaatgaatataaaataaacgcaaataaaactgattttgatatatgtttaataaataaaaaggtaaaaaaattaaaatatttttagtggataaaaaaaacttaaaattttttcacaagctactaaaaaaactttaacatacagcggaaagtgatcggttctaattttatataatcacaaaatgtatcaactcgactcgacattttttattcatcaatttctttttattttttccacatttatttttgtatttgcgaaatgaaaaaaatggaaccgtcatttgttcacaaattttgcgatcgctgagctcagtttgtttcttcacttgaaaatattgctatgttttccattttttcactaatctttttcgctctgtaattagaaattaatttaaactaatttaaaaattgaccattaaattattttgtttgatgtttaatttcttggctcatctttcaatcgtaccaaactttttttcagatcttttgtatgatcagggcaaaaaaaaatccaaatttaaattaataagtcgaagggcaggctgaatcaacatggtgagaattgtttaaaaatgcataggatgatcaaattttgcatgttgccttctttagtcaacaacatgatcctccacaatccaactgaccgcagtcaaaacaatttgcatcaaaacaaaccatgccgacatcacaacaataactccatttggtttgttgaacatcagattttgtgcaagtgcacagaatggcacacaaaaatgaaatgtacataaataatctaaaaaaaaagttaattataattaattagtatagacttgaataaaatttaacaacaatttttgttgaagaaagacaaaataatgttgaattatgaatttaatgacttttatgagaataattgctataagccatataaaattaatgaaaatgaaaataaaaataaaaaatacatgcaagatataaaacttacataataatcataataatgatgccaatattatctgctgatgaattttttggacaacaatcaatgccacaacatttttcattggttgcacattcccaagtaatctgacaagaaattaatatttagaaaagaaattagtcaaaaaaattaattaaaagaggttgttgaccagtattattttgtcttttttatgagattgtattgtaaaaagttgttttattgaatattttatttttacaatttaatttaatgtaccttttctgggcgttttccaatgaaatttggctaaaaaaaataacttttaaatgcaatatttcaacactttatattattatttaatttagtaaaattgaatttcttattaaataaaacaatgaaaatcattgttgaaatataataaacgaacaatttcttcattttgttgatcatttgcaaaattgtaagcataaattttgttgaaattcatatagcactaaatgtttaatgaaaaataataaattattgtcccacctttgaaaaaccatcccaaaagtaactctggccatcaaatttgaatgggtgatcaattgagaaatcgctttttgccaattcttttttaaaagtttctaaacgttcccatccgctgctaaaatttaaattttaacatttaatttattgctccaaagaaatataataatataatacaattattggcattttttaaaatttaattaaaaataatctttgctaattaccccctccttggttcattgacaaatgatgatacgcatccaagaattatggagaaaaatgtgaaaaagtttctgattaaattatttctctccattttttttctcgtaacagaaaaatattaatgaaaatttttaactttaaaagcataattttttatttataaaatttaaaaa

SEQ ID NO: 12244 - DNA, 2023 bp, Heterodera glycines
aatttcgttaaaaatatacgaaatgggaaaacgaaattcaatttcgtaaaaatttacgatataggaaaagatgaaatagaatttcgtgaaaattttaacgaaatgcaattcaaaatcgtaaaaattttgggttattggcaaaaaagtttgatttttttcaatttcgtaaaatttttccatctttaccagtgctttttcgattttggccgaaaattttacgaaattgcctcggaccctcgtacgatttacgaaattgactcccccccccccttgtccacgtatgatccaaacaatgggccataatttctgttttaaatgcttattcgaaactaggttttaatgccagacataagccgaaattctgcgttttaattacttccaatcagaaggtgcgttttttccgtagacatttgttggcacaatcggatagtcccattcggcactctcattttaaatgtccgctcacctgacgatggtgaccagcaccagcatgagaaaaaggatgacactgcgttggttggtcatcacgtcaatgcgcgacgttttcagcggggcgctggtcgagttcatcagaagtcgcgagtcgtgccctgtgtagacgacgacgccaaacacccagcggcaattcttcagtttggcaccgcgcagcaaaaattggtcaatcgctgcgggaaaatatattaattgggaaactgagtttcgttgtacaaccaattaatgtacggggaatgggaaatcgcactcacaaagtggcactttttcgtcgtctccggcacacatggtgccgctgaattcgtgcacccgtcggttgggcggttcgcattcgatgtgcgcacgcaacgcggacagttgggcaatgtcagtgagttgggcggtgagagggacggcctaaaggaacggagatgaactaacgagaaaactggttgtttagaaagagagaacctgtcggatcttcaaatttgtctccccgtccagctgtgccgtctcaatgtaagctaaaaatggcacaatggttaattttgaaagaaaaaatgacggtaaaatacaatgattgatatagtaaaaaattgagttttgttcgggaccgttaggaaaaattgagtataatttgctgaaagattttgtaaaaaaagacgaaatttacgattttgaacaaatttaaaaaaaaagaattaaggattttttggaacggctggaaatttagtatattttcaaatcgactttttaaaaagactttcaccaaaaaataaataattttgtggaaaatttcgctaattttttggggcaattttggtaaggtagaaaattaaatcattttattttcacccattcccaacgcttcgctggacgaaaggagcacaatgtcggcagggaaaaactgtccttcgcttacgcgaatgatttgaccgacacgcaactgaacatttcgtaatgaatgagaaactcgagaaaggtttgattaagcttaatataaaattagcatggtaaagggaaaagattagagggtcactaattaagaaagataccagtacataattaacaccgacaaattgctctgacctccttccatttggctattcgtatttggccaccggcgcaaaccgaaccgaaagagtccagcagttccacctcgtagttgttcacctcactgtccatgcgtcgccgtttctggaaacaaaaaattgcacaaaagtgatacattgagcactgacaatgtcctcgaaaatctcttttaacgccgacccagacaaaatgaagagaaaaggcactgctgttgtgtaatgacctgacgaaaagaaggcagagtttaaaatgggacaaagacatctttggtttggaagagaaactttccactttcccaaccatttaaatgtcgttttatgacctattactagaaagaaagctcatggttctattagtgttattgggcctcaaatttaacaagcctgaacgatccaggacatgagacaaattgcccgaagtaatgggtttccctattcatttttagagttaaaattcaaaa

SEQ ID NO: 12245 - DNA, 1016 bp, Heterodera glycines
tatgctcgacctgtggggctgacttcggggatttgctgcaacaccacaataataagaaagaaaacgttgctgtaacgacggaactgttcaagaagaaagcgcgggaagaatgtgaagacgttgtatttgcaggtgctgaaaattggagatcggcctgtatttttcctggatctaggtacaggtacaggccatttttaggaaacctgtatttttcctgtactttgtacaggaaatacaggtacaggctcaatacgaacaccctggattttcctgtccaaaattttagaatttatatttcaagtgaccgatgttttttaatttttcaaaaatgatcaataaatttacagagaaattaatagcaaaaaaatatggcgaaaatgggatttactatagtgaaatttaacggcccaaaattgtcaacctaaaaatagggtgaaacaaatggggcgttaaaggaggcaaacatttaaaattgtcacttcaataattgcaaaactttccaatttgacagcaaaacgggaaaatgtctcaaattcgtcaaaatgggaaaaaccttattttgttgtcgcaatatttttgcgcttgcgcacctccgcccacggcaatcgaacgcggcgcgacgttcgcctgtttttgtgtgccgccgctccacgtcgaccgttgggaggcggaagacattgaggaggtcaacgaagcgacggtggtgtcgcggatggcggaataggagggccaattggcacggacccaatgcataacaacggactgactgcaaaaaaagggggctatactttcgttcaaggggtaaactaaaaacacgtttaatggttatgaatagggtcgcgacttttagtgacgaaaaatcccaaaatagttaactaaaatagtgacgaaaaagtgagaaaatagtgaaaaaagtccgaaatagtgatgaatagtgacataattttcagccaaaaattgagtaaaaataaggataaaattttagaatgtatcccccccttttttgaaaaattttt

SEQ ID NO: 12246 - DNA, 3941 bp, Heterodera glycines
  misc_feature (48)..(48): n is a, c, g, or t
  misc_feature (58)..(58): n is a, c, g, or t
  misc_feature (63)..(63): n is a, c, g, or t
  misc_feature (72)..(72): n is a, c, g, or t
  misc_feature (98)..(98): n is a, c, g, or t
  misc_feature (132)..(132): n is a, c, g, or t
ctatttggtgtttctgattttgtccaacatgttgttttacatggcggnttggtttggntgtgntttagtggngagccttgttggtgtccttgtacagnttggttttgatgtacgtgggaagactgaacttgntgtacttgagttggttgtgcaaattgtcgtccatttatggcttggggttgctgttcttgtgtttgaacaatttgctgcccctgtacatcttgtcgtccttgtactattttatgttgctgttcctgcatgctctgctgtggttgttgctgtccttgtaagaaatttgtcaggggcagctgtccttgttcaacttgttgtactggaacagtttggtgttggtgattctgtccaaccctttgctgtctttgtacagcctgattctgcatttcttgtacaacttgttgctgcactagtacagcttggtgttgcccttgtttctcgtttttcaaccctagttgtagttgcccttgcaagccttgttgtccatgtcgtatttgttgctgtctttgttgaacagcttgatgttgttgatgcccttgttgtaaaactgcttgttcttgctgtcctgcttggtgctgtttatgtcctagatgtactgcttgatgttgttgttcttgttgtcctgctagatgctggtgtccttgttgtactgcttcatgtccttgctgattcggcatggcatgttgtccttcttccccctgcccttgttgtactgcttgctcttctggtccctctgtttctctgttttgcatctcttccccactttttgctccattctcttccacttcttcttgactttgctttccccgggggctggtcctttctttctcttgctctttctgctgttttttccccaggggttccgccggtggcatttgtggcggtgtgacagaagcggcgggtgctaataaaagtgcaaaaagtgggtgccattaaccaattaatgatgtgcttattttgtgttttgtttggttggcctacgcccacaaaaaagaaaaaacggaatataattaagagaaaacgaactgtgccaaaatttgccaagaataaaatggacaaatcactcgaaaaaaaaattgctggcactttgctcttccctccccgccgatcagctgatcagagtttgcgattggctatcggtactgatccatcacactgatcagtgactcaccgttcgtcgtccgctccatttcgtccggcctttgttccgacagcgccaccacttcttcctgcccttccacttgttggtgttgcatcgggtggttctgttccgtctccaccacttcgttcctctctccactctctgctcctttttctctctcctctttgtcttcgtcctcctctcttttttcctgttctttctctttccctcctcctctcccttctctctcttcccctttccgtctctcttcctcttctttggcccttcttcgctcttcctcctctctcttcctttcttccccctccttcagagttcgtttcgtgttttcttcttcctcttcctttgctctttttctgtgtccctcctcttttcctcctttcccttccgtttcccccactctctcttcaactttccctctctcttccaccaattcctcctcttttggtgtcactgcttcttctgttgctgatgatacaaatgaaaagccttataccggcgattgcataggaaccgattgaatgacaatgtttggcacttctttttcagaatcacgcacttctgttagtcattctcgtgatttgtccactctctctcccctctctgtttcttttccatcctccactctctgctcattgtcttcttttccctctctcactgtattaatgctttccatggagtcttctcctccctccactctatgtccaatctccacttctctgttactctcccctcttcgtcccaatgtatcttccgtctttttttcttttcctacgtccaatccgtgctcttcctgtcgctctctgtctgtcccgttgctctccttctgtttgctctgattccatttgttccttttctcttccgccaatttcaatgacactcttttcatctgctgtttttcttcgtcagttctttgctgctgttgatcaaatgcctgcttctcaccctcaacatcatttggtgaaggtggcaccgcccggggggacgacggtgcgatttcggggacggagagtgccgtgagggacggggaaagtgccgggggcggttgttgagggacggccaccgtggggagggagggattggcgccgtctgagtgcgttgtgccggtgcctgaacattgtgccaaatgtgaagcaatcaaaggcgggaggggagccaaagaatggccagaaagtgtgatcaattgatcattccaggtgatcagtgatgatcagagcagtgaccgttcgatcatttttgtgccaatttgtgcaatgctttcaaattccattcgctgttttcattcagaaaacaattttttataagcttttcttttttcttttttgtgtttaagctgtgagtgcattattaattaattataatggtggaatgaacggaaaaatgtcaaaaaaaaacttacgcaaaaaacgaccgcaataaatttggcattccttctgtgaaaagaagtgatttcggttgccggcacaacctaaaacggcaaattagtgccaaaaatgtgccccattactgaattatttatcgctgctgtgtgctttaagttacctgtgtaagtgaacgattcgcactgcgcacgttcgacgttgaaaaaccaccgctgcacaaaacgcgtgcaggtgggagcaccggggtcctaaagttggagcagtacaacgagaaaaaagagaaatgaacggacaaaaaataaagtggaatttgccaaatttggcgaatgagttacggctggtgccatatttctcactttggaaagggtcactccgtaaattcaaaaaagtgccgcataatccgtccccaaaaattgtcaatgatgaatgacttaccaaaatttgcgagcaaatttcgttgtttccgaatgcgaccacttgctgctgttgctgcttttcgtgttggctttggtgccgttgatggccatcaattggcacaattggcaccggtgcggacgctgtgctgcttggcaaggccaattccggtgtcggtggagaagccgagtccgaagaaggcaccggtgactcatccgatgccgcgggagtggcggcagtcggcggggcgagggaagagcccaaaagagaaggcacgccatgttggatgacttctgtacattgacagtgattattaaaaaaaaagccgaaatgctaataaattgtgccaaactcgccgattaattttggtgccggcggcgacggaggcgaaggcggtgaggaaacggaggggtcaacggggccgcggagcgtgccgattcggcaccgaaacggactcatccccttcggggagagccggcgccgcgggcggctgcgcgccttcgccggaggacggctgagggggtggaagaagcggacaaacgcactcctggcagcttttgctgacaaagttgcgagagggggatataattaggagcgattaattaattctggaatatttaattaattatcggagggaaaggttaaaaacaatttaaaaaaattaaaaaatggatggaaaaatactaattaagccgaaagtcgaacctattcaagaagacaatgcacggctcgacgcacaactgaatgtccacgggaggacaatgggcgcgagcgacggacgacggaccggggacaagcggaggatgacgcggaggagcacaactgaacggaaggcaccaattagcaaacggaaatcggaaaatggggcatggtacaccaagaaattagcaaaaaaaggaggatgaatccgattaaaggatattcatacgcattgattgggagtgaccaatctgatcattaggaagagtaatcat

SEQ ID NO: 12247 - DNA, 3826 bp, Heterodera glycines
tcccgagtccgaacattctttgtttttgagtcagtctcttatttaattcccccccccccctcctttttttgcattcgaagtgtaataggcacccggaatctcgtggtcacttctccgttctcgtggattaaatgaatttgggaatcagtttatcataaaaaacaaacataaaaggcaaggagaaaagaagtttaagaaagcgaattatccctccaaaaatcaaaacaatgagaaatgtgacgacgatgagaaaagcgcaaaaaaaagcataataataatgagacccgcttcacgggaaaggccttccttcgaagtgattacgaattggagttggcgatggaccgtttggccgcttcgatcaaataatggagtccgttcaaaggcttggcgcatttgagaaaattgtgacggagcaactcacgagcagagagacgcaagttgacgttgacctttgccaattcattatttattccttttcgccatttcccttaatacttcaagtgccgcgtctataaaatccttaaaaagcggcgaaatttgctcgcgcgagggaaagtcgggccgcccattggtcgcaatctgaaaaaagagtaaagcaacgcatcccacaatccctcagaaataccaaataaatcgctctgagtgggttttcattgaggtaaggcggctcgccctcgaccatctgaaagtgttttgagagagagggcggcacggcataaccgacctcaatggccataatgcccaaggaccaaacatcaactttaggcccatattgctggcgggaaacgacttcgggcgcctaaagggtttgggtggaagttcagattttaatcgagaagttggtggggtgcgtttctgacactgctcttaccatccaatacggcgtcccgacgagagtcgtccgcttgttctgctcgggactgatctgtgcacaaaagccgaaatcagcttaaacgaaatggacaaattaagggttagtcgaatttcggctgcaaaattcttactgagtttgactgaaccgtccaatcccaacagaatgttgtccttagaaatgccaattcattgagtttggaaagggtcggccaaccgatttgatgtcgcgatggatcacgtgccgggaatggaggaactccaacgcctgcagcacttcacgacagacggcggcgatcattccctggcaaagcgaaagttagcgaaaaagtgcataaatagcaaatgcctcttccatttggcactctgtcacaacgtccgtcagagaaccaccggccaaatattccatcaccacccataagtcctctccgaccaaataggagtccaaataattgacaatgtttcgatgtctaagggaaattggaataaaagaaaagggaaaggacagtgggcacttgttctctcgcatgacgaggatttcgttgatgatcagctcctttttgggctgttggctgagattcatttgcttaatcgccactaaaacggcggcacagacaaatcgccaatgttttttgtttttaccttcggcaccggtgtttacttcgattgccgtgaacacagacccggaagccctttaagaaagaatggcgcgtccgcttcagtctttagttttatcccagtgaaaagtgctcaccccgagccgatcttctccacttttctgtacttccgatcggggtttccaatgctaacaatctttaaaattacttacaataaaccttgatttgttcatattgcaattaccgtcctcagtcgtgccaatacttctgaatcggttagccttcttcgacgtccatttgcgcgtccaccaaaattgccatttttaagcaaataatcaggcacaattttgctggtttcttcgtgttcgatgggttttgtgtactgaaaaagccaatctttttaaaattcatcagttgatcgatggcaaatgccaaagcgatcgactgcttcgtccaatggcatttcgttttagcgttttccgattggcacttttgtcttcccccccccccccctccacccttttctgttcggtgttttccttacgatcgaaagtgttttcttcggcctttccgggatgggcggtgcttctccctccccttcttctccgtcgtcgtcgtcttttgagggcaattgtggcggcgcatattcctggtaaattcacatggcataaataaaaatttacggcgctagttaaaaagtgaccacttttgaaaaatttttcactttttttggtaaattttttttttgtttatttacatataatgatgtatataaagcattaccatcacaattatggtgaataaaaagtatattcacgattttttatcttaaaaaattttgtaaaacaaaagggtcccccctttggtttttgataaaattaaaaatctgtcactttataactagcgccaaatttcttaataggccaactaattgtcatattcatgatcagcgacctctaaaatccccgggtacttggtttcatgactttaaaaaaaaatttaccaaaaaaaagtttgaaaattttttcaaaagtgactttttaagtagcgccaaatttactatgtgtataaatatatttaaatgttggaatttcgacttacagggggcaaactgcttctgacgaggtcatcgcaatcgtcgccaaattcccttctcgacgcttccattttcgttgttttatggcatgcatctaacacaacaaaaaaaacaaaaattgacaacaaatgataaatggcaaaaaagagaaacatgcaaattgtaagtggcccttcccccgttgcagggtttttgccttaattttaaacccttggggtgggggtaaatattttatagtcccttttttatggtcgtgtaaagtgcaatagagccgtatttaccccgtggacgccctcccataggccgtctccctgaaccaacccttatttgagtaatacggagggacagttgcattcaatcgctttggagaatggggcagagaggcggacgaataattattgttgatattgtgactcatccgattgtccagtgaaacttgctgttcgaatatcgaagaaagtgttggagctgaaaccgtgagaattttacgatttaacacaccgtttcaaaaaattttggacaaaataaataaaatttcatacattcgaaactgttgctcggctgcagccatttttggtccttcccttcggtcctcgtgaagtatttaagggcatttagcaccgcttgtgggttctgctgctgttcttgcttgctgatttgactttgttgcagcaaaagttcccaacttttgggcattccctcaaaatttaatttatttttatttattttaccgtcttttatacaatataattgactaccgtaaattcgccagtcaccgggtcatagccaacatgaacctaagcaaaaggcatggaatttaaattagattttgtaattctgaaattgtccaaccgtatgttgaaagtctgatggaagcgaaataacgggcttctcggtggacctgtccttgtccttttctgcaataaaaagaggttaaaggagagagagagaacaaagcgactactttttcctccgaacggcttgctcttcttgcatttcttgttcatctccattcctgagttgaaggcatgagcagtttcgagttctgatttggacgactcgaaaaagaatccgtgatttttggagggagcgagtatcgaagacgatgacgaagaagaagaagaaaagcgaacatttgcgggagatggcctctcttgaccaatttgggcaaaagaggggggatgcatcgacataattgcaaatggtcaacaacgattacaacaagatcctggcgaaaaaaagt

SEQ ID NO: 12248 - DNA, 3631 bp, Heterodera glycines
  misc_feature (3531)..(3531): n is a, c, g, or t
  misc_feature (3613)..(3613): n is a, c, g, or t
atgaaaactgatggatatggatgttgtaattatttgttgtttttttctgtgccgctttgtttcgtctgtatttttcgtcacttatttttggcgttttttgaaaaatttcttaacaaaactatgtaataaaacaacataacataaagttaagttattaatagagatagagaccgacttttaaggcattgtcttttttttctgcgcactagtttcgacatattaagcataaaaaaacgcattttccatttggtttgagtcttatacgttgaattctattatgcctttaatgccttttttggcattttgccgttttggtgtcttttttggcgttttttcccgaaaaacccattaaaaatgcaatacaatcgagaaaatacaccattaaaaatgatccgaaaattttcagaaaatacacctcctaagaattgaaaactttctcaaaattaatcgcaaaattgaatttttaggtttaaaaatttttcttattcgaaaaattaaatatttattaagcatttaaaggaccgaattattattttttttggttaagttttacgtgttttgctccctaaaaacccttaataaaaaactttaaatgccaattttcatgcctctttcggaatgttcatgcctttttttcaattttttcgtgcctattatagtgccatttttgcgatttttggtgtctttttagtcggtctttagttattaattgaaattttgttcgggttaggcaaaatatttataatttgggtttttctaaaattcgaaaaaccgatttacattcgaaaaattaaaaaatgattttaagtgtgtaaaagcaatatatattatttaaaagcatagttaaattttaattaaattggaaaagtaagtcaacgaattgtccactcaattaatatgcttattttgctggactcattacaattttttatggatcattgccatgctttttctttgtaccatatcacagctcagtatgttgaataacagtggaatttaataaaaaattttagtttttcaatttttaaattattaacagtgcccaaacttctcggtgcccaaaattcatgtcgccagaaattattcattggattaaaacattctctccaattttaagaaactttttatttatttgtccttatctgaacaaattgaaataaatgaaaatgttccataaaaggagcttaatgagcgtgaatgttactcaaataatcaaacgtattaaaaaaatgaactgacgaagcgaaaaaagcatgggtgcggggtgatcggaagaggcgggtcatttcagcacggaaaagttatccagaaaataattaattatttaagtaataatgaataataataataatttaataataataataataataataaattatttggctctatttaagtttatatgccataaaaaagatacgaccatataataatttgacaaatttaatgctccataactttttcctagaagcatcattcttgtatcatttgatagccctaagtgtcttctattttcctgtaaaatttcaaaaaatttcgttgtctcaaaactggggaagtcgtaaaataaaaaaacagtaaaattttggttgggtaactcataggcatttcctaattcttaggttcttacttaaaaattcccatccttttaatttctcttcacattccgcaattttaccttaaattccttttccttttcattaggcagtagggatgtgcgagattctcggttctcgattttcgactcatgaaattttttgggtttttgggtctcgcttctcggggtcatttatcggtctcggttctcggtaaaatcatttctcgcacatccctatcaggcagtcattactatcagccgcatatttcgcttgacagtccgctctcccctataaaagccaaggagattacagctaaagaagagaagagcatcccatccgtccaacttctctcctcccgcccttctcttctccatctcatccattttctctcgatcagttcgctctcctccgtctgatcccttgcaacgccggcggagaaggaaattcttcaccctcctttttccgctctatcaccagggatgtcattccgaggccccaagaattttcggaattccgaggcccaattttttcaatatctgaatccgttccaaccctgcccccatcccttcttgggacagtattcgattccttcatccactatggtgtcaagccactagagcccggaaatttcaaatttgcggatcctgttgcaggattggaattcaaaaatttttgcagggccggatccggccggattaatcctgcaaatcctgcaatcatgcattttaaatttgcaggatcccgcgcaggattgcggattcctagaaattttgaaaaatttcaatgaaatttccaaaaaaaaaaacctgacaagaaattttaggggctggcgggatgcattaaaaaggcgactaagatttttcgaatggttcagacggtaaaaagagatcggaaatcaaatctgttaatggttaataaatttgactattttttgcttttcaaaaatgctttttttcagcgcaattttttcaaaaactaggaacaaaggggtccgtctatgcagataggcgccgtctgaaattttttttgaaaattttatcaattaattaactgattttgaccaaaaaatgaccaaatgtcacaccttttgactcaattctacaggattaatgtcgatccagtggtgtcgataggcgccgccgggaaattttttttgcaaattctaggtgaaatttgagatgaaaattgaatttattttgattgattttattataaatttattcaaaagttttggcattccgttttttaaaattttcaaagaatgtatgcggatcctcgccggatcccgcacaaaaatcaaatttgcggatcctgttgaggattggaattcaaaattttttgccggaccggatccggccggattaatcctgcaaatcctgcattttccaaaaaatgcaggattgcggactgggatcctgcaaaatcctgcgcaggatccggtcctgctccgggctctaatatgtataaatgatggccaaggatatttgtttttttaaattcgtatatttattcatagttcaatttctgtttgcctatttttttattgttagcgctaatgattcattaaacagttgatttttagaataattttaattttatttttcatggaccaaaatttgttttgccccacaatttttttcttacttattcttccaaactaaaacaaaattaatatcattcgaatgttttttaataaggcattttttaatttctgcaaatagaccaaaaaagtggtcataatggcacaaatttaattggactccaaagaaagagaaaaaggagaaacagttttttgggtagaaatgaattttcaaattaaaattcgggaaaatccttcgctccgattattaatttattatcgtccaaatgatactccttagtaaatgtaggtcgtggtctaaatttcaatgaaaacgcgattcgcgcaaattanatttgcgcaggttcgatacgtgaaatgctgatcgcgatcctttgtctccagcccattgctggtctgtttcacgctaggaganttaaacatccctaatttt

SEQ ID NO: 12249 - DNA, 2390 bp, Heterodera glycines
  misc_feature (19)..(19): n is a, c, g, or t
agtaaaaatattaatattntaataggccaaattttaaaatttaaatgaaacttttattcaatgattttcatcagtctttttgcatgtctatatagtgccactcacatcaacacacatttgcacgtgccacggcacgccgtcgtcgccgccaacgcacgcgacaccacttccaaggaaataactggaaaaattcgtcaaatccaaggaggcgtaagaatttatcaaatttgaaaaattattaatttgtcttcaagtggtttggattttcgccggaataatttttctaatatttttcttaaattatccttgccataaaaggactatttctctcttgtcttgcctctctctctctctctcgcctatttctctcttgtcttgcctctctctctctctctctctcgcctatttctctcttgtcttgcctctctctctctctctcgcctatttctctcttgtcttgcctctatctctctctctcgcctatttctctcttgtcttgcctctctctctctctctcgcctatttctctcttgtcttgcctctctctctctctctcgcctatttctctcttgtcttgcctctctctctctctctctcgcctatttctctcttgtcttgcctctctctctctctctcgcctatttctctcttgtcttgcctctctctctctctctttctttccctctttctctctctcagtctcctctcatcatctctctttaccacttccttctcctccactaatatctggatcattttattcagaatttatataattattttcccaataattaattgtattttcccaattgggtccccccactccctattagtgccacccaccactcctttttttttgttgtcggcgtctactgctgatcactgatcaatgaatggatcatccgcgacatccatcgcgcagcgtgccgcgcggtgctaggatgaagtgacaaaaatatcagtgttagaaataattaaatttaattattatttaattttaattgctacataataaatcataacttagcaaaatttatcaatcttggttttagaatgtagcttctacgtatcctctattacttatgtaattttttaaaaattagtaaaaatttacaaaaagttgtaactaacgaaaaaagctcgaagtatttagactcaacaattttgaccctaacttttttgaaattcaataaaattttttgaaattcaattgaatattagagaaatctttgagctaactaattatattaacaaaattaaaattgcttgtttttgaaaaaagttattaaggaattaataagtgtaatatttttatggtcgaccaaaaaatcaaaggtcatttaaatgcatgaaaattgttccaacttcaattaattccaaaccgtaattgatatgaaaagatagcccaaagatttctctattatgcagttaaatttcaaaaatttttattgaatttcaaaaaagttagggcaaaatcgagtgtcgctcgtaattgtttaaacagtcgagctgtcttacaagggaacatatcgaaagttgtcaatgtggtgctgagtcattatataaaaaccatatatgtatataaaaaaccatcaaatacataaagctgtctataattttttccaaagtcaatcaaatttgacattcttagtatcattcgaaaaccctaagtgtcctctattagcctgcaaaatttcaaaaaatttggctaagtttcaaaaaagatggccaaaaatgtgtgaaaacctggttgcttgtgtacttttagccataactttgctcaaacttgaccaaaatttttgtaatttaggtgagcttatagagaacacttaaggctatcgagtcatatcaagaatgttgaatttggttgacggtgacaaaagttatggacagttttatgttgaaaattttcatttgatggttttttatataacgccctttttgatggtttttttatataacgacatagcacccaccgtcaatgtacaaaaaatattttaaaagcacttttaaaaaatgctttttttgtcctcttatattttaattaaacatttttatcgttttcctaagaagcaaaaactttactcatctgatttatttgctcgaaataagcattttgttgaataatttatttaaaaagaaacggagtggagacacaaactctcagaagagagacaacaaaaaatggtttttttaaatgagaaaaaatcaattttataacccttcgggggtcactaaggaggaggagggggaagagagagaagtcactgtgattcattcatccgtccccccgggggacaaaagggcagaatgaattgcaatggcattttaaccgtaccaacgaccgatggaaagggaacagatgagagagactaaaaaggccattaaaa

SEQ ID NO: 12250 - DNA, 1236 bp, Heterodera glycines
ttccccctttaattcgagcaggaattttatgtataatttattaatgtttgctttaaattttaataattacaaaaataaaactttcgataaaatgcccgtaaatgtgaacagcaaagagtggagtggacagcagaagatggcacgagaacacagagatttgtgttcggtttgaatatgacgcaacgttgcacgaatgaaatgaacaagacaaccaaatacctttttttctccaaatactttattaaatgcattaatttcggcccgctcataacaatatgaattctctcgattacttcaactgtttcagttccccattgtcgatgaagctcatttaaaacagttttcgaaaaaagataaagtgcaatcaatagaattgataaaaggagattgtgggttcatttatttcataataattgtttggagaataaaaaattattttaatgtgctcaaatctcaattaaaattacaaaataaaatttattaaaatctttcccgtactgaaattactcgcctcttctgatcacccctcacccatacttttgacacttcggctccccacggacccaaattaaaaatcactattttggcattttgtcactattttttcactatttcgacattttttggaaaattccttaacaaaaatgcaataaaaacaaaaaaatacacccctaagaatcgacctaaaatttaaaaaaaatacacctctaagaatcgacctaaaaatttttcaaaaaataccagttagaattggaaaattttcataaaaatttttccccaaaattttttttcttgacaaaatttttggtttaaaaatttcaatatttgcttaaaaaaaatgtaagaaaggaatgtacctcatttgtaactgcaatcagtgaataaaaattatttttgaagactcgattaccttcaaataacgggttcgagaccgattaaattccaaaagaggactcatcggactcgagagaatttcccctcttaaatgaccctcaaaacaccatttgccgcccaaccctcattgtggtactgggagataatagaggctaactaatcaaccaacggtagacagacagagagcagagagaatccatcgaatagagccaatcaatacacatgtatgacactatgccacaaagacactatgccaaaaaatattaccccggcggcggcgggggattgtcccctcaaaggcgcaaaccccgcgggcgacgacgacgggcacgacgacgacaa

SEQ ID NO: 12251 - DNA, 3343 bp, Heterodera glycines
gtttagggggatggattaggcccaaaatagacaaacttattacatgtagtttgacaagtcaaacatttgaactgatcatcccctgaccatacgatcgagcattcagcgcacacattcacatgtgcgcaccattcacttccaaacatcggttcgtcgatcaaacaaaacatgcaatgtggctcccatttgggagacacatcggaggtgcgaactgatgttggttttgtcattgttgcggagcggtagatttgcagtgcgaggtgtcggcagcgcatatgttgctcctccactacagagcgtaactgttgttggcctctttcacgttcagcgtgtattgcgttgttcaaactttgtttcattttgcgctccgcatcagcgatggcaaattctgccaattcttttgcttcggcaaccttctcttccacaaatgtcttcattttggcttccaaaaaatcttttttgaagctttccattgccatcccatctgaaaaagcgcactgttcccagtaatattacactaccattaccggaagttgcggccgatgttgctggctcgtcgtccacagaaaatcgtttgttgcgtgttgtgaacgaacaaacattttgtctttaccctagttaaaaactgtgatcacaaaaaacattgaataccttacttcaccggcccaagcctcaagtttctcaagtctgaagcggtagttcacaaaatggtgacgcatctgcatcaattttacggactgtgcgccaataatttttttatagtgacgcaatttcactttcaaccgatgcggaatttgcactcatttttattaaccgtgaagagggtgggagataaaatgcaaaaataaggaaggaaaaggatgagggcagagtgtgtgaggatatgccgaacaataacaacacaacaacaacaactgatgcggaatttgctgccgacagatgggtacccccccccccccctcccctgccaccattgcgcaaattgaattagattatttttttattggttcgattgtaaaatacataataataataataaaataattatatcatgatctcattaggcttgatgggttaaaagtttacgtttctttgacggagccaatatgtccgttccgttgcaattcacacgcgcacaactttcgcacatttcgaaacttagggccacacgatcattgcccattcggcgaactttctctttgttgtggaactgattccgccagtcatcatcacagagataaattgctaacatgtatttgcctttgaaaattttcacatagctcgatgatcaactttgcactttttcggagacggaggttgagccaaaattttttcgggagatgatgatgacattttgtaaaaatgactttgggtttgagcgggtaaattaatctgcttaaagtggcggagtcctaagtcacttttttgtccagagattccgctaaaagtagatttccgaatacattgatcgccgttttggtcttcttccaacgtgcgctgtcctgcatggcatcggccattaacccagcttccactaagtcaagagctaccttcgcctttctcttcaagtcctgtttatcctcatcggtgtgcgtccctttggttggcgtagtggtggggtggtagtgcaagtgtcggagggcacgtcaccgtagggtacattgaacacgcgggccttgtttttcacacggaagaagcagtggcctggtagatcgtagacaacatcaaatgggacgaattgggctttgctgatccggctgcaccacatggtgatcccctccttggtcaccattatgtcgacctcgacttcagtagctttacaagcgcggcagcgaccgcactcatcgaatagtataaaacggggagtggacagacgaggaccgctcacggttataccgctcgttgtcacggttatgtcagattgggcaagaattgagcaattaaaatattccggcccggtcctaccctattattcaaatttttaaatattatttttctcatttttacagaacccaatatacgtatttgcggttttcttactaaaattatcaccccctaattataatcaaatgaaaaaattatgagtaatttatttcttgaatacttttgcatactattttaatagttgtattttggatacgccattaatatgattgagttaaaaaataatatttaataaatgaaaaattataaataatatgagaaaattataagaccttttatttttaaaaatttttatcattaaaaatatgtgctttgcgggataaatgttagcaaaaaaaccctaacatattagccgatttttatcgcttttttaaaaataaatttgaataattttgacttaatgagtagttagggcagtaaattccaccggattacggtagcctcccatacctatgggaggggtgcacggccaactgagcgccagccaggtgagcgccgccaagtgagcgcgggccaactgagcgccaaaattttcagtactgaaaccaaaacctattgcgcgactttttctgcaagcctaaacctattgcaggggggtgcgcgactttttttctgcaagcctaaacctattgcaggggtgcgcgactttttttattcgaaaaattctgccgcagactagtggcctcgaactttcgctctgccaccaaacccaacacactaccactctgacacgagaccagttgccagaaaaaggataattgtccactatatgctgcaaagatgatgacgtcaacactgagaggggtactgtagtccagggaaaatcgcaataaattagccgcaggcaagcggcctcgaacttttggtctgccaccaacccaacacactaccactctgacacgagaccagttgccagaaaaaggataattgtccactatatgctgcaaagatgatgacgtcaacactgagaggggtactgtagtccagggaaaatcgcaataaattagccgcaggcaagcggcctcgaacttttggcctgccaccaaacccaacacactatcactctgccacgagaccagttgccagaaaaaggataattgtccactatatgctgcaaagatgatgacgtcatcactgcgaggggtactgtagtcctgctgaaattcgcaataaattagctgcaggcaagcggcctcgaacttttggtctgccaccaaacccaacacaatatcactctgccacgagaccagttgccagaaaaaggataattgtccactatatgctgcaaagatgatgacgtcatcactgcgaagggtactgtagtcctgctgaaattcgcaataaattacccacaggcaagcggagtccaactttttgctctgccaccaaccccaacaca

SEQ ID NO: 12252 - DNA, 2959 bp, Heterodera glycines
  misc_feature (2844)..(2844): n is a, c, g, or t
  misc_feature (2849)..(2849): n is a, c, g, or t
  misc_feature (2874)..(2874): n is a, c, g, or t
tttcagttttcgccagtggcgttgatccgctccatatccgtccatcatttaaaagatatcctttcaaataggcattaaaaatatttacatacgtacaacattttttaatgctttgcagggcaaatttaattaataactaacgtaattaattttgttaatatttcgcacaaaaattaattaatatagtgtccgggctctactgatcaaggatgaaattacgatgatgaatttaagaattggagtgttgaagcgattcccattattggggagacggcggcggttcagcagaagaagaaagcgaaaagttgggccatttacacagagtctttcagtattggtgatgccattgggtgagcagaaaggaggccttatttttgttataaagcacggacggacaggacagtatccactgtacagtacttgctcagaatcttggcaggcccaggggttcctattaaaacaggaattaagtgcttgtcttgtccatgccgttctggtccatctcggaaaccctggtcctctagttcgaatttttttttttaaactccgggctttacttttacaaaagtgttttcatccgacgattcaaattttgcttaatttaggccgctgtctgaaaaagtgttctcttttcccgggcccagtgatcagcggaagaaaaagtgatcatttgagaaatgtccgaccaaaaaagagctaatgaattgtgttaattgatactgtcaaatttaacgctgggtattaaaaataggaatttaagttgggctaataattcaaaaattaattaaattcagcgctttttttacttcaagtaatttgcaaataaggattagaaaatttatttgtgttcagcaaccctacctcggaaaatgaacaatgtcctaaatagttattggaacataataattttgtcttatggcaaaaatggcggattttgggtagtttatttttgtgggttacttttacggtttataatttttctgataaacaaagaaagctctaaacattcttctagagttggtattttgaaaaagcctggattcaaagttgggaggaagaaaagtcgcgggggtcgaagaaaaacaaatttttttatgagagcgttgttaatcttggtataaaatttattttaatccagcatttcgattttccgggatcccgtgcgagattgtgagctttttaaaaatcgcatattttcattgtccccgattcggagacaatgtcaggaagtgtggttggtgaccatgtatggatgggacgggacttaaacccttatagaaagttgttatttataaatttatatgatattttattaaattcaatttaataccgaatttcgaactcaacgttataaaaattcattaaatccgataaaataaaaaaatgaattttgtatttttgaaattattattcttattttttatctctaaacaagttcagccaatttcacgcccatcagatacaataacaatttaatggtgcatacaacctgaaaaatttaattgtctgttctcgaaggaaatggaaaatttgctctaaagaaaatagcagcgaatattttcaacaaaaatattttattacttctaataaaaaatttcgatatttagttaataaatattttttatgcatttgtttgtccataaaaagttgaaaatggaatttattaatttttttttgttttgttttgtttgcttaaaccacattcatttcataaaaattgttctcctttcaatgtttgaagaacaattttcacattccgttggcaaataaattttaaaattattattttttttgtttgaaaagcactttttgtgttttcaatatctgcttaattgattcctaagccgattaaccaagtattgttaatccagtaaggaattaacaaaataagtgttaatttgtacgtaattcgccaaataataaaaaacaaattaaaaatatatatttttggcaccctgaaatgaacaaacaacttgtaattataacgggcttatgcattaatgagatagcccaaatgaaattttgaattcactacctttttgtttttaacaattttataagttttgaccgattagaatgcaataaattctagggaaatttatatttttaattacgaattctgttttacatttattaataaaaaatttttaattttaaatttaattattatatatttacatcacattttataataaaaaaacaacattttttgtttcagcatttttcttttttttggcctctttgagatacaactttccgcttcataaagcaaattcattttttccattaagccaaaagggaggtggaggcggcttaatcactgaaccgagcttgaaattaaaaattcatattaattcttaaataatgtgttactaaatttgaaatcctttcattggcgttctaatagattattcaagttatttcaacagattttttaaatttgaaaatacataatttaaaaaaaaattatattttattttatgaaaaaccagcaacaaaaaaaaaaataatcttctcaaaattttaaattctctcatttccaattttgacttttatgtaagaattttcaaatattttttattggataagaagaaatatttttggcattttttttttgccatttttggcaaaaaatcatgtgggcaatgattaaaaattcattcacacaacaaaaaaattttctgctaaaatttgccgggccatttttgtccattgcatcagcaattctctcaccaatgtccaaagaacgaagaattttgttaaaaatatttcttcgggaattttatttaactgtttctttttttgtctaaacattaacaatttttatttcaaatttaatcttanactanatttcactaataaaaatctatattnttttatagattttttagctttttgcatgacccacatttgcaaagcgccaaaaaatatttaattttcataaatttttccatcttaa

SEQ ID NO: 12253 - DNA, 3883 bp, Heterodera glycines
  misc_feature (9)..(9): n is a, c, g, or t
  misc_feature (3796)..(3796): n is a, c, g, or t
  misc_feature (3810)..(3810): n is a, c, g, or t
  misc_feature (3816)..(3816): n is a, c, g, or t
  misc_feature (3871)..(3871): n is a, c, g, or t
aataaaatnttgatttattaatgttagaattttattttttctattaaactgttttgttttatttatatttacttcacatttgaatagaaaaaagaacatttttgtttagtaattttctttttttggcccctttgtgattcatatttccgctccagaaagccaattcattttttgccattatgccaaaagtgaagcggaggcggcttaaatcagtgaaccgagctgcaattcactattcttttcaattttaaaatttttttatttaatattattttaatttaaatatttctattttagattatttttttaatgaataggcagcaaaagattaattattcttcacggaatttttcaatttttcattctccattttaccttttatgtaagaattttaaaatattttttttgataagaaaaatatttttggcattttttccatctttggcaaagaattatgttgtcgctgattaggaattcattcacacgattaaaatttcctgctaaaaatttccaggccatttttgtcctgggcattagcaattctctcactaatgtccaaagactgaagaatttttgtttaaaacattttttcttaccacaattgccaagcggcaaaaaaacatttaattttaataatttttttcatgctaaataaaattttttatttttgtgcttttttcactttattctattttatataatagaattatacaaaattgcttagttagaaataaaataattaatttttatctcctttcaccattaagtgtcgtaaaatttttctttatcgtgtcgattgattattataaaattgcgtcaataatgaatgggaacaataacataaattcacacgaaggcaagttttttattatatattctttaccaccttaataaaaccacaatttattgatagagcttgtggtttcggtaaaacagaaaaacaggcctagggtaattatttttgataatttaaattaaaacatggtcagttaaaaatattattataatgtaggacctcggacaatgcgccaagactgtaaaattggcacatttaaaaaaaaaagttcggtataataaattgaaaattaaaaatatttttcctctcagcgatcaaatcagtccgatcatcgaccagtgacggagattacgttcttaacaatggtgatcagcagcattgttcaattaacgaagaactgcgcaatttgacgctgtcgcacaatttgctgcggcagcaacaatcatcagccgtactgatttcgccgcgctgtcagccccgacgactttcgtccgtgccgcttcagcgccagcgctcgtcggcacagacgcgctgtgccaaaatgtcgacttcgttgggtaaatttcgaagttttttaaaattattttgaaaaatagatgtttgcgaactgttgcacattgtaacgcatgaatacatcggtgctgactgcgcactgcgcccgggcgaacgtttggtggtggtggacaacggggacaagaattggaagcacgggtttaaggtggaaaacgaaaaatttttagagttttttaataaattctgggggaaaaggactattatgagaaatttgaagaaaaattgtctcaattatttttagaattgataagaaattataaattaaaaaaaacatgctataacggattttattgtatttttttcaaaattttaagattaatttcagaatattttatttctttgttcttaaatttgtgtttttgttgttctctgaaatttaaaaaaaaaacaaaaaattattttagttatttttcattaattaattagtaattttgaataaaaaattttattaataaacaattattttagctgtcggattatatggaacggatggtcaccttcccaagttcatgcgtagcagcttatcggcctgaagaacgtccaatgcgtttggtgcgcaattgtaatttgttggaccagaaaatccgattgtaccgcgaccaggtggaaaaattaattgattaattaattaattaaaatgggtttacaatttagaagcattatcaaaaattaaaattaaataaattcccagcttgtaggtaaatataattgtgatgatattttttcattttttttggactgacaggaggccaatgttagagaaaaaaaacgccggaaaattggaatgtttaataattcattatatttttccataaaactttttgaatatcttttgctaaataaagccacaaaaaatattaaaaaatggaaaaatccatttttcgttttcggttgaacgattcgatcaaaaaattttctatccaagaaacagaagatggcgatgacttcttataaaaatgatttggagtcacataaatttcattaaaaataataataatttaatacaacaataatttattaaagatcgtcttcgttcaaccaaattctttggaaaccaatggacgtgtggcgatcagaaatgagcacaacaaaatcatgcattgcccaatacaatttttgacaaatttatcttgaaaatttgaaaaggaagcacaataaaattaattaattagacaaatttttttgccaaaaaactgttatcatttgcaatgatttatttttgtataagtaaataaaaaaagcaattgaaaagttgcggattttatttaaaaaatcatttggtatatatcgaacaaaaagaaatacagtagaaaaagacaaaaaatgccgtatcaacttaatcaatacccataaactaattggcatcatatgtttgagtcaaggtgtacataagcagtccgaatgcatcatctcccatgctttttggaatttctaaatatttaaaaatatataatatttttctaggtgagtgctaaacatattgaaaatattgtcatagtcttaaattgaggttttagaaaatttgtcaaaatttcaatttatttaatttcaatgtttactatgctaatttatgagcgcatgcatgtccattcactcaagttaaatcactgaaaatttgtttttagcccataatttagtaacagatttggaaagaaaacaattttaaggatttttgctcaaattttaaaagattcaaagggagaatggtccttagccaagacaaatgccgccaggaaaatttaaaaaaattttggaggaatttttaaagaaaattattaatactttcaaaaaaaaattaatttaaaaatcaatccatatagttagttacaaatttctcataaatattgtgcaatttttaaaacgatttgcctgttggcgtttcgttgctatgccaatgtcaaaaattgcagagggcacttcacaaatttgtcgtgttcattccgcactgtcacccgtccgtcctcacccagcgaattgggctgcacaaagacaaccttaaaatttgaaatttctaatttaaaaaaaaatttttttacctggtcacgataaagacgcattttttgctccattaaattgcatgtttggatcaatcgcatcggttgttcctcttcagttcggtaggcggcaatgcatgtgcttggaaagatgaacaagctttcagtgcggtcatttaacttaataatagaaatgaaatttgagatttataaatcaaaaaaaaatatgaggaaagcaagaatttataaattttaattattaatttaacttttcaatatataaattaaaattaatggtcttgatagaatgcatttaaaagagttataattaattttgattttcttgctcgatttattcgatataaaattgacaaaaataatttaaagacataatttatttaaattcaataagtgccgtttgataaatttattngtgaaatttataanaattanattaataatggaaaatttaaatttcttgagtttctccaaaattacacgaattaanaaagggcttctc

SEQ ID NO: 12254 - DNA, 821 bp, Heterodera glycines
  misc_feature (789)..(789): n is a, c, g, or t
ggtgggacgatgaaaacctataggaggaatcataaaaatttggcatttaatatttattggcacaattaaattatagccgagatgatgaaaaccttgaagggtcccttttagtgcaattttttttttatatgaattagtcaaaataaaatagctgccatgatcagcgagcgaccttgaaactataaattttattgttaataattcacttcatcttcatcatccagtcgcactatcttaagagcaacaatttgctcggtgtccttgtttcttgccttgaaaaccttaaattaacaaattctttataatataactttgaaattttatgtgtcactttttttaccgttccatatgtgccttcaccaattttccccaatttttcataaccactcatgtcgttgctgttgctcatcttcatgatatgtatcaattaccaatggctaattacttaattcttgaaatcttgcaatattttaaatatgaatttaaaattttctaattgtctcgctctctctctcttatttttaaagtcaagaattgaactgtttgatcaaaacaagtcccgaacataggcggccccagccaaaaaccgacatttgcggcgcccgatatttgcagatgatttcttaagggccattttccgatatttgcggccccacttttgcggtccagacatttgtggtctcagtcaaaaaccgatatttgcagtcgattttttaagggccatgatttgcggccccagtgaaaatcggacatttgcggcccgcatttgcggcccaaggcaaaatcggnttttttgcgaacaacggaaacgccaaaatttt

SEQ ID NO: 12255 - DNA, 2565 bp, Heterodera glycines
taccattacgagttgctttcgtccgtttctggtttttgcatattaatttttagttgaattcaacctttgcgcaatttaatgattttttctactcttacgtttgttctttgatatctgtcagtctattaattgcatcaaaatggtatgtttttggccttatggctgggccatcaaatgaaaaaataatttaaaaaattttttataatgtatattacaaataacaaaacaaacaattattgtagtccttctttggctttggtcaatcagcagagatcgcaatacgccttgacaatgaagaacaacaacggacgaccagaattcggatggaggatggcacttatgaggctagctcggatacgaattgaaaacacgtacataagcacgattttttttagaaattttttctcttttatgatggtgagaatgtggccggtgaaattgggatcactttaaagaagcaaggccaaaaattggagcaccaaggcattcgcatcgatttgatcggccaaattggttagaaatttgatcccccattcatttgaatgactcagtttattcagaggtgtactatgacaggggtaatcagcatgactttctgtatatgtccaaagaattggcacggcctggtgaattgttacaaaattccaaatttccattcaattttaccaatgtcagcaagccggtgagttctgctaattgagccggtggtaacatattttaaactgcattttagtacgaaagttatatgggttccaatgttaaattgcgctattttcttcgcgtcactgtttttcgtcgtcttaccgacattgtgcaagaattggaggtataacaaaaaccggaaaatgcgttaatagtttggtttgtcttccccctcccccatattacgcaaaaattttttatggcattgaaaaaatgttcccaagtttttggttgttgattacaatacatttgatacccttttcggcgaattccagaccataactcgaacaacaagtagaagtagagtttttaagtgcactttgaatgttcatcctttgcattattggtgctttttattttaatgtatttaaaaattttggcccctaaagaattttttaaaaatttccgacctttttgaattccgaaattgacagaatgaatatttttcgttgttatcgactaagaaacgaacctaaatatattttatgacagataataagtaatttgcataaaagaaaaaaggggtgagggggcgggggacaagccaaagtattatagtaccaaaaatacacgctgtgttcacggtttttgttttaacagttcgctgtccatacattagctgtctatcctgagaatgattgcaacatcaaaatggaagtgggcattgaggattgtttgcacatcgagttcgagtacaacaagtcgaggcgagcaagcacaaaaaatatttaaaaaaaaaattttttttttttaggtatcacctaaaggatgtgattgttgggaaaatttatttccttttagtccgcatcaaaattaaggtctgtagagctgttgtttgacacttggtaaaatgaatcaaaaaatggagtttgctttgagtctgtgttttagcaaataagtttttgctaaaaaaatattcggtaaattaaaaaatgaaaaaaaatccgagaagagggggaagagagttgcgcacccccctatctcctcaccaaaatttttaaagcgaaaaaggatttttttggtaaattctaaattcgacatttatattgttttaaaataaagcggcaaaactttggtggccgtgaagagcaaaaaagggtcgtcatctttatctccaagtcggaacttcctggaccttccctgcaaattatttgcacatttttttttctattacagcacatggaaattgcaattctgaagcgtgaatccgtgggcaatgggccaaatttgttcaacgaaaatgaaacaattgccaaatacgaaatcatggacggagcgccagtgaagggtaggattgttttttattatttaaattgtgaaaaaaaaaaatttcctttggtactttttgtccatacgcccaaaaattttaaaaaaaaaaattaacaaaggatgcaccgtgttttttttttgatggcataaaaggaataatttgccccaagacaattctgaggttttttttcctttttggggtaacttattcctttttatgccatcaaaaaactcagtgcattctaacatatttttaacatttgggggtgtatgtacaaaaccgaaaagtatctttcttctttttttattaaaggagaatccattccaattcgtttgtttttggccggttacgatttgacgccaacaatgcgcgacgttggaaaacgtttctcagtaaaagtacgttgttgaattcatcatgcatgggtcgggagatcactttttgcgccgattcatttactagctggttttttgtgacttttaaaaaaatgttatatcatattaaatttccaagcgcccaaacggcggcgctaaaaatttcctcgttccatagaattcatatatgtattccgtggagaaagtaaacaatttagt

SEQ ID NO: 12256 - DNA, 1259 bp, Heterodera glycines
  misc_feature (19)..(19): n is a, c, g, or t
atttcatagacatgccccngcccttcaggaaatcacattatggcgacgtcttgaaaagccactgttgcgccattcacaacagcaacagaatcagaaggctaccgcccaattggttccctcaaccggcactgttgaaagtgttttatcacctaccaccccgaagggtatggagaaaatggcaatagtcacgtcactgataaaacttttcctaaagcgttgacattcaatgattccaatgaaaagccaacagaaacggaagaggaggatgagtgacaaacaaaataaacattttattaaaattactcaatttttagattgttttgtattgtttatttatttaggatcatttttatgaaatgacataatttttttctcaacgccaattgacttcacgtcatgaaatatttataactacataaattattaagtcttcttgcagtatttgatgcattcattgtatgtcctaaatatttgtgttttggagaatcaaatttaaaataataattatttattattactcgaaattgttgccatttccgagtgcaccgtaataagtgaacagaaggcaattgtcaatgtctttcttgtagaagtaacgctgtaaattttcagtgcagtgttttcaatttctgtccaaaatttaccggcgtatgcgacccctggaaggcgtatcgtcccgtatcatattcaataccgcagacaatttcttttagggtgttaattttgtaagatacaattaatttttgcttaaagcgcgcatcgtttggtctctccccattttcaaaagaaaaaataataattaaaaaattcagttgcaattatgttttccgagtgttttcttggtcatttgatcatgaatcaagcattcacttgtgcaaattctgaaccctggaccgggaccgaacaaaaagtcgaaatttctttttagtttagaattatttaaatgatctttttgttggctttttagtttgtttctttgtatttaatccggacttgagccaaaaaagcgaatttcgatatgaatttgaattttcgactttcttcgaatttggatctgatattaagaaatggtcaaaatatagtttcatgaattttgaaaacaattttgcatgatgcgccatttccaaaattatttgtttggaacctttcgaacctggacaacagtttttatttgcaacacatgtgaagccgtccgggcatttgtcagtgccggcacttcaatcactcctgcattagcgttccccgctgcgcgaacacca

SEQ ID NO: 12257 - DNA, 2480 bp, Heterodera glycines
cgcttcttcccccgcctcctcctccttctcctcctccgcccaattgtttagtttttagttgtgcctttctttctctccttttcactcgtaaaaaataatgatggcggcggctcttttctcgcgcttttatgtagcacagtaataattgaataaaatgtgtgctgtgtattccgtgtgctaagtttggcacttctgttgctgctgctgctgcacacaattatatagcgccattcctttccatttatgtgaattctaaaaagccatacagtaattcattgcaaaaaaaaaaacatttttgaaaattaattttcaatttgaatttatctcagcgtacaaaatctagtaaatgtagaataataatgaccggaaaaaattggcaatttccatttaaactctatgaagtccctcccaaattcttaaaaacaaagttaacaatcgaaattgagtctatgaaatttacaaaattgtttaaatttacttaaatttaatttaattctttaaaaatttgtttgtttcattttcggaaattaatttggttaatttgtttgtttgttttttgcatagaaaagctaatgtcaacctaacacattgacgtcggtcgtcagtcacttggacgccattatcattattattattattacacttttcttttgctacttaatcgccctttccccgttttttcatttttttgcctcctccccataaatttcccgttttattatttcgtccccaattttctgcggtgcaccggcggggcctttccttccttttgcattaatttttgtgttcgcttcgctcgtcggtgtgtacagcatttatcagctgctgctgctgctgctgaaaattggtgaagctgttttttgagaaggtaaacaaacaaaacaaaatgagagccccgccgggcaaagggttgggatttgggattttttggcattatgcgggggagagattgcccggcattttctaagcaaagtcttttcaagagtggcatgacggcatggccattacacaaaatttacacagtttaaggctatgcccataaaaggcttttttaagcattggaaaagaccgaaacggaacgatttgttaccgaaaaggcaaattttatatttatttcttggcgttttgtttcaatttaaattttttttgttgtgaattggcattttcacaattttcccgggctcaaatattcgctgactttatctaggatttgtctacctacatatgtatattctttccctgttccggttaaggagtccgggaaaaaaggatttttaactctgaaatccaatccggatgcaattcccaggactctgatctgaattcgggaatctcaaaattcccggcgctttaaaaaaatttctaccccggaaaaatctgaaaaagagtcagccctttgttagacccttcaaaaaactcacccgggttacccattctttaaaagtgccaaaaatatgggtttttttctgaattgccattaaaaattaattaaaattcagggcgcaaaacaaaatttgacgacattgcaccactaacgacaagcacagtgcacaggggtcgacaacaacaccaacaacaacaactgccaccagcaacaacaattacaaaagttcgaccaacgacagtaatggcggccacagcggtgaccagcaccgtagtcgcgccgcaggcgtactgtagcggcgtgtttgagcgccgccggcgccaaccgtccggcgttgtggtggcggcggcggcggcgagcagtgcagctgccggcgctgtgcttgagcagcagcgacagcgacggaccagcggttggttggagggcaaaaatttcatgcttttttttggagggtgatggattttaacggatttttttaatccaaattctttttttttgtgtcattaatttggtgtttttgtacagattttcactttaaaacatcaaaaaatttagaggatgccatggaaatatcatttttttgacagaatacagagaattttttggggtccgtgtgaaaattgcaattttacacggtttttcaaatttccattttaaaaccctaaaaaatatataaaattacattgaatttttaccgcctttcaaattttttttgcaattaatttcggttgggttttgcactttccaccactttttaatttttttactaaaaatcaaaattatttgttgccaattaaattcgcttcacttgggagagtacaattaacaaccaaacaataaaaaattatattgttgctaatgcgatacaaaactcagcaaaaaaaaaaaactgcacttttcccccattttgtagcccattgttttggcaaagtcacaaaaaatggcattttttttgtatgtgactacaatttgagtctcctcattttgctgaattgtattgttggataggcaaattttatatgaataaattggactgatttcggggaaatgaagcgatttaattcaattaaaaatgccaaaacaaaaatgggggagg

SEQ ID NO: 12258 - DNA, 1785 bp, Heterodera glycines
  misc_feature (17)..(17): n is a, c, g, or t
  misc_feature (41)..(41): n is a, c, g, or t
  misc_feature (1673)..(1673): n is a, c, g, or t
  misc_feature (1680)..(1680): n is a, c, g, or t
  misc_feature (1682)..(1683): n is a, c, g, or t
ctaaaaatcaaaattantttgttgccaactaaattcgcttncacttgggagagtacaattaacaaccaaacaataaaaaattatattgttgctaatgcgatacaaaactcagcaaaaaaaaaaaaaaaaaaactgcacttttcccccattttgtagcccattgttttggcaaagtcacaaaaaatggcatttttttgtatgtgactacaatttgagtctcctcattttgctgaattgtattgttggataggcaaattttatatgaataaattggactgatttcggggaaatgaagcgatttaattcaattaaaaatgccaaaacaaaaatgggggagggcatcatggccttaaatggaatttttccatttttttgtcgcttggtttgtgcccaccatttttctttgaaatttcagcgcggattaacggagtcgcaaagcgtgccgccatttcaaatgcggcggacacaccgtcggcgccgaggcgttcaatggtggccagacatcaccggatcagtctgaagccgtcgccagccgaaggtattttttggcttggccatgtcacaatttgttttatttttggagtggaaaataaaaaaatattttattcttgatttcgaattagccaatgcatacctaaaacatttgatgggtcaatattgaattttttaaaatttacaataatttcctcaaattttagcggaaaaaatggggatttttttatatagtaaatctaccctcccaaaacgtcataaaacggggattttttgtcaaatttttttataaataattcatcaaatgttcaaattggtccgttaaaatcaggcccacattatatgtcaaccaatttttcagttttttgtcactttttaatgaaatattttgaatttgttgctctttttaaggcactgttgacattcaattcgatgacaatcagcagcaaatgccaacagcaacaattggtggtgctgctggtggtgatcagaataagcaaagctgtgccaacggttcttccaacacttctcctccggcacggcatggacatcaaactcagagccaacaacaaaaaatgacgacgacgagtcgaagcagtacaacgccaacgccaccttccacggcgccgtcgttgtgcccattgaatggcgtcggttgtgacggagaagcggcgcaacaaaaacaggacacaattcagccagcaaattgtgttgctggtgcatcttcatcatcatcatcctcgtctttttcagttccgaatgaggtaaaacaaagaaaaaatggggccctaaattatggacgattttacttggttttgtgagcaattttttgcgtcttaatccggctcaaattgtttttttttattaccctaatggttcagacttcttaatgaaaaaaaagcattaaaattttagcatttcgcttaaaaagcctcaaaattttgccaatctttgtccaaatttgttaataaacgggctaaaaatggaaacatttggacttttttgtgtgccattttacggttgtgccccatttttcggcacaacaatcgctgcggacgacggaaagccaatgccaaccgatggaagaagccattgccgacatgccaatggatgatgatgagaaggaggatgaagaagatgacgacatcgatgtcgaaagcgtgttggtccacagaaactgncacaacnanncacaccaaattgcatcaccacccaccacacttatatgccgtcaattgacaccgactcgtaatcccattttttaattttatttaaatttcgaatttgatccgc

SEQ ID NO: 12259 - DNA, 1744 bp, Heterodera glycines
  misc_feature (1676)..(1676): n is a, c, g, or t
cggaccccaaagaaatggcacatgaatgatgaagacaaggcgattgtaatttggcacaattaacaaagctactggcgcagaccttgccactaattatctcctcctttaattttgctttttcgcagggaaatattgccgacaaatgccaaagattggtttctttaggatagggcctaatgtaatgaaaggaacctccgactcattcagttacttaaatgggcatttttcatttggccataaacccaaaaagtatgacgtgccgtcgccatccatggcttaataagtgttattactcattttgtttgcgtataaattggtagtgccctgctgaaatttgacacagcttttaatctcttctcgcgtggacatttaacaattttaattaatttcttcccccccccccccccacaaaaaaaaacggaagaaaaccatttcttttaatgccaggacgaaacgctggtacactgcagtctcagcgagttgccagatgcgacaatgcaatttgaggtggaattccaggagactgtgtatcaggtggggaaaaaattgcatttttttcccggaaaatgcaaattttttggatggtttttttgcaggtgttcgttagagtccgtccccatcttcacgagttcctcgaacgcttgtccaaccattttgaaatcattttgtttaccgccagcaaaagagtgtacgcggacaaattgctggtataataccgtatatttttttgtgctttttaatgtctgacggtgtgattttttaggattttctcgaaattttttaaaatttttggtttgcttttattttgggatgccgttgaaattcattgttaattactaatagtatcctttttcaaaataacatccaatatgttttcggggttaataaattcattaaaatcatttgttttccattttttgctcgaatttgccctgatttttttggaaaataaatgagaaaacaaacttttagtggcaaaaacacgaaaaaacaatccattggattaccctaaatatggagaaaatggacaaattaatttgttgtactgtttgtttgttgttataattggacagtttcacttttgaaaatcattcataccctccctaattataaaaatgctcaaattaaatgtttttttttgaatttttcagaatttgttggaccccggcaaacggttcattcgccatcgcctgttccgtgaacattgcgtgttcgtctacggcaattacatcaaagacttgaacattctcggccgggacttgtcccgcacagtgatcattgacaactgtctccaatcatttgcatatcaggcaaatacaaatatttaaacttttgtcaacaaatgttttggatttgaaacatttttcaaaaaaaaagggccacaatttttctcactttttttgtcgaaaatctgtcaaattttgtgtcttgataataccgccgccttttttgtgcagcttgacaacggcattctcatcgagagttggttctcggaacagagtgacaccgaattgctgaaactgatcccgttcttggaagcgcttagtcgtgaggtcagtttcaaatgatttaattgttaataataaataaaaaaatttgttggtatactgtgcataccgtatatttcttcctaccatttttctgtaattggagcctccaaacgacgttttggtggngctctatttccggggatcagttcccttctccccgtcgtttttttgaaattttccagcggatttttttt

SEQ ID NO: 12260 - DNA, 1510 bp, Heterodera glycines
cgtggaatgccattgcctaagacgttgaagccacaaaaccaatgaaaatacttgtacagtgtgacaatcacaatggaaattgaacatttaacgaattttgttggcccaatccacagccgtgccttttacacttgtggccttaattggcatatgtccatcgctggtgtcggtggctgggcagaaaacagaaagaccttactgtggaactctcaactgtaaccgggacgaaaacggtgggaatgaatgatgaatctttgtctcaaaaccccctgggggagggcggtcaacagaaaattttgccatttcaatccccagccatgaattcatttattttttggaattttaatgaatttataaagagaattagtcaaattttcataaatttctctctttcctttagcttatatgtaagcactgtttcccaaaaaaacaaatttgttcccatttaaattgtatattctaattaagagccgtggttgatgtactgcaacttttgggtcacgccgcgaattgattcgcaatggtttgttttggcagatgatcatctgcaggacagattcttgctcggcgcatttgaaggagaaattaatccaaatacaaattatgtgcaaaaccgtatcttgattgaggtcactttagtgtacgatagtatgccaatccattaaaaaaaaattcaaaattttagcgtcgtgttccgcccacggcgtccgtgtgccgacacgaggaagaggacgcaatcacgttgggcattacagtgtcacgtcaaaacaaaatacagtactataactggttcgggtcctttggccatggagggccacatccgccacccggtgcattggccactgactgagtgaggagcggagggaggagttgtgccgtgccgtgccgtgcaattcattgacagtgccgtaccatccattaacatgttcaaaattttgatccaaatgatctctgcacttttatgtttgttgttgtttatccgatcattttaattttacggggacaatttgcttatttaaatgaaatttaaattagaattaaatttggttgatgtgcatacagttcaatgcttaagagtatttgatcgtttcaattagtcttaacggctgcttctgatcagtggcaaaaagtgtgttccgtaagagagcgctttttgtgccatttcctcggccgttgacacgcgcacaaccaaacggaactctaatatcagtgtgtcctcctccgcgttgtaccatcccaagtcccggtcccacaatttcttaattagcaattaaattgacttaattaattttttgaacctgggcgaatcacctccattattctatttgtattttaaatcttcgagctttacttggattgcaaagttaaaattgtaatagaaatctcgtgttttttgggcaagggttgcgtgcaatttcgaaaattttcccccttttcgggatttttggtatcttttgccttcgatttcgtttttgtgtattgatcattgatcactgatcacatttttcat

SEQ ID NO: 12261 - DNA, 3031 bp, Heterodera glycines
aaatttttaattcacaattagtcatgttgctgatgaatataattatttttttttattattaattcgccaaaaatttaaaaattttggccatttgttaagtgacgtatttccgatttccgacatatttttgtgagagatgagaggtcgaaattccgattttcgatttcagaaatttttttcaggtatcgaagagttcctattttcacctaaaattttacgaaattatgtacccctataactaaactgaaattttaatttaatttatttttatttttacgagagcccggatcccgtctatctttttaaaacatttatccgtgagcatgtgtggttcagtggatagcccttctgctttttattattttcgcttgggttcaattccccagtggaatatgaaatatttcattttaattaattaaatattccaacttaaaaaattattattgtagaatatgctggaacacttttccacgcgataattcttttcatcttgttgcgaacaaattcgaaatgttgtttcaaagaacatttctcggtcggaaactaaattttatttgaaaaattaggcaaatggatgaaaataattattttttcattattcacttgccaaaaatttagaaaattttggcatttgctaaataacgcggacttacggttttcgacataactttttgggagggagaggggtcggaattttggttttccaattttcggtttcgatcaaaattccgatttccatccaaaatttacgaaattacgtaccccttgaactaaaccatgaaattttaaatttttgtcttttttttactcacaaattttgctgtccgtgtcacaatcaatatcgaaacgaaaactgattagtttttcaccatctttcaccatatgatcaattaacacacatgaattcagttgccatttaagtccactaaaaaaatttaaaaaaataaactttaggacaaagaaatatgcttaaaaacggtttgaaattaaattttagaatttttcaaaatttcaggtcaaaaaaatattttaagggtctgggatttccctgtttttgtaaatcctttttagcctccgattacgcccctgatttcaacgctgtcaaagctccgtttactgtcgccagcaatttgtctcgccaattcggcaaaattgtcgattttctgccgaagcgttgcccggcattcgtaattgcgtttggtggtgggaaattgggccacaaattggaggggacggcacagcgcggccggaagagtacggcacgtgggcttgggacgagaacggtgccattgcaaaatgctggacacctcacactcggtgagcagaccagaaggaactggcaaaaaaaaaaggcattttaagtgtaaaaaacccaaaatagtcacaaaaataatatcaataggtcattcagtaaaaaaaaaatatcaaattttctggggccagtaggaatacggtattttatatgggcggaaaatggcactttgttgaaaaaatgctctaaaaacggtcacgaaaataattgaaaaagccattctatgataatgtctaaaaattttaggatttgagagatacggtagtattcggggatacggtgtttttaattgataaacagtccaatttagtaaaataaaattctttaggtccgtaaaaatacggtatttatgtgggcggatacggcactttcgttgataaaaactccaaaaatagtatttttagtgggaagggtaagaatacggtgtttttggaggagacagtatttttgtgttattgtaaaaatgtagatcgtataagtgattttgaaaaagcataccgtaattgcatctaattgaaaaaatgagtatcaacactagctaggtgtacggtatttgagtataattttaaaatgctggctacagtattgaccaatttgagtcgaaaaatccgtttcaaagatgcacgggaagcggattttgtacagtgccgggccaagcattgcacgacgattctgtgccgaacattcagtatcattttgacggcatttttcgtcggcccaacggagagcctttttaattaatttaaaaggaaataataaaaaactaaattaaacaattacagcctcccaaatgacaaattctccagcaatcagcagttgatcacgcgaaagaatgtcgcacaataagctctgatcaatttgcaaaaatgcgtccgattgaaacaatgcgtccgcgttttgatcaatgtaagccaaacattggtcggcgaaatgccaaaatgggaaatgtcaaatataaatttaaaagaatttgaattaaaaaatattgggaaaatgtagagtatcactggccaatgataagataattatttaacagtttcttaaatatttcaaattttttaaatttggatttggctttaattgtttttttggaaattaatcggtaaaatgtgaaaaaataagggtaaatttgaattctgctgcttaatcccagagatattgtcctgtttccccattcaagaatttctaatcctgatcgaaaccctaaccctaaacttgtgatccgaatcccgaaaactcctattttatccctaaaattcttctgtcctcgtccgattccttcccaagttttgtgatcccaactttttcctacacacattttcaccaagaaagtgcgtctccgcaaatgcgaagaacacattttgcagctgaccaatgggaaagtccaaacatgctctgatcagtccgatcacattatattttttggctaaatttatttaaaatgacaaattttaaataattttaaatttattttataatgcttttttacccgcataaagcacagcaatggcattttgaccattcaattggctcagatcagccgaataaataaagcgaagcatcgctttgaacgcttcggccggcacatcactgatcggcaccacatttttgtggtcatttggaacagaaaaagtcaaacatttattgataataattttaattaataattatatatgtataaattaatattaatacactttaatattaatttttattatt

SEQ ID NO: 12262 - DNA, 1034 bp, Heterodera glycines
tggttcgaatcaaacggcaaatgccgcgggtcatatggataggaaattttcaaaaatttaaccttaaaaaactttaaaattttttattatttgagtaaatttaaataaattttctccgattatgtggccacctcgttgaaactgttgacccaatcgaagtttgattgtccgttcaactcttcgtaacaacgcaattgcttggccatcagtgcgcggaatgtgcaaccatttggacaacgcttggccagcatttaaatttggcccagcattagcgttcaaatcgggcaaaagataattggaattgatccaaatcaattggtggcaatcagtgagaattgtcggtgaaatcagacaacgcaaattgtccaaatgatcgccatctttgaaagtgaaatgttaaagcaaattttgttcggcatcggacggtcgaatacgacggatgattgcgccagtggggaggggggggggggggggtgtttcgggaccgatttttcatacgaatacattcaaaaccgacaagcaatttaggttttggtccaatgtccttgtgaattttaatctctctccaaattctcaattctctgcgatcaaaatgcgcgtccattaaaccatcaaaacggggcgaaagaagtgccaatttgaggccgagttgaggacggcgaaaaagggggaaaatgtccatccaaacatcgtacaaatccaactaaaatttgttaaaaatatttttcaatgagttttaaaaattaattgttttccatggttgatgtaatgattttccaagttcaaactcaaaagggtaccccaccccccccccccccccccccaatacggttttttggcttgggatacaccggtgggggctatagtttttgttattctatttaagataatattttttgtgcacaataggttaataaaaacttttttttattaagggagacgcatttgatttctgatgcctactggtcacaatcaaattaattaatgatcatttgcctcaaattttcctcaaaattcaattttccattttcttt

SEQ ID NO: 12263 - DNA, 1323 bp, Heterodera glycines
  misc_feature (120)..(120): n is a, c, g, or t
ggggggggggagttgggaaacccgatttccgaaaaatttcgctaaatttgtccgaaaatcaacaaaaattagcaatcttttgatgaaatttgctaaaaatatgcaaaactttatgtacgnccattagcccatttttcatggttgggaaatgatatttgaatgaaacaacaaaagggtaccctcattacgtttttttggctttgagtgcactggtggggggccttttagggttgagtccgaaatcattaacccaaatttttttattatttatcatttgtctcaaacggagagacgatttaaaattagaagagagctgcagcagaagataaaaatataaaacaactgaactgaatgagaatgaatgatgaaaagagggatggattttgggactgaattggatgtatcttgaattttactcttttcttgtttcttggcattttgttaccgtcaggcatttcttcttaacactttctttgtcttttttcttttcgttttctttgaaggtaaggcctcgatccctctcttggtattttcttatcgcacagcgtatctttggtattatcttgtttcttggtatttcttatggcccagcgtgtctttgaattttactctttttcatgttcattggcattttcttttggcatatagcatttgccttgtcttttcttgtttcttgcatcttaccgttaggcattcttggaaggtacaggctcagaagcttcgcggcctcgcacctttaagatactatttttcggcggttcctgtcggcatcgccgcctcctttgatttgaaataaagtagagagcggtattttgagaaaatacggataagggcaagggttacgggcttgacatcaatacgggttacgggcttacgggctaaaaacccgtaaaacccttaacccgtaaaaacacgtatcggccgaaaaaaatacgggttacgggcccgtaaaaacccgtatacgggtccggcccgtacccgctctctaaaataaagtatttttattaatccgttggcacaatggcacgtgatgttattggcattggcatggcctagcccaggatatctatattcttggtattattccatgtttatatctcatgaacacaaacacggaaaaaatttttgattgtataattaagcctaaatataaatttaatataggttttccgaaaaatagtaatagttacaccgttatttctacaaggactcgagatttttaattacgaatttctttttatttaattaattaattttacaaaattttctagtctatattaatttttttattttttcattaattgaataaaatcaggcgtgaaa

SEQ ID NO: 12264 - DNA, 658 bp, Heterodera glycines
  misc_feature (88)..(88): n is a, c, g, or t
catgaggaggacgatgacgaatttgcggcaccaccggctgccgaggacgccgtcaaacttctgaaaattaaaattatatcaaatattntagttgaatttttaagatattaaatttatttttaattttttagtttataaattttacgccattatttggaattttttcacccttatttcacgattttttcgcccctatttaggtacataagtatttgggttttttgcccctgaaaatccgccccaaaatggtaaataaagataaaaaacgataaaatgaaaacaaatgaattaaaatattgtattgtctttaaacttaattgataaatttaaaaaaacaaatttaaatttttgcaatttaggtaaagcacaatttttatttcattaattttcaaaatgaaaaataaataattaaagaggaaatcattatttttattttaaattaccttccgatttgttgcgacttttcgtccacaattggctccggctgcttgcagatcagaaatggtacgtagaacatttttgagcgcagcagaacaccggacaccgtctgaagcattggaagccttgaaaataaaaattaaataaaaaaagaataaaaaaattagaaaataaataaatttttagcaaattagttagtttgaaaacataattgactcta

SEQ ID NO: 12265 - DNA, 2831 bp, Heterodera glycines
  misc_feature (2412)..(2412): n is a, c, g, or t
  misc_feature (2428)..(2429): n is a, c, g, or t
  misc_feature (2450)..(2450): n is a, c, g, or t
  misc_feature (2452)..(2453): n is a, c, g, or t
  misc_feature (2461)..(2462): n is a, c, g, or t
  misc_feature (2471)..(2471): n is a, c, g, or t
  misc_feature (2484)..(2484): n is a, c, g, or t
  misc_feature (2489)..(2489): n is a, c, g, or t
  misc_feature (2500)..(2500): n is a, c, g, or t
  misc_feature (2520)..(2520): n is a, c, g, or t
  misc_feature (2522)..(2522): n is a, c, g, or t
  misc_feature (2529)..(2529): n is a, c, g, or t
  misc_feature (2534)..(2534): n is a, c, g, or t
  misc_feature (2538)..(2538): n is a, c, g, or t
  misc_feature (2540)..(2540): n is a, c, g, or t
  misc_feature (2554)..(2554): n is a, c, g, or t
  misc_feature (2559)..(2559): n is a, c, g, or t
  misc_feature (2590)..(2590): n is a, c, g, or t
  misc_feature (2592)..(2593): n is a, c, g, or t
  misc_feature (2616)..(2616): n is a, c, g, or t
  misc_feature (2644)..(2645): n is a, c, g, or t
  misc_feature (2649)..(2649): n is a, c, g, or t
  misc_feature (2687)..(2688): n is a, c, g, or t
  misc_feature (2695)..(2695): n is a, c, g, or t
  misc_feature (2697)..(2698): n is a, c, g, or t
  misc_feature (2700)..(2702): n is a, c, g, or t
  misc_feature (2704)..(2707): n is a, c, g, or t
  misc_feature (2709)..(2710): n is a, c, g, or t
  misc_feature (2712)..(2713): n is a, c, g, or t
  misc_feature (2715)..(2715): n is a, c, g, or t
  misc_feature (2725)..(2725): n is a, c, g, or t
  misc_feature (2731)..(2731): n is a, c, g, or t
  misc_feature (2735)..(2735): n is a, c, g, or t
  misc_feature (2739)..(2739): n is a, c, g, or t
  misc_feature (2769)..(2769): n is a, c, g, or t
  misc_feature (2771)..(2772): n is a, c, g, or t
  misc_feature (2776)..(2776): n is a, c, g, or t
  misc_feature (2781)..(2781): n is a, c, g, or t
cggcggaggcgcggaagcggaaggggaggaggaggaaacgccggaggaggacgcggaaagggaggagccggccgagagagcgcaccccgcgggtgaaaagcactgaaaggccggggaaaaagcaatgaaagacaaagttaaaatggcaattgtcggaatgattcgcaaatgatacgcaattaagtcgcccctcccttttgttgttgccgctaattacctctcttttttgttgtcgcgcaacaattaattgattgattatacctcaatttgctgttggccttcgccggccccggccgcctcgcaaatggccaacaaaagcacgtcccaatagctgggcggtaccacttggccattgtccagcccaatcgcgtgctgtgccccaaattcggccagcaattcggcgccgggcgccgcgtcatccgccaaagaggcgcaaagggcggacaaagcgtaggaaaagcgctgaaaatgaatgggaaattcagccaaatttcgatcggaaaacagttttcaatttaccattgtaagaactcgaaattggggtaaatttttccaatttctgtcgttttgtcggaggactgtccgagcgaatgattcattgcggcgaaaggtccgttcgaaaatgttttcactgagtctgaaaaagagagtgaaaatgctaaaacaaattttattttatttttatgtacagtaacattttcctaccgtaaaatgtccgcggcggacaattgtcgccaccgtgccagaatcagccttttttgtggcaatgtcagtgcggtaattggacaaagcatgcccaactgttgttccatggcactgtttgccatcgcttggggccgcagacggacgccggcgggggcggtggacggctgagaggggccaactgagtacgggtggggcacactaaaaagggcacatttggcattttgtttatttatcttatggagaagctaatcaacggaccatctgccgtttatgtgttggagtcggaaggattttgcgcgacgtccgtcgaaggaacgccccgcggggcgttggcggcgaatgccatcgcccaaacggccgccagtgggtgcgacggcacaactgctgaaggcactaccgcttgtcaaatttgcctcgtcaagcgaagcgttgtcgctcatggcatcggccaaaactatcgctaccgcgtcgggacggtccgcggcacagccaaaagcgacggatggacgcccatccgaccgagcggaactgaacgaggccaaacgaatggatgagaggaatgtcaaactgatcaactgatgaccaacaactgatcagatcagatgccacaccggtcgcttttggttgagccgccatttcgttgggcgccgctccgaccgctgccgccgcgccgctttgactttgccgtgccggccaccgcggcggaaagcaccgcccccgcggttgccaaactggccccgttcatgtcatgccaccggacctccaaaagcggaaattgtttcatttcttgctttcaaatcataaaggcgtacggacgctgcgactggggcgacaggacggagaggagtcagtctggtcaactgatcgctgtccaccgccgcggagcggatcttcacaagcaacaagggatcagcctggtcaactgatcacctcacagattttacgattaaccaaaatcaaccgcccgcctttctcagcacagacaacccggaatgaggcataataaataaaacaacaacatacaggcagacttgcagcaactgaaccccccgacaactttgctgtggggagtgtcgcgactcacgtcacgagaaataaaatggaaatgataaattttataagcatgatgcaatttcattaaaaatgggaaaaaccttaatttaattagaaatgttccccctcttcgtcgttctattcaaaaaatatttgtttgtttacattcaattcttattcatttctcacacaaaaatgtattaatcagcgaatgacaccctatttaagtcgtggaattgttattgaaatcggttcagtcggaataaaacatcattcccctgcttgtctactgtttgtcccaatttctattttgccaaaatttttgccgggccgaatttgcctctgtttggtcccgacagcgactcacgtcacgagaaataaaatggaaatgataaattttataagcatgatgcaatttcattaaaaatgggaaaaaccttaatttaattagaaatgttccccctcttcgtcgttctattcaaaaaatatttgtttgtttacagtcaattcttattcatttctcacacaaaaatgtattaatcagcgaatgacaccctatttaagtcgtggaattgttattgaaatcggttcagtcggaataaaacatcattcccctgcttgtcttctgtttgtccccctttctcttttgccgcnttttttgccgggccgnntttgcctctgtttggtcccgncnngtggtgcnncggccgggntcctctgccctgntggtngcttgtgttcngcgggtggccgtcgctggtncncgggcgnccggncggngnggtccgtctggtcngctgntcgctgtccgccgccgcggggcggttcttcncnngccgcggggggtcggcctggtcngctggtcgcctccctgtttttgcggttnncccncgtcggccgcccgcctttctccgctcagacggcccggnntgcggcntnntnnntnnnncnncnncntcccggctgncttgcngctnctgntccccccgtaaaggtgctgtggggcggtcncnnctcncgtcnctgcttaaatcgaggaaatgataaattttataagcatgatgcaatttcat

SEQ ID NO: 12266 - DNA, 1434 bp, Heterodera glycines
  misc_feature (60)..(60): n is a, c, g, or t
tttcaaatcataaaggcgtacgcccgttgcgactgccgccactgccacgcgttcctcacngatgcggaagtacggtggtgcggctcatcgccaccgtttcctcggccatgcggggcatccgctgggcggccaagcgtgtgcagcagcaagcggaagcggcggtgccttcggacgatttttgtgttagtcgacgcggcattcgaatgaatttggcggaaattgactgaaaatgaggaaaatttatacggatgtcattggtcttaatcatttcttatctcccttccatctcttccccttttctctttccctcgaattttctctttccccctcccatttctcttcctttctttccctctctctttttctccttttctctcttcccctctctctttctctttcacctcttcccttctctctttctctttcacctgttccttttcctctctctttccccccccttctctcctttcccctcccttttctcttcctctctttccctctctctttctctctcctcctttctctttctcttcacctcttctttttcctctctctttttccccatatttttcttctttcttctttcctctctttctctttcacctcttccttttcctttttgtcccccttttcctgcttctgcttcatcttttgcttctcctgttccatgctcgtgttcctctgctttatttgcagctgttccaagtgttcgctgcaacttcgcttttcctttttcgcctttttcgactgtcgcaattttccactgcccacgtgccgtcccgcggcatttgactcggcatttcccatcaaatatttatttaaactaaaataatttcctttataaaaattattttgttccattccatgttcaaagtgccgcaaatggcgataaactcccgggggcaaatttattccatcgatttttcaagcggaaaattcccccgggcgttagcatttttaagtgcttaacatagaaagcaaaagtcagatgaattacaataaacaaaaaaaaagaggaaaaagaagaaaaaattaaacggaaatattttgatttaataagtaatattttcgaaatatttctttttaattagacaaattttgatttattttatttgtttcttttattttattttaatttttctcattaatttttgccctccgttcgttcaaatggcccataaattttgccatggactgataaaaaattcttttacccaaaggaaacgtaaaaccgtgaagggtttcgcgcccgcgtcagcacatttaatcctttcggaggaggacaataaaaaaggggggcacagaacaaacaaagaaaaaaaggaaaagcattgaagggaaaaaggaaaagaaagcaggaaaagaagcaaaggaaaggaggaaagggcttttgggttttgcccttatcgcagcggatgaaaacgaagccttgaa

SEQ ID NO: 12267 - DNA, 1550 bp, Heterodera glycines
tttgtggcactctaggaagaacatataaatttaaatggaaagataaattcttcatggctctttttaagtagtttgattttgtgtcataaatatttttattttatgtataatataaacaaaataaataaataaataagagtaaaaagacaatattttgggtagaaatttaaattaattagaaatttaaatgaaaatattatttaaaaatagaagtacaattgatttccaaaattgcaacatcacaaatcaaaaataattttttgatcaaaaaggacatttttaaaaacataattccaatagctaataattattttattcaacttaattcaatatttttttttactccaattcgcaataatctgattattttaggcgttttggatgaacttgaaatttggggccatttttgatttttttattttaattttagaataaattaattgtgctcgtccggaaaatttttgaaattttgcgtagatttgtcaacagttttacctcttttcgctcctttttaggtcgataaaacagcgctcatttcatacagaaatttatttttacgtttcgtgttcactaatcaaaaacaaacaaagaaacagcccaaaataaaaaaaagaattggtattttaagtttaaataggagagacatgagagagatatgtacaaatacaacatataaaatgtcaaattgagagaaatgaaacaaaaatgtcagaattatttaatttgtgaattttctctatttatctgagcttaaactcacaatgcaaatttcaattatacaattatatttaagaatatatttattagcacaatattcattataaatttataatagtaatttttcaaatgtttggcaattaattttcccattttctcgactaaaaacccttccttataattcatcatcttttttctgctgcttctcattcaaaagaatttttattttgtggcggtgacggcgataaacaaatgcaaaggaaattttgaagaaaaaggggggaaagggagaagaggaagaaaaagggagggaagaacctgctgagagggaacgaaattggggcggagagcgccggggggcgagcgaaggatgcgggggatagggggtgcgggggggcattctggtcggctccgtccttttccctctctattctctgttgcccaattggatgatcggcggattaacttttttcatcgccggttacactttccaggccaacaatttagccaccgctttcatccttctcaaccgacttaccgcgattgccgtcccattgaaacatgacaaagtacaggacttgtcccaagtctccccggacatacatatcttgctcataactagagcaaagatttttaggagcgacaaagttggggggggggggagagtggaaagagataatgagagaggaagacaaagagatggcgagagagtgtggcgacctttctcatctgtgcccctcttccctcatccttttcttctttttctacagggtgcctccagcacaaccaccgccccactcatcgacgagtgtcagccggcccccccccccccc

SEQ ID NO: 12268 - DNA, 1210 bp, Heterodera glycines
ggttcaaattaattttttgcggaaatgggaatcgtaatttttttccccaaaaaatttgggaaaaccctaaattctggccggtcccctcgtgatgtccccaataaaatccatgtccacattttgttccctctgtactacaatatacaaaaaaattcttgttcctactataggcccaccgaatggatcggctttttgattaaatgacaattaatttatatttcgtttccatgactatatgcaaaaaggcttcagttttaggcacccataaaagcgccataataggcacaaaatggagaatcaggcattcacccccccccccctcttctcattccattctttcgtccgcccgttttgctcccccccccctcccctctctttcctccgccagtcgaaggtgccaatcgataattgtgcattgggcgggggaggggaggagggatttgtgcgtactttttgtccacgacgaatgctgctgatcatcgaactgcaccagcagcagcaaaagcgaaggtgtgcagctgcgacgggcgggcggagaatggctttgtttggtttcggcttcttttgttgttcaaatgcctttgaacaaatcgcaaattgtcctcccatcgctttggcaccgtttttcggcacacttttgctttgtttgtttgttcactaattgtccatttagtacggtcctcccctccctccctccatttccgtcattttttgtccactttttctctgttggtccttctcactctttctctccccccccattccttctcactaacccaaggacgtccttccgtcgctctctcctccgccttctctcccactcattcccgtcaaattccatggcggtatcctttcatttttgtctctgttttataatatctgattagtctttgatctaattgatattcatattaatctgatctcctctcatccatcccttctgtcccccacctctcattcacttttttttaaactttcccttcttttttgattgagtttaactctctcctaccgtacccccgctcccatcctacagtactcttctgagttttccctctcattccttctcccctcctccctttcccctcacaattcttctgctgctgtgtcgtcgtcttcgtttggaatggcccttctcttctctttggttgggcaaattttcccatcaatcagtgcgacgggggggggggggggggggacaccccccccc

SEQ ID NO: 12269 - DNA, 3419 bp, Heterodera glycines
tgactttcccttcttctttcccccggttcaatccctctacagaaagtaaaatattttgaattttctttttgtatactcatggctttcctatcgacaaaatatgattcctcatagttttattttaattgacacatttttatcattttttaaatgcaaatcctaccaattgagcttaataatcccaaaaacctgaaaatatggcaatttgtgagaaaggcttaagaaagtttaatatagtaaaaaatggttacgtgttatggagggcgaacctcccattttattcactgcagcaaatacaccgcggaccgcagcacatttgtggcccttgaattgaagggaaaaccgttttcataattaatcatcagggctgccaaaagtatgcaaatgcatatttttttcctggcttctccatgctctaaatagtacgaaaaacactttcttttttgtgtttgcgtataaaaatcgggacttttatttgcatatttttgcttgttttacattctcatgcatattttaccattttttgtgcatattttccgattttttgcatattttgacatttttcttcaaatattttccgattttttgcatattttgccatttttcttcaaatattttccgttttgaatatcccttaagtaaattttggcagacaataggatggagctttagtgccgaaaatcttgaaaaattattgattttcaattgcaaaaaaaaccgataaaatttatgaggaataaaaattttttattggatttgcacccctaattttcaagtttttttttgtgcatatttggtgcatattttgcgatttttgtgcatatttggtgcatatttcacgactttatttgcatatttatgcgcatattttggccacttttcgtgcatatttttggcagccctagttattactgtacgttggaaaggaataagaccaacatggtattcaatatcgtgggaaatgcccccccccccatgactaagaccttgaacaatcttgtacttatctcccataaccaaaataattgaagcatttataagtttacaagactgaaactttggttggttttaacttgatcaatgaccaataccctagaaatcttgtaaatattaccatggtcaaaaaacttggaaaattttattaagcttgtacaaacctatgaccaatattttatctatataattgtacatcatatataatgagaatacaaatgattcaatggcttttgataaagcttaaatcttggcgctgttaaattgcttagttcttgaatctccgatcgtccaactttcagatgtactggacagatcgacggctggaaaaagtgtttgctggcagcagcaaacccaaccaaagctccatgatcctttccccggtcactgttgttggtgatctgcaagatctgactgatctggcggcatttgacgcgttggcacagccaaaggccacttcgccgtgccatatcagtgaaagtcttcgaaaggtaaacgaaaaattttttggaaaaactttagtagttcatcagaaaattttgaaaaacaaaaacgctgaaaattttcaaaattatgaaaaaatttactaagaatttttctttgacaaatttttatccattcataaattttgtttttcgatttgtcccaaataatattccaacaatttgatgccattctttttggttttttatatttgactgttttagtcaccttgtcaacaattgtgcctggccattccgggctcatcatcgccaaactgtgcatgtgccaagggggtgccgaaaggacgaatttgtgacggtattatataattattaaaaatcattaaataattcattaaattccaaattttagagcccgacacattcatggtactttattattttaattatatttaatgattttaattaattattttatactatacaatgaatttgagtttaattgtttgtttgtttgtttttggaaaatgcgtcagtgatactgtattcattaggaaagggagacacggtaaaatgttttactgtttgagaagcagctctaatatctaataaatcatttttaaacatgtcgttataaaatttcccaagacacgaaagatttgggtatactgtagcggggtgtaatataaacaataggttatcattgcggggacccacgcgtttcggcgctcccgtttcggcgccgcaaattttgaaatgctataacttttttatttgtcagtcaactttagccattctggcatcatttgaaagctctatgtgtgctctatatttacatgccaaaatagaaattaatgattcaacaataaaaaagttatggcacgcggcgccgaaaaagccaagaaaaagtcaatttttgaggttttttggccataacttttttataaacggatgaaattttttgaaattttgcaggctaatagagaatctcaagagctatcgaatgataataaaaatatttaatttggttgataatgaaaaaagttatttgaatcagcgccgaaatggtccgcgccgaagtggccggttccccaaatacattcattatctatggaattaattgcagatgttcattgatggggaccgtattgtggacgcaacaattgtgccggacataaaggctagcaggtgaggggaatggcattttttaaatgcacaaaaaagttattgttttttttaaatttaattaatttcttttttttaatttccagccctttgcgcgaacaattcccgcctttcccgtccattcaaatttttgatgttgacgtgaatttgcgacgcatttatgtggccactgatgcgccaaatggtgctaatataaggtggaaatttattttacattgataaaatatgctatttttaattttcttttttaattcaaaaaaagaatatttaaaattttattattatttaagaatttaaatttcacaattaaaatcatttttttaatattgcatttaattaaacaataatttttcaaatcattaagcaaattatatcaaactaagcaataatttgttttaatcaattcaatatattatttaaaataaaattgctgccagtatttaaaataatttatcagcatttaaaaaaaacaacaataaaaagttatttttaaattatacaatcccattaaaaattatttttaaaacttttaattcaaaaaaataaatttactgtttgttgccagctggttcccaatgagtcagccaaagcaaatccgccaattgatcaatccggagcgtctccattcgttggaaatgcaaatgggcagtcgccatgtgtccgacatgcgctatgattgggtcacacaaaagctgtactggacaaccggaagatcgggtcaataattttttgttaaataaattataaaattttatacaaaatttttaaaaacattcatcggatcaaaattttaaaaaa

SEQ ID NO: 12270 - DNA, 3457 bp, Heterodera glycines
tttttataattataattacgaaagtctctgtggagctcatacgatcacctcaaattggcacgtaattgaggaaagaattgccgcaatttgggcagccgtgcgctgctcaaatttgttgtccaggatcagttcggtgatcagaagttcctggaaaagggaagatactttaaaaaaaatgaattaattcaaaatcaaaaagtggacaaagaaaatttgataaacatttgaatttttaaaatttatttaaaaacacctgtgaaatgaattcaatttttaaaaaataactttaaatttcactccattttggggcccacaataatttatttctcacaaaaaaacatttaaaaattttatgccaggaatttaatttttaacaatttattttcttcatcttattgttagtccaacaattttgattaaaataataactacaaatttggaaaattctacagaatcataaggggaaaaatgtttaaaatttaaaaatttccatctaagaaaatgtaatttgtttaaaaaacatttaaaatttaaaaatttagtgccaacaatttccccccccccccctcctcacttggttgctgatttcgcacgccactttgcccttgaggccgaccatgttgtgccggtcaatgtaatgcaacgcttggagcaccttcagccggtccacgtactccttggagaactgcaggttgttggaggacgtctcgaaggctaaccgccgcttttgctcctccaatttgcaccgatgggccatcagacggagctgaagcacaaattttgaaaaaaatgaaataaaatttatccgcctcgtaagaattgaagtttttcaaaatttatttgattttaatttaatttttcccccctaacaaaattgcatttgaaaacgtaatttatatagatagtatttattcctcgaaaaggaaatgattggaccgtctaaattatgtgatttctcacatgttggccaattagtggacactttaggcaggggaacagcgcctcgggctccaccaccaattgggcacggagttcgcgcacctgtgcaacacaattacatgtaaagaaattagatgttttattattgtagaaaaaattaaaactgaaaaaattttcaattaaaaaaataatttcggtggaggggggggggggcgaacaattccaaaattaaaaaaatttggggacgaacaattccaaaattaaaaaatgttaatttgttcggctcgaggcgagagagagtgagcgctaaaacggaggggcagtctctcgcaatgcgattgaaaattgaaattactcccccccccatttcggcacagttatttattttacgataactcacttcgcgcagccggtccaccaggtccacgtcacgccggtcggtgtcctggccaagcacgtagaccagctcggacatgtctgatgaaaattttgttttttcgatacagagtcttgaagccccgagacttgggactcccaatcccgagagagaacccaagactattccaagggacgatttgtacaattaggaattcaaaaaatgtttcaaaatttttttttgacagttttccaacaatttctgtgtcgtccgtcgccgccaagactgcctacctcgccttttgagctgttgctgctgctgctcgaagcggtcgctgagcgtctccaactcgacgagcagtcgccgcaccgcgcggtccggcgactgggcacggtacggtccgctgatgcgcctgtgctcctccagcaccgtgtccacgctcagcttggcaatgctgcgacggcacacggcggtgagactgcaaaaaatgaattttcagggagtatttggacattcttacagccgtagaaaatttttaaaaaatcggaaaatttccaaaaatttttgttttttccgttttcagtatgtacctgtccaggccgacgtcctccagtatggtgaaaggtgcctcgcgtgcaaatgcgtgggccggcacaacgccctcggggccatgcagcgcggcatggctcaacaggaggccattgcggtgccattttttgtcctaaacacacataaaaagaaattttgtggcttctcgcattcttaaaaatccaaaaatttgtttttttatgaccattttgttcgaatttggagggttagacattcggaaatcggttgaatggatgtagggatttatggtcagcgaccccgaaatgcccaaatttctggaccccatccaatttttcttttagaaaatcaaatttaagtcatttttatggcggagttttcggttttctgaatttttttattcttggaaaaagggtaaaaattccatgagaattttttacaaatttttgtttaagtaaatccctttcccgttaatccttaagccattcttcacccccccccccccccttcacctcttcgctcaacgcgtcgtacgctttgtgccgttggccaaactcggaaaatttgtcgccactgttcggcacgaacagcgtcagcaggaagtgaccaccggtgtcagtgaaacgggcctatattttgtggaggaaatgaaaatatttcaaaaaaaagaaaatattatcaaactctaaaagcaaacaccaacctttaaaacaacagccaatctgccgacaatggacaacggtgcgtaatggacaaccacctgccaaagcattgtaatcagttacataattaattgccaattaagcattggaaataattaatcaactgattaatggagaaggaggcaccaccatacataaaataggggtggggtaaatggagccaataaatttttttttgatttttaaaatttttgggggacatcgatttttccatttttgggcaaaatatccgtgccatgatggagtcatgaccaagcatgttaactacacgtgtgccaagggccttggccccctaaaaccgtgatgagtgagcattaattgtatggcactgaccactcggccaggcgcgaacagtttgtcctcgcgcccgcgctgcaccaccaggggccatgtggtggccaacgcgtcggcatagcccaacaccgtctcgaaatacaggcgcacggaggccatggaggaggaggaggacgacgatgtggatggcacgctgtcgttatcgtcagcgggtggcattgttggacaacaatttgtggtcgtggcactggctgtgccgtcggcggcggcaggaggaggagagggagcagcagcagcacaatgggcacattccatggggggcaaggcgtcaatttggtcatcaatctgtaagtgcaattgtgctgtttatggatgagtttcaagcaatttttttgtcacacagacaaattcagtagaattttgtgattatttgcacccctaaaaatacaatttttttaatcaaaatgtagagagagagagagagagagagaaaatggaaaagaaaggaagaaaaaagagctggagagaagagaaaaggtaggagagagagagagagaga

SEQ ID NO: 12271 - DNA, 1599 bp, Heterodera glycines
tttttttgaaattttcaagcatttggtggtgtttttctacctgcacatactccgtcgggttcagaaaccgcttctggttgccgtcaaatttttcgatggtttcaaacgcgacagttctggccggcatattctgcgcaaaaaaaaattttggttaaattttcaatttacaaaagtagcaaaatttaaatatttcaaaaaaaaatgtaaaaatattggaaaattttttcgtttccagaaaatattgccggaaaattttaaaaaatatgctcttcttttggctttgccaaaaaaaattgtaaaaactgtgccatttttatcggtaaattttttcggttttctggaaatttatctgtgtgtcccattttcattacccatttattaataatggttttttgtttgactgaccacgcccattgcaaatgtttcggtggcgaacaaaattttgacgtagccccgctggaagagcagctcaacgacctccttgacaatgggcaaaatgccggagtggtggacggcaaagccacgcttgcacagctcctgcatcagcaacacctaaaggcacacaaaaacgattaataatggcgcttttcaataattggtgggtaggaaacccgaaaaaaaccaaagtttaatgccaagattagagtgaaaaggtaactggcccaaaaccggcatcaaaagcatggaaaattttgaaattggccggtaaaagcgtggataaaatgccgcgagcgcatttcctccatcataaaaaattgagccagcatttttttttgttggaaaaatcacaatttttagaatgtttccttatgaagcttttttaggatttcagcaaaaaaaaaaaaaaaatacagccctatcgaattttcgctttcagccttccacccccccccctcccgcgaagccaagggtttggctggttacgcccttgggcatatttttcaaaaaatcaaggacacctgatacataccagggatggggcgaggtttcgcatttcgcattattcgcattttttagcgtttcgcatttcgctttttatttttcaatttggcccatccctgatacatacctccctccgccggtgggtaccgatgagcggacaatttattttttaggattttaacgatatttgcaaaacaaatttttgcccataaaaaacgacgggtgataataacctgcggcaacattttgtcggtgcccttcagccggtcaatgcatttggtgaagaagcggtggatggccgacttctccttctccgtggtcaagtccaccgattggagcagttgcgcggtgtcgtcacagcgttggcgcgaaaaaacgaacacaaccttaggggggaggaaggggggaatccggcatcagaatccgcgaatttgtaacggatttttgggatttttattttccacgcctcagcctcccccccccccctctccgctcttagtggtcccaccacaccaaaatcatataaaaaattgaaatttcacaaacatacattttttaggggggggttagcagcgaagggggggcggggtgaaagaggtggcgtgagagggttcgcagcgaggtggggggccgcacattgtggaaattttcttatca

SEQ ID NO: 12272 - DNA, 3224 bp, Heterodera glycines
acgcatgcttggatatcaatttttgacaagaaaattcgttgaaaatattttagaaattaaaatttttatatttttgatgcggtggaagcgtgggacatcgtttatccgttttagttttacaatttgtcaaacaaaaagttgggatggcttttaattgcataatcataattcagccacttcacggccaccaacactgcaacaacaacaaaatacgccttccacaagcggaacaacaacttcttgcattgtcaaaaatccgtcatcctttcacccgaaatctgcaccgcctgctgagagaaagcgcatgaccggtctgccgccaaacgccaaatcaaagtgcaaaaaccgaatgagcaacagcagcgccagcacaacatggatgccgaccgccagtggtggtggtggtggcacgcaatttggtggaccaatcgcaatgccaacgacgacgacgatgacagtcggtgacggcgcacctccaccaacaaaaattcggcgtaaagaaaatgatgggggagcgacggctgcagcaacagaaacagaaaacatattgtaattagacaattagtgggttctattagcacgaatattttgtggtgatcccggatttggtggctctttattgggttttaaattgttgtaattttttgattttcggttctacgaatttcgttcatattctctgatatttacaaaaatgtaaatcgggatcataaaattcccgttcacctatgcgaaaaatggggtacaattctttaaaatgccacttttttctctgaaaaattcttgtctttgtgtaatgaatggatgctaaatttttaagtttcgtttccagcggaactcagcagcatgctcaaccgtctgctgcaaagaatgtgatcatcactctgaatgatgatgacatctttccgatcaaccgttcacatttcaccaaacaacatttttcaaatgctcaaaaaacgctggcatctccacgacaaaaggcgccgcaaaaacacactcataccccacagacgacgacaaatactgctgctggtacaggctgtcaaccaagcagcgatacttctccaatgcctccacgaccaccaccaccttcattcactggcacttcatcatcatcattgtctgcttctgttgctgctgcagttcaccatgatccgtgtgccggcttgccacggtccgctctctccacaatgatcgctgcattatcctcacaattaagccatcattatcctcatcaacctcaacaaccgtctctcgctgtcattaattcgcatcagttacataaacaacagcagcaacaccagcaatcgtcgtcaatgacgagaatgacgacggcggtgacacagccaacctgttcttccccctccattgcttcttccactctcttccgacaacaagcacaacaacaacaacaacagcatcatcagcagcagcaacatggaattcctccgcttcaaggccaacaacaacatgttgttaacccgcaaatattgtcgtcacaacggaataatgctgaacagcaacaacaacagcagcagccggatttgttgcttagtcatctggtgaatatgcaaacagttgaacagcttcgactgcttggtgaacgttttgggcttaactggagcaatggcggaaaacagcgcaaatgagaaaggaagctggacaaaagccataattgtaagcactgaatgaattcaaatgactttttatatttgtattgtttatttatttattttttttcatataaaaatattcaggtcgaacaaactctttttttctttgtatttgacacagcgtccggaaactgagcccctgtaccaaaaaaggtttgcatgtgtggctcagtggtttttagaagatagtaaagggacaaaggacggaggttcgaatccgttgtgcaacatgaatacctatttttatttattttggtccaaaaaatttaaaaaaatacaattttcagtaattatttttgaaggtttttggcaaccaaattggacaatcttggtatcattcgaaagctcttgatgaggataaacttactaagcaagtgctaagcaatttgacatctcagaaaagagtagtgagagtttcaaattttcataatggtttcatgcaaaaacaggatgtttaactcaaaaaagtatttgatacgttctatgcaaaaaatttttctctatcggtgtgcaaaatttgaagaagatttaacaagtagaaaaaaagttaaacaggatgaagtaaattcagtaatatagataaagaaatagtacgctaaaaagagaggtgttttttctctgcactctctatttattgttacacatctcgttttttcggacggtgtgttgagtaggaagtaaagacaatgcgacagacagttcattatatttgttagcatgaaaaagatgagttggtgcatttaaattttagtacctcatatttgaaataacttatacacacacatatgtaacatattaaattgtcaatcccgtggaaaagaaaatttcgtacccatcaaaaccaatttctggtgggtagaaagcacttggtgtgaaaattgaagcttgttggaaacgaacgcagaagatatgtatagagagggatagatagtggtagcaaggaatagtagagaaaatgggcttagaaagagggaaaggatggcaaagaaagcagagttagcaagatagtagggtgagagaaagattggattgagaatcgacagtaaagcagagagagtgacagttgaaaaagttggcaaaatgaaggaaaaggaccgcagagaaagcagagtttgcaaaatagtagggagagagagagagagaaagtgtaaagagccagagagagggagagtaaagaagcagagaaagggtgggttagcaacttgacggcactgccgaagagcctttttctcctaccgcccccgcctattagtcagctatgtcttctgccactcatcaaatttcttcattttgctatcgacccggcaaattcctatcctttttctatttccgaaagcattacatacatacatatatgaatacgaatttaccgtattatctctaattatcccccgtctccattaatccacccggggggataaatggaattttaatttttttgaaaaaatcatttcttttaaaatttaataaaaattaattaattcaaaatcgaaactcatttaaatgtttaataaacatgaaaaaataatacagaaaaattacttacttcac

SEQ ID NO: 12273 - DNA, 1603 bp, Heterodera glycines
tcttaagatttgccaaaattttcaataaagacatcccctatcaattgtggcagaaaaatttttgaaatacgcgcctaataaataaaaaaatttcctcctaaaattattaaacttttcattattttctaaaagtctaagaaatcatgcaattgttttttttgataaaattttttttgtccaaaatgctaaacttttatcctttctgcttatccagcccgtggcacatgcgctgcattgagcacattttgcaattgggaattcaatttgattgtttcgctcacttttcttcaattaagccaggcagttaccagattcggtattctcttctatttgctgttttaataattattattaattagtctttttaattggtttgaattacaggcacattctttatctatgcgggtgttactgctgttgcatttgctatattttattttgtggttcccgaaacaaaaggattaaatctcgatgaagtgaatttctatttaatttttctttaaaaacttttttttaagatcattttataatttcttatatgtagggctaggaatttaagtcaaatgacttttttttgctgatttataaatggccttagaatgacttaaaaagggttttctacgctttgtttgaaacttctaacgtgcatttttatttgacttttttttactttagggtttttatgaaaaatttgaatttttgcaaaaaaaaaatgccgaaaaataaaggtttgatgcaattgaaagccggcaaaaaccttctataattgttgagaaaaccccgagaattgcgctactttgtccgattctttgaggcaaaaatgttactctgttgaagtctcccccaatcatttcctcttttacaatgagttttactatgacaaatttggaaaagtacctttttttcaattgatactaaaattaatcgcttttgtaaaatgctattctgtaaagtgttaaaaatggtattcttttccctttttttacgattttttatgacttttttgaagactttttggcggtatttttgtgacttaaattcccagccctactcatatgctgttttaggttcaacttttgttcatgactaaaagagaacggaaaagggcagtgaccagcctaaagatgaagcaactctccggcttggacttgtcaacagttactcgatgatggatgtcaagtaaacaaaattgatcaatttgatcccaaactaaatttgaccgacataataaacaagtgaacataaatcagtgatcaaaaaaccatttatttatatatttttgtttttatggtatttaaatgatataaatacttcaaagccacccatacaattggaaaaggaatatgcatcaagtttgaatttgatctcgccagagattcgacaaccagcgtttttatataatcaaaacaatgtgtgcgactatagcctacccttaattaaatattaatggatcctcaattagcatttgttaagagcattcgaaaattttctaatccctatgcgtttccgcaggcgatcttttaaataaattcgcagatgaattttttatacgttttattttaatttttaaattattttcgcctagaaaattcacttttccaac

SEQ ID NO: 12274 - DNA, 3383 bp, Heterodera glycines
  misc_feature (44)..(44): n is a, c, g, or t
  misc_feature (80)..(80): n is a, c, g, or t
gcaaaatctgagatttaaagatgctaaaaagaagacaatcagtntaatccctgcctcattacgggtaaaaaattttatcnttaagccagaatttatttatttttattaaataaaaaaaagattaaattgaaaataactatgcccacgcacaacacattttatttgtcatattttaatgaaaattttagctttatgttttttaattgtattcccatgtaaaatatttagcccctttgaaaggccgaggcagggcacagaaagaaatagtggaagaaattaaaaataattaaattttagtccaactaacttttttgccatgaccaaaacagtgacagtccaacaaacaaataacaaatgattgacatcccattaatgaccagaccatttctcaggagcattgtggtcatgccaaaactgaacatgtcagaatttgtgcataaaactggcctaaaattaaatatttaaaaaacgaatgaaattttaaattttcaaaaatgagctttatttaccagtcggggtatacaaaaagtggccattttgcagctttctgaagtccaaagatttatttatagatttatatttttaaaacaattattttagtgaaatattctatgattaaattcgtaaaattccactaaaataatctctaaatatcggcagggtttttctcgtacattaccttaatgggagaaggacagaaatcagtcgatcaacgccaacaaagaaaacgatccaaccggaggagaacaggccaaagtttggcaaaaactggaggaaaaagcagccaaaattgctgatcatgttctggccaaccaacgaaagggcaaaagggaccgaaaatgagagcaaaaagagaaagtcaacggctgagccgatggccaaaagagtggcacaagtgccgcgcagatttctaaaatagtaaaataaacacaatatttccataatttagtgccacaaccttataattaagccaccccccccccctcgaggcagtttaaatagatacaatggggcgctaaaaattaaaatgagacaaaaaaaaaattttaattcgtccgccaattttattagacggatattagaagattcgaaaaaagtttctattttattttctattatatttacgtatatataatcataggccgttaaataaattaatttatttattacttttcgcttatgattgtgtacaaaagtgcagaattgaacactaagccgggaagcgtaatgagccaacggcaggaatttgacaaaaccaattccattgaaaaggtgtcaacaccgaaacgattgaatgccttaaataccaaaaatatataatattaaattgaaaaaataaaaattattttaaaatgaaaattatgaaacaattgtcctcaccaaattaaccatggagtagttttgaaaagccattttaaagggagtttattctaaaaagaaaattaatttttttaaatttgtttttatgaaatttcttttattatttgctttagaatgtcactttcatttgattgacccttttcattattatcgttgtttcggagaagcaaaatttaaaaatgcatttttcacgctaatttttttcataggataatgtgattttatatattattgtaagcgaaattataaacgcatttttcacgttaataattttgatcgtagtaaaatataaatttatttgaaagaaatattacttttttatataaaatattcatcaaattatctaatatgaaaaaaatttaatgaaaagcatagttttcattgttagtggaccatttattttcatgaaaatgatttacgtctttgaaagcggaagctttattacgtttataaattagctgaaggtgcctttaatttttccgtggctgataaccaacaggttcacaaagaacgcaacctaattagtgggcatttgttaaactaattttgcaaattagatttgagcataacagtgacatcaaagattttaacaaactaattaaataaaaatatgtaacaaatgatttaaattactcaatcagaataattgtttttgtctaaataaagtcaataaagttaaaatttttaggatagataacattaaattttctatgtaactttaaaaaaaattgaaataagttttttatttttcatttaaaaaagaaataaataacacataagacgaatagcaggaaaatttccatcaaatgcttatttttaatggctttagaatgctctaaattcccttgatacaaaatcgcttttttgaaatgccaaaaaaatttattttttatttattctaaacaatttttagaatttttattacaataaatgaatcagatactttcattggcgaagggcaaaaaaatgtgcatagtccaattatcggatcagcttcctcttgtcgtctttttgagcacaattgtgaatccgttgccgactttgtcgtcaatgtcccgccattcggccactgtccaattaaaatgtcggcaaagttccagcaaatcttccgtaatccaaaaagacacatgggcatgggccgcatttgcattgccattcgttggccgactgtgccgttcgagcagttcggacaaagcggttcgatttcggccctgatcaaaagtctggaaaacggttaaaacagaatgctggattaaaactaattttgaagctgaaaaattttgctagtaattaaattttaataattaaaaggaaaatatgaaaagttaaattaatttaatttttttaattaaatttgtcatttgcccaaattttttgtcgggaaacgggaacgggattcgtgggttttcccgcgggaattctgttcccgccagggccctacttatcagtggacttggagatgcagaaaatagcctttccaaaactaaaggccaattcccaagcacaagaataatagccgttctcaaaaaaaaaaaactaaaaattaaaattaattacccgctctttgtgtgggatgtccatatagacgaagccacctttataagaataattacttgaagttggttataaaacaattttgacctggctttacaactcgtaaccattccttaattgctttgattgggtcaaaaatgtgttccaacagatgcgcgctgatcacaaaatcgacagaatcatttgcaaatggtaatttgtcacccggggctattatgtgaacttttgcaggatttccttaaaataattgtcatacataaatgttttttactaattaaaatttctatggggttgaattgatgaacaaatattgtccggtcataactgttttgtttttcttaactattttatttgccataaatataatattttctttaaaataaataaaattaaaaatatcaggcggaaaagatacttttgaaaaataactaaaaaatcacttctaatcc

SEQ ID NO: 12275 - DNA, 1437 bp, Heterodera glycines
tactttcatatactaataaaacacaatgagaaaattggaataaataaagaaatgagtaaatgtattgtattatttattgcttaaattaaattgaggaacaaaaataaaaatacaaataaaaaaaaattaaaatttgaacgggtgatttaatgataagagaatattaacaatctgtttgagaaagtgttttgattgacagaaacagccgaaggatcatttaccttgagtggattgaatgtgtccactcaattcgatccaatcgaattttatttgaataagcgcccaatacccatgaataaaatcattttaaaacatttgcggattcaaaagggtggcggacattgcgcaaacaaaaattattggtcaataaaatatttgatttggtgggaagagaacgaaaatgagcaatttgttggtagttaattactaaaacagcgaaaaaaagtaaaattaacttattagctaatcattcattaattaataataatgaaaagaagcgatattcgcttagacaaaacacaaattaaatgctaacgaaaaagccaaccaaaagcaaaaaaaggcattccattgaatgagaggtaattaaaggaacaaccggctggggagaagcaggaaaagtggtgtaagaagaagagaagggctaataacacagaaaaaatgtaataaaataagaaagataatttataaggacagggaaaaggagaagcgaatcgaaagacaacgaaagaaaagagaacagaagggatcagcagaagaagaaaaggagcagagaatgggaattgtaaaatgatcaaatatccttcaaaagtaaactggcaaaaatactaaccaaccattcatttttgacctttacgtacggaaattaaggacactatggtcaaaataagatttaggggatctaaaaaaacgcaattatgaatttttgaaaataaaattttcgacttcaaataaataaaaattcctatttttcgtgcgatgactatttactgttgaactataatatattagaattaattttatttaaaaatcactaaaatatttaatttctgaccaaaatatgtcaataaagaaagagagaaaattaaatcttcaattaccctcaaagtgcttattaatgacagaacaacaattgattcggagcctttgggttatacgatttgaaaaaaaaaactaaaattcaaattttgtataaaaatcattcgctcggggggaaaaacgcattgaattgagcacaaggacatcatcaaatctaagggggggggggggaagaatgaatgaattggcgaatgattcgtttgattggcgcatgagaaaatcaattagcgaagaaaaagcataaaatgtataaaaagggagaagaaaatagcgaaaagggcgacagggacagaagaaaataagcgaaatcgaattgagattaaaagataaaattttaca

SEQ ID NO: 12276 - DNA, 1583 bp, Heterodera glycines
ctgtcgaaatcacttggcaccgtggcaactgcgtctgtgtaactttaagaagccaccataacttttttttcattaatggttaaatcaaacaaacttggtatcattcgctcctgagggaaatgcaaattcgatcaaatcagcagggcgatagagaaatgtacaaatgtttaatttaaatatttccttttattttgatgtacaataacataaaagtaactttttgttttgctgtttttttctgtgcttttctaatgcttttgctgatccttcagttcgcttttgtgccatccgcgggactttcctccgactgcggcacagaacagtcccacaaccgataagtttttcattgcattttttacgagtgaacaaataaaattcaaattcaaataaatatttttaatctgttacactttttcagtgatggtaaattttcattcattcattcttttatttatttatttttgaagacgctcaatatgaaattagcttaatttaactttcacttggcaccttttgtttgatttgtgtaaaaaatgaaatcaaaatgaattggccgaatgttttgctgaggggggggggggaattggtcacacatttcgacacttttctaagtggccaccaaaggcaatgaatgccttcccccccccccccccccaaaaaaaaaaattcattcatccgatcactcattcattcgattcattcgtcagtccgtccctccctatcccaccattgtttgagttatgatgaggagagtgtggttttgcaacacaatgaattggggggggggggagaaggggtgcaaaggcaaattcattttcattcattccgccggagggcaaaagtttctgtgacaaatgaaagcgtcaacagtcagcaaaaggggcgaggagcaaattcttcacccccgcccactttcatccatctttttgtgggccgtccgtcttcgacacattttagctgcccacccttaagcaatgtttggcgaccgatccctccccccgcccatcgaaacgtcgttttattgcctctaccgccccgcctaaacacagtaacggaaagtgcgcagtggtcagaattggcggcaatcaatcacaaagtccgtcagctaattccgcgccgggaagactccgcgtgcccttagggcaaatggcgtaacgacagaggagaacagaagcgaacaaacagccctttcaactgattgagctgtaaggcttttgcttttttgggcgaaaagggcgagaggggcgggggagggaaaattggggtggcgaggaatggggaaggaatgggggaaagggggggggggaggaaggcgatcaccgcggtccgtccacccagtgcagttggacgatgctgaaacgatgaaaagcacagagttgcccctccccacctcatttgcatgcaattacggattacgagattcataagtacggcgtttctggacccctcgcaattaattttttcgatttttccgtaattttgatcaataagatgaattctggaagtatttctagatgaatccacaagtgcgtaatattttaataatattagaaattaaaattaaaagataataataatttact

SEQ ID NO: 12277 - DNA, 926 bp, Heterodera glycines
  misc_feature (381)..(381): n is a, c, g, or t
cccccccccccccccccccgctggcgatgtaatacgaccccaactctctccccttctccccttttcccttttctccctcccttccgctctctctctcggcttaacaaaagaacatctcggctaatattcaatgcttttttattctaatggaagcgtagcagtaattaattaattcactttcattctggccaccaattgggttcgccaatcgttttggttttttaagtcggctccttttttcgcccttttttattgattttgttgagtttttcagttaattataataattaattttggttgtataaatgcataaacttcaaaaatttatttaaaacaaataaatgccaatcctaaatgtcgccccatcattgtcctcccccnccccccccattttcccctatttttcccccttcggtgtcccgttacattttgcatatcctttttccctcttcgtcttttgcttcgtttcgcccatccaattttcaattcacgcgcttattgctatggaaataaataacactgatgtctcccccgaggaccgatttaggaaaagcgaaacgattgatggtcaatggagggggggggggggaatctccggccgacggaataattcaaatttcaaatccgaatcgattgggtggtttaataataaaaacttttaaaaaagatttaaaaaaccaaatatttaaaaacttacacttctcaattgtacgattaaatacgcttttgcccattggcccttttaatgaggcgacttggcccaattttgggctcgtatttgaatgattcgagaaagtaaacaaaaagtcgcgagaagtgactgacaaataaagcctccatccctcataaagtgcaccaatttattgcctttttcatttttatttactttttttattcattttaataattcgttttgattttaaatt

SEQ ID NO: 12278 - DNA, 3587 bp, Heterodera glycines
gaaaatttacaatttttggcgaaaattaataaatttttgtttttttctcttttttgatggatgaatttttttctggaataacatttttcaataaatcgtttttgaaaaaatggtttagtataaataatatatgttcaaataaaaaataatctgtgatctatttatttttacgtatatgttttcaaattaaaaattttaattttttaaaacaatttactaattttcaattttaaaaattgtacttttacgccaattttattacacaaattattgcaaaaataaaagtccgaaaattttatttttatttgttttcgtgctgcgcattttattgtcaataacaacattttactacaacatacaatacaatgtttgaatgatgtgaatgaatgcaaaaatcatttaatggagacttatcaaactcatgaattttcgtagaaaattcctcaaaatttggccaccattttttttatcaaatttttactttccccacctcgtgagctttagggaacagcagattgaagtgataaaaatttaattttggtcaaattggactttacatgctcatcaaattttttatttgtcacttaattaatggcttaattttattttttaattcttttctctttagttttacataatttgatgtaaataaatgtttatttattctttttaaataattaaataaaaaagaatgtttttttttgttcaaaaaatggccaaaaatttttgtccttcaaaaatcgtaccattttgttttgttttttattctttacgcagcattttcctggtgataacaacaattaggaatgttaattccaggaaatttcacaataattatattttatcacataaaattaatttcattggccttcatttagaaattcattgaaaaaaaaattttgtataaaaaatatttgtaaaaaattaggcaccaaacattttgccaatcaaaatttaatgcctttttaggcatcggaatgcctttttcatatttatataaataaggcgattaattggcgggtttattcacattgcaatgaatgaaaatgataagaaatcaaaaatcataatagctttaacaaatacattttattgctttattccatataaataacttgtgcatttttcgcatttttcatcaaattaaaatgaatttttaatcatttaaatttaaatttctaattaaataactttgagctcaacgccaaattaaatgattccaaaatgtccatccacaccttcttcaatttcaacgtcacagaatgggcacgcatttcaaaataaagtaattattaaattaaattaatttaccgtattccttaaaatagtgcgagccctcgggggatttatttcagggagagagggaggctctaatttaaggagtgaggggggcttattttttttcaatccccctcaacaacaagggaggggggggggctttattttaagggggggggggctctaattattagggagggggctctattttgcaacccccttcaaaaggggggctttatttcagaagggctttaatttagggggggggctgtattttaggaaatacggaaatttataattttatttttgcaggatggccgactcaccggcattttggcattttctgtttttatggcggctttcggcagttcattccaaatgggctatcacattggctgcatcaatattccaggctcggattttattgcattttatgatgcattgacaaattaagaccattttgaaatttttgtttttgtttttttttaacattgtccggaaatatttaatcaaaattttatttttttttaaattttagtgaaaaaccgggaatttttcacccatttctacaatattttttaaattttccagccgacttaatcaaagaatggttcactgaatcgtacaagcacatgaaaggggttccgatatcagtggaagagatggaatcgacatggtgaaatttttattatttatttaatattttccagaaaattatttggcgctaaaatttctgtttgggggttttccacttgaaattttttgattatttaaatattttttatttccaactctattatatatatttttttgaattttaaattttttttaaccaattttttttcgaatttctgaatagggtatatcaattgcccagggcatttgccgtcggcatttttgccgttggcggaatgtttgtggcataaattttttaatgaactgtactaattctttgaaaaattatcattattattcaataaattcatttcattaatttattaattaattgcccagggcatttgcggtcggcatttttgccattggcggaatgtttggtggcattatggttggcactgttgcggacagattagggcgccgtaaatcacttctgtacaacaatatattggcgataattgctgcggcactgatgacactggcaaaatatatgaatgtttattatttgatcatcattggacgattcattattggactgaatgttggtaagtcaagcgaatattaattaattttttaataatttaaaaactgaaatttaaaacaatattaaatgaatttttatgaaatttttgtccaattttttgtccgcttttggtcatacataatacgcttaaacataatttaaaaaacaatcttaatataaataattgatagctcttgatttgctatactagcatgaaaaatttcaggaaatttcattcatttttcagaaagtcgaaaccaaaaatgttgataaaattgacataactttttgaaaaattgaataaaattttatgaaattttcaggttagtagagcaaacgaaaagctatcatatgataccaaaattatttaagaaaagttatgagaactttttcgcaaaatctgtaaaaattggcacttttacaaaatgccacgtgtgcctaaatttttaaaattaactctccaaaaaataaataaaagactgaacaaatgcatgcttttacttcgattctgtatttgtattaatttgtttcaatcggatctaacttttttaaatttagattttaattataattaaatcattaaatttcgttttaaaatttgaagggctcaacagcggactgtccccaatgtatttgattgaaatttcaccaaacaatttgcgtggctccatcggctcgcttcatcaactgtttattacaatttcaattctggcttcacaaattattgggcttccccaaatttttggcaccacaaatcggtggccactgatttttgcatttactctggtaaatgtttcaaaaaactttgaattttatttaattaaagtttacggattacagcggatccgtctgttcaatcctgggttcagataatatcaattttgccatattttttgggattatgtgccatcttttttgtaattaaaaaatccgtaaacttgattagaatattttgttaagaaaccattaatgggaaaatggtgtgccaaaatgtgatcactttaaaaaaaataattgatttaaattgatcaatttgaaaaagtggaattcgggcaaataattaataaatctaaaaaaaaaataattaaaattacataaattttattatatt

SEQ ID NO: 12279 - DNA, 4670 bp, Heterodera glycines
  misc_feature (4621)..(4621): n is a, c, g, or t
atgataagtgaaaggaaaattggctgaaaaattaagtctctacagaaagaatttaagaagatggaggaaaaaattcggcaccaaatcgaacaattaggtttcgatcatttatcaattcggaggctcaatattttaacttttttttctgttactttattttgctgagaaattcaaaataatgtttcactattaaaaataagtactattttgattcagaaatatttctgtaattttatgtattttttaaattttttcagaaaaattcataacaaacgaaattcacccctatggattgccgccttcagacaattttcaaaaattataaggctaagaaaaaattataattagctttgtgactatttatactcaggtgcaaaagcacggaatcatgtaaatgaaagcaaaaaacgaattttatttttcttgtttaattggcatttatgttttaaaaaagatagggctttagcatgctaattactagggataggacgaacatttatatttcaatattttgggggttttgtcaatgttttgtaaatatttggcatttttcggatttttcatgtgaaattcagaaattctaacaaaaatgcaattaaaaattattatttttttgacacacaatatataagctttgaaactgtaaagaaaactgaaaatggttttacattcacttaatttgctgatttagaacaagaaaaacccagtgagtttttttgtgtatttttaaaaatatttttcaaaaaaaaattcactacaaacggaaatcacccctatggatcgacctgaaaaagaatgttaatgatttttatgttttttatgtaaaaagggctaattattgttttttaatttaattagtgaatctatatttgtgtcccgattgctctggtcgggtgcacaagtcagccggtggcactgtggttggggcaggcagggacgagaccaaatatacacaaagaattacaataattaaaaaataattccggggaggacctctaatttgggtaattaaaccgaacaaattaaaattacaaaatgagaaatgaaaaaaatgcaaaaatgggcccatcaccggggaaaatatcacagaattgggaaaagcacagcatagagggacagaaccaggagaaaatggaccagaaatatcacataaaatgggcacgcaatttaccgggaccggggcaattttcacaaaagaaatggaaaatgaagggccgatcacagatcactgatcacatttgggggaagggatcggggcaagagagctcccagaaattggggaaatacatttgatcggatgggaacaggggcggagtaataacggtggacgaaacaaagaacccgagcctcggtatcgctatacttccttttcttttggggagcggtttcgtccatgaaacaaggcgccagccagcatcaatcaccttctgatcacatattgtcaatgaagcaccaaatagtgggatgagtacaattcattgccgcagttgtcgattcgatcggcattgtccaagatgcgctgatgaacattctattcgttagggtcgatgtgaggcaacgtcagtgcattattgaaactattgagccacggtctttctcatatatttttttttataagcatttttaaagaactatttatttacaatagacacataaaattactcacttattgtctcggagtggaagcatgtgaatggggtcaaatcaaaagaattacaaaaccctaacaaaaactatgtttcaacactaaaacgaaaactcgactttttgcatgactaaatagcgcgtattcgattgaatcttgcaatgacgtctgtcgggtggcaaatgtgtttgaagatgtttcaatttccttgaacatatttttttttacaaaagcatccaatatttttctattgttatatgtaggctcatcatattttgacgaataatttgattaaattcattgaatttatattattttgtactatggaaaaataaatatttttgccttttacctttataaaaaaattttactttgccaaattcataataattttcttggctttattgtcactttatttatcattatcggagaaataaatgccaaaaatgaagaaattattgataataaagtaaatttgaaaaacaaaatgttaagaaaactttgataaagtatgaagatagtaatttttatgtttatacaaaaatgtaaagtcgtttaagtgcgaaaattgttcataccttcttaatatcaacagatagcaagcatgccaatttaagatgctagacgaggaattcggcaccaaaccgattcattagcattgttccaaaataattaaccttgttacagtagggtcaaccttcacgatttaaagaaaagcctagaaaatctacaatatttgtttttttaaatttatctcactttggcgtactatctttcgctttttttaagcgatcctcctcaaggatcgccatcattacctccggggattttaacaaattccctcgaattaaaacgccgttcttaaaggatgactttagactcggcatatttatgtaaagcctcttctgcggattcacactaaagtagagtgttatcgacaaattattatcgggcctctatacaaccaggcaagagactgtttgtccctctggtgtgagcactcgcgtcgtaaatgacgcgtatgcacaacttgtgcttgctggcctggttcggttgaaggattgcttccccagattcgaaagttctaaagccccttcaattgtgtcggcagccctcgggatttgtcgccccagtgcataaaagttctcactttccggcttaaattcccagtagttttctctcttcatcttggagagcctgtcctgttaccctctggaaaatggcttgccatttttctggaaaatgtctaggcatcaccattgatgcaatggaatgcgtaagagcttactcattgctcttacgctttaggaaaatgcaatatatcccttagggttgcgttttatccaagcgctacggccccgcttttttttttgttgtattatccaattaaatttccgtatcgtcatctaaaatttcggcaatcggagttttgactgccaaaaaaaattcggcaataagaaataagaacacaaaaatgtctgtaattggcataccgatacatccctatttaattcattgacaatatatttaattttttagaattctaaaaattaattttttcatatttacaaacatggaaagagaaattatatttcgtctttttaaatcaattatttcatcataaaagcaagacaatcgaaattcatttctaatttatacttaaaaaatatatttttttataaattttactttaaaaaaataatatcctaagctgaaatcaaaattatcattttatgatttattactaaaaaatgctaaaaattaattttataataattttcttcttatttctattcgtaataattgatggaactgatgaagatttaattgatgatttatggaaaaacctaaaatcaccgaccccaaaaaacttcaaaaatcaaaaattcggagaaaataataccataaagcaagaaattgttgaaaaaaacgatgaacaagaaaatgccaataaaatcgaaatggaagacataaagccaataaaaataaaagaacccaaaattgaattaggacaattgaacgaagaatcatttggaaatcaatttgatcagcaggctgatcagaatgtttcgtttgcggatctgagcaattctgcaaatgataaggattacaataatatggtaatataacagataaaacagcattattcctgaaaaaaatattttacaaatacactaaattcttagattttttttcttaaaagtgaattatttctttagaatacagaagaaataaatgaaatggaaattttaaataaatttaatttgatgaaaaaggaattgcgaaaagaaaatgcttataaaaatttgacaaatgttcaatttgagtgcgaaattgcgaaaaagttgggcacaaatcgaaacaaaatttatgaaatgaaaaaaaaattaggacaaaaaagagagaagagaacagaggaaaatgaagaaacaaaaaggaaactgatcagaaaatttgatcaattgagaaaagaaaaaatttgtgggtataaatatgacaggttgaaaagaaataaaattgagcacgaaattgccaatgaattgggagttacattcaataaattttaccaatggaagagggaattaggtaagaaaatattaacaaaataaaatttataattattgtatcaatttaaggtataataaagaaatttttatttacaaacgaagaaaaaatagaaaaacttgagcaatttgaaagaataaaagaagaattttcaaaaaaattcaatttcaaacccaatagaaaaattgaatcaaaaatagctgaaaaaattgggattgtgtggaacacaatttataaatggaagagaaaattcggtttaatcactcgtaatattttaattattaaataaaaaataaattaatttgcttttcttttaaggagaaagaaaaatttattccgttaatgaaaaattggaatatgtgaaaaaaagtgaggaaatggctgaaagaaatttaacgatatgtgagaaanaaaattgccgaaactttgggcattccaaatgacaatttaagacgatgga

SEQ ID NO: 12280 - DNA, 2363 bp, Heterodera glycines
ttaggcaaacttatgtttttttacaaaattgttttgactttatttttttaacattttttgaatttttgcatatattttggtattttttgaattttagcgcatatttttacattttttggatttttaacctcatattattatatacatatttatgttattgttttacaaaacagactggctcaacttatggcgaaatgttttcaattgcgctcaaaaggcatggccaactgtgcattggactgtaccgtctgcatgaccaggcttcgttggaatccaataaacgctatgtgagttaagcgagcacaaaattttcagcgatttttggaaaaaattttttttatactatttcctttttgatataatgtcccaacacaaactgatccggggtgggggaaacgagttgctcacacacagcaggaatatcataactgtcaattaaaatcattttaaaaccacttttatcatgtagagcatggtcgatttaatattgccaactttgggctttttttgctccggcgccaaaaatgatcagaaaaaatcgatcaaaatttcgaaaaaagggttattttttaaattcataaaaaatttccagactcatgctggagccctaagctttttttaaaagttcagcgaaatttctttacaaaataatatgataaaatcaaataaaataactaagtcaagtagactcacgagtaggatcattacaaattttgttttctttctagttgagtaaatttttgcaggtgatcaccaatccgccagcggagcttcgcctactaagcagtgacaatgtcggcaattattcaatttatcgcaaaaaaaaaatcataccaaccaaatcagaccgacatttccatatatatatggtattatatattcaggtgtatgtgctggagcagttcgactttggctactcaaaattcgacacatttggcagtgaagcggggggcgctgggggtggcacaagcattggctccgatcgtttgttcgcgtaattgtcgaacaaagtggtagaatgcatttgggatatatgtgcttttcccagtcagttccctgactctatggaatttcccgctcttttcgtatcgcgcgttctcggtttcccgtacatctctcgaattcatccgggctgttagtgatctgaaaattttcaacactcgagaaccgggatcgagaattgactcacaaggagtcgagactgaaagcagaaaaccctgggaatttttgactcaagaaccgagactctcggacatcccatagcatttcaccacatttcgattgttttgttactgtttacttttggcgtgcctgtttcattttttttgattgattgatcaattgattgatgttgggctcaaccaaaccgcgaatttatgttttaaattaatattcagttatgcaaaaaaatttcttttttaaatttcacacattttaagcaacaaaatttgttcttacctgattttaaaactcatgtcgaacttttagctctacacatcttcggcgtcttagttttttagcaaaaaaatttgatagttaatatttattgagatttaggcccattaaaatgagtaattttaaagggtttttttagtcaatttttgaattttccgaccggcaatagcaatcggtatgccgggaaaaaaattgcaaatctataaattaattcctgaaaaatgctgactccgactcaatgttatttcgatatttttctataacatataaattgttgaatttgtttttcaaaatagtttctgtgttgtgctatatgtaccaaaaaataaactatctattttatttattttctgtgaaatctgattctcaatttgcaaaaaaaaaaataatatataaattttttagaggaaattattttttgtggtgtcaaattacacaatatgtaaatgcatattttaactgggtaaaatcagggttcccaggttaaaattttcaaaagcctcatttggcatgcaaaaaagcctcattttgggtctaaaagcctcatttttataaattttttcaaaacacgtttaaaatgttcagatgttatatgtattttcaatttattgttagaaataagcattttgtgaaattctaagcatgaaaaaccaaagttgattttttgcggcgctttttccaaaaaaacttttggggaacaaggggggctggcggtaccgataggcgccgccaggtaaaaattttgtaattttaatacgatttgttaaccgatttgtcagggctcgcagatgggtctaaaagcctcatttttacaaatttattcaaaacacgtttaaaatgttcaaatgttatattttttattgtcaatgataaatttgagcaattttttggttagaaattagcatttt

SEQ ID NO: 12281 - DNA, 873 bp, Heterodera glycines
aatagcaatcggtatgccgggaaaaaaattgcaaatctataaattaattcctgaaaaatgctgactccgactcaatgttatttcgatatttttctataacatataaattgttgaatttgtttttcaaaatagtttctgtgttgtgctatgtaccaaaaaataaactatctattttatttattttctgtgaaatctgattctcaatttgcaaaaaaaaataatatataaattttttagaggaaattattttttgtggtgtcaaattacacaatatgtaaatgcatattttaactgggtaaaatcagggtttccaggttaaaattttcaaaagcctcatttggcatgcaaaaaagcctcattttgggtctaaaagcctcatttttataaattttttcaaaacacgtttaaaatgttcagatgttatatgtattttcaatttattgttagaaataagcattttgtgaaattcttgaaaaaccaaagttgattttttgcggcgctttttccaaaaaaacttttggggaacaaggggggctggcggtaccgataggcgccgccaggtaaaaattttgtaattttaatacgatttgttaaccgatttgtcagggctcgcagaatgggtctaaaagcctcatttttacaaatttattcaaaacacgtttaaaatgttcaaatgttatattttttattgtccatgataaatttgagcaattttttggttagaaattagcattttgtgaaattctgagcatgaaaaaccgaaattgatttttttttttgcgacgtttttcaaaaaacttttggggaatagggtggggggtccggctaccaaagaggcgccgccggggaaattttttgtaatttttaatgcga

SEQ ID NO: 12282 - DNA, 965 bp, Heterodera glycines
tttttgggtatttgtatataaattgtaaaacacaaactaaaaatgtgcatttccgctatttgcattaaaattgtaaaacacaatctaaaagtgggtatttttcagtatttgtattacaattgtaagaaactaaaaatgtgtatttttcggtatttgtattacaattgtaaaacacaaactaaaaatatgcattttcaggtatttgcattaaaattgtaaaacacaaactaaaattgtgcatttttcagtatttgtattacaattgtaagaaactaaaaatgtgcatttttcagtatttgtattacaattgtaagaaactaaaaatatgcattttcaggtatttgcattaaaattgtaaaacacaaactaaaattgtgtatttttcagtatttgtattacaattgtaagaaactaaaaatgtgtattttccggtatttgcattaaaattgtaaaacacaaactaaaagtgggtatttttcagtatttgtattacaattgtaagaaactaaaaatgtgtatttttcggtatttgtattacaattgtaagaaactaaaaatgtgtatttttcggtatttgtattataattgtaaaacacaaactaaaaatgtgcattttccgctatttgcattaaaattgtaaaacacaaactaaaagtgggtatttttcagtatttgtattacaattgtaagaaactaaaaatgtgtatttttcggtatttgtattacaattgtaaaacacaaactaaaaatatgcattttcaggtatttgcattaaaattgtaaaacacaaactaaaattgtgcatttttcagtatttgtattacaattgtaagaaactaaaaatgtgcatttttcagtatttgtattacaattgtaagaaactaaaaatatgcattttcaggtatttgcattaaaattgtaaaacaagactaaaattgtgcatttttcagtatttgtattacaat

SEQ ID NO: 12283 - DNA, 1664 bp, Heterodera glycines
  misc_feature (1589)..(1589): n is a, c, g, or t
  misc_feature (1631)..(1631): n is a, c, g, or t
  misc_feature (1640)..(1640): n is a, c, g, or t
  misc_feature (1652)..(1652): n is a, c, g, or t
caaggggtggcaatgcgctgcagcggcagccaaacatttcccggaatattgtgactccgggaaactcggtgacaaaaaatgcgccgattgcggtgcacatctcttctcacatgaagacagtagcatttgctgccggaagggaagagttgtgctgccaatgcttaacccgcatcctgatgagctcaaacagctgattgtggggaataagcaatcccgtgaagggaaagaatttgtgcgacacatgtcgcgttataacaacctgttccaatttgcgagcgtttctgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggaaaaaatcacaaacgaagatgagtttgtgcagggtcaccagctaaatgagcagactcttgagatcttagaacaaatgatccaagtgcatcatcctgctgcgcaggcatataagcaggcgcgtgagcagctcactgagcttctccaacaacaaaatcaggaagagcttcgtttcttccgcatgactttgttggatagccgcagggctccagctggtcttaaagacccaaaattgcacccacaccaaataatcaccccatctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgactcggaagccgagtcagataatgagtcgtgcgagactcagtcaattgcatcatctgatgcggggtcagtcgcagattcagatgctgaatctgtagcatctgtttcatcgcagcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcgtagacctgacatggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatgtatgaggattgcaacaccgtttttgcacggtgtcatgacgcgaaaaaggcgcgtctcttcatcacattcacgaacaacagggaatggcctgagttcaaagagaatatatataaaaacggtcaagtatttactgaccgtnttgacatgtggatgcgtgtctggagcagcaaaatcgctgagntccgagaangactttatgacnaaaaagtcttcg

SEQ ID NO: 12284 - DNA, 2402 bp, Heterodera glycines
tataaattttatttcacatttttatctctcttttgcgaattgttataaaaataaaagtgattttgtgcttcgggtccaaaggggggtgaccaggatttttgagtggaaaaatttttctcacaaaaatcttccaaaaatatgtctttaggggttatttgggccgctgatcacgaatacgtgatcagattttacttttgacatcgtcaagacctcggaatccctgtgtgattggggattctgggacatgttctgagggggggggggcaggttcgaatccggacggtgtaacattatttttctatttatttttgagttatttttcaatgcttttaattaatttgaagattggttgtaaattttaaatttttttttaataaataatttcattattattttttatctgtaaaaaataatatcatttcaaatttcttaaatattcaatgcattcaatttttattctttaataaaaaacttttccttatttatataattttaaaccatgttgaacctcttctatcactgttgtacctcttttatcactgttgtacctcttttatcactgttgtacctcttctaatcactgatgtacctcttttaatcactgttgtacctcttctaatcacttttgcacctcttctatcattgttgtacctcttctgatcactgttgtacctcttttaatcactgttgtacctcttctaatcaccgttgtacctcttctaatcactgttgtacctcttctgataactgttgtacctcttctgatcactgttgtacctcttctgatcactgttgtacctctttaatcactgttgtacctcttttaatgacttttgtacctcttttaatcactgttgtacctcttttaatgacttttgtacgtcttttaatcactgctgcacctcttctgatcacaattgtacctctttaatcactggttgtaccctttttatcacagttgtacctcttctgatcactattgaacctcttctcacttcacattctaatcaccgttgtacctcttataatctctgtaaggccaacaaaatttgaaaagcgggcgcgaagcgcccgtcttgagcctcgatgtggactaaaaacccctaataattttttaaaaattagaaacgggcgcgaaacgcccgtcttgagcctcgatgtggactaaaaactcctaataattttttaaaaattcaaaaaaacctctccaaccaattcgatcaatttgaatcgcttcacagtctaggtagcgaagctccgaaagcgcgaagcgctttttcccataagcgcttcgcgcaaaggacttcgtttataaatattagataaacatttgaacaaaacttggcacaaaatgtaaaaaaaataggtttgagcaaatcccgataatcccgcgggatcccgaaaaaaaatcttcgggattgatcgggattcggtcgggatcccgacccgggatccctcccgatcgtttttccaaaatgttcgggattgatcgggatcgggattcagtcgggatcccgactcgggatccctccgaccccagttgtccggtctctagtgaaaagtgatttggttgtcaattcaaaataaaaattcttttaaattaatttagtaaattatgaatttattcaaatatttgattgactccttaatatttttgttaaaatataaattttttaatataatttttatttcttacaatgcgctaattattttttataaattcaaaaattttgtcaatttttgttttttgaaaaaacattaaaattacccatatttttatcattatttttgttttatttatttttctttggtattatatgtgaattagtttaaattcctattattattgataataggtcgatccttttatcgcttttgcagggaacttcaaatcattatttgattgtttttattataacaaattaattattattctttttattttcgatttctatatgttaatttttcaaattattttcaaatatattcaaatttatactttatttatctatgaattactaataatcaatattcgactgtatatgattaattttttatgttaattttcatttggttattctccactagttctgtagcatttgttatatttatatgaaaaagatacaaaacggcattaaaaaagctaaccgcttgagactgtcatcgccatttccagccttttaatttttatgtttttaaaatattattgtattcttcttttatttattaaactcatcgatatccgaaatcttcttgttccaagcttggtgcatcccaaagtttaacatttaattttgaattttagtttgttatttaccctaatcaatgtattatttttccattttttttaaatatccatttccttacctattgaagggctggtttggtgcaaaactattcaa

SEQ ID NO: 12285 - DNA, 1381 bp, Heterodera glycines
  misc_feature (1124)..(1124): n is a, c, g, or t
  misc_feature (1174)..(1174): n is a, c, g, or t
  misc_feature (1198)..(1198): n is a, c, g, or t
  misc_feature (1247)..(1247): n is a, c, g, or t
  misc_feature (1285)..(1285): n is a, c, g, or t
  misc_feature (1288)..(1289): n is a, c, g, or t
  misc_feature (1308)..(1308): n is a, c, g, or t
  misc_feature (1311)..(1311): n is a, c, g, or t
  misc_feature (1315)..(1315): n is a, c, g, or t
  misc_feature (1318)..(1319): n is a, c, g, or t
  misc_feature (1321)..(1321): n is a, c, g, or t
  misc_feature (1325)..(1325): n is a, c, g, or t
  misc_feature (1328)..(1328): n is a, c, g, or t
  misc_feature (1332)..(1332): n is a, c, g, or t
aatgcttcaacttgcgctactacgaaagctatgtgaccgggatgtatttggtgggttggccgactcattagcatcatttgatgcgcttattcaggcaacaaaagtgttttatgtgggcaatgtgctgacaaatgtgagaaagggcttattaattgaccaataattagccaattactgacctaataatttattgattggtttatgactaattaataattggttaattgtcagtaattatctgatgaaaagaataattatttgctaatatttttaaaattaattaactgattaatattgactaattatttattaattaattgattatcattgattaattaatttatttcaaattaatccccaattgatttgtctgatcagatgaatgcttcttgtctttagcttttgctggttaataaatttctggagaccaacaattattccatttacgggttgggtgtgctgtacgatttgcttctgctcggcaaatcttggacacaatcaggtggacgaacgcgcaaaaccaacggcggaccaaattcaaacaattttgagcaaaaacgcaatttcagggaattttcctcgcgtcactttgtgcgacttcgaagtgcgcgttttgggcaacattcaaaggcattccgtacaggtgaaaaaagtgaaaagaggaggacattttgaaaaagagagcaaaaagaaattaaaatcgaattgatcaaaacacaaaataagaaataaaactgaaattaaactttaaaaaagtgattaaatgaattagcaaattaacaaataattaaatgttttttgactgtcagtgtgtgctggtgatcaacatcttcaacgagaagatcttcatcctgctttggctttggttctgcgtcctcttcttcatcactctcttcgatgctctttattggtttagcgtttcgctttttcacagagaccgtttccgatttgttctccgccatttggaggtatcaatgccaatttcaatttccaactttgatgaatggcacattaatcagctcacttccgacccggaccggcccgaacttttccggaaggagaagcgcaaacaagtggagcactttctgaggacttacctaaaggtgaacaacggcgcttggtgngtttggtgtttgtggtttttcctcggttggcggtgttttggtgctgcggntgtttgccctccgcgcgggggttntgttctgtcctgtggtccctgctgcgctgtggctgcgcttcttgtcccnccgtccggtgtctctgctcgtcgttgcttcttttcttntcnntttccctcaaggggtttcnctnctcnttnntnttgnctncttnccctcttataggtgattgattgattcctcttcagcacccaatccatccg

SEQ ID NO: 12286 - DNA, 3331 bp, Heterodera glycines
ctgctcattagtattggctaattaccgtcaattaattcctttattgattcctcttcagcacccaatccatccggcgtcggattggctgcagtgcctcctcctcgtcgttggcgcccaatcacaacggaacgtcgggcggaagtgcgggacggaggatcatccaaaggtcaacagaaaaagatggaagcaaagttatcagcaaaatatttattgcagaacagcccatgcccgactttcccgctttctttcctaccgccaatcgcctggctcccccggcggttctccgtcgcccggcacagcggtagcgaccacgggggtcatctaccggacgccacgacactcgggcggagttgagcaggtaattaagaataatcactacctactggcttaaatcgcatttcgccttagggccgtctttcgcgcggctcttcgccgttgccaatgatagggcgatcagtcgctgaatttggtgcagacgcacacagcggacagctgagaagggtcggaggtcggttgccgatcagtagcgacagctccgcagccaacacccaagtgatcgtcactccatcaagcaggtcagccaaaggtatccccctaaagttgctcgagagtctcgagcatagtgaagtgagtaaaattcatttattttttatgtttttgccttaactgattgaaaattaataaaaataaaagttcattaaggccttcttcacgacaggaaaacaaattgaaaatgaatcataagaatcagaaccgaagtgagggggacgacttggaattctgtggccacagaaagggcgagcggcagggcagcatgaccaattcaatcgcttctctgtcaatgtcgcccacagcaaagcgcaaattctcctccaaagccttcggccttaaagtgattaacaattcggattaataaaccaattagggaaatattccgtcgtcccctttttattctcctgccttttttggtccatcatttaccaaatttcgtccataaattccctccccctttcactcatttcgtcccattaattttcatcttggactctctctccgttaaagagtccgctgaaggcactccgttccgccgttctgtccaaaaagtcaaccgcctcggcgggcagcggcatttccacggaggagcctttgtcggcactgccaaaccatattcagcagttccaccagtcgtctcccactttgccatcctcggcaccagcccaataccggcgaaagatcagttttctagacaccgccgaagagggaggcgcactggcggaggaagaggagaacagacggtcccctgttgatcagaatgccaaagtgccgcccgacaaatgaccgaccgaccgatcagttggaatgccattgatgcttttcatttcactgtcaaagcataatgatttatttgctgtttaaattgttgttttgctctatctgtttgctttatcatccttttgataacattttattcgctgtacttttccagaattttaccgggaaattggtcctttgattttgcaaattatcttttcggctttattatttatttactttcaacggttcagagtccgtgcaaaacgattcgggtcaaaaacaaattgactttacccgcccctcccccattttttgttaattttgctaaatgagtgtagcaccttttaacggccatccctttttgtcgcttacaattaattaccttttgacacctgcacaacaaaacaagtttcgtttcactaattgaacaatcgatgcttttcgtggattcagctaaaatggattcttctatttaattatgggtcgtttcttcaaatctcccaaaataaatttgcaatggtgtgggcttttcgcgcactttttttcgtaagttttattattattaaaaaaaataatatccttttgtgttatttttagcttttcatttttctcttagccgtgccatcgttcgcatttgcaaaggcactttttccgcttgggcttgatgtctgcggcaaaagtcgcgcgtgttggtccacgccgccggggtgcgactcggctgccaattgccaagcggtaaatgccgcgatttaagggccgaattatttgtccattaatagctcatcgtttccagttcagattgtgagatggcgttatgagaaaagcaaattgcgagttgaaatgcaggtcaatctctccccaaaactaattattattaattattaattaatcggcagtttctcctttcgcttaaaataattttttttcattttgcattcttattttttattattatatttttattttaataaattcttttttgtttctattcgctttttactaaaggccaaaggcattggttctttgggtgcggcagcgcctgtcgccgcccaatggatggcacttggattcagtgacgacgcgcacatggcaaatattaattaaattattaattaattcattacacttttaagggaaatgatactgttttttcgtgtctttttggcaccgaaggtggcaatcgcgccgaaatttcgtacaatcaatggactgataatattccgttggtcgaagtgagtgaatttggaaaattaatatttataaatttaaataaattggcaatttattttaggcatcaaaacaaatgattagcgaacagacattttcaacgggaaaagaaacgaacggatgcgcaattagcataaattatgcttataaactcacatcaaaagatgagcagaaaatggtaaagaaaggaattaacaaaactttgaatattaaaatgctcagattttgcgtttgaatggcaaagattggtggcacattttattcgcgcaaggcccagccgcgcgaaacagtaattaggccaattaaagggccaattaacaattcaaaatcacacgttcagccggccaaaaagactttcatacgacagtgcacaaaagtgaacaattggtgaaaatttgtgagagttgttcggacaaattggccgttttgcaaggagtaatttgaaagaaagggaaagtggcgaatagaaaaataaattaaaaataaaattaatgtaataataatttgttgttattccatgccaaaagtgttttccattgtaagtcataattaattaattaatcgcttttctttttcttttgcccttttcaattgttttcgttcacttcgacaattcttcgattcgttttcgttctcttcgattggcgttctgaacaaatttgtctttttatgaaaatcaatttgtttcgcttgaacgattttccccataaattcttaagtttttagatgaagtttgtgactttatttttctcgcaggaaaattaatttaattatttttatttttgggttt

SEQ ID NO: 12287 - DNA, 1085 bp, Heterodera glycines
attaagatttcctaaaaatttgattttttatttaattcgtagttgtcagaatgatttaaaattttgcagaaaatccttaggctaagggctcagtctccaaaatttcaaattttattcacatacaacttctaaaaaacctgcttttttataaacttgaaaattatatttttgactgtaaattttcaagttttacaaacacgaaattattacaacaaaaaaaaggaaaagaaatttgtaaaattttgcagactattagcctttatgctaatgtatttctttcaaaatttcaactaatcattctgatgaccactacaaaatgaataagaaataagattttttttcaacttcgtcataattatttgcatattttttcgaatcttattaattaattaattaattaatacactcatatacttactctccctccccccccccctttttgtgacatgaagcggtggcgccatggtacacaacaaatgactgaaaatttgcttgaccaacaattgacccaactccgtccaatgttcaacagcgcagagaaacagtttggcactgaattggatgccatttggagcaatgaaaattgtgggcagaaaaaagtgccaattgtttgtcaaattttggcggaactgcgcaaattgggcgaccattggcatggactgtttgtcaagctgtaccttagcagtgtgtgctgtaagacacttgaacttggctccacttcacaacgacgacacggtagtggcacagtgtcttaccgtaatcctatgttctaatgaaatgttttccttaatggacgacatatgttgatcgtatgaatgaatacatacgcaaacaattaccatatatacatgtaaatgtagaaatctaagacacagtaatttttgattacgatatattaaaatgaaaaacatattttatttttctattacaaaatttgttttggccaaaaacatggtcatcaaccgccacatttcagcatctacaatttcctactcatatttaattatgcccggcttttttccgcttcatataattggcacctttgcttgctttttaaatccaggcccgtatccgggggggggggg

SEQ ID NO: 12288 - DNA, 1737 bp, Heterodera glycines
tatttaaaaaaccaatcaaaataaaaaatttcgcttaaaattttgctctaaagcaacaaataatttttagttcttatatcattcgattaacctaaatgttatctattagcttgcaaaatttcaaaaaaaatcattgccaaaaatgtccgaaaaacaattttttttttttgagttcctctggccataactttttttttttaaaacttaacgaaattttttggaattttccaatctgttagagaacacttagggctatctaattataggatcaaattaaaatttggttctttggagcgaagtatgaattatggttttttaaatatgtaacgccctttatgatgttttttaaaataacgactccacaccattttgttgatttcatagatgagcttttttgtgggctgaattgtctgctggcgagagactcaatcgtgtgggactcagccgggtgagtcccaactttttggcgtggcggcggcggtggtggtgatgctgcagcagcttcatccatgtaccattagtacatgtgtagttagaagtacttttttaatgagaaaatttttttgtttttacccgccagcgcccgcccgcccgctaatgtctcctcccgccctaattacgtctccccgtcccgctaattccccaaaaattcgtccgtcagtccgctttggtccccctcgcccgcaaatgcgtcgtcgttgtcgtcgtgcagcaacagcaaaaagtaacaggagaaagaagcaggtcacatgagcgcgaccgataatgcaccgctgataaaatgcattgaaaaatccccccaaatattatgaagaaaacatggagacgacgacggacatgtttttctttggcatgtgaacatcatcataattaaccgagcaacagattatgacagcgaataattaacagttggcttatatattagggattaatgctgctcattcatatgccagtctcactcatcacacattgatggatttgttgtccccaaagccaaaaattctgataatccttggtgaacaataccttctctgttccccatatacggtgctttaccgtagtctgtaatatactttattacgacatatttggatctaaatattctgattaaaagcatatttattctttagaaatttgtttgtaaaatttggtctattcaattcaatgtccgctaattgttatatgggcagccgtgtgctgatcagtgtttccatcggcgggacggcactgatcacttttgttacactgatcacactggtcacactgtgccgggacatcaactcgctgtacgacgagatcatttctgatcttgacgagttcaaggacattgccaaccatgcatggaaaacgatgatggacgaacgattagtgaagggcggcgtcgctgaacagtttgggagcggtgacgcggagttcgttcggcgtcagccgcgtcagtcgtacgcggacggagacgctgccgcaactgccactggcggcagtgcggcacgagtgagcagtgcgagtgccggtatttgcaaatgtgccagacagccgaacaactgccctaaaggaccgcaggggcccaagggacagccgggtaagaggaaatcatttttaaaaatgggcattttgtcgggcaattcgacaagttgtcgacaagacaaaacgccgacactaataaaaccagggttgccaattctgttgatttatcatatcactttgctgcttttaaagaaatttgctttttccccctgt

SEQ ID NO: 12289 - DNA, 2341 bp, Heterodera glycines
  misc_feature (161)..(161): n is a, c, g, or t
  misc_feature (2247)..(2247): n is a, c, g, or t
gggcacgaagtcccagcgggccaacctggacagccagggccagccggacagcctgggcagagggcagccgcagtgcctgggcccaaaggaccgagtggcacagctgggcccccctggaccggctgtcccaagcggagggtaattaaaatttcaaaaaattntcattcaattttttgttaagctcctcacccggccctccggggtcccaagacccgccgggccctccgggtctgttggccaacccggccacagagggcagcccgggaaggctggccaagcgggacccccctgggccggatgccgcctactgtccgtgcccaccgcgcaccggcgaagtggcgggcaagcagcaacaatccgccggtgccggtggataccgtcgcttcttccgcgcattccattcacgtcattgagaaatgggcgcttgtgccacaatttgatcaaataaatgtccgtccattaattttgcatttgtttcactaaaaattgtgataaaatggaaacaaatttttagtgattagtagggcatcaaaaaaaaaattaattaaataaaaattaaaaaattggatttatttttatcactaatcaataaaacatattatgtaattccattttccaccatatattttttgcatcatttgtatgaataaaacatattctcattcatattcgccaaatcaatgtaataaaatgaatatttctcaaatccaatgaaattaataataataatttttattattatataattgaaattccattattttagattatcgaaggtattttatttacaatatattcttgtatcataaaaaatgcaattgctaaatatgaaattatgtgctttttacataattattttctttttaaaaaatgaaaaagtccgcacaaaaactactgaagaaaaagttttcggtataaataataaaataatttaaaatatttttaaacattatttaattaacaaaaatttttacattttttgtatagtaataacaaatttaaatgtttgaaggaatccgtccaagcaatcttgaacaccattatgagcaacttctgttcaatgccgaactgagttcttcggaccgggaattgttggcccgtcggatcattgccgttcatttccatttgtcaattatggccaaattagcgctgcccaacgagtccagcagcagcagcagttcaaaaatgaaaaacaaaaaaagtcgaaaacccgaaaaatcggacggtggccctgttgattatgcacatgcatatcaaactatcagacaaacaattgagctcgtaagtgccaaagattttgtgccaatggaacacctatgccatttgtggcagttggaacgtttgtttaatcgccgatcggacaccgaagacaaggccagagacgaactgataaagtacattaattatcaccaagaagcactcgcttcgaaaaggctcaggcactgaatgccccggggggtcgggcatattgagcgtgctttcgtcttcccgtcaaacccgaaaatgagtgttttttaataaaacaaaaaataaacataatttttagagcctgtaattttgtaaaagtcgtgctcctgattggggaatcaggccaggataggattacggggattaaaacaccggttttaacgggatttataccacgacatcggggtttgctcaaagtcaataaatataaagcattatagagttcatttcgatagctagaagttttgtttataatgcctgcaaaatttcaaaaaatttcatcgtttaaaagagttatagaggaaaaactaaaaaaattttaaactttaatgaccacagtttgttgatataatctggataaatgtttttgaaaattttgcaggctatatataaagtaattatggcaattgattttgaaagtggctaggacaaatatatatttatattttttttgtaagctttagcaaagccaaatgagcattaatatatgcaatgatactgtaggatttttgcccacttcttactgtgctcattatgaattttcaaattctgtacataaattattttacagcgtaaattgtgccaaaactaatcaactagaagacactcaaaacgagtcagaagtggccacagattgggtgtacaaatttcagttggttatgtcgcgtaagcacttggattttctgagaaacttattaaaattggaacgaatgggagggcaattcaaattttggcgatggtttgacattggacaccaaattcagggcgaatcgtcgctgngctttaggtttgttgaacattcgtcggacaataaatcattttatcatagtttccaccgatatgagaggctttagcctcatttttgggttttttg

SEQ ID NO: 12290 - DNA, 1053 bp, Heterodera glycines
  misc_feature (38)..(38): n is a, c, g, or t
cagggctcgcagatgaaaattttcaaaagcctcatttntgggtcaaaaagcctcattttacaaatttattcaaaacacgtttaaaatgttcaaatgttgtatttttgactgtccatgatcaatttgagcaattttttatttgaaataagcattttgtgaaaatctgagtatgaaaaatcgaaattgattttttttttcagcgctttttccaaaaacttggggacgggaaaaattttgtaatttttaatgcgatttgttaacagatttgtccacaaaaatgaccaaattttgtgattttgagcaaaggaaaaattaagaattttgaccctattttcattaaaaaaattctttattttgcggtttttctcaaaaaaccgcaaaaagcctcaaagcctcattttgaaaagttagcctcattgacctatcaaaaaaccacaaaatgaggctaaagcctcagatctgcgagccctgatgaaaatcccgctcaaaaaaccaaatttgcggatctcgcttccccccccccctttatcgaaattttttttttgttttcataagtcatgaaaacatgtttcagtgggttttcggggtcgctgatcagtgatcacgaaccggcatccatttcgaacaagagccgtttttagacgaaaaatgcgaaattcgaaaatttgtactttcgactttttgttcgaattatatttcttttgtgtgctatgctgctatgtacaaacaaatttctgtttttagtgaaaattttacagcaattataaatatggacacaaccatggaacaaccggctgaagatgttgaggacgtacagttggatttggggaagaaaaagaagaagaaaaaggcgaagaccacagaactcaaattgtcagaagatgagcatgaggaggaaaaggtggcgaaaagccgttaaatattgaaagtgatagtgaaatccaaattttaggaagtcactgcactcgccgaaggcgttggccgtacaaatttgctcgacgcaaaaaacccccgacgcgtggacggactacaactacgacgagatgctggaca

SEQ ID NO: 12291 - DNA, 1425 bp, Heterodera glycines
agcaaaaagacggcgttcacaaatttcactgaaatttgtcggctgctgaagcgtgacccgaagcatgtgctgcaatttcttatggccgagctgggaacgacgttggaccattttcatttggcaatttacaattttttatattttaggggctcaattgacggcaatcagtgtttaattgtcaagggcaagttccaacagaaacactttgagaatgtgctgcgcggttacatcagtgagccaatttctagtcatttatctcatgatcattgaaatttttgatatgaaaaattcgggtgtccttaattacactttcaccggcgatgggaggagtcgcaaaatgaacagaccctacctaaagcgccaaatttaattaccgatacgtttttaaactgtggcaaacaataatatttgtttttttgacactgagagggcttggttgtgtttgtatgttccggaaatggcgggcgtcaatttacaaaattttgtaccacctcggattctatgtatttttttgagcttggctcgactccgttccttgccataccattcgggcctaaatctaaatctcgggctgtccaacaaatatccattattgggacagaaggacataacccgttttgatcgtgttctcaaaaatttgccatttttagaattatttgataaccctcttcccctgctttcagatgaatacgtccgctgtcacacgtgccgctcctcggacaccgagttgaccaaggatgtgtcccgcctgttcttcatccaatgcaaacggtgcgggagtcgtttcgcggtgtcctccataaagtcaggctacacggcaatggtgggcaaacgggcggcactccgtcgggcggccgaagcgacggcgggcaaatgaatggcaaaaagcgaatgtggatgggaaaggaaagagacttcttccttttgttgtttccttttttgtcatgtaatttaacgcatcaaaatccgtaatattacctatatatcaaaaaaaagtcaattttcatggaaaaaaacattggtgccatggaatttatattttgttttatattctatttatttgttatccgaaaatggtgcactgacaactcgaacttaattttcatcatttctcataatgaagaggcggcagtggtaaagaattgtggtcccggatttattttttaaaaattttattttgtattttgggctcgaaaccaactttaaggggttttcgagggtgctgattacgaatctcaactcagatttacccaattccgaactcgaacaaaaagttgaaaattttttccagtgattacatttttcgtggataaaagcttcaaattcatttaacactatttattttgatgtaaaacaatgcttaaattgtttaattaagtaaagtgcacaatttgcgccaaaatttgaccggttttaaattttttt

SEQ ID NO: 12292 - DNA, 1122 bp, Heterodera glycines
tcactcaaacaggaagaaaaggtttttggctcatcatcggcaccaagctttcgatcagttcttcgtactcgtcgtgtttgtcgtgcacgtacggtgggcatgtccaaaagaacttcacttgcgggaatcggcggcacaaattggcaatcatctcgtattgctccatcatcactgcaatggtttctccgcccaagagtgaatctcgtccgacaatgatcagtgcggccttcactttgctggagagcaccacgggcttcaggcttcgcactgtctccgccaatgttccattttttgccccgatcaccgccgtttggtccaagatttcgcccaattgccccataaattaaattttaaaaaattttaaagtacccatggtcttctcccacgacgaatggtttgtccaatgtgtgcccgccctgtgcgaacagcttgacaaacttttgctcctgtcccaacaccagcgggaagaggaaggaaactcatgcctccaacaacgacggaatacggacgacgacggggagtgtcatgtgcgacgggtgctgcgccatttgctcgcgttgaccacccgaattccgatgcggacacggcccaggactgaaatgggacttttcattgtaatttttttggggttgtgatttgtggcatcaaaatgccacacaataagtcgggactttaccgttgttaaaccttaccgaccaataaccaacaaaaagagctttcggaggagggaatccggcgacttctttcttggtcttcggcccacaattttttttgccgtttaaaatttgcccttgtggatcaatggtaagaaaagcctcgtcaaaagaaagcaattctttttttgttgttcatgaaaaatgggaattatcgtacggcggcgccataaaatctcggcaacatgggaattatacgcaatttgttttacacccgcataaattaaattccatttttgcattcacccccttactttttaatgcggttttcggcactttgctccgctggtcggcccatgcgacgggcgaacatacgagacgcttggggcaaaaagtgttcatcattttgctgaaccggttcgagccgattgcccaatttctgttgctgtgccgcctttttcaggtttcg

SEQ ID NO: 12293 - DNA, 1625 bp, Heterodera glycines
ttttcgctgcgcaaactctccggtcgaaggtgcttcactctgccagagagctccccaatgacgcggtcgcacctttgcgtgactctctgtttaatcggctgaggttgggcgagaccgaaaattgtttttccttgtgtcctttgccttttattttagctccatcgaggctggcttaggccgaaactcaacagcaattatcactcagctcagtgccgccctctgtgacttgtacatccatgtggtccactggaaaggcctcgtcgctcaaatactcgtccaattcgattcccccacttcatcttcaaactccactgttcttgtcgcactgtttaaagcactccccgaagaattatacagtcataaacttaaaattggcgaaaacagacgaactgaaatcgaagaagaattggcgaggcatatggaaacactgctctctaaattggtaatcattttacgactttacaaaaacgtttcatcgttgctcttgtggcgcaatcggttagcgcgttcggctgttaaccgaaaggttggtggttcgaatccacccaggagcgattacatttttttaaatttgtcagttgttttttacaatttatttagtttcatttgtgctctttggatacttctttgtctgaagaaaatggatttcgaacgaaggtttctttttttttctcctttagcattttcaataaaggccgtcgactgcttggcttcttggctgctgaacccccgttgtcctgttgccgtggttcgcctctccccccctccgaatggcatttccttctcttttcagctcactcgttcccctttcttccgttcggttctttccgtgctcagccaacccaacacttcgcagcatttgcacgacgcggccacagaatgtgcggttaatgcgttacaattaatcgacgattcgaaagttgccttgacaatgagcggagagctgagcgaatttgcccagcttttgcagcagagcatttttgaaactgccgacgcatttcgattggccatgcgggaagaagactcagaaaagtgtgtcaattatgcgatttaattatttgtttttctgattcaggctacaaaatttcactcgcctttacgctgaacagtccaacgcatttctttctgcgatggccaataatccccgcaagggatttggcgatttgcgaatgttggatatgcttttgatggccaacgattaccatgattacacggtgattagagggcaatgggatggcgtgataaacagcgcattgcttttttcagctgtgtgaaatgagtttcaatgtgtggtaccaattgtccgaacatttgtatcagtgcaacgaagccgagttcgatgaactccaaggcattttcacgccatatgtggaaaagtacccctattttcttcatttatcccacggctgcctttctttcctttcagacatattctttcgctctgcaaacattgtcgggtggagcccgattcccaagatttgcttgacaaaaattcggaacatgccgattttcggtcaaaggcacaagaaagtgttaaggacgtggtgagttaattcgttaatgagtgaatcaaaggtcatattaatggtatgactttggtatctcgacaactgaaaacataatta

SEQ ID NO: 12294 - DNA, 2363 bp, Heterodera glycines
tggagaggtcagtgataataccagaattcttttttccatttcagttttgcgagtttttattttaaaatttttactttttcaaaatattattttagatagaaattttttggtttcttatccaaaaagacgatttaaaaatacattacttataaaatacgtttcgaattttcaaagcaaaaagtagtaacttactttgaaaaaagagttactcaggtttggtcgcaattttattcaatgaaagaattcttataacaaatatatacacaatttttaaatcgaagaaaaaacgtcgcattttccagtttcgcatttttatggaatcattacaaatccccgaatggcatgccatgaattgggcgggttgaaattcaattccacccagattagctgattattcactgaccttctctggccaactcaatgctccacaggtcgcttcatcgtcggcttcgtttgacgacaataaggagaatggtacggacagctgggccaagttgaagaccgaccccgtactttggctcgacagaatcgccgacgtgtggcgtaccctccgtccatggcagcaacaactcgcctataaacaggtgttaacacctatggtccctgattcattcaaaatggtcgaaaaatggcttagttttccgtgttttcccaagtgaccaaaagcggcaaaaagaggaaaaatggatttacagctttgcacttttataacttgtaatttatttgtttttttaatttgaacataatgtagcttttcattggaagcgttctgccccctaaaagaggcaaatcgcatactcttacattttcaattcacagatggccaatgaacagcaacagattcccccggagtgcccttggctttcgctctgttcaaatgcgatggaatgttctcttaccacgctgcagcgccaccaatcgcagcaaagtgaataaatgactcatcttcggccattcattcatttcccaaggggtcgttgaacacgcgtgccgtacaattcgttttttgatccgttcgatgggtgcacagtccgtcgtgttcattgagccggtggcaagccaaattatgctcaccttcagccaatttccacattcatgtcttctctacttgtccagcattatggtggatgagtacggctcaatggctcaccttcagcccggaatgctccaattgttggacgtgagatcgaaggcatggcttagcaagtcctttcgttacttcagaatttggcgaatcggtccctctctcttttggcgactgactcggagaacggactgcgcgaccatccggacacggtggacgacctgtacagattggccatccgtttcattcaggtgatgatgttctgtgttgtaaacgatgccaaatgaatattctgtgaatacagcgttctccgtccactctcttttctcatcccatcgtggtccaactcttccaaggcgcaatccatggactcgtccttaaccaccaagatgccaacagatcggttacaaaatttgtgatggaaataattgcagcagcgaaaggaaaacgcgtaatttttttttctttattttatacaaaaatattatttctgcgccatttttacaaaaagatgttttttggtgttttagagtcagtcactttcgaaggagcaaactgaaagagtgcgccaaatgcttgccgagaacggcccccaactgatgttggcatgtgtaagtgccgcgctgttccatctctccaattcgctgtgcaaagaaatggccgaaattgtccatgcgttactcaagacagacaaaatggtccaataatttctcaccgatgcttaaatgctttttttatcttaaagaaagcagaacaatggctccattttgtctgtgtccaattgccgcacgacgggggacacagcgcaaccccgcaacaattgaacgactttcgcatgaaaattctggagtaaccttcctttgatcgggttattgtgctaatgcatgttttcaggtcggttcgtcctagcgatgttttggaagcaatgcgcgaattgagcaaattctatgcttaatacgaaaaaatgtgctttatatgcgggtcgtttcgatgagaagacaaccaattttatctttcatttcgataaatcgatgaatttgccagtttttattaagtaacagcagaaccacattaattcccactagagatcggaaattttttttttaaattttttcccggctgtgttatgtgtcggctgtgtttcggcgcgctgagggattggcattcaaaattttttgcagggcgggatcacgtggtattaatcccgcatttaaaatttgcgggattttagaaatttcgaattaaaattaataaagaaaatcgcaaaaaaactaaatat

SEQ ID NO: 12295 - DNA, 1365 bp, Heterodera glycines
ctgctgttggctgaccattgttggtcccccgttcaatgcgtgttgggcttaagtacaaaaaggacacttttgacgtagctggcatccaatttttcgtgtgttccgactgtggcaggctccaactgaacagtgcgagcagcgaatgaccgcgggcaaagcaattcacttccgccgaaagtgttgttgtttgtgttatcaatttgtgtcattgtttttgcatatttaatttattcttttcttttggctgatctgtcgcttctctccgctcatttccttttctgtttttatttgtttacgcttcaggaacgatttattacttcttctttaattggtaaatgaatagtgaaagggttgtcctatatctcctcagatttatgattttgtcgttttcatcttctcataaataaatattgctttatttttcaatcaaaaaatgatatgcgttttacttttgatcactgattttgttccgacaaattcgattgttcgcattttcttcgtccgtacccttctgaccaccgcccattctgtcacgagtgccaaaagtgccgcacttagtgcgacaaatgccacaatccatgcccaatttggcacggcgtgctgccgcagtttccctttcgttgaatggaagtcgcggatggcaaagccaacgcgatttgtcagatcgatcagaacgtcgacgagccgattcccttttggggaggggggggattaaaaagacggggaatcgaaatgaatgttttgttcaccttgcattagcaaattcgaacattcgttttgagcattgacgaggaaagggaaaagggtcggattgtcttaatgagtaaatgaaaatgattattggctgcgtcgttagtgaccagtgtgcaaagtgaccgatgaaatctaaacggacgaatgaatgcttttccattgaaatgcgacgtctttgtccccccccccccccccccccgaaattaccctctttgggttggtcgtcagtccctccagcagaaccaaaatgagaagcaaaagggtctttattattattcgacggaaaaggcgggtcataccaatggcgagaaccattggacaatgggcacccaattcacgacgacgatgttcggaccatcggttcaaaaggacgtgcgcatacagctgaatgggacggggcaagtgccaatgacagaagggaaggtgggcaatcgtccccttcttttgtgccattgccaattgtctcccccttccatttgcccttttgtcgttccactgacccgcatgaacactttcgtgcttctgacaaatttctgtaccatttccgcgctcattgttccgcacggaaggcggaaaagacagccgaactctgtgctgtttctggtaatggaa

SEQ ID NO: 12296 - DNA, 1656 bp, Heterodera glycines
gcagggtcgccaaaaagcgacacgcttcagcgattaggctgaggtctgccgaccttaaaattggcgttggcagtgccaaatggacaatacaaagcccgtttcagcagaaacccaccaattcctccgtgtaaagcgtcaaataagcttcatatgctttggcggcgttttgctggttttcctgttcttcgtaaagtctgaagagaagtcaccttcaattggcggactttgctttattttacttggccaaatgcgtcagcgcatttccctccacgtcgccaatttgaaatgcctttttaaagcatttttctgcatccgatttccggtcgattttggagaaaatcacacctaaaaaagaaatttaaaatgacatccgaagaaaaggaaaattaatccgaaaaagtctcgcctaatgcgatcaaaattctcgagtccgctggccgacatttgtgcgccttttggtaatagtaaagggcggtctccgattgtttcagtatttcgtaaagttggccgagtccgtaccatccgcggtaacaaacggaatcgatctctgacaatgacaaacaaaacagttaaaagggcgtcgtaaaaaaaagtaaaaatgggcaaagattgaccaatcaatcgcccacctgttgcctttttgtacgccgttgaggccaattggtggtttttcgtctccaaatattcgtgtcccaaaagcacccaaatggacgcatttgtcgggcacaatttaatcgcccgcttcaaaaattcttgcgcctgctcgtgcatgttccgtgcactgtagtaattggctgcaaaagaattgaaaattgagttttgcgctgaatgccttttcagtgagtacaccccaaaatctcgccgcagaaattaaaaataaaatttttcaaggaaaaaacagaaaatttttttataagaaaattaaaaaaaaaaattttttacaactttttttttgaaaattttacgaaaaacagtaatttattataaaatttcaagaataaatcgctgaaattttttttgattttcttataaaaaatttctaaaattttattcttgtgagcgagattttgtcccgtccctcttttcagtaccgacgatgcaacacgtctcccagtggaatttgtgactggcgtaaaaccatttggccagcagcgaaagttccacgacattttgctaaaaaaaagtcggatggagtggagaaaacgaggaaatgattagattacccgaatgtacagcgaatccgagtaaaagtgcatctgccaaaaagagtcaagaaataatgccgtacaatgggacaatggaacagcgtactcactcagcagaccccaccaccccccgggttcacttcatcccccccccccgccagtcgtttccaaccaaaaaatcaaaaaaaaatcaaacagaaagtttaaaaaaaccttagaaaatgttttcatatgaaatttcaagaaaagtaattttaaaaaattttcagcgctttttcatgaattttgtgattaggaaacgacctgctccgacaaccgcccgccctacatcaccatgaattacccaatttgagaccatttccaacatcatccccaatttggacctgctcaattcggtacgggtcgatcttgcgaacccgggcgaaggaactgatcgcactgtcgtgctcct

SEQ ID NO: 12297 - DNA, 1716 bp, Heterodera glycines
  misc_feature (1698)..(1699): n is a, c, g, or t
atcactatttttaaatataataacagcagttgcaatcaaatgtttttcttttttatttcttcttattgataaaaatctttaattttttaacaatgttttttgcttgaaatttatcattcaacaaatctaaaaaaacttacggcgttaacggataagggaagccacatggtgatcagctgtgatcacaggtatctttcaaatttgtttatttatttattttttatttcatcttgtcacacaattacagctaattgatcaatcgcaaaataaattagttagttataaaaccattttacataatgatattaattaattaatcttatacagcagataattattactaatcgtagcatttaacattagtaattacaaaacgaccgcgaacaggtgatcaagaaatgattgaatagagaatattttgcatataaaagaccctcaaatttgtctgtaatcagtttcaaatcgtattttaattccaaaaatcaacaaattcacctcccatttttacaaaatgtcccccctccgtttcttcgtcgccctttttctgatcactttggcaattttggccgggacccacggcactgttgagaactcagtggatggtgggccaaacatggcatcgccgattatccgtgaacgccgtaagttttattttattttattttaattgttgaatttaattaaaggttggggccatggcggcggaggccattggggctgaagaaaatggtggaagagataatggaaaatggagaacggaagaagcgataaacgatgaaaaacaagaaaaaataatttgtggtagaagaaaaaatgctgaactcttgttcgaataaagtttaaaagaatttcttattttttactcaaaatcgtcaaaaaatttgggctttgacgcaatttaaaatttaaatagtatttaagtcgctgatttctaataaatatgtaaaaaattcgataatgtaaaatatttttatcaccgatcatcaatcattaattatgatcatggttttagccaaatcgttgttgttggtgctgatcatgctgtaaaatcatggccacaagctccgcttcgtcaattccgctgatggcaatgcgcgcagcggccggtccgttgacgaaccgtcgcggcaattgcactcgcgcaccagcagcagccgaattgcgccggtgccgacgcccattggcaacaaatttgaagacgcgacgctttccctgaaaactgaaaaaattttaattttggttttgaatttttagaataaaaaaaagttttaattttttgctaatttttcaagtcatccttttgaaaatattaagaatttttcgagttttgctagcagaaaaattcatttcgattttttaggaaaatttctagattttatttgaagagtcaaaaagtttttcaccgtctccaaaaaaactataaattaacaattctggggataacactttttcgccaaaatgggcaaaaaaaatttttaatttttccacggcatggctatttgcgacaccgggatcaaaaatgtttggcataactgaattcacgtcccgttttttgaatctaacttaatttcccataaatgtcagtcagcacagttttgattttcgaatcgtataagaaagtcattgttgaaaattgcctgaggcgataattgttttgaaccgcgccgcgttgattttgtgtcgccacgctttcatcgnnttgcgatgcgtgccatt

SEQ ID NO: 12298 - DNA, 2241 bp, Heterodera glycines
tggaaattgtgtcgttgacatatgaataaagtggtcgcaatgggccataattggcctcataaatcatttcatcggtgctgaacgtttctttaaaattggcattttttaaaaatttaattaaaatttcgaaaacttattttaccaaaaaatgtgacagcaacttgtaacaccttggacatcaaatacatgctaacaacagcgatcagtgtccgagtggcagccttttgtaaggattttttaattcttgattaaaaatgaattttttgggaaaagtaatataaattgtacaattaataatttccgttagcaatttgattaggttaaatttttaatttaataaaaaaagtttaaaaatatatatatatatatatatataaattttcaatgcgtcccgaacactgggtacaaaattcggaattttagaaaaacctcagaaaatttttttctaaattttaaggaaaatttttttcaaatttttctatcaaactttttgacaattttatgatcaattattaagttttttcaaattttccaaaaaatcgctgaaaatttttcaaattttctggaaacttttctaataaaaaaaaatttttaattgattttttttaaatttcctcacccgcaaatttttcttctgcgcgttgtcctccgccaaggttagcgcgtgccgttgcagtcggcgaccactgcctttttggcacaaactttcgcgccgtgtcgccgccgctgcggcggcactcgcgcgtccgtcatcactggatgcgctgctgccgcgcaatgtgagggcggacgcggatgcggcagcggtggcaaatgaatgggtggcacggatgtgctcgcggttgagcgcacggatgatgaaaaagttgaggatgatcagcaaaaagaagggcacaatgtgatcaatctgtgaagcaaagaggagaaaataaaattgaaaaatgataaattgaaaatttaaaaagaaatatgaaaaaataaataaataaaataataaattgaaaaatttaagaattttataaataaatatttaatttaaatataatttgtatttaaaaaaatacatatttaacctaccacattcctgaagacgaacatccaccaaaacctatagaatttccattcttctccttccactgctgaacggacttcgaacctgtggattttattataggtattctaaagtttgaatcattggaaaactaaaaaaaatttcaaatcccaaaatttaaaataaaaccaactaaaatgggtaaacttagttcagaaatagtaaaaataacattggttatttattattaatttgttttccccgaataaattcaccgttcaaaatctgtacagttggcaatctcgatcacctcaatctcgaaataaatgctcattttgtaggcaaatgacacgcacatcaccagaagggtcacttgtggccgatgcctttgcaaaattctgaaaatttatggccatagattttcttagttataatttttatttcaactggtttttgttagtgatttgctcgactgatgaatagagacgcaaattttattgaaaaatcgcaaaaaatatatacttaaaatacggtaaaaaatccggaaatgttacaaagtatgtaatataaaactccaatattatatatatatatccaaaatatgtaaataagatttttttaaataaatatgtttttttggactaaaaattcttggaaaaacgtgaaatattggacaaaaagacataaaaaaaatcctaataaggtttaaaataacattttggtattttaaaataaccacaaaatttgcgtccgtccctactgctgatgaataacagagaaatttgtaattttagtttaattttcaaaatagataattcatattttttcctttttaattattttttaatattaattaaataattttatcaaattcgcgagattctgccagccactgactgaccttcgtgttttgacaattttacggcccgaaaatgtttgtagcagacgttcagaagtggccaacaaaatcatgaacacggaggcgaacatggcaaaataggagaaacacaacatgggccggagataagccaaaaacaaatggtaaagccacaggagacgaaattggtccactaagaagttttaaattcattaattaaaactcattaattaagattcttctgcgcgttattagcgggtggggaaaattttcaacaaacaaaaaaaagtacaaaaattcattttagtttttg

SEQ ID NO: 12299 - DNA, 3494 bp, Heterodera glycines
ttggggacccgacatctggggatccgacacttagggaacccgacatttggggacccgacttttaggggcccgacatttggagaccgaacgacatttgtggatccgacacttagggaacccgacatttggggacccgacttttagggacccgacatttggagaccgaacgacatttggggatccgacacatagggaacccgacatttggggattttaatgaaagaaaaaaatattaaaaaatttaatttatgtccaaaattaaaaaaatttacatctgctttagccagagttaattcctttgcaagaaaaaacaaaataatagttttaatgcaccgaacaaagtcactcgaaagatataaaacagaaaagatgacctcggcatttattgcaattagacagcaaaatcgtctggaactttttgaatgcccttgaattcctgttcacgttcgcccttgggaaagacgttttaaataaaaattggcaagaggtgtactgtgcataaaaaatatattgtgatatgtctattgtgttgtggttagtatgtatgtatgagatcaaaattaccgtaaatccgctatttgaatgcccctctctggtagaatgccccctccaattaaatgcccttttttggaggggttgaacaatacaatgcccctctctggtagaatgcccctctccaataaaatgcccccctccaggaggtatcgagtatatccgcagggattctggggctttgtcgatgccgaaagcgaaatctgattacagattcgttatcaacaccctaaaatacctctaaaaagtatttttcagctaaatttgggtgaaaaaatttttcccactcagaaaccatgtggtcccccccctttggtcccaaattcccaaatcaattttatttttctaatcttttccaaaaaaatagtagaaatatgaaataaatacagttctatagagcaaaaaattgcgggttttttgagtatattaattttcgaaaacatcctttaagaaccgagttctgattttttgtctgaaaattcgaatttttccagaatttctggaaaaaatttttcattttgatgatagaaatttaaaataaattcataaaattcttcttatttttctctatttttaaagctttattgtacttaaattgatccactttgaaatgagttatgaattttcaaatacgagtccaaattcccgagggccaaaattaaaaattttcgaaattttttaaaaattaaaaaatttgtaaaacgtaaaataatactcatattcatgctctgcactataaaaccggttagaaaaatggttttcacccctttttgactcgcaaaaaaaatttccgagatttgaggggttgaacaatacagtgcccctctctggtagaatgccccctccaattaaatgcccttttttggaggcgttgaacaatagaatgcccgggcattcaaatagcggatttacggtagctatttccttgcggtgagtccggaaacagagttaatttaaaaaatattattatttttttcttgcaatggaattaacgctgcctaaagcagacgtagatttgtttaattttggacataaattaaattaacatttatattgaatcttcaacaaagttttaaatttttcatgctgtaatttgctgaattcgagatttccattctaaattgagcattaatttttgtgctttttggcatttggtgtgataaacaataaattgttccatatttttttattccccataattaccgatttttaaaattatactcttttttggattaaacattcgaagaaatgaagctaatgaaaaatcaacatataatatattcaaactgtgcaaatataatttaaaaaatttttaaatgctattttaagataattattaccattgatttattcatttaattgcataagttgtccataattgtgtgatgcttgcctcccctaccatacccatttatggaaatctcaataattcatattataaaatttatctcataaacaatttgaaatgggaaaattatcctttttcaaaaatagcattcaaatttttgttcgtaaacatttaaatcccaattttaatcaacaacacattttattggtaaataaattgaacattatttaaactcacctaaaagttattcaactcaattgggattttttatgaaataatttttatttaggaaaaaatgttcacattcatttgcttctttatgcttttgatttcgccaattatttcagcacaaaactccaaatgccaagtgagcaaaaaaactaacaaattatttggttaattaatataattaagatatttttatttttaatgaaaaattttagttggatttttagtggcaaaaaattaaattaggtaaaaaattgccaaaattgcgacacaatggaaaaacttttctgtacataaagtaaagcaacagaaaaataaatgattttattacttcaacaaatcgctttttaattaattaaagatgagtttattttttaatttatcttttgtttcagtgtcctaaaaatgagcagcccggccaactgaagtgcaccggatgtgagccgagttgtgacaatcggaaccccgacggcgcgattttgcaattgctcatgtgactgtgtgaaaggatatttgcgcaacaaacagggaaaatgcgtgccgaaagaacaatgcccgcacaaaaagaattgaaagtggggaaatgatggagaactgatggaacttcaattttccaagtaaaaaaaattcaacatttaagtttttggggggttcatttgtcgagatacatttctttgtttttcattttataatagctttttttgatattcattttgataaaaaagtttttgggtgttcgttttgcatttaagaatatataaaaagttcaaatttaattacaaatatgaattttgtttaattgatttgaatttgaaaaaaaatattgataaaagatttttttgtccagtaacatcaaaaatcagcaaaatccgttctttccagcaaaatagaaacccttaggaaaatccattttaaagctttcataataaatttttgaaaaatcttttacacggtctttatgcactgactaattgaatggtgactgaacatttgcgcccctacatttgcgccccgcacatttgcgcccctacatttgcgccccgcacatttgcgcccctacatttgcgcccctacatttgcgccccacacatttgcgcccctacatttgcgccccgcacatttgcgccccaattatgaacaaaaaaaaatatttataaaattgcctttcccaagggctaacgggagattaatatgattgtttgtttattcaatccaattatcaattcctttggtggtcagacgaaatgaaattgcgtgcagatgtcgtagccaatgctgttcattgcgatcattggatcttgctcgtcaaattgggcaaccaagtctcgaatagcacggtcgttttcaagataatgttcgaacgagg

SEQ ID NO: 12300 - DNA, 2356 bp, Heterodera glycines
gacggtgggggggaatgaagtgcacccttcaccccccaccccgtttaagaaattagttcctagcgatttttttggagaagaatgcctccagcagatgaatttgcactttaaagtgccattaattggtaaacaaatgccaatgtgattagtcagtccattccacacaataaattaaatgaaaattttaagggaaacagatcaatttcattggtatttcgttaatccgtgatcaaaattgctttgctcgagtcgagaacgagactctcgagcagcactgctggacatgaacttgcccgaggccaacacaaagaagcaaaaataataatcttggcgaaacgttctgcccaaaaaataaaactcttggcgaagtgcccaccaaccaatcacacccatttttggggctgggttttcccccaaatgctaccgagcggcacgatggtggtagcaacagttgtgccaccggcggctgtcaatgacgcttttctgccgccaccaacaaagacggtggcgccgacagagggtgccgtcatcgacgacgacgatgccgtcgtcgtggtggcgacggcgttcggcaacaacggcacggcggtcttggcaccgcgcccgctgctgctgcacatgatggacggcttgtgcaacttcttcagctcatacgcgctgaacacgccggtgccccagatgccctcgctgctgtcgtcggagacggtgccatcatcgatgtcatcattgtcgtcgtctttgtctgaaaaatggacggatatcgccatcggatcagatcgatcccgggtctcgagactctcggtgttttatgaaaagttaattttgtttatgaggggaataatgcaagtccccctccgcatcagcaggaaatgtttagaaaaaagaaaaatgtaaatttttcaacaaaaaaaacttaggaaaattttatatgatttttttagtgtaaaaaaaaatatttttttaaatttaatttagttttttttaaatttttgggaaaggggccccaaaaaatttttgacgatttttgaaacaaaaaattttttatatttgtcaacaaaatttaaacattattgggaaagttcgaccgatagttagttgtatgtgtttgggtttacaatttttattcggcaaaatttcagaaagtttcaaaaaagtacaaaaaaaaaatttgtttttgttttgggaaatttttatcttattatatacaaaaaaaattttgctgctccgacttggaagccatctggaaacaaaatgaatttttttttttgaaaaatgccaaaaaaaatttgtgagttccaattcggtcggaggtgtgtgtttgcgaccgacgcgacgtacccctgggcctgcgccgcgtctccggcttgtccgggtccgtggtgaaaatgtagttggccaaccacaggtccagctcgcggatggcgatgctgatgtggtaggggttgacgcaaagggtgggaaactgcggaaaaatttttgtaaaaaattaaattaaattaaaaatttttttttttgcaaatttttctaattttaatgccctcctctcttctcactcacattgcatgtgccgcatttttctagccgttcgccgtcagtgctctccaatggaatgccctaaaaattcaaaaaaaattttttttttttaattttgtataaatcgctcggagaaaaattttcctcaatttttgggggtttatgccaaattatttcttcctttttttggggtttaactcattttccggcccttttatttttgatttaactcatctaatcctctttttttggggggggggggagttgccaaatattccgtcatttttggattttcccccattttctttgcccaatttaacccctcgcccccgattttttcgtttttttttgccaatttttccccatttctggcttttttctccttggcatttccattctcaattttcccgaaggattttgtttgccttgaacaggatgaccatgaccaggtccaagcgccacactttgtccgcctgccgcaaacagtcaattcggcgcattttgcccttttggtccgggttggacagcacacagcacagtgcccgccgctgtgggcacgggtcggcgatggactgcacgaaagtgtcacggcactggggctggatgtccttcctgaacaatgccaatgtcgaaaaaataattttggaaaatttaattgctaaaaaaggcccaatttttgaatttacggagggttgtgacactcaaaaaaattttcaaattaattgtgagggggctgaatggcttcactggatgtcgggaaaaaaatccaaaaattgacatcgatatgaaatggaaaatgacgaatttcgcctaaatattctct

SEQ ID NO: 12301 - DNA, 1363 bp, Heterodera glycines
cccaatttttgaatttacggagggttgtgtcactcaaaaaaattttcaaattaattttgagggggctgaatggcttcactggatgtcgggaaaaaaatccaaaaattgacatcgatatgaaatggaaaatgacgaatttcgttaaaatattctctgggggcatttcggaaaaaatttttggatagaaattccaaacccaaaaaattacaatttttaatttgtaaggggctttctcgcaaaacagcaaacaaaccggagctttcccaagaggcgagcagcccatttctgcttttcatcggcactttcttgctaaaatgggaaaaaattaaaaattttctgccaattttttttcaattttttttactgagtttttctcagtaatttaaacccttggggggggggggtgattaacggctaattagttacccgacattagtgtcccgggcattttccatttttctggacaattaccaagattttctattagtagttcatgccgaatttcgtgctcggttgtgccatgtatgaatgacattactctaatattttctcgggcaacaaaaaaaggctccaatgatctaattatatcatcataataattgcaaaaatttcttggacaataaaaaagctataatagcatccaattgttccatggtacccaaattttttgggcaaaatcaaagtttgtcccgattttttccataattgccaagatttcttggacaagcaaaaaaaaatgcctagaattacaacccgaatttgtgccatcggttgccaagaattcttgggctaaacaaaaaaaaaatgccctcaaattttgtccccattttttccatcaattgctaagaattctcgggtaaaaaaaatgccatccccccccaaccccaaattttgtgccgactgcttggccagcagccatgccaaaaagccaccgaccatcagtgcctctttggtgtgccgttcctcctccagcgtcatgctctgatcacagcgtttgttgtgccgccgcttggcggcctgcaaattgaaccacacaaaggcaaactcgcgcacatggggcaacaagtcctccacgaacgggtggaactcctcctgacaaacagcagcaaaattcatggcacggaaatgggtttttcaactttcccccctacgcccttctttttctcagaaatttttttttaaaacgacgaaaattttagtttccgaactgtcttggaggaaaatggtaattttttggactccgagaaagtgtaggtaccccactcccacccccaagacccctccatactcaaaatttaaggggttggcaattttttggtgaaaatttgttacaaatagaaaaattatttttaaaaaatttttt

SEQ ID NO: 12302 - DNA, 2139 bp, Heterodera glycines
  misc_feature (24)..(24): n is a, c, g, or t
ggggggggagggggaccgaccccncagaattgaggcctcgacaaatcaaaattccgctttaactcgaaacttgattttcccgtaaatttttgcaggctgctaaaaaaaactagccagcctctgccccatggaattgatgggtcttcaaaaccaaaaattttcaatgccaaaaaaaatttttttttttttttgccaataccgaatggcccactgatgctgcttcgtcctgctgttgaaatgaattgtgctgctggtgatagtggccattaactgtgccggtgaggacggcacaatgtgccgaatttggcggagagattgccgctggggtccgagtgcgccaccgatttgtgcaagtgctgctgctactgctggcaggccccagctcgtcctaattttttgcttttgaaaaatcatatattttacacagggttagtcatcccaaaccacgccctctcccaaatttgtaaattcttaagatttttataggaatttcaaacccaaaaagcgcaataagattttcgaatttaattcaaaaaaaaaaattcttttttatatagtcaagccttaataaatttacaccaggaagtttagcccggaaacctccaaaaaaaccggaatccgtcctgactcttaattaattttcggagtttcgaaccacaaaaagctcgcaaattttcggttcccgggacaggtagctagctacaccttattttgcatttgttttatttttctaaaatttcgttggcgccctcggcctagaaccttcattacacaattcgagtaaaataaaaaaaaatttatacaatttcatgtgattgtattactgtgtcattattattgtacgactgtctctgctgctgctgttgcttatggttgtggtgcctttgttgttgttgctgctgctgatggccggccgtggaagaggccatccaattttatattttgattttttttaattttgctcaaaatactccacaaattttcgtctttgattggcaccacattaaaaaatctcttggcaaaaccttaaacattggacaaattatcactgagaatattttccttaattactaaataggatttcgttagtcaattttccgtttaaggctcacacatttttaagacatagaaaaaaaactttttttaaatcttcatttttttttgtatttttggctttgtataaaacaaataaaaattatatttaaaatgtcatggcgcggagtcgaacctccaccccttcctttttcctttggctgtcttagaaaaccactgagccagatacgcaatttcttggtacaataaatacaaaagtctgcaaaaggttcgaaaaaatttggtagacaaaaagaaaaatggcaaaaaaaagaaaagaaaacggaaatttgtacataaattgtcgccccaaaaactttttaaatgcctccaggattaaatttttaaattttgggacacaaatttaatggactgactgacactgactcattcatttcatttcaatcatcagcaaaaatcgattagcaaaagcaagaaagtacacacataaaagataaaactgctgatgaataacgaaaaacccatcggttgtttctttggatttattggaaaacgatagacaataataaattaattttcctcattctcattaataaataataataataaattgcccgacaacctaattactgctaacgaaatgataaagcgataataaaagtgattaatgtgcgatgcatttgcctggagaaaatggcgtggtatgaagtgttggaaaatttattaaattaagaattaaatttgcgaatttttcatggtttcaaaaatttcacaaaaatacgaaaatcaacaatacaaaaaaaaatcaattattaaaacaaaaagccttaaacctttcactcgagttagcggaccagtaccggagacggtaattatcgggttttcaggttccaatattcttttttgaaaaaattataagtaccactatgattttggagtgatgctctacataattttcatggttattaaatttaaaaaaatcaaccccctctcaaacaagggctgaacctcgccaaagcctatataggcacataaaaattataattattaagcaaaaaaaaaaaaattagcagcagcaaaagaaaa

SEQ ID NO: 12303 - DNA, 2562 bp, Heterodera glycines
ccggcgtcgattgtgccgataatttccgatttccgagcgttattttttccttttcattttcgctatttcccaattcaccgttcatgagacataaaattgtgttaatttggccacaaatttggacggcgattctctgaatggccgagtccatctgatcaaatttgcaattgtccattgtctccaattcgcgaaaaagtcgcagcaaagagtcggaaaagagttgtgccgccttaattacccatttagtggtgcccttctttctttttccttctattttcaccttttccatcagaatgtccgtctctttttcttctctccgtccttttttcttcatcttttcgttgcacttcgcttcttcttctttttcttcgtcacttttttcatttattttaatcgcagaaattaatttttcgaagcgaatttcgaatttaaattccgctggaggctgttggaaaagatttaaggcggtggagaactttaaaagccgctttttaaaagatttattgcttttcgtccgaacgtgccattgctgtgagtattctgaaggaagcgtcaaccgttcgttggcacttcgacacgccgcactcctccacacattcgaccaacgcataccaaaagctgtttttgccagtgacaatgcttaaacttagaagctcaacaaatcgatgcccatcgccatttattcgtttggctaatcgaagcgcttccgaacgctttgagagggttggcgaaagcaaagcacaacgccacaattcttcaagcagtggaagaagttcaacagcagagtctgacgaaagttgaggcaatgaaagtgccaatggagacaaaagacgcagcaattggtcaatgactctgatttgtgagatgggattaattgggaaggggtgaagaacggcacaaactgatagaaggagtgggcactttctggcccctccagtgccattgacacaggaacaatgcccgatggacgacaatcggtcgcagagggagtgcccgcccttttcagagtgccgatcagttgcatgccaattctttttgagtagttttcattcatttccgagcgtttcgcactgccacgtaactgccaaatgatcagaggtaccaattcgtttctgcaaatttgcgactgaagtgagtgtttggcgaccgatcactgactccaatcggtccaaaatggcacagtgccgtccgatcatttgggggtccaatgcgcttaaaacgccaaacagagcgtccaaagggagaagcatcggttggcgtttgtccgctttttcttcgctttgttttccgcccgaaagtgcgtcgatcggctccgctacttctgcgacggctttgcccattctgttgatcaactcgcccaaaagtgccgccacgtccttggaagctccattttcctccgattcgctgttttcctgttcagttttttctgctatttttttctcccattttttgtttcatttgttttttggtacttttgcatttccctccaaaacgcttttacctcgatggcaattttattcagaacgtacgaattgagcatctgaaaagtgccaattcgcttcggacagatacagaaaattgcctgtgtaagcgctgcccgagcagccggacggacactcgcggaatccgcggccaattcaaatgttttcttgcaaatcttttaaatcgaaatttaattttattttattacataattattcattcaatatttttctcaaaattataataattattttcttttttttaattttgcacttcaaatgcggcgagcacttccgctgttcgaatgggaatttgtggggacgaaatcagctgaacgagcagagttaggcattggcactgcgtggcgggcatttcgcgccacgaaggaatgttggcgaacagtgagaggagttgcccggccaaacattcgcccggcggcgtttgcccttccgccgccgacgaagcgccgcctcggagaagaagctgaccaatgggaacagcagaatcaaaaccaaagtcattttagaaaggcacctgaaccccctcaaaggcaatcgctgcgaatttcggcttcgatgttccaaatgccataacaaaacattcaatgcatttgcgccgccgctcaaaagcatttgtttgatcgggcaaatctgatcagagcaaaatgaacacatgaatttcgactgatcgggacacaaacttttagccttttgaagtgcttcaaaaaggccgtccgttggctttaagtcgggctgaacttcgctttcgaccctttgatggcttttcccctttactcacctgattgcccaatttgtttagaatgccttccatttcggcttttctttcattgaaacatttcattcaccaaaaaagaaatccattcgaagaatgccaaaaggaaaagcacagaaaggagagagaaaaacaagaagaggggaggaaataatattgaggagagacggcggacaaaagcgccgctaagtgactgccgacgggaatccccccgtcccccgccgggcacagccacttcggtccctcgctttgggtgagtgccgcggcaatcgttcattgcttgtccat

SEQ ID NO: 12304 - DNA, 3078 bp, Heterodera glycines
taaagaaatttacaataaaaatatttaatagacttttcttttttaaatattacaatgtgaacaaaaaaaaattttgttaacagtttaagccaagaaatgagtttggggacccgacgagaaactgttaattaaattatccctgacaatggcacaaccggtactaagaaaacaaagtgatctttgcttaagctattcgattgattggcttcagcagcattaattcgacatcctccaaaaccaaaggctttcgtttgccatggaaatagtcgatgagagccacgatgtttttgaactcgccaactgtggtcagaatctgaaatgttggcttccggcgcgacaatttaagcgatcacagggggacgggacaaacggacattggacaaacggacaattgaaaatggacaattggcaaccatttaagtaccaaaaaaaccaaatgagacccgtcattctcgattggttttttggcttaattcaaagggcttatttgataggtcgtttcctaaatctgccaaggagtaaggaaaacaaaaagtaacacatataaattcctaacttcactcagtttcaaccaaataaattaaattaaatttggctcaatttcaaattaaataaattaaaattattaaatgactttaaaatacatgcatgaccctggcaaaaaagttatggacaataattttttatatttttgtaaaaaaaatttcttaattaatatttctgatagagaaaacctagagctattaaatagataccatgaaatattactttggctgaaactgagccaagttatgaattttatgtgttttacattttttttattttcatttatgaaacgacctagcactaattcaaagcataaatgtaaagttttataagcatgccaaggtcaaattcccatcattttgaagaaaaaaaagtaaaaaaatcatttgaaagatccgccggtaggggccaactgcgtctgagacaattttaataagccataactttttccgtaattgcttaaatcaaataaatttagtatcatttgaaaactttatatgtatcgaagatacttgtacgttttttctacgcgattaagcaacccgtaaaatttaaagcttgaaaatgcagaatgttaaggttttgaatggtaccaagtttgtttgatttgagaaacaaagaaaaaagttacggctccttaaagttgttttggcccgctccttcggccattttcttttttgcttcattatgtttttgaaatgggctgtgtttggccttttgtcctttcggttttgccgctccctcactttcccctcattgtccatcagataaacgtgccgccgttctccgtcgttcattcccaccaaaatgaattcgtcgttgttagggcttttcctgaccagaaagtgcccattctcgcggacaatcatttcggcttcttctcgtgtcattgtcccatggaaccaccggcacttttccaatccaaaagtgacctccctaaaacagctcaaagatgggcctgcgccagcatcgctgtctgccaaattgtgcattaattcgtcgggttttcctctgttcccaacttggccgtgccgtccgtttgggccgcggcggcacttccggcggaacgaccgaagagagcgaaggaaagggacggatttccaattcatttggcggttcgggaaaatcaaaggctatgttttgagagcacaaatcagtgcaaattggagttggaggctaaaagtgatgggaaaatgatggaaaattcaacgaaataaaaatgcaatttgtcccagggggaagcccttttgaaaaaaacagtaataattttgcttttgaaaattattgcggccaaatatgccaaaccatcgcaccgtcgaagatggcactggagttttcgcctcttccctcgcattgttggcattggcacttagacggaaggtaaagcaaatggcgtcccgaacctccaacagaacggaacggtcatttgccatgaacacaaaacacttgcgcactctttcacccttttctgacactttggcaacgaaacagaaaaaggaggccatttcttaattcgaaaatattacggggcaagcgaaggggggggggaattagaaattggggaatggggaaggagggaaatgaacaaatcgcctcaaaaaggaaaggacaaaaaagggaaaaaagaaggacaaaaaaggaaggacctgcctcggagccaagggacagcacagaaacatccgggatgagaaaacggtgcaaaacgcgggaggaggaggcgtcgatgagaagaatattgcgagtggacacattaagcataacatcggcattttgtacgcgcacggggccacgcaaatactaaaggaaacgagcggagaaagggaaggcacgggaagggccaactgagcaaatgccgtcaccagccaatttggcacggcttggccccgcctcgtcaacgaccagtcgaataaagtctctgaaaattgcatttgttgtgccattgttgcaattacgtgccttgtcacttcggtttgtcgttcgattggcagcgaattcagtgatttttcgaccacaacaaatccgacaaactgtcaaaaatcggagggattgaaaacgaaattgtttctgctgatcacccgaatgtaaaaagtgatgccacttttctgcagctctttctccgtctctcttaaacacttcgaatcgatcggaagagaatccatcggcggaagaacgcttttttgagctttgaaattagattttgcagtggcaaactcagcctttcatcacattaaatgtgcaaaaagagagaagggacgcaaagaaggaaaaggcaaattgattattaaataagtaataataataatatttagatagaaaagaagaagcttccccgagaggaagattaatggatcaattgaggcaacaattgatcctatatgatcgagcaaagtggggagctggggagggcaaggtcggtagttcagctggtagaacactggtccggaatggcagatacgccggttcaaagccagcccgccccatagttttcccacagaggcttcctcagctcgttcatatatttcaatataataa

SEQ ID NO: 12305 - DNA, 2293 bp, Heterodera glycines
tgcaggtcgcaaaaatcacacaaattttagggggggggggggggggggaaacgtaaaaattctttttgggggagagtgaagagtattagcgcaagaatgaaacaacaatgaatgaagagcatgaatgggagatccggttttgctggggtgggcccaaaattggggagggaattacaaaaaattacaaattgggggacaaagggacaaaaaggggagaaggggcgtttgatggggtgcgttaaacatgttaatttgaagaaatgtttgaaatggttttttaaaagggaaagtccaaagattatttaccggaatcaatgccataaaatgccaaattattaaatctttgtaatttcagcaatttttgcgatttgttgaaaaattatggcatatgtaagctccaatagctgattttattctttaaagaagcaatgaagatgccttcttcaattttgatctcattattaatgattaatttgtttaaatttcagttttcgtattttaattgtttaaaattattaaaaaacaaatataaatttttaaacatttttcctaatttaattttgcctacgaagaaaatgttcggattttaaagtgaaaaatgcatagcattttatttgttatttcaacattaaataatttgaatgaatcattattaattattacaaatgaagctcatcattttcatcggttgttgacaagaaaaacaaaaacaaaatttgcacaattttctccacaaaataattttcacatgtccgtacgaaacgaaattgtggtgcaccaaaactgaaaaattaatcatttaaaccattttttaattttaattttaccattattttgtttgtttttttttggtcattcgacgctaattagcggggcatcggaggcgacacttttcgaattgtgtgggatttggtcgtaaacgctcagaagacgcctgaattttgtaaaataaatattttttttttattttaaattcaactaactaaaattaaaattaattaaaattgttttccaccatttttcgtgcaatcggccgacaaattgccctttccgtgcgcttgagaggtccctaaaatcgcaaaaatatgtaattaaatatattttataaattaaaattccaagccttcgataagcgtaaatattccataaaatccacgccacggagagaaggccataaaaggcaatggcagtgataaaatagggccaaaatttgacccaaaaatcggcggtggtcgaatggaaatgctattaaatgatataataattaaacgtatttgaaatttaattttgtcaattttattaaaaaggtggcaatttgtgtgtcaaattacctccgcattttcggacgcattggtggcaagggacaaattttcgctaaaagaccaatttgaaaaaaacaattaattattttgattgaatttataaaagattgttgttttgttgcataattaagaaactttttacatttagtttaatatttaataacttttgaaataaataaatttaatctttaggctccaattctaattctaaaattgttattaccgaacaaattttgaattatttatatattctctcatcaatttatattttaaatatttctttaaaataattcttttaaatgattcactacttctatataaatttattaaaaaaatatttattatttttttaattatataataaaagtaaattcgtaaatttttaaatttttgttaattacacaaatattttaaattaatttaattatcatttattccaccttaatgtgtggtggtgcattggtcgttgcttccttttcttctgctgctgttcaaatgcttctccgattgtccgatggcaatggccaacccattaacaaatataaataaataaataaataattgcttctgattgatcaaatgttttccctttcggcgactcattcaaaaataaaaaatttgaagagcattttcaatttcatttttatttttggaaatttatttttaaccccccaaaattaaactaaattttgtggggactgtgtaaaacactttcaattatttgttcttcagcagagggaaaggagaaggaccggcaaagatcgacgagggatttgcagcgattgcgaaagaaaagcgaacgattttttgtccattttaaattggcgtggaacgacccccggggggaaatgggaaaagggggaaatgtgtggcttttgtttaccttttgacgagaatcgccggcggatatttgagggggcgagagagtgtggggaatggggcggaaaacaacgagggacagtttgagaatg

SEQ ID NO: 12306 - DNA, 1516 bp, Heterodera glycines
tttcagagctttggggcgccggtggaaaccaaaaattggggcggcggcggacgacattgtatgggcggtgccggcattaaaatgcccgttttgccgggcacccaatttgttaggggcgggtcgaattcattcgatttctataatttttctgtttttttttaattttaaagatcacaacgaaaatgaattcagagtttgctgatttcgacattcattttgtttgagtccggcgatgcctaaaagcgccaaggggaaaatttgaatttattatcaaaaaaatctaaaaaaaatttcctattccttcttcgaattccggaaattttttgggcccaaaggtacgcccttaacatttacaaatgtttgtattgaaacatcacatggaatcttctcaaatgtttctttatttcatcaaaatgctcgtttatttattcccttttttcccaataaatttttgattaatttttttttcatttttcgttttcgatgactcccatttttctattttaattcaaaaaattgatttcgaccccgtccctggcaccacggccgggaatcccgtgaaatgccggtggaccaatgccggccgagtccaaactcaacggggaaaaggttcaatcaaattggcactaattatttaataaggtcgatggaaaagaaattgattttccatctttttcaattatattttaaaataggcacataattcagaggaaaaataagggattttccgcttttttctgtttgatcaaaaatcggatccaatttttggcctccaatttatttgttttgtgtgtttattatgaatgaaagaaattcaattccaatttattttttgaattcaattccatttcattttaatttttaattgtttaaatttcattttccgttttaattttccattttttggtccctttgcctttgagcggcggcggcgcttcgctttccgccaaagtccccaaacaaaaaaaggcacttgaaaaacggagcattcatccacataattgtcgtcatcatcatcatccctattatatttcatgtataaaatgcaaaattaaacaaaaccaaaaattattgaaaatggaaattttaacgaggaaaattattactgtaacactgaaaaattattctaaaaattttaaatttttaaatgatcaatgatcacaatttccaaaaaatgcccggaaatatcctttgtctcgttaggttgggattctgtctggcccacccgaattcgaacttttccaattccgccgatcactaccaaaaatttccatttttatgtgcctaccctcgaaaagaaccgtcgtttgatcagagaaacacggtctgatcagaacagacgtgtcgcaaaagcacacagtttgatgggttccaaataatatataaattatttcaaattcaaattaataaaattattttctaccaaaaattcccttcccaaattacactcattaaaaacgataattattttactaataattaattgtccatccccaatttgtacagctttctttcg

SEQ ID NO: 12307 - DNA, 1708 bp, Heterodera glycines
tcccatttcccgtttttgtcagaaaaattctgtttattatttttaatatttcaataaataaattaattactttattgatcaactgcataattttggtccttcaaatgggaattatttccttttttcaaaaaaaaaatttgctaaaaaatggccccttaaattaaattatttcgaaaataattaaattatatattttaaagagaaatatatttattttttaaatttatctttttcaattttttatcaaaataatttttgcagttaaaaacgacaaaagatcattcccttctcctcaccttcgataataaatgctgtgaaaattaaataattatttttttgattttccatttataaatgcaaaaggtcaaagaattcaaaaattttaaataaatttatcggcaattaattcgcaaattccaatttttcctttttttcatatttttccctttttatgtcccataaaataaaatcgaatttattttaaaacgcgtgaaacgatacaaagaatcaattggcgccaaatcagcccataattcgatttattattttttattaacgcgttaaattgggcggcgccaaacaaaaattattaaaatatttttcatatttttggtgaaaattcataaattttcagaatttcggaaacgttacacagattatttttgaatgctgaccttaaaatttaattaaaattttgattttttacgaaataactaattatttatttttattagtcatcgcatttttctgccgaaaatacaaattacaaaacactcaaaaccaaccaaaaatatgacaaatttaatttttttttttaattaattaattagttaattattcgccatcccatttttacactgcctccgttttcttatcgtttttcgccgtaattttgtccatttttttattagcattgaaaaggaatttacagcgaaaagaatttgctggtgataaaagcgcccaattcgggcgaagaatttaaatttttttaaaagaggcttttggttgaaaattaaattttaaaacatcgtttttatgggttaatccgattttacttttcaattaaattataattaaaaaaacaacttataaattagtgggggggggggaaggccttaagaagctaaatcaaaaatatttaatctcataaatgaaatgtttcccaattttaccagacttattttggcttctcctcttaatccgctgacatttgccaatctttggcattttgccatatttttttggtttttgtacagttttttgccccatttttagtcacccccccccttttggctaacatttcgtttctttttattcaatttttcactatttaaggcttctcacattgccccctcccccaattgtcgcccatttttaatgtcacacaaattccgagcaaaacaaaacaaaactaaaaaagccccgcggtgttttcatttggccgttgcgaagccaaaaagggacggaaggacgaaaataaatcgaaaagagagcttattacataaacataggcttatgtatccctcaaccaataataataataataataatatgtacaatttgatgaagagatttgcctaattttgccacaagtagaaaattcaaaaaagaaaaatgccaatgccattttcaagaattttatgaggtgatttcgggttttttttagtaaagcagtgaatgagcctatcagaaaataaaatctaaaact

SEQ ID NO: 12308 - DNA, 2828 bp, Heterodera glycines
cgaccggtgccacggctgagcagcagcaacatgcgctgttggaaaagccacaaaatgcgaccgccgacgcttcgtcagggatcagcagacaggcggcactgatcacatcgctcgtccgcaaaaggcgagtggtgaaaatttggcagaattatttagtttgtggcggttttcgcaatcggatttaccaaaaaatttaattgctacagcaaggacttagccagacccttggattcgagtgggagggctgaattcaaaaatgcggtttttaaataatcccgaattaggggggggggtgtattttacaggacttgtaaccgtttttcgccaaaaatgaatagtttttgccgttttagtctacatttttcaaaaatattgtaaatgggaggccggcggtggcattaggcgccgcgggaaaaattttttgataagtttttatgcaatttattaagaaattgtttaaaatttataaatttgctgaaaaatttttatgggggctttagcccccctggctacgcccttgtcctacagaatggcagccaattcatcgtgccatttacattttcctccttttttagaccgctttcaactgacacggacaatgaaccaaattcggcccgtgttgaagtgccattaccgccctcgtcgtctgacagtgacaagcgcaatgccaatgagtcggcatcgaagacttcgggcggtccgccaccaaaacagcgacacgaatcgcattgccaaatcattggagtgcttcccggcttaccgaactacactgattcaagcgaaatcccgctcatatttgactaatttattaataaaagctttaaagtgatttccatgttttgcctttcgggcgaaatgactccttccaaactcgcaaattgttacgataccctatatgtaatgttaacgacgatcgtagaaatgccttgactctcattcgagttcaatagaaatgctaaaatccatttagaaagtcaaaatttttcgaaattgaataagccggcgattttcttgaaccgttcaccgctaggtcattagtctcaacagtttacggtcccattcaatttaattgtgtaaaactggcggatcgaattcttaaaccaatcagccatttgacgtccagataaaaacaatgttaaactcgatcaaaaaatgtacataaagtccttagggcgcgtaaattccccaatcctgaaaactatggtatgggatttcgtttttcggcgttcgctgccgtttttgtgccgcaatttccgctcatccattaaaaaaattttttgctccgtcccatttttcttttttgtgcttccatccgtccgcccaccaaatttttcgtcctttgggcgtggacagacggacgaccatttattttctttggtcgcatttatttttatcagccatggaaaaatgaaatgacttctctttctccgccccttccaattttcttctttcccttcgttttcttttgctgtttctccttccttattttctcctccctcgttgcctttttaattgtttgttgaaaagtcaattttggtgtttctcagccaatgattaatatgtacaaaggcggcaaaaaattgtggaaacgattgaagaatttgctaatcacacggcacaattatttaattacccaaattagaattctgaaattttttaggacgctttttttctgtttttattaatagaaattcccttttgattttccccaccaacggaaggacatttttatacaaaactattccaataattatttggcacagatggagggcactctgtccaaatggacaaatgttgtgcatggttggcaacaccgttattttgtgctcaatgacgatgctctttgctattacacgtttgttaatagcgttccattaatcaaaactatagggaataacaacaaatttcgcatcatttcatcaaataaattaaaatgtctctactttatggatggattttgattaaaaaacgttcaaaaggtccaaggaaaagatggctcgaggccaacagcgcgggtgcattcgcttgcgcggcgcggcgcttggcattgacgaggaaaacaatgcccaattcacaattgcagtggacggcaaagtgtttcatttgcaggttttcttatttatataaaaaaattactaaatctctcctttttgatcgttcgtttgaggtttaaaaagttctctttttccaatgaaaatccccattttaatggagttttttggcaccgtaaaatttgaatttgcattcatttaccctgtttcatccatactcattttctgaaatgtgtctaacattcagtttgacagtctcataaatattggccttttcgcaaaccgttgaaattaatatacaagcgtggaatcattttaaagtttgaaattttgcccatcacttcctgttttgctaacccaattgcaaattgagtttttattacctatctaatctggaaaccacgatgttttcagaattcctgaattttggcgaaatgcagtatcactggttagaaaccacggcataatgttttttttcagggcaaaaaccgggccgagcgtgacacatgggtgcgcgtgttggagcgcgtcattcacgagaagtgcggctactacaaaccgccccaagaggacccgttggaggaattgcgcaagcgagtgattatcgcggaaaaccagtcgcaaacgctgatggaacaggtgcaaatccaaccaaaatttgggtccctttttcattttcacctctaataataagagacaaccctttttgtattttgaatttttgcttttttagtgataaagtctgctccgcttggaaatgcaatgaaataccgaatt

SEQ ID NO: 12309 - DNA, 2135 bp, Heterodera glycines
  misc_feature (7)..(7): n is a, c, g, or t
  misc_feature (11)..(11): n is a, c, g, or t
  misc_feature (60)..(60): n is a, c, g, or t
  misc_feature (67)..(67): n is a, c, g, or t
taggaanattnagatttctaattttaaattgcgttacgcttttgatcactagaagtgtcncctcttnaactcatttcaaagcatttgaacatgaaaaattgactttcagacgcgcaatttggagcaaatcaccgcccgcgagacggacaaaacggaccaaaagcgtaagaaaatgctgacggaaatcattgcgaccgccaagcgactgcagagcagcgtcgaccattcgtccgttctgttgcggcaagtgcaacgcgacattggcacatcgctgacaatgagcactgatcagcagcagaagagacggactgctgccgataaagcaattcgatcaccgacgacaatggcgacgacgacgggcacagcaaaagcggcaatgacggaggaggacaatttgaatgggaatgaggacggagagggcggcaaaatggggggcggtgctggtggaggaggaccaccacaattgcaacaacatcaacgggaacggcaggagtcggaggatgaagaaatgtgcccaattggcggcgggagcaacggcaaggaggtcggttagcggagcggatatgtacattgtttgggtcataatttcaataaaagtatagggaaatgggtgggacacctacagccccatttgatcgacatctcttgggtttccattgggattcgtttccacgctcttgagtcttggtcttgactcggtttggtattccgagtctcggaaatctttcattctcgagcagatcaatacctcttcatttcctttttctagcttttgattaaaaaattttcctttttcgtgtacagttctaggcataattacagtcatgttaaaaaactgctttaaaatccttcaaaattccatgtgctttgtctgcacgattttccgcatttccaaccaaaaatgtcctttttttttgtctggctaactctctgaagtctttattgtcgtgtcgttgtacaggacgtgttaaacctggacgaggtggtcagctactccagctcggatgacgaattctacgacgccgccgaggaggacgagcagcaacagttgcgccaccattgtcgttctattggctcggctgctgcccttggcctgagtggacaaaaggggggaggtgaacagcagcgcaaaacgtcgaccgactcgcccaccgtcagcggtcagagcaatgccgcacttcggcgcagcagcaaagacttatttaggtgaacggactgaacatggtttttgcagagagggggggcacaggcccgtagccagggggaagggctggggaatttcactttgtttggggggagaaactatataaaaatggatgcaaattcaaattttgggccttcggaccgccaaaaagtgatattttttccttgatttcatatttttccgggttctcacgggtcgatttttcagaacagcggcgcgctcccacggtggccctgcacaccttcggccctcctcgcttgttttacagcatcaacagcagtcggaactgtccgattggggccaattcgatgccaagggcaccgactacgacgcaatttacaacaacacgcatgacgaacaggacattggggacatcaacaagcaacatggcagtgtgctcatgcatttgttgtcccaggtgagagaattttttgtgaatttttgggccgaattttcaaaaaagtcccggaaattttcaatatatatccatccatttttaaaaaaattttacatttcgcatgtatgggaaattttctcctcctcattggttacaatatgaaatttatctttagtattgggaatcccgaatttactaggtttttggtctattgtaggttgtacaacaagactacaaaaaccttatttatttgacattgtcttcatttcccttcgctttttaggtcagtgtcggcatggacttgacaaaagtgacgctgccaactttcattttggagcggcgctctctgctcgaaatgtacgccgactttttcggtaagtatttgaattttctgttggcttttcatttctaagcctttttatcgaaaaataaaaatttagcgcatccggacgattttatcagcgcggtggacgaggattctcccgaaattaggcgataaatttgtttttatataatttttctggactaaactga

SEQ ID NO: 12310 - DNA, 1064 bp, Heterodera glycines
attttcctatcgtatttcattaaattttccaaaaatttttcccggcgtcgcctatcggcaccgccgggccccaattgaaccattattttttgaaaattagagccaaaatggataaatttgtgatttttcggcgcaatgccgctattaattcctgctttttggttccggcgctgaaggtttcaaaaataacacaggtgccacaaaatttttttggcccggagcaaaaaaaaacttcgggtgccctcacgaaatttttttctgtatacgggcctgaactcactcgaccacccagaaaagtgtgttcattgtcagatggatgttgcgttgcttttggcacgttccggggccagcatcgaaaagaagaatcgccagaacaaaacgccgattgatttggtcgacggcaaagaacagaaactgaaactgatcaaagcgagtgaatcggtgaagccaactgccggaacatagccgaattcctttgttaaatcaattctattgtttttcaatgtaattgtaatgaatcttttgatttcacttgaccaattaaaaattctgaattattgttgagttgcatttttcgctgacattaaataacgccaaataaattcggaaaaatatgatgcttcagttttattcccgaactgctgtttaaaataataaaacgcttgaaagacaaaacaaagcaaaacataatcattctatacatttgaagtgattctgtcgcataaatgtgaaatttggtgaaaaatgaattttcgaattttggttcgaatccgggttcggtgttcgaaataggtcgatggatatcagattcgaattctgcgaccattaaaacccctaaaacaactttatctcaaaaaaaaaaattgaaaattttttccaaaaaggggggggggaccatcggtagtattaccaaaattcgtactttttgaaaattacttaatgtttttaagcataaatttaagtgtttattattttgtttcatttttgggttggtttgtgcatttacctaattaaaacctttaaggtaaaatttgttttcatctctttttgttgcctcgtcatcc

SEQ ID NO: 12311 - DNA, 1713 bp, Heterodera glycines
  misc_feature (36)..(36): n is a, c, g, or t
agttcagacagtgcgcggcctttgttcggtcgattntcggagagtggccgttgcgatgtcattgttgctcaagcaaaggcattcattcgattttattcgtaaaaaataagtcatcagaagagcgagaaccacttactctgacgacaataggtaaatgtgcgacatgaggcggagattatgcgtcaaattgagcgattggaggaggaaatcatccatctgagggccattcttcagacttagcgatattggaatatttttaaatattcattatatggatccactctttaaaatggtctctaaatggaaatgacaatccaaatatatttccgcttttgccaatttcctttcatttatcttttcaaattgcataatgtctcctttccctccgagtgccaccgatatcttcagtcttctggatgccattgacaaattaaaacatttaaagcggactggtttgtttgatttgtattgcattcatctcttaaacgttttgcctagccttggattttgtgacatgcccctaaagtaaaaaagtgccaatttttagaaaacgctcacattaatcatttcaaacaaaaatggcaatttaaattttcatcatttaaaagttttaagaaaactgcctttgtaccaaatcatttctcatttgttaaaggttgggttctcgtcggcatttcggagcccgagacagtcgcttcccatatgtatcggatggcaactttgggtttgaaaaattatcgtcgatcaaccaaacggaaaagatacgttaagcaatgactttgtcggcgcaccgaactgatttggacgtcaacaaatgcattcgaatggcattggtccacgacataggcgaagcgattattgggggttattcagtccattttcattttttgaccttcgccccccccccacagatattaccccccactgcggcgtatcgaatgaagaaaaattcaaaattgaaaaagaggtatgtgcagcaattgtaacaacaacattatttaacagatccctaatttgaggctgttgagactatttcgaattggttgcccgaaacggtgggcgacgaatggaaaaacctatggagagaatacgacgagggaaaaagtgcggaagcaaaggcagtgaaacaattggacaaattggtaaatggtgcgcgaatgcgacgaattcaatctgaaaataaaatatattttgaaaacaaatccaccaaaataaaatcattttcccgggtgatggcaattaacaccgttgcgtcctgacaaattagcctaaaattgaaaatgtagcgaaaaagctgcgacgggttgccggataaattttgagcattttcatctgcgaacccatttcggagagaataatcatttcaagtatttctgaattttgattttgaggatatgttggcccaagccttttcctacgaaaaaaggctctccatcgatttgactgagttttttgatgcgacttcgaatgccttctccgaagagccctttgcgagttgggcagctcaaattaggctgggacgcgaacaaaaaacgatgacaaattagaataattgacggggaaatataaaaggattattttcccaatgacattttgtgttgtaataaattcctccttttgtttgcttaattttattccacttttttaataataaatgatgaaaaggcaattgcattcaaaagagaaaaaatcgaagaggtttgaggagcacat

SEQ ID NO: 12312 - DNA, 1537 bp, Heterodera glycines
cccccccgtccctttgctgctgggcgaaatggtcgcgcattgcgtgatgcaacagctcaatttggacacgcatttcctcttgggccagcgcaaggcgctgagtgtgcgaatgcatttcggtcattagctgaagaaaaagcatcgcaattctcgggaaggacgagaggaagcaaagggacatactttttaaatcaaattcctttttttgtgtacgttttgccaagccccgttttgtgccattgcccacccgactgagttgctgcaccgttgccgaaccgttctccccgaaagagcgtattttgtttttgatgcgtctgaactgatggatggcgttgagaaacttccgctggtgccgtctcagctgatggtcggccgcgtcactgctcctcaaacagcggtaaatgtgccacgtcttctgcaaaacgcgtgccgccgcgtgtttatgtgccaatgtcagtcgagaatcgttcatgaaattgttgacattcttttggccttgggaaagaaggattttgcgcgaaatcactgcgatcagaatggacgaaatgacggcaccctaaagaggacgaggaaaatgatggcactgtaagaaacggtagccggaacaaacacatacagtatccatcccggaaggaaaggaatgtttgttgctctcattagaactgatacggtaaggtatttaattagcaaataagtatttcgaccgaaaggaagggaaattatgctgccactttaaatccgatacagtatgagagtgtctaacattaataaagtatccctgacaacagagaggaaaaatgtgccacttacactaatgccgacgagaatggcgatgagtcgaccggccaatgactttggcacaatgtcgccatatccgttgccgttgaaagtgatggcgatgaaccacagggcgttggtgtacagaatgaaagggtcgtccacgtcacggccaaagcgttcgcattgggcgaaggaccaagcagtgatcagccaaaagacgaacagaaaaatggacaggaaaaacatcggacgctggtcgagcactacgaaatttggggaatgaccaggggaaaaggcaacggacgaacggagacggaccggttttgaggacgaacgcgaagttgacttggatacggttcagggcagccaaagtccgtgtggaggcatcctgaaaaagatggacgaaatgtcaaagcaaaaggataaaatgccaaaagcaaagggatggaatgccaaagagcctaatttgggacacaacggcacctgaaactgtttgctgtgcagcacttgccaacggcagacaaggtaaacgcgcgagagcatcagcagggacaataccacatcaaccggaacctttcgcacattataaacacttcgctcgtcggcctgcgaccacacgcgggagggctcaaaaaaggcccaacggatggtgccggtgccgggcaaagggctgagaaatgagaaacgatgaaaggaatacagggagaggtggaggggggaagggtcacagtaagggagaaagggggggggggggggg

SEQ ID NO: 12313 - DNA, 4508 bp, Heterodera glycines
gtgaaaaggcggcccaaccattgttcattattgttgttgttgttgttgttattgttgttgttgtcatcaatcaggtcaagaagctccattgggtagtagcgattctcacctcctcccccaaagtgttcaacaatgcacggtaaatagggaaagtgaagccttatgcggtgtcgcgcatagaaatgcgctgctacattgatgttaaatggactgcgcagctgcccatatgctggaagaaatgccgcctctttagtcgaaatgccgccgacgaaaaatgttttggtcattccgttcctgtcgttgtaggtcgtgcgcactttacgaccaataagatgcttcagaacaagactccgatcctcgggatgatttaaccgatcgcgcagcgacttgggctgacagttcagcagtttagagcaaaatacagtgacaagaatcattttagagggattacataaagttgcaaattggacactcattttatactcaaaaacttggccacgcccatccaaattcaaatttgactccacccatttttcaagcaaatttaaattaccatcccgaatcccaattcatttttgccaaaatgaagaaatccgttaccgtcgctgttcccgaacaaaaagaaatcaatcaaccaaacgcggaagtggagccaccaaaatcagacactacaaagaagcgcaaggtggaggaccaggaactgtggaaattggcaaaagggaaattcatgctcgcgacgtacttatgcgcaggttaaattgaaatattaaatttaaattttattaatttaataaaatttatttagacgactgggaccgactgttccataatcaacagaaagtcgcgcgcttggaagatggccgttttgcggtgtgctttgagctctgtgaagaatgcgtgtggcgcaattgtcgcgcaaacgatctcattgcctctatgaagaaaaaacagaacaatgcatgagaggcgagtgatgggatgagtcgctgcaacatcattaattattaaggagtgatgacaggcacaagaaaaaccatattgttcatttttgccgtttacttattcattcgttcattcatgctctgttgattttatttttaatatttttagcataaatggattctgctctccgctccaatcaatgttcagcaaagtgccgcttccttcgctaccaattgagtgatctcaaaaatctaacactcaactatggcgctagaacagaaatgttagaaaagtgggtggccagtgaagttaaaataatttaattaaattatttttagtgattatcattttagcacttttcgccttatccgttcgacacgacttcgtcgatttcactagcagttctgcgcaaatggttcgatttgctgaaacaacaagaaaaagtgcacgacgtcatggccgatcggattctacgccacggcatgtagaggtggctggctgttgtggaaactgccctccaatcattaaaacggaccatttcatcatcatcatcattatcatcatcatcatcaccactacctgataattcaccatcaaacaagcggaaattgttgtcatcttctgtgccaaacggcttatcggaagtggacagaggtactgtaatgctcatttattattatttataaataaacatttgttcatttttgttatgtaatgattgatcgtatacatgccgcatctttgacaaatgcatccaacatctcctcggctctcttgtttttcagcggtacaacaaacaaacgtttggataggacgtcaaccgcaacgagcaggtagcggtgaccccgattgtgacgcgaaagagcttgaaaatcggctaaatccacctggacatcggtcatgaatcccactgctacagtttttgcccttggaaagcgtaccctccggggccgcatcagagtgtatgtacggtgaccctccaaataattctgcacgtcccttttccgtaagtgtttcaacttttttcgcgcctctttccacaacgctgtaacgcctgcgaacgccgccggggaagatggactattgtacagcttgtcaagagtggtgttgatcagctccattttttcggacgaaattccttcttgattttcggtgccgtcctggtggtcgtgctctttgacggtctctttgacggagccgtccatgaatacaaaattgggtcctgcctaagcctctcctccaaaatggccgctccaggtggtctaatggtggggcggcccgctctccggtcaattatatacctgatggccattcgcaaattgctatgcgccaacggcttaccgtttgcagtgttaattgtatttccccgaacacccatacgatccgcgtaacggttgcatttgatgtacagtcgttccgaacgctgaggcatggtcagctgatttgatggaatggcaaacagttcacgttgttgttgttgctgttgttcatcactttgtgcagatgttgatggacccggttcgggcgagtactgtactcttaccctcctcggttgcctaactcgttttcttacgcgcacctcatcatcaccatttacagggtagtggcgtttggtccccctcctaggcggaggaacatagggcatttcttcgacgacagcagcaggaggaggctgctgctgctgcgtctgtggtggcttttctttactttttggctcttttttcgggatacggtaaggcatgggcctctttgtcggttcatgttttggctcgattttgtatgtcgcgggagggaagtaaccggcttctctagatgtggatggtcgagggtcgagcccggacattggctctcgattcgcccgaggcgctggagtagggtggtcggcttgctttaacgtagaaggcttaacttccatcaactttggttcttttttttctaacttgacggaaggacgtcgtggagatggaggagggggtgcaggccttggtccagcttttgttttcaaacgaggaggaagtgggagtcgaggaggtgaagggcgatagatcctttgtcttttaccttgtaaatcggcataatctgtctcgtccttttttaattttcttctggtagcaatcctgcgctgagcagtgtccatctcctcaatttcgtccgcgttgtcgggcagcgcaggcaaatcgccataatactgtgatggcgctggcagcgcccactctcaagcatataatcatattcatcatcactttcgggcaatggagcagcagctgcttccgcaagaaggtcccgcacaattggccgttgtcgttgtatatcagatcgccttttatgccattgctccaaacgactatctcctctccgagaaggcgcagcagctctactcggtctgggaggacgttctggacgaggtggaggacttggtgggtacggagcgggagctggaggaatgggtgggggccgagaacgtctcccagccggcggtggtggtggaggaggagcgggaggactaggaccacgtcgaggacgtctcccaggcggtggtggcggtggagcgggaggtcgtggtggtatgtccacaacctctccattttcatcttcgccgcctttccttagcagtacacttattcctttcgtcagctcaactttggctggcctatcttcaagttccctcctcattttcaagtatcgcctaagctgttgattgtaatggacattttttgtactgggatgtgttcgctcggcccttgcacggtctaaatcatgtcgaacagcatccagatttaggtcacccgtgttggacatggaagtgagaccacgataaatttcttgtgggacaagtaaaaatttatttgccatctctgttaaatgaataatggaattcacaaaattcaacaatgatgagaggtatttatgcgtttttgttcacaaaggattttgccacttccattagaacgggtgtcaatagggcagcgaacaatccgccaaatcctgcgcctttctggacaagcactcgcttggcaccccgttcattcctcgctctgctgattcggcgtacagtatccacataaggcattagtcgcttcttctgtctggttgtcagttggaagcgcgaagcgacgagattcaaacaaatttcgaccagcgatagtagttgttcactgtttgcatttcgtataagtttcctgcattttttcccggattttgtcctggccaaagcacacaaccagtcgcgattctgttttatcagctctccaatctttacttgttgctgcttatgccgctccatttttgggaatgaatacaactgttccttcgtcttcgccctcctgctcatccttaaatatgttggttcgcagccgtaacgacggatctgatgcagcgtgcatatcaatccagcaatagccatagggacgggcggtcgctttgcgataagcatcaaggaaaaagtcgagttgactcggaaagagttggacgcccaatgttgggaatggacaaaggggaatacgggcccgcatcaccccaggaactgagcggacagggggggccactttgaattttacgttcaaaca

SEQ ID NO: 12314 - DNA, 1543 bp, Heterodera glycines
cttcctcttctcttcatttcttctcttccctgctcttcctcctcattcgcttccgtttctcctctttcctcctcttcctcattctcttccatttcttgtgtttcctcctcttcctcattctcttccatttcttctcttccctgctcttcctcctcattcgcttccatttctcctctttcctcctcttcctcattctcttccatttcttgtgattcctcctcatcctcattctcttccatttcttctcttccctgctcttcctcctcattcgcttccatttctcctctttcctcctcttcctcattctcttccatttgatgtgttccctcctcttcctcattctcttccatttctcgtcttctctcttcttcatgattagcttttaagcgcattaagagaagaaaagcggcgatggccaatccaattacataatatatggctgttttgatttttgcatcaatcgcttcgctgataatcgcctgaaaatttttttgtgataaccggaattcccatttttagaaaaagcaagctatttttcaaaatttgaaagcctcatataggctaattttagaaaactttattgaaatgcatttaatttttctaataaaaatattttaattttcaagaaacaactgtacctcaatttcacggaaattctcattcactttgggctggcgttcgctgatcagctgaatcagaaatttaaaattaatataaatattttgtaaacaaaaaaaaattaagactaactttctgttccaatttgtcgagcattgccaattggaatttgttcattttgtcactcataaactgaaatttttttttacaatttttagacgaaaatctctctttttaagtaggcatttccccaaaagtgtgttcagacattcgcacctatgccaaaaatcgaatttaattattttcaatcccaaattgtaaacggtatcattgactaataccgtttttaatatgtgagattgaaaataaataaaattgaaacggacatggcgcaaatgtaataaactaataattagtgataatattttaggtgctaaaaactgccaaaataggtatattttaggtcctaaaaaccccaaaaacaggttagaaaatgggaaaaaattctttacattcactaaatttagccaaatatggtatgcaaaataattttagaaaaaagaaaacaaaataaagctaaaaatttattatttttgaagaaaatgagtaaaagttcaaaaatttatatgcattttattaaacaaataattaaaattcaaaaccaaccaaaaaatggagcccaatcgctaggacacaaacgaaaacgagcgcaatgagccataagtgttgtattttttccggcttttgttggtggtcatcgtcggcggcattttcctcatcccatactataatttgtaaattaattcattaattatattacaacaagatcaggtgcttttttacatgtgtcatccaaatacatgtcgtgttgagcaaattcgggattatggaaaataggcattttaaatgaaacctaaatttaaat

SEQ ID NO: 12315 - DNA, 2708 bp, Heterodera glycines
  misc_feature (2687)..(2687): n is a, c, g, or t
ttttgaataagaaatattagagtaaatgttaaaaagtgagagatggaagaatgaagagagagggagacaaaggagagggtggaagagagaggaaaaaaaatttaatatatttttaaattaattattggataacattcctaggatcttccaattttatattctatattgtgtaaaatccgctaatttaagttttgattagtctcgaaaatgacgaggaccaacttcactattaccgatttcttattctttatgtgcgttttgcattgaatatttattttttagcgaatcaatgatcagtgattggtaaatcatggttttttcttttaaaataataaatatcaaaatataaaatacattttattaaaattctgccatttattttctgccaaataattcaaaggtgttgtccgcacattggcaagaactataattaaatgattttaaaataatcaatttttttacgaaaatgcattttcctggccggttaaagaatgttaaatgctcggacaaagccgttgataaagccttgaccctccagccaacgcaacacttctactgcatagttggctttagcaaatttaaaattgtatttaagtttaaaattaaatccattttttgtgcctccggcgggtctctgaccaattcaacactgtcactggatatttaactcaattaataaattggaaatattatttaaaaaattaatcacaaatcccaaactaaagaataataaaaataattttgtatacctaattaaaagtgtaaaaaataattcaaaaactttaattaatttttgtgaaaattaccaaaattcataaaaatatactgtaattgaattattgtaagtttccaagtaatttgatgaactgacgcatttttcgatggcctaatatttaaaaataaaacattttaatggcctgctggacataaacgtttgtcccccgcaaaaaatgattaaaaattaaaattagaaaattaaaatccaatcaggaaatcattcccattcttaggaatttctcgtataatatgaatacaattttttcaaatgagtcaaggcaaagaaatttgatcattgattttgcacattcgttggaatttcatttaattttaattaaaaattatttttataattttaattaattttcactcggttgcgcgggtggtggcgttgcgtcctcacgcgagtttggaatagcttttaaaaattttacttaaatttttaaaaacttttgcaagctcagatggcagcagacatctcgtccctcactttgtacgatatgttgtcaaaacgccccccccccaaaattggcaattcaatgcttttggtaaggttttttgcggatttttaaaaaaaatttgtgttattataatgtcccaattaatatttgtttaaatgctcgaatgttaaataacaaatcgtgtatcctaatttaacataaaatgaaaattatttcaatattttacttatcgcataaatattatatagtgataattttgaatatctgttttcgttcaaaataaaaattctattaaaatattttaagaagtttatcgtttgtgtggttaaaattaatctgccaaaattaatactcgctacaaaattctattttttggtatttcccttaaaatgagaaatttaaatttttttatgaaagtcttgaaaaatccgtaatacataaataaatacaaaaaatagcatttttacatttctcttaaataagcacacgctcactctgatcaaaacttattttttttttaatatttatctattaaaattttaaacaatttttttgtatgtataaaacccaaacaatccaaaaaaaatactttcatttattcactaaaattgtatgatcagcacatttcaccatgataaagattgaacaaaaagagcgaaatgagaactcacatcagcagtttatcaaacgggtgaagaaattgggacaaatccaactggataaatgagcgtatattcaaatcaaaatattatcaaaaatgatcaaaataccaaagaacaaataaatgatcaacaaaaaagaaaaacagttcaaaaatttgaagcaattaaagaaaaattgaatcaaaatagaaaatataatcggagaaacagtgtcaaaattgagagaaaaatttaaacgcggcatatgaaaaagatgcatttatttttattaaaataataaaaagaaaatccattaattgcaggaaattggtcggatatatttgccaaccaaaaaattattgactttttaaagaataatttttttcaaaagcctcattatttaaaaattttaatttcctttttattatagaaaagaaatgtattttttattaaaataaatatagttttatatttttatttttatatttgaaatgcattatttttttacattttatttcatggttgttctttttcaacggattgatgcaattgcgcgtcccgcgacattcaatcgaaatattttgaagaataacagttttgagggtataataatttcaaaattcaaaaattattttaaataattatttaattttaaattttttaataatttaataaattattttttattttatagcaaaattgtcatccattctccacaatcatccagataaggaaggaacattgagtaaaaaagaagtcttttcaaacggtgttatcagaaaatgcctgaatatttttccgatttttntattcattttttaattaattt

SEQ ID NO: 12316 - DNA, 5198 bp, Heterodera glycines
cccgcctcggattgctgttgaggggccaatgtccattgtgatcggcgaaggccaatcctttgaggagaatgtgaccatttatgcgaatccgcgcgtcaatgcgtttgcgtggcgcaagaacggaattaccattgatcggacagtgggaaccatttttgtgcgccaatcggtgatcggaggcgagtgaccgtaacccaaatttagggcaccttttcatttatgataccgtacttgaagtaaaataccatattcaacatcattttacattgaataacacagcttccaccataattaaggtgccggggtgaccaaggacgactccggcatttacacactgttcgtctctaacggtgttggcaccgcaaatgcaacgattaaggtccattaggcgaccgattgtctctgcctattgggctacagtacccccagttttgcctacttttactttttaggtggttgttgagtacgctgcccggatcacttacatcacaacaccggtgatcgcaaggtgaatcactcgccgccgttgattttttgaatctttggctttaagtttattggtttaaattgatctcaatgtcgttaaaatggcctactgtattagatctaaaagactgcaaaacgataattttatgcaacatccttttcctaattacccgtattaattctattttagtattttaattggctaattatcagagaacggacatttaaacagaaacgtttacggattcgcgctgttaattttttgccataagttttttgaaagttaacaagttttttgaacttttgcaggataatagagaacatttagagctatcgaatgatactaataattaaaaatttggttgctttagagcaaagttataagcaaaaaaaaaaaattttttttatggtttttttaaataacccacattatgatggtttttaaataacgacataacaccattttttaaaacactggattaatttaaaagaatggcacgctgaaaatttcccgctgtttaagtgtcggtgaagatgtcgtgttggagtgtgaagctgacggaatgccgatgaaggcggggatgatcaaatggtttcgaggtcagtgttaatgcactttttaatttataaaaccttctacggtatgcttttttcaaattttcatactgtagcattaaaaatgtatttaaaggccacaccgaagtgcgttccctggtgcaggaccaacggcgtgccgtcatccgaatgaatgcgtcgcatgataacagtcaattagcacaataattgatcctttttaatttaattacttttgtcttttgaaggtggcgcttacacatgcactgttgacaatggaatagggcaggtgataagacagaagagtgataatagagctcgcatttttttggcattttgccgttttggtgcctttttggcgtttttccgaaaaattccattaaagcaataaaatcgggaaaatacacccctaagaaatgacctgaaaaatttcagaatatatacccctaagaattgaaaagttttctcgaaaattgatcgccaaaatttcattttttttcttgataaaaaattttagctttaaaattttccttattctaaaaaaactatttaataatcatttaaatgaccaaaattaatttacctggttaagtttacgtgttttgctccttaaaatccttaataaaaaattttgaatgccttttttgggattttcgtgccttttcatgccttttttcaattttttgtgcctattatagtgcctttttcgcgatttttggtgcttttttgcgagctctagtgataagaaatctaaaattttaaattaaattttccaaaaatttcacagcccaaccacacaacggcctatcttttggtacgacgagcgccggtgattgtgaagaatgcggcattcagtcgcgcagcgggaccaatcggtggcaaggcggttttgcggtaaaaataaatttacaaaaatgccaccgcctcgggtggtagttgaacctacgaacctttcaccacttgaccgtttacaaaattgtgcttgtgctttcagctgtcgtgccactgctgtgccaaacgcggagttcacgtggggcattgagggcgaagggaatatgatcggtgccgtcatttatttgcagccatttttatcaaataatttttaataattaatttttgattaactttctattgacaagacaaaacattatttgtattggcacgaaattaaattttttaaagcattggaaacagaaatttcgaggtttacgcggtccattgtttccaaaaaatcacgggccaaaatgccatggaaaatatttttcgaatttcgccgatctcatcaattctctgctatttattaataagcgcttaattaaaattactaacaaaataattttaaaaacattttacatatcgcattaattattttttcaaatatttttgccattttagtccattacaacaccaccaaataccgcttctttgacacccaattggactacacaacatttcaaagcacattgaccattctgaacctggaagaacatgactatgcccgacgctatcggtgccgagtcagtgtaagtggtggacaaattgaaatttaaatgattaaaatggtatttttgcgagattataattgatttttatacggcaatatgcttatgtaactcccccatcatattcattcattattgacccccttctgtttttgcataaatacgctccgcccgttcattctgttcgggccaatggcaattcgtacaaaaggcaactcgtattaagcctaggctcaagcaagccttggcctagcctagcctaaagcataggcttaagcctaaagcctaggtctaacctaagcaattgtacgagttatcatgattcattccgttcattctgtcaattttgtcatttccaccatatttcccctctccgcttctgtgacccaaattgtcgtcggcttaacagaattgttctgctctttttacctctaatttagtattagatttaaaaaaattaattattaatagtaatataattgcactaatttaattttaattcccaatttaaataataaaggcccaatttttaattttgtcaattaccctccccattttgctcagaatcggcttggccttgtccaatcgttcatttccgttggtccgcccgcccctcctgaactgcccacggagctcgaaattgtgaacgtgaccaactccaccgcgtccatctcgtggactgccggctttgacgggggcgcagagcaaatgttcgagcttttgtaccaggacatggacagcaatgaaatacggtcgctgaacacatcggaaacggtgggtgacggaaggcgagagacgcgtggttggtcacttcacaaaaaagtgcaaaaatcaaaaatctgaataaatttaattaaattaatgcttaaaatacacattcttctcaaaattttgttggatatcgaataaaagaataattaaaatttttaatattaaataaaatcattagccagattacattgaattttttaaatattttaagttaatttcaaatggactgaaatttaaaaataaactcaaattatagaaaaaattgaaatatttatatggaaatgtatccgcttcaacccaagctaaattgcttgggctaggccaatgcttaggctttattttgaaaaatttatagacgccatttaaattaggagaatatgtatttttggcataaatttaattaaattttaacacatttataattttaaaaaattgataaaaaatcataacaaaaatctcatttttgatttttacacttttttgtgaagcgcccaaatttctattgattttgaacttttggaatgctttgaaaattttgctgagaaaatttctcgaaaatttattttgtttattagttaaattatttaaaatatttaatattaaaaatcataattcccaacggtttcctcatttttagcaagtgttgctgaaggggctcgacgctgaccatggctaccaactccaaatccgctcaattaatgcccgtggcgacatctccgatttgacgagggtaagtgccgcacacacacaaaatgccatgccatttgcattaaatgatgaaagcaaatcccttttcagcctttgctcttccgcacaatggacgaaaactcgcagagcgccggggttggcttcagcataattacaaaggtgagttttgcttaacgatgccgccctatttaattgccatttgctaattatgccgttttgtattattttttgccgcttcttcaaggacggccccttctcccattctgcaattgtcgccctttgcgttgcactgcttgcgctgcttctgctcaactgtttgctcatttgctatttgaatcgacggaacaaacggcgcaaaatgcggggtaaatgtcgggaaaatttgaattctcgtaaacaattcggctattgtgtaaggcatagttcgtggtaataattttttggttcccccccttttttggcagaaaaaattttgttttaaaaagccgtggaaatgtttctaaggggtttttgggtcgctgatcagaatatggcatccattttggcctaactcgaaccccggatccgaattcgaatcaaaagtggggaaacccaatttttaaaaattcgttttttttgttctaaactatgtatgtagattaaaacaagcaactaatcacaaatcactgcaacacagaaaaatataatcattcggcacagaacgtgctgagtcgaagcacgaaaaagtgcaaagtgatcaaattaaagcaaaataattattaataatcaaattaaaagcaaaataattattttaaataataataataatctacttaattaatgcgtttattttataatatttttaaatctcaataaaactaacatttatagttttctcattttttattataaacaaaaaatcaataagagactttcagatggatggggtcatttcagtacagaaaattatattaataaataaatttaatttttaaaatgtattttttaaatattttccatattggttcgaggcaataaaatccatcaatatattttttgcccattaagtggattgcacttttatttttattcacaattgtatttttatataagcttttttgccatgccagccgaccactttttaacgagacgtaggaaaagccgacggaaggaaagcaa

SEQ ID NO: 12317 - DNA, 1679 bp, Heterodera glycines
  misc_feature (1584)..(1584): n is a, c, g, or t
agttattttaataattctttttttattttgtttgttagaaagtcttctttcatttcatgccattgtttcattttttatttgcttaggcaattttttagtatttgctttcccgaccatgcaaaaattgaaaattagcccactaatttttctcgatttttttatggtcaaaaaagtaacctgatataacaaaaaagaaggttttctgtacaaattagaccagtagactccgaatatggccttaaatctgacctatcttttaaccctgagcttgtactgctctacaggtttgttgagaacccagagaccaaatctaaagccatattcggactcagcgtggtcaatttacttagtttaattaaattcggaatttccaaaaccacttttaaaacattttgttatttgatggtcttgaaaaatgccgtttttggagaccatttttagactcggccctccaataattcatttttgaagtaataaaatttttttcttataattttttatagtcctaactttgctctatttactcactttttctctgcctctgtatctcttttcattttctttaaatcagccatcaaaaatacatacctcgaaaatgaccatttttacattatcaactctaactccttaaatacttttctaatgggatttatcccttgcccgataaatagcaaactcattctcaataataatgtcagatatttcggatcatgattgtggttttttaaatttatattcataaaaaaattctttaaaaaaagttgtgcggaaacttatgttaaccctaagtattactgacctattcaggatttcattagactctggttctcttccagatatctggaaggaatcaatagtttttcctcttttcaaaaaaggggacaaatttaatcctgaaaattataggcctatttctataacctgctcactttgcagggttatggaaagaattcttagccaaaatatttacaactttctcctaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaattggtataaagggcaaacttttaatgtgtataaagggctttttgagtaataggactttttgagttaaaattggggattctttatcctcaagtaaaaaagttacctctggcgtcccccagggctctgtcctgggccctttattatttttgatttatattaacgatcttcctgatgccttgccatcaggagtgaaaataaaattatatgctgatgatgttaaattatatatttgttataaagcaaaagccgacacagaaattatgcataatgcattgcataatttattcgaatgggcaaataaatggcaaataaaagtttcaattcaaaaaacttttgtatatatttgggttcaaaaaacccaaaagaaacatataaatttgatggaaatacaataaatgctgtggatacanattagggatttaggagtagacattgataacaaattacaattttccgatcatattaaccaaataacaaggaatgcgtatttacgtatgcgttcctt

SEQ ID NO: 12318 - DNA, 1897 bp, Heterodera glycines
ggggcgacagaggcaaggcttctgacaattggaattccaccaaaaattctttcctttctctttctctctctctcttacatgttttttcctcctccttttttctatggctctttccacgaaattattttctgtacatctgctttatctgctattttccccatctttaagcgtctgatccgctcacattttgaaatgacaaacactattcttctctctccctctctctaactttttctctctctctctctacccctctctctctctcgctcactctctctctctctacccctctctctctcactctctctctctctacctctctctctctctctctctcactcccatctcatttctctttcacctttctcttatgttttctcaccttctctttctttttctcctttcctcttcacctttatttctcttttctctcttctctatctgttctctcccctcatctcgtctctctttttccctctctctctctctcttcactcttttatttgcgtctttccgtcccctccggcgccgggggcagcgccggctgtcactttgtgtcaattttcacccgcttcacaattttacttttcgttcttatcgcttcccccatcgttaatctctcgttccaaattactttcccattttttgccatttaatcttttcgctcgccgcgggcaaataaataatttttagggaaagaggggaaattaaaatgatctttggtttaaaagctttttaaaaaatataaaaaatatcaaagaaatttcataatatgtaacatttttttctaagaaaattcaattgataattattaaataaaagaaataaaatagttttgtcataatgttttaattaatttaacaatatatttaaatgaatttttaaatttttttatgatttattaataaataactcaatttgcaacatttaatattcatttctgacttttttttttgtaataaatgatattgtaaatatctacattgcaaatgtttggaaatttctcgagccgcttatttatttgtaaaattttcttttgtgcggaaattaaattgatgacttttctgctgtaatatggaaataacatatgtagatattttgtagtactaaaaaatcattttaattatttttattttccttttttttctttttcttttttttcattcaaattaatccatttttatttatttaaatttaacccaatattgtattaattaaaattttttagttctctatttaatttcagcaaaataataatccaaaattcccaaaaacacaattttcgcataaaatgcactctctcccgtcgatctttaattatatttttaatattacattccattgccatatttatttaactcaatttaccatcactgcacccattattatcattaatcatttgataattaccaaattaaaagctaactgataaaataaaataataatttgccattatcatacaaaaaactctcgggtgaactatagtgaacgccccgtgaaaaaatgggtcaaatgatataccagtcaattcgtctcaaggagctaagcatggaaaaatatgtctcgagttgcggaaatgccaaaaaaccgatttttgaaccggttcaaaacttgaaaaattgagtgaaaaggggggcctattaacctttaaaacggtcaaattcggacaaatttggtaccatttgaaagctcttgatcagctaattataggtataaattcgaaccgatgccatctaggcattgggagaactgagtcccagtgaaaatggacacttcagtaccaaaagaaataaccatttaaaagcaaaaatttcaaagaagggagcatgcgaagacggagcaagtagtggggctagtaaggagggcggaggaagacgtctgacgagcgccacaggcg

SEQ ID NO: 12319 - DNA, 3653 bp, Heterodera glycines
tattattatcctacctattttatttgagtagtattagatccctttttgaatttggttttagatacatcttattgcatgctccgagagtaactaatattttatttccatagagctaaataaaaaaacaccagacaaactagaattagatgtaatattttttactattactctgaacgggtgggacccgaaccctctataaaaggcagggacactaaccacttgaccactgggcggcttgccaccatgcatgttaatgcccttttcccttcctttcttttattgcaaaaagctcgaccaaaagcgcataattttatttttctttataaaatatttagattttattttattttaatgttatttttgtatttatttaatattcaagttattttaaatttaattttaaaaaattattattttataaattaaaaaaaattattattttattttaataaatttaattaattaaaaaaacaaaaaataaatctaaaaaaaaaagatgaagtatttaaactaaatattgaatagaaaacaaacatcagcaatgggactcgaaccctcagccatcacagaaccaaagtcaggcacactaaccaattcttctgtctcatcattcaaaatttcatttagcgcccctgcattgtttccatttacgtcgaaaaattgttcagtaggcgtagacgcatttaatggcaatccgagtaattcttgaaagaccacattgtggatatagcagttatcgcccatgcaggtattcggtgaaaaaacacgaatgccttccatttgcgtaacccttgacatggcgacgtaaacttgaccatgtgtaaaacattgcttcccactaagcacaagacccatcttttgaagtgtctgcccttgcgacttaaatacgaaaattaatgagaaagtcttgtatgtagtcaaccgtcttacgtttattggtaaacactaattatgcatttttctacctaaaaacgacaagttcgtttttaactttttaaaaattgtatcttccattccttaattatttgcaaattgtgtcttcttgctcttaattatgcatttttctacctaaaaatgacgttcccaaatgcttaataatttacaaattgtgtcttccattgcttaattatgcatgtattttcactccttaattatgcacttttctacctaaaaatgacgttcccaaatgcttaataatttacaaattgtgtcttcctttgcttaattatgcatgtattttttattaaaaacgtgaataaaacgacaaaataacacaattttaggtataaaatagagaaaaacaaaggggtacatgcgtgggtatggcggtgtatgagggtgcgtgtgtgtgtgtgtgtgtgagatacaatgaatgatgaacgaaatgaaaaacaattacaaagtgtgtccaaaattgagaacatcataattagggcccactatccctttacctacatatgggcgataacatttttggagggggcctgaagtgacgtgtccgccactcctaatgtcgggtttcaaaaagttgaggtacatcacatttattggctcatactctccggtttgggcataccgcaacacttctttgaatgtgtcgtagcagagggattggttctgcatcacgtcgtgttcagtgtgatgcccctcagcttcagtacaaattcgtcctgcccattacgccggagtttgagtccatactgaaatgataaagtgtaaattatgaattattaaaggtgaaaacctgcttcgctccgccactacaatactccacaatttcatgctttgggtattcatcggtgaattgtcccaagtgtggtcctgtctccaacggattcatgccgattgggtggacaaagatcagcgaggctggttaaacaaatcggcgtcaattttggcaatgaattgtgctgttctgctgcctacaaacaggttgcgtcgtgcagtgcatccgtctcccacctcaagcacaccaccagtgtcacggtaataacctgcagcattcaaatgcgagtctcgcggtcgtggaatggagagttcgtgtgaaaaatacgatttgtaggccatcagagaatttgcgttgaacacttcacggccattgatgctcattttgatgttacggatgaatgtgtgtccaatcagttgaatcggagcaacctcatcagctgcaaggtcaaccagttggccatttgcattttctttacgaattcgaaactcagacagcaaatagcatttggagagatcaatgtaattttggctggagtgaagtttgaagtggtagggggtgtcggtcaaagggttacttgggagcagttcaaacactttggaggatgagacgctgatgttggttggcgggatgcggaaaaagtccaaggcgttggtgatggagttcacactgtcattgtaaattttatggaatgccatttagtaaagaccaaatgcgtcagatcgaacacgttttctcgctagtttgctttaattgaattttttcaaaatttccaaaatcccgcacgggatcccgcaaattttaaatgcgggattaatcccgcgggatcccgtcccgaaaaaaattttggattccgaacccgcagcgggatccgcaaatttgaaatttccggtctttaatcactactgactaaactaaaaactcattttttcaagttttggttttttatcacccatccggcacgagaagcggtcattatcggtgttgctccttcgctgtcccgagattggcgttggcgccactctccacgagaagggtgactgaaaatgggaaaaactgctgatgtagaaattattgcggatgattgcttcaccgattcatgtgagtcagcggcgtcaatcggttcccaagtcaacgtcgtcaccgtgagcgacaacaaatgcacatctccaaatggagcaactgacagcaaaccacaagggcgtaacggctgcaaattgggtgaaaatgcgtgaattaggaaaccgcagaattcggtccgcaaaacgcattcttaccaaaggttgacatggcgaatagtgttctgatgcgggtccgcacctttgtccaactgaaaaatgggcaaattttcgttgttagttttttttcatgggtcattgatctgcagccatcggcgctaaacaaatcgatcagcgcacccaatcagtcgatgtttctctcgtggataaagtcgaagaattggccgctgcgctgcgaaaagtctaacataatcagtcttaattaattaaaggaaagcgaatgaaagtcaaaatcaattaattcacaagaaaatgaaccgaaaaaaggtaccaccggatgcaattaatggataacgaatgtctttgtgtactagactcatagtataaaagcattgcattatgcaattttaaaacactctctcattttctcggatgcctttatttcactctcgaagcgcgccgtttgttttttctaactcttgcaatttccctaatatattatttcctgttttgaggtcgcacaccaagattttaaaaaacaacaaaaagcgccaaattcattcactcatattctcaagcttatccatacatttgaaaatgtgttcgatcagaccgaggtggaggatttgtgtactgaacaccaattggaaacaattaggatcggtgagtgcggtaaacatgaaaattaa

SEQ ID NO: 12320 - DNA, 711 bp, Heterodera glycines
ggtcaatcaattgactcagagcatgcagatgcatgtaagttgtaggggaataatacagcatcatttttattggtttttaattcaattttgtaaatttaaatgatttagagcccaggttccgcttccaaatcaataaccccaggctcctcctatttgagtcattgcggacagtgccgctcacccgtgttgttatatgccatttccagcgtgatcttttgcgtgtagtcgaccgcgtcgcgaatggcaatcgcctccggcgagtcgctgaacggagccgggccggccatagccaacatttgcatgtgtttgttcggttggtttccattggccttggtgccattgctgacgctaaccgtcccagcggaagcggatggcatttgctgaaattgacagtcttcaaattgagggaaactttgaactctaaaattctctaaacaaggaatatctctctccccccccccccaaatattcattagcgtgcaaaaattcttgggaggctaaacttttggacggaattccatcacgttcattccccaccaaaatgttcgccccaaaatttgaccataatttatgtgctttcgtgcataattttctccacttatcaaactgcgacaaatttaaaaaatggaaaaaaatttgaatgagtggtgttgggttttatattccattttaaatttcccaatgaataaagaaactgttgtggaggaatgg

SEQ ID NO: 12321 - DNA, 2149 bp, Heterodera glycines
ctttcagccggattttggcagagaaaatttgccagatcaaaaaattttgcaagaattgataataaatatcatactttgatatgctgtgggatgctggcccagttctgtttgactgtgttcttcagcagcaaaccgctcagcgaacgatgggccacctggaaagtgaaaaataaaattttgtaccctaaaattgagcccgtaattttgaaataccggaaccgatgtgtcgcccggtgaaaaatgtcattttaccgggcggtcgttcctggtggtttgtccaaaaaaatgggaccgagatcgtggggccggtaaaagcccgccgggctctactctacttaaaaccttttatgtttacaaaattacgcatttaggttgtctgattttggcaccctcccccgtttaaatttaaaattcattaatttccttctccggattttgttccccggacttttaaccataaatttttttgtaaagaaattaaatccaatgaattacgtcttgttcggtgagttcgctgagaatgtagagcaaatagcaacagaactcggggtgtgcattcatttggtccaaatgctaaaattaaaaatgacaaaatcaaagaccaaacgacacacaaaaccagcagaacccacttgttggactcgttgttgcatttggttgtcaggagactgagaatgttgcaaaagtgagacaatctgaaaaatggggaaaaatcgcgataatgagtataaaatcacaataattaggggccgaaaattgagtttttttgttgcaaaacaaaaagggtggcccttttgatttgcaaaaagaaaattttccgcgaaaaaaacaaaaagaatcaaataaataccaccttcataattaacaactaaatcgtttttttttgtatgggttttgtggtccccaagttaaaaaaataacctgattgagctcttcctgagatggctgccaatttgtggcgtccattttcactgatttgatatgaaaataaaataatttatttctttttcgctggttttgatttaaataaaagccaaacatggcacaaaattacgacgaggaacataatggggaggaaaagcacaaaattgtgctaacttaattaagtgagaaaattctgcatgaaaatggaaccaaagagaaggaatggaatgggatgatcaatcattgaaaaaacaaaaaagggggaaagtgagtgagtctagtttcttataaatttttctaaaatttttaaaaaatttatttttggggtggcaattttgccctctctccttcacctaaaacaccattctagctaattccgtttttttaaagttcttaagccttttccactgatgaacacacaagcagtcaaccaaagcgtgcatggcaaacaacaaataagaaatggcttcgctcaacaaattttttggcgtaaaagaaacgccaaagttttaaaaagcatacagaatgccttcgtggacgaaccgctattcgtttttgacatgactctttttttggggctgaaatgcgaaaatcgaggccgaatcaattaaattttaataaattatatatggatataaaatcgcaaaatttggccatataatatggaccaaaaagcatgaaatatgcacataaaattgcaaaaatatggacataattttctaagtttcttataattaattgaaatttagcgcgccgaaagaaaagtggttgaaaagcaaaacaaaaaaggtcgtcaatttacagggccggcggaccccttcgcaaaatttgcttaccccccccccccacccctacagacaccttcgaaaaattttggttgaccccctgtattaactgactagaaccattaaatgtgagttttattcgaatgaaagagtcaacaaaagcatttctgagagcatcaaatcaaatttcaattggtgtgatcgaccatttctcagatataattaattcacttccgcgccagacgccatttcgttgctttgacgcgcttctttttcttcttccgctgctggtgacaaggcctacaattaaatacagtttgaattgggtgtgaattatctttacacttacgcagcagcagtccattttctaccaccccacaaagtaaattggacactggtcaaattgtcgtcccaatttccgtcgtcttcccattgatccg

SEQ ID NO: 12322 - DNA, 2449 bp, Heterodera glycines
tatgttaattggttggactcataaagtgcaatagagcctaattttttgcttttctgaagtcatacttctctggcggctgctctagcgtcggctaggtcatcagcatggccagtgctaacaccgaccaatttgatttccacggccttgccggccatcgttgccattaatgctgctctcaattgcgctggcgtgcagtcttcattcggcctccgtgttgacaatgtttggccatcaagaccattctggccaatgatggtggtgctgatgaagctctccgcaatgtcctcattcaatttgaccactattgaatgtgccgcttcgtgcgcagcgaccaatgcgggtgtcgtttcacctgttctgcgggcttcttcaataccctttttaaaattgctccatttcctccaacgccttttctgcgcttttcctgctttggatcgtttcggcatttactaaattctaccgtagttggggttgtatgtgatcgattttcagccgaaaagtgtcattttccttcaaaaatcctagagaacgaagtacgataagaattccctcgatcacatacaaccctgattgccgatcattaggtttagaaaacagaaatgggtagggattagtacagagtcagactatggtgctaatgcactttaattaaaatgctgtaggttcgaatgcactcaatcgggttcgacttcttctgatgcgatgaaatattttagaaaaattttcgacttcttctgatgcgatgaaatattttagaaaaattttcgacttcttcgtgcgtttaatactttagaaaaaaattttctatttctccggatgtgtttaaatacttaagaaaaaaaatttcgacttcatcggacgcgtttaaataatagaaaaattttttcgactaattaaatgcgaatgtattcttcaaagcagtaatggtgcaattaccgtctcttaataaaagtaattcaattacagtcagttcgtttaatccatctttctgcataaaaatgatcagctaatttgacaaaatcacaacttttgagtttttctcatgtcatttttgttatctgaacagttacaattacgctatcaataagcaaaatttcaattgtccgattcgcgcgggatggaatcccgcactgatttgcgtgatcccagtccgtaattttggaaaatgagggatttacgggataaatacagcggcatcccttcccgcaaaaactttgaatcccaatagcgcaccggcatccgcattgggttttttgaactttgaaaggacagaatgccaaaattttctgaaggtgctaggtcatttcgcgaaaagtgtaaaaatgatgcagtcacacaaaggccgtttcgcgaaataatttttaattattttaaattctcaaaaacaattcaaatgcacgtagacaaggaaagagaattcaaataatctttatttacttttctggctccctttctcctctctctcttgctctctctctctcctctccctttcttttctctctctcctctctttctctctctctcgtggtccctggattctcgcttgatttcgttacaatttagggaccggggttctgtgcttttcctctctcattgccaaattcgaatgtagctctacatatcctctactaaattataatttttttaaaatctagcaacaattcacaaaaagttgtaatgaaaaacttccggaaaatttagactgaacaattttgaccctaactttttttaaaactgtgattaagttttcgatcgtctgttgttgctttttcgttgttcataacaataaattcgttccaagactgttcagtttaatgatcagaagtacaaattagttcgaactcaattaacaaaagatctgccaaagttgggattcgttgtcttctttaaattattttttaacgctgcatttcatcttttggcacgatatgattgtcaattaaattaaacatacgaattgattccgccgtgaaaatttatgctttttgacaaatctcaagaaaaatgcgttcaacgataatttcaaatggtgacttgctcgagatccacggttcgggctttcttttctgtctcgacttttacgcactctcggtcttccactttcgagatcgagcgactttttatgcctttaagattgactcttggcaaattcaaaaataatttcgttgccaaccatccattttttctggtctatgtaaaatctgtcgacctgctattgaattaataaaattttccaatttttttttaatttgaaagattcttcacattgttctcatgagcagcaaaatatgtagtggggaggaggaggaggaggaaaaaatcaaaaatcggaatggacaaagtttaatttaaaccaaaaatgaggcccaaaaagcaacaaatttttgggacacaaaattcacacaaaaaatggggaaaaaataaaaaaacgaatacaggaaaacagata

SEQ ID NO: 12323 - DNA, 1633 bp, Heterodera glycines
tgattagggatgccaattctattggaaatccatatttttttcccggactgcggggggcctgaaacgcacgaaaaacatgtttttaacttggtttgaagctgctaggatgggtttttatatccatattttccatattttgcgatttatgtccatatttttccatattttggcatttttatccatattttatgtccatattttggcatttttcaaaaaaacctctattagaacggcccccagcagcttaattagcctttttgagcccaaaaaccgaaaaatttttcaaaaaaatcattttttcgcaaaatttctcgagaatattgaataaatttaaattttcttaaaaattaataaatttatgtcaaaaataagcaaaaaagcgaaaatttcgcttttgtggttgattttgcgctaaaaaattaataaattttatttcatttttttgccaaattccattttataaattgcaaattttgtttctttttcaaaggctttcaaagcttttcgattggatgagcggttgccaatgcgttgggttgcgttccgctgcccgagctgacaccaaaaaacaaccaccgccgccaccatcattttcatcatcaaaattacataattttcatcaccaccatcaccaaaaccatcaccatcagacccaacaccatcatcgaggagaccgagaatttgttgttgtttttgttgtccattcctcaccgaacaccgcggccaaaacatcgttgacggcaaatagtcatcataattatcatcattcatcgccatttccttcaccacctccgacgccttcgtcctcctcctcctcttcctgctgctgttgttgtccttgtcctcctcgtctcttaaatggtcggtctgtcggcgtttgtttgtttgtttttgttgttcaccgggccaccgaccgaccaaccgactgactgggcttgggctggtcgtgtttgtttgtttttgtgtgcaattggccagcaatattattatgattatttggtttggctgagatgggccggtgcctcgtctgtcatagcaaaaaaccaaaaaaaaaccatttgaaatttctgccaattttccaattatttttcgtaaatttttgccaattttccaattattttcgtcccaaattcacaataccgaggccagcagagcatcgaaaatgtgatttctttttttttaattgcccaaaaatctcaacgacaaaacccataaataccaatgtttgtctgtcggcggtcggtcccatcttgaaaaattaaatttttcaatatttggttcaaaatttgtatttttatccgaaaattctgcacattttatcaacaaaaatttttaatttttcctaatcattttgtacaatttttatttttaattttttttagaggacattgttggtgaccattcgtcgtccgaccgagtccctccgccttttatcgttgacggacactccgccatttgtggtgacaaaacccaggcaacaacccatgccctgcgctcaacagttgtgccaagcgcatgcaaaaccggtgacacaaaattcggtattattcaggaaattatgcataaatctaatcgaattttagagaaaatcctttttaatacaatattagtagagatcgacattttgaaaaaa

SEQ ID NO: 12324 - DNA, 1391 bp, Heterodera glycines
atatagtcaattttataaaaaaaatggcacagtagtaaattctcaaattggcaaatttctcggcattatttatttttattttttttttacataatcgcccgtcgaatccttttcttaattcattgccaaaattttaagaggcaccaagcgccgcagtgccaccacaaagtgccaacgccgacggcgcattggcggtgccatcgaccgccaaacggcggcagcgacacggcgccggccaattttctgttccgtcgtccccctcggcgtcgctgtcgtcgttcaccgaatgccgtcggcggcggcgtcccgcgctttccatgccgttcatgttaaccatgtggtggacatgtttgttgctgttgttcgccttgccaacccatgtacattgccagactggcacaagtgccatcgaaggttttttttttggtttgattttcagaaatttcgcactgtaaactttttggaatttttcaaaaaaaaaaatcccaaatttcagtgcaaattgaaagaaaaaattgcaaaaattttaaacccaattaaagttttcgttttggaaatttaatggattttgatgaaaaaatcggcaaaaaattaaccaatttctttatgctcattcataaaaactattctttgctctaataaaatgtgaactttagcgaaatttgtcaccactcctcggttttttatacaattttttatggcttggaaaaattttcttaaaatttttttttttttagatttttcgttgcatcccgcgcctcggcaaccgcgccgtgtgttcaccaaccaatgggccgttcgcattgagggcggtctgccggcccaagcggatgccatcgcctccaaatacgggtttcgcaatttgggaccggtaattttttggctaaaatttggggccccatttttggtactaaacttttgttgataaaaattggcaaatacctattccctttgaacattggcaaaaataaaacatcgaaattttaatttagggaaaatttttttaccgtttttaaataaaaaaaaattgccaaaaagtattgcgcgccattccccaaggttatccccggcggtgattacttcctttttgaaagccgtgtggtcagaaagcgatctctgcgcaaagttcggcgccatttgcaccatccgaccatcggaagagagcaaaatgtgagtgaattgcccaaaatttataatatagttggaagtctgatttcgggcataattaccccctcatacattaaaaagggagggggggggtcagcggccaattttgcgaaatggtcccggccatgtaaatcgacgaccttttttttttgcttttcaaaaccccatttttcatttttgttgcggcgcactttttccaaaaattttctggtgaaccggggggg

SEQ ID NO: 12325 - DNA, 2165 bp, Heterodera glycines
cccccccccttttttttttatgaatacctgcccatgctacatcatttgaaaaatacaggatgtaaagcattttttttctagccagaaaatgcgcatattaaaatattcaaaaaaggaaaaccccaaagtttatcaggcttacttgataattttaagatttttcttttcttttttttgtgtttaaatttgctacaagaaaaatcctcgaaggaattttaagtaaaaagttagtttttatttttttcttagattttaaaacttaaattagaaatttattagaaaaaaaaaacttagaagttatttttattaaaatttcttgtaattataaagattttccagcgattttttggaaattttttttttgaaactcaataatttatcataaattttgcaaaaatcgctataaaaattttactattttttccttttaaatattaaatgctttctaacatttttttcaaaatttgttgtttaattttttcatattttaatgtttttcgctcttcatttaggttctttggttggagcaacaagtggtgaagaagcgggtaaagcgcgactttcgcccggtcattcaccggcgacgccggcaccggcgcgagtcgtcctcctctttgacttccactgacgcgtcgacagagcagcagcaacagtcgctgtcggcgtcccttgcggcgacgctggcgtcagcagtgagtgaaggcggcagctacagtgccgttgttggcggcggcgacaacaccagcgacgcggtcgccgtgttacgtccacgcgctcgccaccacaccacgacgctgttgcagcgacagcagcaacgacagcgacaacagcagcacccattccgaccgccggtcattcagaacagcgacgacgaatatgagggggaggggacagcggcgggcgacgggccggacgactttttgaacatgaacaggtgggcgatgcgatgtgattggacgaatggaggaaaaccgggaaaaaatgtttaaattttattcaagtttttaaatttgacacgaaaatcccccaaaatggcacctattgcaaattaacgaattttttttagatctttatggaaaattttttaaaaaatggaaattttaaaacttgaaaaaacctacaaaaatggccatttttgagttaaaaatataacaattcaaaaaatttattctcgtgctccactggcgcctaatttttgaaaataatattggaaaaaaaaattaagactaggattgaattaaaatctatgtattgctgatttaatgatttttcttttagattttcttgaaaatttgaaaaaatagcattttaaaatttgaaaaatgaatttaaaaattcaaagaactaaccgttaaacaacaggatcagtcacaatgatcagcaccggacacagtgggcacgtcttcggtacggcgtgccaaacgacccgtactggaaggacttgtggtatttgcatcgacgggacgaacagccggacgaaatggatcacaacgtgaaggaggcatggtacctgggctacaccggcaagggcattgtggtgaccattttggacgacggattggagcgcacccatccggacattgggccaaactatgtgagtgttggttggcatggcacacactcatcatttaactaaatatttgccatacttttatagaaaaatttgtctgacaggagggatggaatttagtcgatctaaaaaaaatttttttttcgaaattgggtaattccgaggcctaaaaaatgcataaaaaattttctcgcagccctgtcaaaaagacaccgagttcgctacaataagttgagttttttttttaaagaaaagacgttcaaattttgcatcaaatgaatctgaaaaacaatggatttaacgcaaaaaatgatgaggcgcttcggatggggctcgaacccgcgactccttgtcccatagctcagttggtaaagtgggtgtgtatgtgcatgatgcgcacgggttcgattccttcccaccgtttttttttaaattattttttgcttttgtcataattgtcaattgttcatgtattctaatttatctctcctttttttcaggatccggatgcctcctacgatgtcaatgatcgggacgaagacccgaccccgcgctacgagtacacggacgagaatcggcacggcactcgttgtgc

SEQ ID NO: 12326 - DNA, 2921 bp, Heterodera glycines
ggagaaacaaattgccaattccaaaaaggaaaattggaaatttacgaattggaacggccatgaaagtgaactccgcttcgcttttcaaaaccgacgtggcggtagatggcaaagacatcaaattcgtactcgacagcggggctgaaataattgtgatcgatgaactatcacatgaagtcatcggcagcccccgactccgcaaatgcaccgaaagtggatgcatgttcgatggaacacaagtcaaattcatcggaaagggagtcgccaatttcaaattccgcgatatttgcatcaaaagcgaatattatgtggcaaaaaggggatcgctaaatttgctaagtgtgcaaatgatggacgcttttggactcctgaacgaactcaaggccaaaattaatgcgccagtaaatctgtgccgagttggagacgagacaagaggttttacaaaagctccaaaaccgtcacaaaatttgacagtcaacgcgcacatcgaccatctcaaagcgacatttcccgacattttcaaaaacgaattgggccgatgtatgaagttcaaggcgcatctgactataaaagcagacgccgcaccggtctacagaaaggctcgcccagtcccatacaacgcacaagaagcgattgatggagaattggagcgatgggagaaaatgggtgtgattgggaaagttgaatacaccgaatgggcagctccgattttggcggtgaaaaaggccgacggaagcgcacgcctatgcatagactattcaaccggtctgaacaatgcccttcaagaccaccaacacccactgccgctacctgaggatattttcgcaaccttaaatggaggaaaatattttttcgcaaatcgacctcagggatgcatatctccaaatcgaattggatgatgagtcgagaaaaatctgctcgatttcaacacaccgtggcaactatgaagttaaaagacttccttttggcgtgaaatcagcgccagccatcttccaatcggtaatggaccaaattttggcagaatttgaattcgccacagcttacttggatgatgtgatcatcgtaagccaaagcgtcaaagagcacgctgatcacttgaagaaagttttggaaaaattccaagaatggggattccggatcaaattggaaaagtgttcgtttttccgagaagagattaaatatctcggacaaatcatcgacagaaacggacggagaccggacccagagaaaatctcggcaattagtaaaatgcccgcacccacagatgtgccatcgctgcgttcatacctcggaatggtgaaccactacgagcaattcgtcaaaaacatgcgttttgtacgaaaaccgctagacgatctgctgaagcaggacagcgaatggagtggagtgaaaaatgcaaacaagcatttgacaaaataaaggaaattttgtcatctgaacttctgctcacgcattacgacccaacaaaggaaatcgtggttgcagcagatgcatccgaactcgggattggagcggtaatctcccacaaatttcccgacggaacaataaaggcaattgcacatgcttcatcagctctaacaccggctgagaaaaactattctcaaatcgagaaagaaggattggcactgattttcgccgtgcaaaaattccataaaatgatttatggacggaaattcacgctgctaacggaccacaaaccacttcttgccatcttcggaagcaaaaagggggtgcgtcaatgtagtgccaaccgactcctccgatggtcgctgatcctcctcgcatacgatttcagcattgagtacatcagcaccaatgattttggtcaagccgatgtgctttcaaggctgatcgcaaatggaaaaagcgacgaagaccgagtgattgcatctctccgatcagattcggaaattgacgacattttgatcggatcaattgaagcactgccaattaaatttaaggaaattatcgcagctgctgaagccgacaaaaccattcaaaaagtcaagaaatttttgacgaatggttggccaaggaacgtcggagacgaaagtgccgaaataaagctttttcatcggatcaaagaacagctttgcatcacgagaaattgcctgatgtacgccgaccgagttgtcatccccgaaaaacttcggcagaaaactcttcatgcattccacaagggacacccgggaatcaaaagaatgaagcagttggcgagaaattatgcctattggccaaatatggacgccgacatccaacagatggtagaaaactgccaaccatgccaaatggaagcaaaggcaccagttaaaagtaatcttcaaccatggccaaaaccatctgcaccatggcaaagagtccacatcgactatgccggaccatttttcggcaaggaatatttaatcattgtcgatgctttttcgaaatacccggaggtattcgaaatggccaccaaatcgacagcggcaacaatcgaaaaacttcgatatttgttcagccgacacggcatcccggaaattttagtgtctgacaatggcacccaatttacgagcaacgaatttgccaaatttatggccgtcaacggtgttaaccacctgttttcagcgccgtataatccaatgtcaaacggccaggccgaacggttcgtggacgcgtttaagagaacgtttcgaaaattgaaaggggagggagccccaagcaaggaaatcatcgaaactttccttgtaagttaccggactacgccaaatgattcgttgccgaacagcaaaacacctgctgaaatgtttctgggaagaaaaccccgcacaactttggatttgttgcggccgccaccagcacaaccgatcgaaagagacgtagaaatggcgagacgcttcaataagcgataggaaccaaattaagggagttttcgatcggaaaca

SEQ ID NO: 12327 - DNA, 1923 bp, Heterodera glycines
  misc_feature (891)..(891): n is a, c, g, or t
agactttacaaaataatacccctgtggagaagggtcgtttgaagcatgattgcgaaattttctattttttctagtctaatctactcaaaccggttcagaattcaataaaaataacattcacggtgcctagaaaagggggttgaaaagtttattattgaaaaaaagactttacaaaataatacccctgcgagaagggagtgggaaacatgatttcaaaattttcaattttttatagactaatctactcaaaacggctcagaattcatataaaaataacattcacggtgcgaaaaatggagcttgactagtttattgtggaatgaagactttacaaaataatacccctgtaataaggtagtgggaaacatgatttcaaaatttttggtgaaatatttgtcgtgctctgaagggcgtggtaggttggaggaattcacgattttttcgaatatatagatagatataatcgttttttcaaaaaacttttgctatttttttcttcaaaaggtttcaaacggatgaaagcaactaccgccgcctcacacagcgccgtcccactgcgcattaccgcaccattcgatgccgttggcactttctgatggccaaagaggagaggaaaagacgggcggggaccgaattgactgacggacaaagatgggaggaaaaacggacggggactgaattgactgatggctaaagaggagaggaaacgacgggcggggaccaaattgactgacggacaaagatggaggaaaagacggaagagggcggggacttaattgactgatggccaaagatggaggaactttttaacaaaccggtctcaaattaaatttttttaaatccccgcttccccgtcgtacatcgtttatcgcctagatcccttccaatatntttccattgtattattataagcgacatcatttacctatgcatataatcaatcaccgacaccattaccatgtttattaaacattaagttatctaaaataccatactaaattgaaaaaatcacatattaaaatactaattatcacattaaattgggaaacattacatattaaattgatcacatcgacgccaatattgccgcaaattgttgttattctttttcaaaataattgggcgatattggcgaataacgcgcgccacttgacggttgatgtccaactaggcagtttttaaaaagttttaaaattttttcaaattatcttttttaaatttttatatttttaaaattaatttttgatggaaaatcatccaaattatcaccaatttcctcgtgcccaacccaagcggcggcgctagtcgatggcaccaatccgttttgcaaaacttcttaaaaaatttttaaattaaatgtatgagttaaattgaagaaaattcataataattaaaaacgaaaaaactcaaatacaaattaattaaaatattttttcaaatcaaaaatttaatatattttattatttttcaccaattacctatttccgcagtatatttattttttattttctgacgatcatttttatatcccttccaaagatcggagatctttgttttcatctccttttttagatcggtaatttgcttctttcgtgcgttttcctagaaaatttaaaaggtgaaaaagagggggtgggataggcacctccaagtaataattgccaatgccgaatgaattattcataataaataattttgttgtttttttatattttgtatctgtaattgatcagtttttttttgagaggtatgttagaggataaaaaccatgaatgccactgatttccgatttaaaaaataggaacactgatggcgaaaactattcggaaattggacttccgaggtcaaataattttctaggatataatataatcggaattccacaccaaaagaaaaaacggaaatgtgtggcatactggcaac

SEQ ID NO: 12328 - DNA, 1877 bp, Heterodera glycines
taaattttcatcttccattttaaatactcgttccattaattttcatcatttttgcaattttttaatcacttactttcggattttcactcattattttattaaaaaatgaattattttctttttttttgatcagtagaggagaaaaaattaaattaaaaatatttttttctttaatataaatgtgatcagtagggaaggagatcatttcttctttttttcaaataaatttgtgatttttccggaaattcagtagagtcgtgattttttcaaatgaataaaaaggctcttaatggactaaatgaataatttggatttaaataaaattatataaattcatatttgggaatataatccagaaaaatgaatttattactgttattctgtttattttaattataattgccctaattagtccaattgaatcagaaaataaaaaattacaacaaaagtcatttggcaaaatatttggagaaaaatgggaagaaaaagtgcaaaaaatgcaaaatgaaaagaagaaacgggaaataattcaaaaatattcgaaacaaaatttatgaatgtattaatgaatttgttcttcaaaaacaaattcataaaagctacaaattaacaactgatgatgagaaatttgaaattttacaaaaattcattggaatggctttttataaactcttgaaaatgcaaaaaaaaaaaagtcaaaataaacacagaaatagtcattaaaaaaaatcatactagaaactccaaacccgttttttcaacgttaaagtggtaaaaattttagacatttcatttctcagtgaaactaagctgaagaaagaatattaaaaataaataaatataattttaagagtcgacaatttcaaaataatagtgcattaattttatttgttgggaatgtattcccaaaaatgtattaaaaatggtaattcttcgcaattctactgagcaaaagacgggattaaaaattcttgggttttcggtatctgtgatttattcaaattttgtgcctttttgaaatgtttaaattaaaaaaattagctattttttggccaaatctgttaataaattgaacatattccaaaaaatttcctcgtcgatactttccatcagcgccagaccaccaaatcctaccctaccataaaatctccaatccgttgcttttcagaacattcaatatttattttcattttttcttctattcaatcacttctttttaatctggtcagaaaaaaagtaatagaaacgtaatatagaattaataattcaaataatattggtatctacatatatggagatggtggattttgcaaaatgatttctatggtaagcaatcaatgatgttcggcaaaaacattttcaaacgcccttcaattaaaattaattcaggcccaaaattattttttccaagtttatgttgaatattatgcgacattcggattttggtcatattgcacgctttaacatccccttttacagatttaacacaactaataaaaaattttgtcacttactcaacgacacatttacctgaatattcattcgtcagagtaagtggttctcgcccttctgtgactagggccccgacttttagtgacgaaaaatcgcaaaatagttaactaaaatagtgacgacaaagtgccgaaatagtgaaaaaaaatccaaaatagtgacgaatagtggcataattttcagccaaaaactaagcaaacatttttttattcactggattgtagttgtaaatggaagtaaatttactttctaataatttcgtggcaaatattgacatttttaaccaaaaatttttgtcaagaaaaaaaaatttgggggatgaatttttaagaaaatttttctagaaaaattttggtcgattctta

SEQ ID NO: 12329 - DNA, 2357 bp, Heterodera glycines
taccaaaaatacgaataaatatttggaattcttaagtttcaatgatacatcggaaaatgaattttctaaaattattcattccaccccaccccccccccccccccccactcgctctggttggttggcctttattctcgagaaatgaacgttcccgaataggcggtcgaaacggcaatgagcaaaggtcagcccaacattaattaatcaccgggagaaactgggggggggggggcaggaaaaacaaacaaactctcgacaaacaaatatttgaggagaaggaatggacgggagtgagtgtcggtgaagcgcaacgagcagacctccatttgcgcacacgattttcatttgtcaaatcagaggatcgatcacctgctgccactttggactggacaaaaattgttttacccagaatcagcaccgaaaaattggccagagattctcgagagcccaaatacccgagaaattgcatgagtcattagtattaattcacaggaaccgcgagactcacgcacatccctcacgccgtaccctcttcttatttctaagaaaacttttacaatttttgaaaattaaaacttccataattttaagtatttttcaacagtttgatgggcggtgccaatcctttaaaattaaaaccactcaaaaaaagaagcagccaatgctcaaaacaaaattaaattgaatttttgttaacatttgatttggttagttttaagccaaggttatgccaaatataaacggggctttttacgaaacagcctagcagttagagcataataagcactacttttgtcgcttttgtcctttattctcacatatattaattaaaaattgataatgtgcctaattatttgcaaagaaaaattgtgtgcttaatcattcaaaatgattgcaattccaattattcttatattctttgttcaaccggttatttgtttaaaaattttatgcttcatacacagcaaaatggtaatcattgagctattataattaaaaaaatttaaaagtatttttaataaataataattttaaaaatgcaaaagcatttttgtttagtttgaagcaaattcttttcttcaacaacaaccaaactgttcacatttggtcattaaagatttcgcaaaaattggattaaaggaattcaaagcggatttgaatgcacgttataaggcacaatatctgaagtgaaaattatacaataagaattaattgaataaaaataaaattaaaatacaaatatttttcctgcaaaaaatatcttccaaaatatacatttaaattttataagtttattttatttcttataataaagaaattatcttacatattttctgtataatgaccaaaaaatctcaagaaagtaaatggctcagaccaaacaataatcaaaaatatattatatatttaataaatattaaagtattatttttattatatacttactcattgtccgtttatcacataattttggtatttttatttttcatatttttgcagggcttctgctcctccacacaatttaaaactgtttgccgaaatgtcaccaaaaaatggcaacacactggtctttcccattggcattgaagggcagaaaaattttgttcaaaaattaaaaagaaatttacggcatctccgttctttgaacccattgactggaaagccaatttttagcggactattttttcgtgccggttcgttttcaattttttttttagaatcatgaattaaacttgagtgacgagtttattttaacaattatatattatttaagctatttttcaaacaaaaaaaattgcgaaaatttattactagagattttaagaaatatttaacccattggttatgcttaaaattagcgaatttatctatattttggggcggagttcattttccattttttttttgagtgtttcgaatgatgaaaaatttcgattttattaattgattttaaatttaaaaaaattattccgttttttgcacctcctttagctgcattccaaaaagaaggcgaattttttggctttttccctttattggccaaattacgtgaagaaaagttgcgcaaaaagaatacaccgtcgtttggtgaatttatgcttggcattgattcccattttaatccgtacaccatcggtttccctgctaataagtcaattgccaatctcattgacattttctacctttccatgatgtcagacggtttgatcaaggtataaaacaataaagcatcatactaggggctaaaaacagaataatcttaaataaggcaggggggggggaagggataaagggccagtttaaaattgacacaaaaaaaagggattctaaaaaccaatcaaagttaaaaaaatttt

SEQ ID NO: 12330 - DNA, 1011 bp, Heterodera glycines
  misc_feature (14)..(14): n is a, c, g, or t
  misc_feature (37)..(37): n is a, c, g, or t
  misc_feature (101)..(101): n is a, c, g, or t
aaaactgtttgcgnaaatgtcaccaaaaaatggcacnacactggtctttcccattggcatgaaggggcagaaaaatttgtttcaaaaattaaaaagaaatntacggcatctccgttctttgaacccattgactggaaagccaatttttagcggactattttttcgtgccggttcgttttcaatttttttttagaatcatgaattaaacttgagtgacgagtttattttaacaattatatattatttaatctatttttcaaacaaaaaaaaaattgcgaaaatttattactagaaattttaagaaatatttaacccattggttatgcttaaaattagcgaatttatctatgttttggggcggagttgattttccattttttttgagcgtttcgaatgatgaaaaatttcgattttattaattgattttaaatttaaaaaaattattccgtttttttcacctcctttagctgcattccaaaaagaaggcgaattttttggctttttccctttattggccaaattacgtgaagaaaagttgcgcaaaaagaatacaccgtcgtttggtgaatttatgcttggcattgattcccattttaatccgtacaccatcggtttccctgctaataagtcaattgccaatctcattgacattttctacctttccatgatgtcagacggtttgatcaaggtatagaacaataaagcatcatactaggctaaaacaagaatagtcttaaatagggcaggggggggggggggaagggataaagggccaggtttaaaattgacacagaaaaagggcatctataaatcaatcaaagctaaataaattttgtattcaaaattatttaatcaattttacaagttaaaatccaaatattatcagaataaatgtataattcctttttgattgggcaggctcactttggataaagcttttttatctgtgatccgcactaattacccttatttattaaaaattacttacataaacatttatattcgctgctt

SEQ ID NO: 12331 - DNA, 1915 bp, Heterodera glycines
taaaaaggatagaaaataattccatgcttaatattttttattttgttgttgaagaaatggagtccgcctcagatccaattagaaaattttcatttttgtcttgaaaagtttttcgcgtgctttttctgagtgattattgaaataatttttttagaggatttttttatatctaaatgcatttttatcgcctttttctcctgcaagtgaaattaattggcagtgaaaaaatggtgatttgtgactatttaccatgaaaatttatgcagcacttttaaaaaggatagaaaaagaataccttgcctaatattttttattttgttgttgaagaaattgagtccgcatcagatccaattggaaaatttttctgctttgtctcgaaaagtttaacagaaaatagattggataaataaaaaaattaaacacctcttatgaacaatttaaattcccttacattttgggcttactttactatgctggcctatgaaaaaatggagttttataagtgccaaatttttgtgaattttcttccggcgcgtcataaacgaattgtttggggacaaacccaaacaaatttggtgttcttcgaatgcgctaggcccgctctacattttcaaatgtatcaaccaagggtctatctccactctctggctaggtatggcccgtcaaagcagagtggggcataaaaacgaattttttaatctttggcatttcctctatttcagccggctccacttacatgtcttgtgccaataggttattgcaacagaaattttttcagctttcccgactaattgttgagataattttgttaaacgacttatttatatctatatgcatttttatcgcctttttctcctgcaagtgaaattaattggcagtgaaaaaaagttgttctatgactatttaccatgaaaatttatgcagcacttttaaaaaggatagaaaaataattccttgcctaatattttttattttgttgttgaagaaattgagtccgcctcagatccaattagaaaatttttcatttttgtcttgaaaagtttttcgcgtgctttttctgagtgattattgaaataatttttttagtggatttttttatatctatatgcatttttatcgcctttttctcctgcaagtgaaattaattggcagtgaaacaatggtgatttgtgactatttaccatgaaaatttatgcagcacttttaaaaaggatagaaaaagaattccttgcctaatattttttattttgttgttgaagaaattgagtccgcatcagatccaattggaaaatttttctgctttgtctcgaaaagtttaacagaaaattgattggataaataaaaaattaaacgcctcttatgaacaatttaaattcccttacattttgggcttactttactatgctggcctatgaaaaaatggagttttataagtgccaaatttttgtgaattttcttccggcgcgtcataagcgaattgtttggggacaaacccaaacaaatttggtgttcttcgaatgcgctaggcccgctctacattttcaaatgtatcaaccaagggtctatctccactctctggctaggtatggcccgtcaaagcagagtggggcataaaaacgaatttttaatctttggcatttcctctatttcagccggctccacttacatgtcttgtgccaataggttattgcaacagaaattttttcagctttcccgactaattgttgagataattttgttaaacgacttatttatatctatatgcatttttatcgcctttttctcctgcaagtgaaattaattggcagtgaaaaaaagttgttctatgactatttaccatgaaaatttatgcagcacttttaaaaaggatagaaagataattccttgcctaatattttttattttgttgttgaag

SEQ ID NO: 12332 - DNA, 1451 bp, Heterodera glycines
aagaaagcatgatgaaattcagtggattcttaacaaatttgtttgtgaaaatttacttagaaattgcattgtgtgtgtgtgtgtgcatttgttatgaggacattgaataaacagaactgatcatttggattcagagattcaaaacatccccagaggcgatcaaagcctggaattatggtggtctgatcaaaggcggacgaaaatggttgaaaaattgtaataactgacaaaatttgaaatgcgtaaagaaaaagacaaaaagaaagaaagatggaaagcgaagacggataaggcgatgggattcaagcaaacgaggagcggatgccggaacaacgcaagaaaccgatgactgacgatccttgacaaaacgacgatgaaccgattgatcaacaaatggacgaaccgacagacggacgaacggaacgagaccaacggacgcgaccgcggacccgagaatgcccatcccataataaaaaactaacagttgaaaatacccacccaaacattgccactccgccacactgccggcctcggcggtggtcgtcccccccgggcacggtgtgcacttcgtctgtcccgcttgtttggcaaatgtccccgtagggcatttggcacaagtgccgttggtggcaaaatgtccctgtcggtaaaatgccttttgtttaattgggttttgctacctttggacatatttcacatctgagcaattcatttggagcccatccattcagacattgtaaatggtaggcgaaatgccgtgattggacacctgcgatttgaaaatcggcaaaatggatgtcaataaaaatttatttactgccgtccgggcattggtcttcgaatgacgcgtcaattttgtcggaaaaggcggcgccaaaagcgccttttactcgccgaatgcagttcaccaacacttgtccatcattgctaaaagccaaagaatttattacaaatccacaagaaaattcaaagacattctgaccccccgtttattgtctctgcggtgaaattgtgcacagtcaaattggggtggacaaagtcaaaagcatttggggagacggaccattggacgccgggacaattcaaagcgaaaaagccactgaattttcattaattcctaatatttacactcctctcaattagtgcccactttgtgtgccgtgccaatgcctttgtgcatttttcaatgtccgatgccacgacaattgaaacggtcaccgcggaagggcttcaaaatggatttttttttttcactttttggcttttcccattttcctttaattttcaattcttccattttccctgcctttcttcctgcagacattgcgcttctccaatcaacgacatttcctgactttcgctccccatttctcttgtgtatgtcaaccctttgcccggtcggttccgccagaagcgcaactcgcgcaacccccgagggtattcgcgtcccc

SEQ ID NO: 12333 - DNA, 1194 bp, Heterodera glycines
tcgaaaataaaactcacgatctgataccaaaattggcacttttggacgccgttttctcctacagtgactaattttggcactgccaaaggaagcgaagtgccattgggggggatcaaaactaaaacaggaatgattatgagacctttggaagtcttatttttatttttgcctcaataatctgcgattttttgctaaaattggcggatattcagctcgaattaacggcggttcgtctgtcagcgggtcacctccaaattcggcactcacattcacttcgcgaatttgccattctggacattcaatgtctttgtcattagacgagtgtcccgcagctaaaatttataaaaatatttaaattaaaataataaatttaataataaatcacttactggcatcgtcagaagaggtaccaccttcgaagacaagctttgtcacacactgtttcaattcaccgtgaaaatcaacagctcgccaaacgatttccgtctcatcgccttgtggaaaaaaacaaattaaaagggaaataattttaaatttaaaaattattttttcaaaaaattattagaaaagcttaattcaaataagcagctaacaacacctctgaatttatatgcttttgccgaaatgttcatatttactgcactgatttgaatgtgcgggtcattgtcaactaccgtaggcctaaattcggttgtttcgagtcaatttcaaacaaaacaacttgccatgggattacggtaggcttaggttgtccggtgtcaatttggtgtctaattttgagttgagaagcgcaacgaagttccagcggttgtctatcaatgcagaaagggggcgcagaatcgaggtcaaactcattcaaattttgctgcgaattataccataaaaatgtttaaatcaaaaattaagattttatgcaattttaaaattaatcaacaccttttctctaattacagtttgagtcagtggaactgttgtggttgaaattgctgttggcattggcgttgtgctcgtgctaattgttctactaatagtggacaaaggtgctacagtatttctgctggttgttgactgtaaagattttaatattattaaattactgtcttcctttccctttttcataacgaccgtattcacttttccattttctaccgtattcctttcccatttttgatatcctacagataccttcccatt

SEQ ID NO: 12334 - DNA, 2046 bp, Heterodera glycines
  misc_feature (2033)..(2033): n is a, c, g, or t
ccccccccccctccgaagccctacgcttttttattaccttgaaaatgccgcattcggcacgctctgcgcacctgcgtacgactttgaatggcatggctcgtcttccgcttcgttgtgtgccatccgcggcaccgttgcgcgtgtgcgattggaccatacacaatgcttttggactctcacaacgcacgttagtgcccgcgtcacgcgaagcgtcagcagcagtcaaagaaatgcaactggggtccgtgtcggaagagcacacgtggcaaagcagtggaactgaggcggaagggaaaatggcgaaaataaattaataaaaaaacatttattcgatttgcaaaataaaatatttaatgaatttacataaatattcacccttttccgcgcattttccatttgcgtttattttctgaccatttggacattggcaaccaaaaaaggacgactaaaagaacgaaaattaatttatttgtttattattttattagctcttttttcgaactccgttctctggcagaagccaattgccgcttggcgaacagatcagttgcatcgttttgccggattggcattttgccgaaattgtccgattttcaaaatgggccggtgtgcgcggaaaatttgccaacttttaaatattttagaataaaaatttttcaataaaaattattaaagatcggtaattttaaatttgcagatcccgctgcggtattggaattcaaaatttttgcgggattactggtggacaagccgtgctggacacgcggacacgttcaaccacaaagtttggccatttatcatcggcggagatttgaattcgaagtttggagtgcggggggaaaaattggatggaatggacgaacggatcggccataattcggcctaattaattgaaattaaaaattgatttggtaataaaatgataatagaccacaaacccaagggattgaaatgttccgctgaagggtccgcggaaagcgaagggccagcgaaataactgacccaaaccatacagtcgggacagggaataggcccaatttcaacggacagtgataaccaatcgccgcccgacacgtccatcaacggagtgatcagaaaacttagcggacatttcattaaatatatgaattatcaaaagagtagggacattgaacaaatgattgatcagtggattgaaagtgccaaaaaactcaatcagtcgatcaatcagttaattaagaagattaagcatcattaactaatattcaatcaatcagcagccaatcagtcggtcaatcaacaacaaataaaccaaacaaccaattaataatacctctgcagacgacgattggatggccaatacgcccaacttccatttgggtgaatttgatgccactaatttatgtaagaagatatctggctgatcaaacaaccaacaataataacctgaatggacgcgtgccatccgaacaatcgccgcgcactgtcaaaaaccacagctaaagaaggcactgatcagcaccaatcggctgttgtttttctcgcttttcaatcgactcgcctttctcgggctttgctgctctgaccagtgcgtctaattggccatattcggatgtttgatcagcagcagtgatcggctgcgtctgtccatcggccatcgcttctctcactgccctcctgacaaaatctaaaaactgggcgcatgacattaaattcaaaatgatttaaaacctaactttttacacatttccgcgctttccgatcgctcagagtgtaatttggttggacacattcaaaggacacttcctgcccctcaggtacactttcgcgggacggactcagcaaaatggtggaatttgctgtgaatttggacatatcacaaatgccgttactttctgttttggctaaaattaaataatttaaaaaatgttttcttttttgaccttcgcatttcggcaattcgtccattgaccatgccatttcaaagtttgtcaactttttgcaagtcattgtccattctttgccgaatgttctgagaattatttttttacganttaatttacccat

SEQ ID NO: 12335 - DNA, 2367 bp, Heterodera glycines
  misc_feature (13)..(13): n is a, c, g, or t
cgcctaaaataanaggcgaaaaattcatagttagaaattatcagttttttcttacgtcacatagtctgccccctcccaaatgcgcttctttttgctggtcgttccttcgttgctcaatttttgtccaccatcagcttcggcacttcttttagctccaacggtagatgccgacctgcgtgcgggtcggtccgcagcagcaagcccatcattgtcagttccatcattttttgttggaattacctaaaaatgggagactttatactaaaaaactaatacatatttcccataaaacaaaatgctaaagaattttttggattggtttggctcactccgatcgtctctttggatgctcgccctcgcttcttcggttgctgttgttgaagcagtttagtgtcaccatcgatggtcaccgctttttccatttgctggcacagagttgaagcatttgctgctgccgcaccaccaccgccactggtgctaccaaacggaagcagttcgttgaactcgcgctgtatggtcgccatttgcttcttggtcagctttttggccaccggaggacggtggtgttgcagcggatagtgctgccgctgctgttcaattcttatatttgctgaaagcgtggaaaattaaaaatgaatgtggcctaatgagtaaatcatacgacaaataccccataagcaaggcacagagagagtgataggcttccccattcaaaccaagtggttgctctctatttgccaaaaagtgagtgtttttgggagaaggaacaattttaaatagctaacaataagctaaattgaaaaaaaaaccatcaatataaaaatgccatatgtttttttcaaacttttctattgaaatgtttattttctatccgatttgtcacggaccttcttcctcccgttgctgctggacagtgaaaacttgttgtcgatattctttcgggtggtataatatttctggccgattgtgagtgccgctgccattgtcattggttgccaccactttgaaatgcattgttggttgctgctgctgttggtgcgtttgtactggctgaacttgttgtagctgttgttgatgatttacagcaccagcagctgatgatgattgtgacggcggtgatggtggcccagaggcggtcgaagttgaccgcatcaaagaagaggtcgcatgttgcaacaagctggagctggcctgggccaagtcggccaaatcctccaaactctgaccagccgtcgagggcaaaagtgatgccgaatggcgcgccagcggctggcccattcccatcccatgagaactgtactgatgatgatgagcagccaaacgatggtggtggtggtgctgatgaaccattgttgtgccatctccacgtggcgtcgcaaagggcacattggggtgccgttgctgatggtggtaatgtttttgcggctgttgtgccgactggtcaacaaccaaatgttgctggtgcttggccggcgacaatggcgagacggtggtgacagaattcgcagttgtgtatggtgggtggatgaactgctgctgcggcacggatgtgatcgctgtagtggaggaaaatgttggagatggagcagtaactgcaacacaaccaccgccgcttatgccaaagcctgtggaggaagaggacgaagctggagcagaagcagcgggaaagttttgcattaccaacgcgtcaccacggacaacggaatcaatggcggaatcaatgctggactcatattgctggtggtgacgatgctgctgattttggtcgctaaatcgatggtgtggagggaggtggtggtcaaccggtgggatggggtcgtctggtggtttcgaagattcctgttgttgttgctgatgataggtggtgattgcgtctaatgatttggggggttaattttctgtgaaatatatttctcgtgtcaaaattaaaaattttagtcttatatttttaaattgtgcatgtacttaaaggcgaaaaactttcgggatcattaagtctgactcgatcacaaagtcggctgagaagacaaacttttttagttttccgttatttccaatcaaaaatttagcaagactttctttgaaaataatttcagagtgcggtatgaaatgggtttccgtttccccagttaaatttttaaacttactaaattgaaaatttctcaaggacaaaatcttatagttttatataagaaaaatttttgaaaaagattttttccttgagaaactaagatagtaaattttttttaaaactttctcgggggaaaaagtaatgcacctgaatttctccgatatagctcatcttacaattattatgacagactttcccaacaaaccatcaaaaatctcctcattctgttgttttct

SEQ ID NO: 12336 - DNA, 1920 bp, Heterodera glycines
  misc_feature (288)..(288): n is a, c, g, or t
tgttgtagttgctgtccgccgctcagtttgaaaagaatttctcatattgcaggtcctcctccgccatcgtgtcaacaattgtgtgctgtggctgttggttgtgctgctctcgaccgaccatcaccaaattatgctgctgctgatggtgtcgctgaaattttggaaaaccaattattttttgtatactacgaataataactaacaataagaaaagaaaggaatgaattagccaagcctttttcatatgagaaggtcggggttttttttattagtgataaacccatcccncatctataattggttccgtaacttaaataatcgacgcttctcataaagtcatattttttttattacaaatgaaaagaagtcctccgtcatcttttggtttgcaaaaaaaatgtgataattctcgtgaaaacttgttcccgggatttttgggcccatgatcacgaatctgctatttttgcttgaccaatttctaaacgaactcaaactcgaaaagacaaaaattcaattttctcgatttagattttttttaaataaaatttaagttgaggacaaaatagacgtcagatttgtgattagagggaccccaaaaaacccggaaacaaagtagctgattatcgctaattgtttattcacttcgtcaaaatgatgttgttgctgttggcgtttaaccatttgcgttgcgctgctgctgtacggtcgtttgactaacgacggaatttgtgacactggacgcgaaccaccgctgtggctgtttggatggaccacaccaccaacaccgactccaccgcgtgccattgtctgcgctgacaacgccgttgacattctttgttgtgccgccgaatgtacagcttggtgctgttgctgtccatgctgaccaccacgccaaccgccaacgggcgcatgttgcgacgacagcgtataggaggaggacagacgaggtgacagacggcgctgctggcgcaacgattgcggaagagcagccgcagacgaaatgaacgccggcgccacatggtgggaagacaaatgcttttgaggatgggctacagggattttaaacgcgaaattatgggcatattgaaaaacatgggtcaggattcataaagaagcggaaattaagattgagaaaagcaaattccgtctctgtactaccgaaaaaggggaaataaaaaggaaattttgaattcttttaactgccttttgaaaaagtgactcgtttttcatggttgtcctggacaaaaaatccaagccaagcaaaatcctttcacatttaattttattcaataaacattgtattttgattaagtttaaaaaaaccaacctatcaaagctctctttggatgctgttgcttgtaaaaatccattgactcatagctcggaaatttgatggcacggcgttggacatggagaaaaggtgcagaaaaagtgccgggcattgcagggacggtgtttgcttcgtcttcaattggatctgaagttcattgctattaaaacaagtttataatatagttcttagaaaatttataattttaaaatatcaattataattaatgaaatgcaaaaaaaaaaccaatgttaattccgtgcataacgggaaaatcgcgtttggtctgtgacgcaacatttgttggtgtttcagctgattgcgaaattgacgaaacataatcatggtcctgaacaaaatattggaaatcaaaagtatataagaaaaatttgttaaatcatttaaatccgattcgaaatggcgtaatgttatagtaaaactgaagcaattttttattgaattatattttgtgaattatcggtcactaccctttttaataatgcgttaatgtatttattaacatttatagattacaaacccaagttcagagcggtcccaatgacaaattgtgacctgccaggccatgcaag

SEQ ID NO: 12337 - DNA, 632 bp, Heterodera glycines
atctatcgtaaatgtagcggtaatttaaatcgattgtgtacggtacgaccattttttaataaagtggctgcgatgccactaaaagccatattggagactctttttccaaatccgcgtaataaatgaaataaagcactttgaacaaaagattttcctgtccctcctggtccatctatataaaaacaatgtggttcattttttccttggtcttcacaaatatttttcacacaattaaaaagttctttttgatcattattcattaaagaatactttcttaaagcaaaattaagttcttctttgggatcaaatatttgatcttcagaaatatgttcagttattttggttatttttggcatatccgtaaaatcttttaaggattttccataattattaatgttttgatcaatgaatgataaggccatttgataagcaatgttttcagtatattgttttttaagatcataacttaagtcgtctttatatttgttccataataaacctgggtgttttggttcacaattaataaggatattagcaaaaagcgaacgaagtcctcttggaaatttaaaaaggcttgcttcatttaaacatttatcccattctaaatcatctcttgttattcctaaagccaa

SEQ ID NO: 12338 - DNA, 1021 bp, Heterodera glycines
ccatcccatcggcggattgtgatgggtgcccgagctgtcattggattagccacataaaactgctggtcaattagagttcgtaaacggagaattccctcatttttgcgggagtgcgattctcggggcacaaaatgccgcggggggaagagaagggaagggaagggaattcgttgcgttggccgcgggggcggcacattttgccaatgcgttttattatgtttttgtttgtttgtttgttgtctctgttcccttttctcaatgtgtttgcttattattttgtgcttttgcctctttttctttcttttcttttttttctttgcctttttcgaaaagtgccaaaaacgaatttttgaattccctggggacaaaaaaagcaatgaaagaatggcaaaagaagaaaaagcattaaaaagcgaaaggaaagaaacaaatggaaatccgccgaaagaaaaactcaatttcagaacgaaagtcggaatgacagcagggcattttgagtctgagctgattggagtgtgctgtgagctgtgagcgataagaaaagtgggcgatggacgcaaaagaaatgggcaaatttaattgcccatttattaatggacggattcttactaatgatcgaattaattaattaattggacaaaaagaaataaaattcgaataaataaataaggcataaataaaagaggaaaagtgaaacatctttcaacagacaaatgaatgaatgaaaatggaatgagaatatgaagaatgaattttcatgataattatgtataaaccgcgagaaatttgtgctcttttggatgatcctccgatttgttacattttattgctatggtgacagcactaaaaacaatctgaggaagagagaaatgagtgattggaaggggaaaaggcaacactcataaaaagggggagagagagagagagagaggggggggagagagaaaggagaggggagagagagagaggaagagagagagaaagagagagagagaaaggagaggggagagagacagagaga

SEQ ID NO: 12339 - DNA, 1351 bp, Heterodera glycines
  misc_feature (1300)..(1300): n is a, c, g, or t
  misc_feature (1332)..(1332): n is a, c, g, or t
ggggtaatagatgagagagaaagtacgggtaaagaaggtgagaaagagaggtgtgatatcgtccagcagggcattaataaattagtgatcggggagaaatgatcgttcgttctgtcagtcattcattcatcataacagcaacggttataaattgtaattaatggcctaagtaggcaattaattgaagagaaagatgaaaagtccgcaaaaaggaaacgtacaattgcgaattttaagtgattgacttttcagcagaatcagtgatataaaccgttcactgatttcccaattaatccactaaaagcgtaatgcttttccttctccctttccttacgattcgttcgactttttccataaatttgttgtccaattcattacaataaaatatccgcgcccaattaccaaagtgtttatttaaattaacaaaaaatatctaggtataataaacaaaatctgtttaaatttctgggatattgaataaatagacaattcaaaaaatgagtgattttcattaatttttatttgggattcgcacgaggattttttcattcgtcgtttttttatattaaaaattttaattaaaaaattatttcttattttatgtgtttaaatcccaaattttaaagaaaaaaaaacgcaaaagaaaaatggcgagaaaaaaaggaaaaaagaaagaaaatcaaaattgaaatgaaatgagcaaatgccaattttgttctgctttctttcgtcttttcttgctgatcattcatcggtttcttctcgacggcggcggcattaagggcaaagggggaggcaaaggcgaaaattggcacattatcggagtgcgacggtagcgggagggatcgacggcggaatgaacgcttctgaagggacagctaatttgatcaaaaagaaagaaagaacagtgatcagaaattaagggaaccgaaaagaaagaaatggaaattggaaagaaaatgagtgatcagaaaaggacgtctttcttcaaaaaaagaatgatggtgattgatcagacaggaaagatcagtaatcggaaagagttgcttcttccactcactcattgcccacaaatgatgctatgctgtattcactggacggaaaatgcctcagtttcgcccgtcgcgtcgcttcaccagtgaaaagaaaatgagaaggacacgcggaggaagaagccaatggcctaaagagtccgattgatcaattggactttggacaattgtccactgatttggacactttctcaccttttctcgatgtcgaattgcgtcggctcttccgggtccgcgtatttgtccgntgtcctcctccgacgcttttcctccgctgatncatgcccttttcacatttt

SEQ ID NO: 12340 - DNA, 1258 bp, Heterodera glycines
cagagacagagcagggcacagcccaaaacgaacgcacatacaaatgccactgaaggtgggaggggggggggggggggaaggtgggacattaggtttctttaaattaaattttcaagcatttttaaataattttgcgaactaatgatattgaattaaaatatttttaataatttatcagcatcagcttcgccgtaccctcctcacctatcaaaagacaatctgtgccgtccgtcgtcctttgcctttgcttttcgtcgccgtttccttctgcgctttgtccaatttcaaatgtttcactttttggggtcaaattcgaattttgtccttccaaaattgtttttgctccgtttgaaacgtcttctgaaaagattaaaattccttccgaagttgcgctttttctattcacccgactcggttcgaatttcgctgatcagcagccatttcgcagcatttccaaaatgcaattccaagcggactttggtcccaattcggtgcggaatcggaacgcgaatccatcgggcggactcagccagaaagtcgggcggcacatcgaactgaaatttcgattttgatcgtttagtgccaactcaaaagtcatcagaattgcctgaacgattctcgatgaaaaagtgtcgccgatgggagcgaaaaggacgcggacaaagcgaaaaaggggggcaccggcacggcgaaagttggacgagtgaagagaaaaggaggaaaagttttgaggtttggagaaaaacagttcgatggagacgaacggagctaagggagagggaaaagtgatcaaagcaaaatgatcagaagaagaaattggaagaagggaattagaaaattaaaaacagcgaccgaatttcccgaaaaattaaaatttgcgcgacaaagtgttgcagggacggttccagtggtaccctccccccctgagacagtccctgaggagttgtgccgttcgctgcccccccccccctctcaccccccatttggtctgtcctccatccgacccatccctcgggtcgttcctcaaaattgtcttctccaactgttccgtcgaacagtcgaccgatccctccacacagcaaagtgtcggccaattgtctgcttccatttttcacttcggtcgccgatccatcgtaagacgaatcgcgaaggtcaagagcatcggcgaaagaagcggaaggagcggaataggagagaagggcatctgaaaagccaattggcaaaagagcggaagggaaaaggaaaacgaaagacggaa

SEQ ID NO: 12341 - DNA, 1413 bp, Heterodera glycines
  misc_feature (11)..(12): n is a, c, g, or t
  misc_feature (40)..(41): n is a, c, g, or t
cttgcatggcnnctgcaggtccgaatggtgagtgccacannttctctgagccaaacacaaatgccagcctatcgttggtgcattttcggtacaccagtgccgggatggtggattcgtatggggtgaagccgtgtttctgggaatttttaaattttttcaattttttcaaacaacctctttgcaaaaatcgagacaaaaaacactgtctgtgccgacggtcaacggcatttggcgctttattaataatcaatattctaattatgcttggtaattaaacatttaaattacgaaaggaagcagaattaaattcaattttttaatttaaaaatatttttcattcaaaaataaaaattatgaaaaaaaaaaattgaaatttgttggaattaaatttatatttaatgaatttaatgacaattgtataattttctaaacagaataaaggagttaattaatgcaattgttttgattgatgcaatgttctaattaataaataaattaatccaaaaaacaaagaaaaatgattaaaattttcacattattgaagacgatttacaacaacactaattacactaattaaaatgctgctgaatgatgattggctcccaattgatcggacggacaatgttccgatcagttagcaggccaaaggcacaaatcgtccgtccccaataacgccccccgccagcggcggtgggtggaaagagggcatatgggcattgatcgctttaacaggcgaccccatttaacggaagcctgggacacaaaaatagcactgaaaagccaatttgcccccaggcggacggagaaaggccgccttaatttatcaaagggggaaatccgctgtttgaacaacaaaacattgaggggcagagagggggaggggggcaaaagccgggacgggggagacaaagcacagatgttcggaaaagaggtggaaaatcggggaagagaaatttccgtaaataaatggtagggctgctcgagatttggggtctgtcgaaaattttggggtttttaaggtgtcggtctcgattctcagggggtcgattctcggtttatgtcatggttgtcaactcgagaaatttctcgggtttttaggtgtcagtctcgactctcgtgtttaattctcagtctcgttctcgagccgcgaaatttctcggattttacgctgtcgttctcgactactcttgagttcatttctcggtcttgttctcgagtcgagaatttctcgggttttttgggtgttgttctcgtctcttgcgttcatttttcgggctcggtcgccgagtcatggatatcttggatagtatgattcaacgattcgaaatcatttgataatataattgatggtataactataataattagcaatcaacgattttgaaatttaattcattagcttacactgatgaa

SEQ ID NO: 12342 - DNA, 2919 bp, Heterodera glycines
agattaaaattttgaaaagcctcatttggcaagcaaaaaagcctcattttgactcgaaaagcctcatttctacaaatttattcaaaacacatttaaaatgttcaaatcttatatttttgattgtccatgaccaattttagcagttttttgctagctttttgtgaaattctgagcatgaaaaatcgaagttgatttttgcagcgctttttccaattttttgggggaacaggggggtccggttagcagattttcattaaaaatttcagccgtcaatttgccgccctcggcggtgccaaacgcgagcattttggacaaaattgtgccaaagccgggccaacgcatgcgcattactgatcgcattcggacatttgagcaaattgtgaccgaaattgacgtaagcgtttgcaaaaataggaaaattggttgctaatgccaataaaaattgaaaattttttgcgggtggcgggaaattggtgcaatagcaaaaattcaccatttgccaaatttcttgccccaccccctaacaaaaaatggtcatttttttaattttcacccttttccgtatttttaaaaattaattacgaactctccattatttttcgctaccctaccccaaaaaataaatatatatatttttacttttttcaaaattctcaccctcccccctccacagtttttagagcgtccaattttgtatttcaccctcccccctttaattttttttttctataacctgcctcaaatattttcacccccccccctccatccgttttttcaaattttcttttaaaatttgccaaccccttcctaatttttttaaaaatttcctaccccctctgattttcagtttctttacactgtgtccacggaagtgccgtcggcactctctgatgagcattgggtccaattgttggacacggtcagcgctgctgaacgtgaacatttgctgcgcaccattcactacgcccagctggtggagaaggcggcggccgcggaacgccaaacactgaaaaatggcacaaaaacggtaaaaaatggaaattttttgaaaaatttttttttgaggacgaccaccatatagaaggtcacgggattatctgggtcagttcaggaacgattctcgaattttggatagcaaataacgaaaaaaaaatttttttaaatttaaatacaaaaaattttccgccgttttttttttcgtttttgagtccttggcttggcgttggctgtccggttctggcaaaatgtacaaaaaaaaaggctcccttttccattgattggcatttccgggggagggggccttgaaaaatttccagtaagaattttttttttttggtcgacttgaaggaaaaaggactaaaaaattgccaaaaaaaatacgggcgccaaattttttttacattttttttctgttttttttttacctaatttaaactcatttaaaaaatgcgcatttttttaaagttggacgtcattgctggagttaatgatgatgatgatgatggttgtgttgctcattcttcctcctccgccacaacagcaacaaactctccaaattatcagcaaatgtttggcgacgaattctgtgaccaaagcgcactgaaaagtataaaatttattttcaaaaaaatttttttttttttttataaattttggccaaaaaagtaatttttttttaatttatccccaaaaagtgcgataaaaacgcatttttgtgcctggaaataaattttaaaatcgaaatttattttcccacaataaaatttagcatgaaaaagttctaaattcaaacaaatttttaccgtttatattagtaaaatgggaaaattcttgcaaaattttattgtttcagcagactttttttgcgtgcatttttcaaatctaaaaaatcgctttttttaggccgaatggacacacatttcgggttggcattgtgccgcaattttttgctggagccctccgatcgaatgcccaatttattcgtggactgtcgctttatgtacgcgcacaaaacggcgcacattctcagcgcggcaaagtgagcgatagcaaaaaaataattaattaattatccaataaaaataatataattaatttttgtgccggaaaaaaattttggaaggaaaaaatttcaaaattttttcaaaaccaaaaaatgttgcaaaatttttcataaaaaagtgcatcactttttttaagttagcatgtgtttctttatttaaatagcatatgatttttttactttctcgactttattaatttttttaaaaattttaagagttttttcctttggatcaaaaatttgtctgtcattatctttattttcaaaattaattaccataattaatttgttaattgcttttaacggcgtgtcaaccaattgcacatgacaaattggacgagttcagcaccatttcccgttaatattgtcaacttttttgcggacgacacagtgaatcgaattgtcaaaaagtttatttgtttttatgccaattaaattttatttttccaaattttagccaatggcactttttgcacggcacgccaaatgaacagtcaaaggaaatgggcggcggggtaattaattaatttttattatttttgtaaatatgtttcagcatttcgtgccccacccattcgcaccgcaagtgaccacgcgggggctaagcgaaatttgtgaacgcaattccatcccaaaaggtgggggcagagagagagagaaattttaaaaatatatttttcaattggtggattaaaaattaaaaatataatttccattcaaatttctaatttattttacgaaatagtttaaattaactttaaaaaaaaatttttattaaataatttcaaacggatttgctcacacaatttaattgttctaaaattttaaacaattttttggtaattataatttttaaa

SEQ ID NO: 12343 - DNA, 4398 bp, Heterodera glycines
cttctccttcctgtcgttccttcggccaacaaatcccctaatgtctcatgcttttcctcacttattaaatcccccaaatttttctttttttgcttttcctctgcttgtaaattctccgctttatctttgccttccttggccttcagttggcccaatgtttctcctcgtttcttcgcttctacggatttccctgtttttgtcccatcgacaaaaatttggtgcttcaaaagcagcataaagagaatagaaacaaaaaaataagttaaatttttcatttattaaaaaatctaaaaaatatgtaaattcaaatgtaaattagttatgcgtgggcaattttattacatgtaatatataaattacgaattataagagctttctatatttattgattttgaattatccttcatagatttgatttaggattatcattggatggtgctaatatggagaatacaactgctaggaaatccccacaaaaaaaaatttgttcactttccttaaattgtttttataaaaaatcaaaaattcttttcaattttttcatttatttggattcatgacccaagtcaggggttgatgctgcaattatgccctttaatcacaaaatttcgcttctatctattcttaccagttttttaaataacaaagaatagggtttttattactaattttcatataataaatttttaaattattaatttagattaaattgaagaatgaatgtggaaaatttataaatgtcaattcataaaaaattgcacatgtgatatgtgattgacatgaattgattttcaatgctttattaggttaaagattttttaaaggtgcaaccttaagaaagtttatttgaaaaataaaaataatttagtcattaaaagtgaatttataaatggagcaaacttacaaaggaagggcctcaattgtccgtgggatttctgaatgaaattttgtgggtggatagagcgccgcagtgacaaaggacccacagtcaaaggaaattctttattttaaagtaaatttttttttgttattttatttttaattttaaaaaatattaaaaaaaaaatcgttttttttaatttaatttttattttttttgaagtttcaggtgtaaaaaaaaattatttaaaaaaaaaataaaaaaatctgtttttttaaattttttttccagacccacgacaaaggacccacaaaggcaaaggacccacagacaaagggcacaaaataataatttaattaaaaatattagagaatgggatgatgattgtgctaattcagggatgggatcgcccaatgtcggtttccaaggacgggtatgccgatttgcaaggacatagtggggaaaattcatgaaattcaaaggacatttaaaatttttattatatgcaatgaaaatggttaatattaattcaaatggcttgtatttttcaccggaatggattttttccaatatttttttgtttccattgatcattttcctcatttccgcgcacgtgagatcaaagttcacctgcaccagtagcaacgctttgactgattcaacttccaatagatttctttctttggtccattgactgcttgccagtgaaaaaactcgttccacgaatgcgttggatgtcggaatctttaaaataaattttcatttatccattattttttaatgaccgagaaagctgcactgacgattcgatacaaatttgcataggcctctgttgcaccatccgcctcaaaaatgcccttccatttatcttcggctgatttgagccaaaattcttcgggaatgtcggccaatgtttggttcaccgcagacacttcatcaaacagttcatccaattgcgctatttcgggacaaatttgctcagcaagttgcacaacttctgcagaattcaaaggatgattttgtaaatttgtccatgaaatattttttggtagtaattggagttggaaccagcgatcaatgtatttgagcacaattttgtaaaaattctttaaaaaaatgcattaataaaacaaaaataccaaaaaattttacgcaaaaatctttttcaagttccgttgatgcacggcgcaacgcaaaatgtcctccaaaaaatggccttcccgaatttccagtgccgtgcaaacgacctttaattttggcacgaaattgttccataatactgattaaatccggcagcatcaaatttgatttctgtaaaaacattgtgaccttaattaaaaaaataattgttaacttgtaatgccaaaatgggctcatcaaacgtcttcaacacattttgtaaaaagtaacaaattggttcagaattttccgattgaaaaaattcatgtaaaacacgcggcttgttcggcattgcaaaaagctcttttaattggtgccatttctctaacatccggctgaccacttttgatagggtagtccaacgtgtgggtgcatgagttggcaatggtacaaaagtcgtctttaaaacaaaattaattttaaaatttgaaaattgagcacctcatattggtcacaaatttcatgaaattcggtgtgtctttgcgttgatcctttgaaatatgaagttaatttgtaaacgacggactcaatgtcaaattgcaattgttcggcacccttttttgctgcattatgcaaaatatgggctgaaatttttaaataagaagaacaaacaatttaaaaataatcggaacagccaatcggaattttcccaatcgggattgaaagaacatttgcgcttatttgaaaacattctgaaataaaaatgggtatcacgaaagattcctaataccatattaataataataataaacaataattctgaactatgagcaaaaaaaattgacataatgccataatttaatatccaaattacgttgacttttaaagtaaaattttagaaaaaaaatttttttcttaaaaaaatttttgccgttcccggcgggatttccgttaaaattgacgggatttttacgggaacgggaaaaaggcaatcccgtccgggaatcccgccaaactcttaaaaatggggaaattatataaaagaagaattaaatataataaaatggtaattagctaattaatattaccaaaatcgcacgcacaatgacaaggacaaaaaaagcggagttaaactcggcaaagttggcgatgatcacccacaactccaagcagtacagcacagctgatggaatgccgatgatcagcgcaaaagcaaaagggacgaactcagcattggcaattagttgaatgacggtgaaaaaggtgaaggaaggcatttgaaagtaaaattttatcttaattagctgacaaatttaaatgctccatttgccattaatttgtgctcccattttatgccacaaatattctttaaaaaattatttttggtatttgaagaattaatttgtgacatatttaataagcttttaactcattttacatcttttgcaggtgccttttactgatcaaaaattgttttattgtcattggtatttatttttggaaattgctttttaattatgcgtagctcattttattctattccgtgctcattttgccttattgtgaataataaatttggatatttgtaagattaatttttgaatatttgataagtgttgcgtttgttagggacaatgaaaggtgctaaaaataaaaaacattgttaagaaaatcctcttcctataaaggatgcgcttcctaaaaaggtaaataatttgttggaatcctattaaaacatgctttttgtccgggatccttcgggttcagtttggaatacggatcctggcccaagtccggattttcaactccaggttctacgtatccttaccaataacgaccagtgttgcgaatccatatttttttttcacgtcccgcggcaaccccttgaaaattatctcacttacatacttttgttgataagaagaaaaatgtaattccaatatagaaattaaaaataaaaccaaatttttagctttcgtttttaaacctgctatttttgttacaagcatcaaaattatattaagctattacgaacaattaaggaaatctgtaatccttcgctatggaacacatgatatgatcgtttttttcttctatcgtttgaaaaatttttgatttgaaatatcatagccttttctgcagcaaatcaattaataaaaagaatttccaataatcctttatcaaaaaacagtggtaattcaaatacaatgacatcatcaaagtttgttttataaaaataaaaaagaatttaaaaataaacgagaaaaacggaaaataaaaggccaaaaaaagaaagatgaaaaaagaagaaaaagcgactttccaaataaagacagctgaaatttaaccccaattaagggatttcatcatcaaaagcccaaaaacggggggggggattt

SEQ ID NO: 12344 - DNA, 1537 bp, Heterodera glycines
  misc_feature (1523)..(1523): n is a, c, g, or t
ccaccggttcgacgtgctttctctgttttttagaaataggctaatcaagagctcttcttgaatgaaatccacttttctcgagttttgaaccagttcaaaaaccgtttaaattttcaatgttttttttttggggtttctatcgttttcagcaccaaaaaaccctataaaagtggtttgggtattcccacctcctcctccccctcgggcattattttcttcattgccatcctcatccaattccgccgcagacggctgtgccacgttcagatcggtgctctccgcacactttgggcaaaacacattttcgagcagtacactggcacaaggcgtccaatccgccaacggcccgtacatttcttttggcgtaccgtcctttttaaaatttaaaaaatgaacaaatattgagaggtggacggaaaggggggcattatcgtagttgtagtactgtacttgttgaaggatgagcaacagttggtgtcggatttgttcaatttgttcgtccagcgcggggatgacacccaacaccttttttaaagggcaatagaaaaattaaattcaacgggagcagttgattcacaccacctcccggaaatttaaaaaaaacttagaaattttcaaaaaaaaaatgaaaaaaaaattttaaagaaaacttcatgaaaattatttttttaaatgttctagtgatttgactttaaaattttatgacgaattactaaattttcccaaaaaatcactataaaaaagtttcaaaattttttcaaacaaacatcaatttgtcttttttgaacatttgatttattctgcgtaaaacaaaatgccaaaaaaaaaagaaattttttttactcggcaaatgcaattgacaaattcaaagggcatgtcctcgcccccgtccccgcagtgttcggccagcggacggagttggggccgtgcagcgacaaggagggaggttaacttgaacaggccgggcaccaactcctcccgcagttgggccacacagaacgtggccaagtcctgctcctcctccgagtcgacgtccgcttcttcctgccgcctccgccgccttccttttgaagaagtgttggttttgttgctgctgctcgtagtggtggtggtgatggattgggaattctgcggtgcaaataattaaataatttaggatttatgttttaaaaattacataatcaacaagattatccgtaaaattttagtatcgggagtgggccataatgcatgaacccaactctttgttttagtttttaaaaatgaactatttattaaaacaaattgaaaataaaatttttgggtatttttaaaagaattttaaaaaaacaaaaattattgtacgagttgccaatgagccaaaattgtaggataaaagagctatgaaagcggtaggtaattttaatttaagattttgccgaaaatcgaaaatttcaatcgaaaaatcaaaaatgttttttgacgaccggctaggtcgaccattaaaacttcacagcgcattttgcattttcaaatccccccanagtgtcgtcgtcgt

SEQ ID NO: 12345 - DNA, 1493 bp, Heterodera glycines
  misc_feature (1378)..(1378): n is a, c, g, or t
ttaaatgtacacctccaaaaataattttctaaatgttaacaggtgattctaaacatatttaggtcatttttatgccattttacgcctatttaacactttacgaaggttttttcccaaaaaataaccatttaaaaaaattttatttacatattttcgtacatattttgggtttatatacatatttcttacatatttggggattttttttacatatttatgtacatattttgaccaatttttgtacatatttttgacatccctattcattattatcctttttctaaagatattttgtatgaatttcttgaatttaagcaaagcaaatggctgaaaaacctgattccatttggttttatttccatcgtcctataaatggcgcaattcgctgcaaatattgcagtgccatttgatttttaaacaaattaaaaatttgtcaattgacccgaaacccggcctttttctcgacccgaaacccgacccgatgattttcgacccgatatttttctcgacccggaacaaccctgaaatgtacaagaaagcttcccgtttttaacgggacagactcattttaagagaaacaatttttgaaaaaattttcagtgatttttagagaatttttattaattaaaaacttagtttttcataataaaaaaaatgtttcaaaattttttttttaaataatatctaatttttagttaggaaatttttctttaaaatttttttttttttggggcggggacgacgggaagaaatgatctgctcctaattgctgaccaccgaaccgatcgactgacctgtttgtggagaacacaatgcgcgtgaatgagcagtggatgacagtggcgcctaacttttgcatttcggcaaccagcagcaggcacagtttgcgcatcagtgtgatcagtgtggcgcgcagtgacgggtggaacagcaacgagctgggatcactgatccatctgatcagaaaaagaaagaatgaatgagaatatccaaagacagataaagagaatgcaattggatcactgatccatctgatcagaaataaaatgaaggaatgggagataaagagaacaaactgaatcactgatcagaaagaatgagggaaaaggtgcttatccgatcagaaagatatagtgaataaaatttgatcactgatccatctgatcagaaaaagaaagaatgaatgagaatatccaaagacagataaagagaatgcaattggatcactgatccatctgatcagaaaagaaataatagtgcgggaaatgatagcttatccgaagccagctgataaagaagaataaaattggattaatgagccctgtgataaaagcaaatgcctgcagaaatggctaatcagtgacagatcagaggctanattaatttgggttgaaatttgatttcgactccaggcaattaatttgaccgacggacgacgacctgtgcatgttgaccaccaactgatcggcaaacacgttggagtgatgatggat

SEQ ID NO: 12346 - DNA, 1354 bp, Heterodera glycines
  misc_feature (384)..(384): n is a, c, g, or t
ataattttatttaaataatattaatggcattaaaattcctttttatgggccgcacttgcggttgcggcaaagcccgtctgctcggaggtgccttcggcctccgaaatgttggcactttgcaacagtgcggtcactgccaccgcacccaaactcagctcagcagtcacaaaattggcctgggaaagataataaataatattcaaatataaatgttcaataatactttttaaaattttaaatgcgaattaataaaaaaaaaattcctttttccccgatccgttctttggggttttcgggaccgccgatcacgaacccatacccatttcggtcatccctaatcaccaacttgaattcgaacaaaaccccgaaaaattgattatccanattttcgtcgtttgtttcaaatttggatgagggattagaattgatcaaagtgaatgccatattcgtgagcaaatgtttttcacaaaaaatacaacattttgtttcccaaatggcattttcattaatcactgccccaccaccattttacgggaacaggacaaaatcacgccgccagaaattttttaaaaaattttcaaacctagaattttttcaagaaaaaattctcagaaaattttttataagaaagtttaaagaaaaaaaaatttttgaaaaattttcagcgatttttttttgaattttatgataaattactaagtttttttgaaaattttccaaaaaaaattttttaaaaatttctagcggcgtgattttgtcccggcgttatttcggcggcgtgattttggggtgcaccccattttacgacctcaaatgtctctttgttgaacacaaacggacgcgcttcggtgaacgcggcactttcccattcgttggcgagacgccaatccttaaaaattttaattaattcgagtcaaatttcatgccattttagtcaaccatccctctcccccaccacctccaactctttgcccccaaaatcgggcaccgccgacggcgaagcccacaacaaatggtttttggcgtgtaacgcgcgcgcaaatgccacatccagcgccagggacggcacatcggcgggcaaattgccgacggggatttcactgtacatggatacggtccagtgctccttggggagggcgaacggagttagagggatgatttaaaatgtaattattacatttttcattaaagcgttattttaatttaatttattatttttactattttgtattttaagactaattttcatccataaattttaaagttaaaaaaaaggaaataataattcacaataaaattattctaattgtttctacaaaatctgaaaataaaaatatttataatcaccagtaaa

SEQ ID NO: 12347 - DNA, 3301 bp, Heterodera glycines
tttctacaaaaaatcattaaaatgactaattattaaacaaatatatttttttggaattcataattattattagtccatgtttattgaaaagatggaatttgcttatacaaaattttgaaaatttttaatcatgaaaattgaatcaatttttatatttagtcattaatcacttcctaattaatattttttgaattaattttatatttttgacatttttaaattaataataatttagcttaattacatgttcgaggtgttaatgccaaaatatggcctaaatgacaaatttttgattttactcgaagaggaccatattgtggcaccggattttttgcatacacttcaattgattgtcaaaaatcgtaaaaagtaaataaaaatattttttaatcctaacaattttttttgtaatttttgaattttgggcaattattttatggtataaattaaaataaaaaattaatttaagcatttgctccaattgtgaaatgctttgtcttggaacatatccaagcacatttgccaattatgcggagaatataaataaattgggtgtcgaagtgtggttcagcagcaagaacaatttgggccttgcaatggaccggcaattatggcgacaaattcaaaattgtgcaaaggttttaaaataaattttgacttttacatgaatatttttaaatattttgtgagaaatttttgtaaaaaaggttaaataatatatatataaaaataaattgatactaattggaaattcttaatttgtttaatcaaaatattaagtaaagagtttaaataaaatattgcttaattctaaacttttttttcattctgttcaccgctttttcatactttttattaaatttttaatttttaatcaaattaacaaataaattaattaaaattagaaataaaatttaaatcattataattcgctgcttttcctgtttttctgtacatgggacgattacaattgggattggaccttgttgcagttgagcattcaatgtttgcccaaaaggtttgaagtgatctacaccgaggcaccacggtcggatttaatgacacattttaaaatatataaaaataaaaatgtcattaattaaaggcttggtcctaattaaacattaattaattgggttacaatttattttactattaattaagggtaattcatgtcggtgactgtggcgtgcattggcacaaatgtgagaacgatcgccgatcattggaccaggcattgtcagcttgatcaattaattgactaattaattaatgtaaatggtaattatcatttatttttgaagggatttgttcgatagagttaacgattcatttttcccgtcaaaattggaagtgtctcatgtcaatgggcatatgaaaggtgttccgtccggaccaaatggtggttgggcggatccaaggcaaattttttttaaataaatttccgaaaaaatgagatatttaataaaaaataaatttaattataaattttgggtacttttccgttatggggccgcactttcaacttttaaaagtgcggcctcataactggaaattgccaattttgtaaaattagaccagaattcttgacaaaaaggcaaaatttcaaaataatatgacaaaaggaattttactcttttttaattgtttagggaccacagattatgtgaattgaacactcatccatcagctgatgataatcccgccaaaatactaaatgaagctcgtctggctgattaagacgaagaaaatgaaatgtaaaaacaaattttatttttgatatttctaatcatttttaaatttgttttaaattttatgcttttgttgtttttgggttgtataaatgtaaaaattataattgatatattttccttaattagacttgaaccgaataaattgagaaaatcacgaaaaacattttttagaatacaaaaaatttttgtaaaagagaattttcaacaaaaaaaataaacaatttaggagaataaacatatgaaagtttccaaatccaataatccctaggaaatacaaggttgaaaatgggaaaaaaagtgttcatcagttcatctgctgttctcttttgcccaacagttggccaaatcctgaaaggatttaaatttaataaaaaaattaaaattacaattttggcattacatttgtgtttgcatttcgcctctgctctcgcttctttaacctccttcataatttcgttatccccatttactaatgatgctggcacatacattgcttctctgagcggttccaatgccatcaaatcattatggcgatttggcctagtcaaccctgcgccgctgctggccgttcgccttaatggcgtgccagaaatcgccccatcatccaggccattatgacgatttgcgccgctgctggccgttcgccttaatggcgtgccggaagtggtcccaccactgccaaatgggaagccaagaccgccaccaaatggaactgtcgaaccaaccacgcttgaaattgcttttgcgctctcaccaatgtatcgcataaaacctgaaacccactggatagttaggtaaaaaaaatttttggtggttatattatggttttcttttaaaatcataaaaatttccaggcccaggttactagggacttgttttcgagtgttggcgggggggggggtggtagaggggtgatagggccataataataaaagcagaaaaatagaaaaaaaaatatatttttttaaacaaatttaccaggcatttatttatataattttaaatattaatgtagtatttataagggaagaagttgcgaggcaataaaaaattttggaagtcggaattacgtgcaacaaatattttagacgttgaacccaaacattttcttaaaaaatttcggaactctgttatcaaatttccaaaaattttctggctttataaaaataaaacactaatattccatacccataaaaatattttaaaagtattatttaatataaattgtaaatgaaatgaaatttggtcctacttttcttcacatctatcatcattacccgggggcacacgacacactcaaaaagcagataaacaagaattgcatcaaatgatgatcccgcccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgatcagtttctgaaaaaaaagttaagcctaaactttttggcctgtttaaaaag

SEQ ID NO: 12348 - DNA, 2048 bp, Heterodera glycines
  misc_feature (2042)..(2043): n is a, c, g, or t
attttttcggttttcattgcattttttcttataaaaatcccagaaaaaatttatcttcgaataatagtgacccgaaatgattaaaaaaaaaatacagaaaggaaatttttttgagttatataaaatcaaagcaaaatttagtcatgtaaaagccaataaagaaccctagaagagtatgatgttaattgttgtttttctgctgattattgcgaagcgtcatctctttcaaatttttttctgccatatcaagagcctttatctaaaatttcattaaaaaaaagaatacaactgcgaaattccttaattacacaaataaaaacttttaaaatttgtacaataatctatgtaaaataacacaaaatttaatttatatgctaatgatcagacagcgaccttatttatttgttgattattagggttgcaaattatatggaataaaaacaccatacatggactaataaaactgtcaaaatattatcgaaaaaattctcttttggggggggggggggtgtatttttaaaaaattttccgaacatcgatttttaggagtatttttcgcatttatttttgcgtttttattgggaaaatgtcaaaaaaatggctgaaacatggattaaaaacgtaaaaatggcgaaatatggatttattccaaaagttctaaatattgatttataggtatgtgcgaaaaagcttcaccaaatataaaaaatttaaacgtagaattgctatttttgagcccctttctttaatttaaggcgtaaaatgaaatttttctctcggattttggccgagtttgggttgggttttcagatcataaaccttcaccttacatctagggaagcaactctttagtgatttaactattttttatcactatttttgcgcttcgtcactaaaatagttaaaattcactattttggctttttgtcactattttactatttttcactatgtcgacatttttggaaatacattaacaaaatgaatttttgatttaaaaatgttcaattttttgctaagaaaacatttgaaatatttaaaattttgccaaaaatttggaaatatatttgcaaatacaaccagtgaataaaaatttatttttgctcgattttggctgaaaattatgtcgctatttgtcattattttggcatttttgctcattattttagttaaatatttcgagatttttcgtaactaaaagttgcttccctaattgtgaaatttaatccgatttgaaatcaattgaaatccagatgatgccctgcggccctcaatattctttaaaaattgtttttcttttttttcacctcatcttccattcgcattttctcgagctgcttagccttgctttccgccgcttgcttgccattgccaacattttgttgtcggttatttgttcgaagtgtcgcgtgcggtttggtggaaaggagccagtctggaagatggaaattttgaaaagcctcatttggctggcaaaaaaaaaaaaaatcatttttaacgattaattttcaaatgtaaaaatcaaaaaaaaaaataatcaatgcttgatcagatttaatttttttttccacaaaaaaccccacaaatgccttagataatcgcaaaaaaccactaaaaaacctcaaaatcttctcatttttgaaaattgcgctttatcggtcttcaaaaaaccaaaaaatgggactaaagcctcacttccgttagctccgtgaataagcagctcattcgatttctaaaaattaaataaaattaaaaaaaaacgattttttaattataaccttttctccttttttcacttctataaatttatattttttacaataatttttcatattttttactttttccaatttctctacattttgtatttctttctctcttcccatatccgcttccgctttatctgcttgcataagaaattcggaatttttgttgcataattctgatgacgcgtattttcctgattcagcatatggcgaatatagcggtgccggtgccatatgcccaatctgttgacttggcctcggtgctcttccggaccnntgcag

SEQ ID NO: 12349 - DNA, 2929 bp, Heterodera glycines
  misc_feature (12)..(12): n is a, c, g, or t
agatcggctganccatgtgtgggatgcgtatttccatgcggtcaccgcccgtttcccgcgctgtcgctaccgtgtcgggtgggacgcaattttactgtacataccgtactcgttcctacccaccggactggctgactttgtgttccacacgctaacccaacagctcagtgagcatgttttgccagccgtgttggagaagaagcagcaaccaaaacagcaacaaaatgcagagcaacagaagaaaaaagtgatttgaagcagaaaaattatcaaaaaaatttgcatttgatttaaaaaaaaattgtgaaattattttttcaggaaaacaataattttttgtatgaaaatttgaaatgccattctttaagtggcgctttttcagttttgtttgaattttttaaaggatttatgagaaaatacggcagatgtaaaaaaaatatatatacaatagacggagaaaatataataaaacttagaaaaaaaattgagaaaatatttttaaagcagaaaaaacattactcatccctatttaagaaaatttgaaaatttagactttataaaagtgaaattggttaagaaaatggcgtcaaatcaaaaaaggagtaaatatgctgcaataaatttgatgttcgaattcgggattgggaattcgccaaaaataatgccgggttcgtattcagcgcctaaaaatgctagaaacatgttaatggaattttcaaaaaagtcctatttttgaaatattaaggtttattaaatatatataataattttttaaattcttagtagttttttaataattatttatttgtttattagtattaggttagcttattatttccttcagattaaatttttgcataacatatgatttccggccccgttaaattacaacgttgacacggctcataaaacaaatttaaatataataaaataaaaattttctctccaaaattctcatttcttttaaattaaatattaaaaaaataaatatttatctcaaataaataagatatccctcccaaaaaatgaagaatttgatgaaatttgttcttttgataatgtttattttgaatgtttccgctgatgaaacaggcaattttaaatcttttcgtacaataaaaatttatgtaaaatttatataaatttagaggaccaaaaaacgcaagccctaaaagctccaaaatcgaatgaagctggtttgtttggcaatggcagcttttcttttctgaacaaccttaatccttttaggaattttaaaaacgtacaaaaacaaattaatagcatttttacccgtatctttccccgcccatgaaaaaaaattattattttttttatttcttgatttcttagaaccagcaaacaatggcactggtaatagtgctttcggcataattgggagagctataaccagacttactgccatttcgtccatgattcatggtgtcggagctacagccggaaatgccgtcaattccgatgtgccaaaacttcgctcataccccggggtgtggaagccagcagaccgagacttcaatttggcaaatttgaagcgctttaagccacattattaaaccaggacacatgtatttgctaaaagccctaatgatcggagtcggagtggaacaaaatttgcttttccatcagcatcatcaccatcaaaatcggacaaagaaaatggtggacaaggaccagctgaatagcggattgttttaaaagccaaaaactgctgaataaaagaagccatgaattttataatgagaggaagaagaactgagatgaatttagtatatatataaaattcttaactcctattgtagattttttcagtatttctttagtttcggtcgttatatataaatactttaaatatttcgtgccgcatttataatttattcgagaagaagatttgaattttgaaaacccggaccatgatttccgaggtggaccaggagaggtttcggcaaaaaatcatgttttaacaggacaattcccaaggctgcacgtaactagatcttcaattacggaaattcgtaatcccataattgcagtgatttttttttttgaattatggaaatcatcctaataatgaggggccccattatttatcttaagaaaatttaattcaaattttacaaattttttcataagctcatgtcggcaccgctgactcgttcttcctattttattattattataatataaaaataaatattacttataaatttaatattttttttgcaaattctacattgatttttttgaaaaattcatcaatggctttgtttgtcatcatgtgtataagtttattcaattctattcttatgatatattaaaaaaaaaatttgcagctaaatctattgcgaatatttaattacctattctgctaaaacaaaatcataggcaatgtaataattttaaagaaaattttttatatgtgggatggaaggagtttttgctaaatttaaatttaaaataataatgataatggtaaagaattaaataggagtggggtgaaaaaatttataatttaattaaaaatgtttctttcatttatcaaaatacttttttattaaaactgagagaatttttaacaaaacatcatgctgatatttttgattgtcatcagcgctgtcctcattaattcagcattgggaaacggtaattaattaattataaaaattaatatcgaaaattaccgatgattaatcagcaattaaacttcattttttaataaaatatatacatattcatttcagtagatcaccctaaaacggctgtggataaatcaactaatgaaggtatagtaactattttttaaatatgcacgacgctggggttcttttggtgtgtgccgttttatgcggaatttttcttacaaaaaaaaaaccaaatcacatatttgtggcatttcgattgctttaaatgcggg

SEQ ID NO: 12350 - DNA, 1961 bp, Heterodera glycines
  misc_feature (1861)..(1861): n is a, c, g, or t
ttcaaaatatgagaaacgataggaaattaatttttttgaccataattttagggtgccaggttttgaagttttaaccataaatttttcgaaacttaataaaaaaacaatttttttttttgaaatttgcattcttttttacctctgctactggtaagatatattttcataaattcataaaaaaatcatcaaaattttgttctatggatcagccccaaccgatgaaaacaatgaccagcagcaagacaatgccattggtagcggaaaacttatgaaaggcatggtttggcttcttgcggcttcatcggggttcaacggtgccaatgccgtgggcgacaacggtgtagtacaagttaatccgaccattccaccggcgaacgcacctctcccaccaaaacatttcgtcaatttgcgtgacttaaaacctcatacacaactggtgccaaatgtaccacgaaaatttggcaaaaatgccaacaatgggaaggtcagttcttgggttaaatatggaaatttaaaaataataattgggctaatttttcaaattttagaagaacggtggtcaatgatcgcatggatagaaacgaatatatatccgatatcgcccagcccaatacttgcattatggcatatgaaaggaccgaacctatagataggagtttgaattattttctattcatttttttcatatttggttgcgaaaattgtttttgtaaaattcattttcctttttccattatggataaattttttcggtaaaaatatatttttgtgattcttgaataagttattcgtttaatccttcaaaaaattatatataaaatttacggtaattaatgtatgccgtgaaagacttttacccggcgctcgaataatctaacgttgtcccgttgattggaatactatttgttacaccgttaattagtaaaaaaaattctcaatttaatgaatcaaattgtttcgataaaaataaaagttttcaatcccattttgtttagagcatcataacttttttttttgttgaccaaattcaacaaagttggtataattcgaaaactcttagcaagctctagtaggtttccaaaaatcacaaaaatataccgacatgaaaaaagttacaaataaaatatgcaaaattctgtctttttttgcggtattcgtgtagcagctttttataaatttttaagcgcttagtaaaaacatatcaatagcttctagacatattgagctttcaagaaatgtcaaatatataaaatttggtccatcaagaaaaaagttatgatgctttaaacttggctcagtcagtcgtgcttaggctttgttagaccaaacctttcgacgttgaagttagagatcgttgacataaaaccattctttctagaaaagcctgtccataaaaaagggtctgctgtaggactaattttctatgaaaatattttaattaattaaattttacacataaatgcaattaattattatttggcggatgtaaaaatctcgaaaaatatttttccctaaaattataatgtttatgttaaacatttttacggaaatacatatcacatcaattccatgtcaatttcatgtgtcatttttttaagatttctttttcataaaaataataatattcctttaattgcttgctaatgaatattcattactctcaatatttaattaaaaaaaaaaatcattattggcaaatacttattgccatattttcattgaaggtaaaaaaaaatattattttaatggtggcaaaattatttttgttggcaaatgaatattaaaaaaatgttttcatttaaggcaaaaaagaaatttttttaatggtggcaaatcataagatgccacccatttagccctngcgatgtaaaagaaattcattcattctattgatcacagtttttattaaaatgtgcttcagtttgtagctttcagaaatccatctttttattaaatttttc

SEQ ID NO: 12351 - DNA, 1754 bp, Heterodera glycines
gtttttaatttttataatttttgcgttaattttctccattgactcttcttattttagcttagcctcactaataaaaaatgctgtttttaattttaatttcaagaaaaaaccctggaaaagagtgacgtaatcattttccgcggcccgaaaatgtgccaaaaacggacattttaggggaaatgccaaaaaaatttatatttattttggtatttaaatgagctttttctaattgatggttttatgctgctgattctgacattgttgccttttcttataccaccaaccaataatggcatttttcgagagcattaaattaaaatttcaaagaaatagattccaacaatttatttgttagggcctaaaaagtaaattcaaaaattcatcgatattcggcaatatataagttttggacattaatagttatgatcccaacaatttatggttcatacattttcggcaatatgatttaggcattatgtttaaaaaaatttttttaatttttgtaaatctaattattttcatttaccgaattatttttatttaaaattattattttttgcggttcttttttaattattaatgaaattactctctcacgtatccctccggcgctttgttattttggcttaattagcggcaaatgtgtgtgcacatttgtgcctaattgccatattaagtaaccattcagacataatatgattaaaaaaatagcatcgccccattttctactttaatggcattttttgccaatttgtgccaaaaaacatctgcccaaccaacaaaatacttttttactggcacatgaattaattggcccaaatgccttcatttcgccaatcatattttgcctctttttggcacttaattatccccaacggagttaaatctggcttcaactaaaaagaagcattattataaaataagagataactatattcgcttttaagcccagcaaaccaaaaggcattactaaaaagaggatttgtgagagccgctttaatctgcgcctcgagaatctcgagtttcagctcaatgccggattttcataggatcaaaaccctaaagcctgcattttcttttttgaccgaattttttttttgccggattaacggtattaatgcccgccgattcttttctggcaataattttgaatgcctttttccagccattcgaatacgcaaatttaatttttcattttctctaaattaacaaaatgcatctcattcatcaatgactctccttgactctctattttttatttgttcatttttctcccattttggcattttccgttgcctccatttttggcattgccgtgccaaatgccttggccattttaattatctcgtgcccttttatgtgtgtatttttcccctaatttagtggccaattctgttgcggagttggccactgttccgctctgatgcgctcatttcgcgcactgttccacggcaccggtggtgacggcacggcacaaaattcggagacggcgacgcaaaaagtgcggcggtggcaaaaaatggtggtacaaaaatggccaatgggcaaacaaatggtgggacagcaatttaatgatgtttgaaacaattaaagaaacctttaatgattacacattactggacctggatccaggaaacatccagactcctcgagacctggatccaggaaacatccagactcctcgagacctggatcccaggaacatccagactcctcgagacctggatccaggaaacatccagactcctcgagac

SEQ ID NO: 12352 - DNA, 2386 bp, Heterodera glycines
taaattagggttggtcgggaccgggaattttgggcaaaaccgggaccggaacttttcgggttgaaaaactgggactttttggctgggaaaaccgggaaaaaacgagaatttcccggtcccggtcaaaactggtcaaaaccgggacttcggtactcagttgtgcatgttttgatcccagtcccgacctaccctactttaaataataaattcgaaaattttgtccaggaaatccaggtttttttgtgttttgcctggacctggatttttttttcacattttacctggggctggatttcctggacaaaaatccaggaaaatccatgttgacaaaaaatgacctggacctggaactggatccaggaatccaggaaaaattcaggcctggacccaggaaaaatccaggcttggacccaggtccaggtcgagctctacacattactaaaattagagaaggctttaatttaggtttcaaaaaaattaaaataaattagtcaaaaaggtgggctttaaagaactgaatcttttaggcttttatgagtaaacgtaaattatcgcttgagatattttttaataaaattatttaattttgaataaatttttttttaaattttttttaataattatttattttaattttaagacgagaagtcaccaccaccaacaacacagcagcagcagcaaaaaccgagcgaaatttcgaaaataaatgtaagtaaaatatattttaaacatttaaaaaagaaaattattattattttttattttaaattaaaacattttttcctcaatgaatttaaatccatcggctacccattaaactcattgaattttgaatttttccattaaatttcacaaaaattttccaatttttaggccccttcggtggacgacagtttggacggatggaatgaagaacaaatagtcggctgggagcccgacgactacgaaaaggagttggtgaagcgcacatggagcgacgacttcgactttttgtacgaattgggcgcttcgatttacgacgtaaggccaagttttattttaaaaattttgaaattggtaaaaaataaacaaattattgtttttaatgttatcaaatttaaaaatttgacttaaatttttcgtcttttttaatttaatattgaattaaattaatttaaaaaattatttaataaatatattaaattttttatataaattataatttttcagtatatttttgagcacaatcctcaagcaaagcaattattccccaaaattcatcggcatggcgacgagtggcgccaatcggccgactttcgctcccaggccctcaaatttgtccaggcaataattaattaatttaatttaattaattaaaactaaaatttatttaggctaaagaaaaaagaaggaaaccatttggaatatcagctgaaaaaatagaatatttcgaaaataaaaatttaaaacttttcaatttttctcataaataaatgaatttaaaaattaattaaaacatttgtttgtatatttttttggcttttccctacattaaaattcacttgctattaaatgataaattaattattaattagtattatatccaattaaccttttaattgggtgtccgccttcccatcagcagacaatcgcttatgctgctaaaaatctctaccacatggaggagtgtttgaagccgtctctgctcgccatcggtgaacggcacgtgcagtacgcggcacgcggctttcggcccgaacattggaacatatttttggcgagaatttcaacaaaaattatattggatgggtgtgcgtgcattatgcccccgccccttagtgctactcgagagtctcgatcgagtctcgactcgagaaaagtcttgggttttttcggtctcgagtctcgatctcggatttttcacattattagcttttgctaaaaaatttaatatatttaagaaattgttttttctctaatttttcaaaacaattttttttcaatggaaaattcaaaataataatatgattgatcgccatttggtcgggatcccgactcgggattggtctggatcctgactcgggatccgttccgatcgtttttccaaaataatcgggatttggtcgggatttggtctggaccctgactcgggatccgttccgatcgtttttccaaaataatcgggatttggtcgggatttggtctggaccctgactcgggatccgttccgatcatttttccaaaatcatcgggattgatcggcacttggtctggatcccgactcgggatacaatccgagggtctttccaaaatcatcgggatttggtagggatttggtctggaccctgactagggatccgttcctgtgggatccaaaatcatcgggattgatcaccatttggtctgg

SEQ ID NO: 12353 - DNA, 1219 bp, Heterodera glycines
attatcgcaacgcaatcgcttgggttggccatcttttctcgtagagtgcaaccatttggacaatgcttgaccagtagaaattgttgcatttggcacatcaaaatcatcaccaatcgcctcgggcaacaaatcaaatgaatggattgaaaccaattggttgagatcgatgagaattgtcggcgaaatttgacgaagcaaatggtccaaatgatcaccattgtaaaagcccaagtggcgaatgtttgtcgaaaaaaagtgccaaatttcacgggtaaaaatgtcccaaatccgctggccattcgtggtatgtgaagaaggaagccacaattttaaattggtgcctcttttgttgaaaatttggtgatttgaacgaagaaaagcgatgacggagtgaccgatgtacctaaaaatgggatgaatgcttttattgcgatagctctgatttttaattaccacatccgaaggcgcttaaaacggattttgctgggcaacggacggtccggcaatggaaatggcacaaatttgtcatccatttgtacagacagcttcggttctggtcctttgcccttctgaatttcgatcgttctccaaattgtcaattcgcttttgccattgaaatgtttgtccaccaacgcattgaaacgtggcgaaagaagtgccaatttgaggccgagttgagcacggtcaaaagaggggaaaatgtccatccaaacgtcgttgcaaatccaactgaaattatggaaaacagtttagttaaataaatgatgaatttgtgtgactattaaaattcttttaccgtcggttcatttttgtggcaattagcacaatttggccgagtccgaatgatgtcgtcgtcacagagggaagaataattgcagaattattgcgttagaaatttttttttttttcaaatgcgaggaaaagcgaaaaaacaaacatttttatagtcatgaaaaggaattgatgaagtttttgtatctttttgttggtaatctttcggaattggtgttccgcccgaaaaaataaataaataaaaatttcttacaaaatcactttttctatggtaaaaaatagagtgccacgggaccgggacctggtagcgcacaactgagtaccaaggtcccggttttgggggccaggacattttcgcgtggcccgttttcgcgtggggtacgttttcgcgtgagtgcctattaggactgaaattggtcggatgtgt

SEQ ID NO: 12354 - DNA, 2897 bp, Heterodera glycines
gccggtagcggagacaatggccttaattaagcgaaatttgaattatttaaacaaaattaaatgcctttttttaatttctcacccaatgcaatcagtgccagcaaaaagccaaatgggcacattgttacaattgttgtcccaattttcatctttgccaaaatcggacttattaagttgctggcttattgtgacaagtacatacggccgtttttatacatccgatttatttaccgaaattgaggtttttgttcataaaatacattttgatcactgatgaattatgatcggtcggtcattcgtaattaattcatttcttctgcggccaatcactgtttttgttggtttgtccgtcactcatttgtcagcagaagacggcccttttgtgatgctttgtcccgcttcgtcttcttcaacttctgccggtggcggagacaatggcctaaattaagcgcaaatctcaaatttggataaaaatcaaatccctttttttaattgctcacccaatgcaaacataattaacacacaacatgaggaggatttgaacctgtgaccccccattttttgactaactcacagaccactaagacgaaaaaaccaacttaattgtacttggagcgcaaaatttactcgccgtgtataaaaacaaatcccctttttattgctcacccaatgcaattagtggtactgaaaagccaaaataacacattgttccaatcgccctctttgtgctgctgaaccgccgcggtcttattcccaattttgcatcgtttcattatccatcggttgtccaattcattttccattgctttggccaatgtcagcttttcctttgtcgattcgttcaccaattcaaatggcaccatttgtattgacggcacatgaacatgaaaatgaatttcgtaactgacggaagaaatggcattggcacggagaaaatgctagacaatttggaaactaaaaatcacaaaaatgttaggccacacctccttgaaattgttgatccaatctaagtccgtttgttcgttgtaaccatcgcaacgcaatcgcttgggttggccatcttttctcggagagtgcaaccatttggacaatgcttggccagcagaaattgttgaaaacatcccaaattggctgctcttccgtggtgtgtggtgatggaatccgcaagtgtaaataggtgcctcttttgtcgaaaatttggtgattggaacgaagaaaagcgatgacggagtgatcgatgtacctgaaaatggaatgaatgcttttattgccataaaactgttttttaagtactcaatccgaaggtaattaaaacggattttgctgggcaacggacggtccggcaatagaaatggcacaaatttgtcatcgattcgtacagacagcttcggttctggtcctttgtccttgcgacgaatttcgattggtctccaaattgtcaattcgcttttgccatcgaaatgtttgtccaccaacgcatcgaaacgtggcgaaagaagtgccaatttgaggccgagttgaggacggtcaaaagaggggaaaatgtccatccaaacgtcgttgcaaatccaactgaaattatagaaaacagttttttgttagctaaataaatgatgaatttgtgtgactattaaaattcttttaccgtcggttcattttttggcaattaacacaattttggccgagctccgaatgatgtcgtcgtcacagagggaagaataattgcagaattattgcgttagaaaatttattttttttcaaatgcgaggaaaagcgaaaaaacaaacatttttatagtcatgaaaaggaattgatgaagtttttgtatctttttgttggtaatctttcggaattggtgttccgcccgaaaaaataaataaataaaaatttcttacaaaatcactttttctatggtaaaaaatagagtgccacgggaccgggacctggtagcgcacaactgagtaccaaggtcccggttttgggggccaggacgttttcgcgtggggtacgttttcgcgtgagtgcctgtttacgactgaaattggtcggatgtgtgccgaacatacattcgacctatttcgaatcccaaacccgatttcaaacaattttttgcttttatttttcgtcaaggacttgattttttcaaaattttggctaaaattgttgtgccatggcatttattgtgttgcgtcacattttatcatcagcaattttatcaacgattaatcacaattaatgagttatgtaattacatataaataaaatacaaaggaaatggacgaatttgcggtgagcaagcaaaggtcaaacacatccaaacaataacataccgtatatgctctaattatagcccatgggggattatttttcaacctcctcagaaaaggggggataattagagaatgggggattaatagagactgggctataattagagcatatacggtaattaagtaataacaataacacaatgtaacatcacatcattttcggtcacataatcgcatcaatcaatcaatcgattaattaattgattaattaattcatgcatctttcttctgctgatcactcggcccgggagaagcggcgtcgagaagactgaaaaacgatgattcaattgcaattataactcatcattggcattttatgagagtttatgagtccaatcaattctaactttccttgattttttgtactttaccataattctgtccatttcaaaacaaaaccgtacatttttggatacgaattgaaagcacaaagtctaagcaattgttgacgattggactcataaaatcattaagcatttaaaattgttcacccatcgtcgcatccgccgtcactgatcagaatgtcaattgggttctgtcgagcttggaattcgttcaacacattat

SEQ ID NO: 12355 - DNA, 2425 bp, Heterodera glycines
  misc_feature (79)..(80): n is a, c, g, or t
  misc_feature (2320)..(2320): n is a, c, g, or t
  misc_feature (2390)..(2390): n is a, c, g, or t
  misc_feature (2408)..(2408): n is a, c, g, or t
  misc_feature (2416)..(2416): n is a, c, g, or t
agagatcaacctttgaaaaaagcctggacctggattgcatgttggacctggatttcctggataaaaaatccaggaaacnnccagtttcctgaaaaatccaggctcctctggacctggatccaggcctggctggacctgtattttttgaaatttgttttaaaagcaaaacaatgtttgaaaaaatgaactaatttcttaggaacctccaaaaatttataattttaaaagaaaatgtgtttttatatctaaataatcattttttgaaaacttgaaaaaacatcgatcacttgaaataataaattctaaaattttgttcaggaaatccaagtttttcatatttggtcattattttcatatttgacctggacctggattcctggacaaaatccaggaaaacacaggtccaacaaaatccaggttgcctaaaaaatagcctggacctggagttggatccaggaaaaatccgggcctatatacaggtccaagtcgatctctagaaaatactcttacgcccacagtttgtgctaaagcggactttcacaaataaaattagtaaaaatgacctttctatggattttgccaaaaaaggtgtagcccgagccgaagagcattccttcgaagaaaataattgcaaaaacgaacaaaatgtgcggaacaaaactgaacagagcctggccaaagaaaattgccaaatttgctaactaaaataaatttaatttaaaaattttagatgtaaaaataccataagaataggaagtgagtacaaaatgagcgatggcatttcgacaaaaatggcacttagccgagcaaggaaaagaccgatcacatggaaagtttggagccaacggaattggctggccaacgacaagccaaaactgcgagcacaatcgaatttgacgtgttgcagctgacaaaatggattttgagaaaataaaaatttattttaattggtaaaataaaaattcattttgtcaaaaatacagagtgacaaattaagtaatgtcccacttttaacattcttaaatctcgaaaggtatacattatctcgagtagtccttttgttttccttgtaatttaggaatttcgaattttgtttgaattcgggttcgggattcgtaattttgaaaaataaatgtcatattcgtgatcagcgccccaaattaccctataaatgactttatttgaaaatttcagggggggggggtcacaaaaccaaaaaatgtttattttcattaagcatttctccggaaaattgccaaaatttgatccgtgagttcagtgccatctgcaaaatttttgttggcacatttatgtctccatctcaggaccccctaatgattaattgttaccctgtaaaaaaatatttaataattataaaaaaagtatttggatgcttcaccaatcctgagttgattagaaagtccaaaacatagacactgctaattgggagcatgtagcgaagaagcggctgaaccaattaaatgttaatttgttttcttattttaaaatcggtttgtttcttaagaccaattgggatcataaaatagttagtcattgtaattattgccttaatcaatttgagcttttgcaaaaatgtgaattcgtgcgttcctccgccggtggtgccgttttttgagtccgaaatggcattttccgttatataaacttggccagaacaatttggccgtcggattgccggcacaatccatgatgatggccgcaagagttgtgctttatgcatccgcggagaatggaccaaaacgaaccaatatcttaataagaaaagcataaaaatcatttaaaatttaataaataaattataaaaaggtaaaaaatatatcattaagtcattagctcatgaatacttatgattaaagtcataagtaaacttacgtcaaaaaataaacagttggcacaattagcattgtcaaaatggcattttggggagacattcccagcagttttggctcagtcagtgcggcgtaagcggtagcgctgacaattccggacccgccagtgccaaaacaccacgccgaaactgttgatctaaaacattgcttaaatttaaaatttttggcttatattttgaatgattttttgtggattattccggttgcctgtcataaaatgaagaaagtgccaaaaaacaaatttcgccaaatcccgcggcggcagagccaaacgcaacgccaacaagtgccattgacattgttgtggaaaagccgatcagtagaaaagaaatggcttgaagtgagcacgccaaaaaatggcgaaagctttataaaaaaaaatcaaaaatataaatataaaattgttttanaaataaaatttattttgtttagaaattatttgaaataaaatatttgaaataattattattttttacctanatggaatccgattcatanagaatganacagtgaat

SEQ ID NO: 12356 - DNA, 1767 bp, Heterodera glycines
agcaatcaataattaaaatcggaattatgccattcaatttgtttttacttacaatgcaatacgaatttgatgagtttgtgctgccattttggtaatttatgccattattttgcatttttattatgtcctccgatgcactgatcatcagagggatgggcaaattgttggccaaaccgagcacaaaaaaagcaaaggcatttcgccacagcgaagcggcggcacccttttgctcatcggcaccattcaacatttgaaaaaataaaacgggaaaatattaaaaattgtaagccactgtgtttacgttccaggctgtaagattttttttcttacagtccatactctaatcattagtagtgtaatactcgagagcatcggtctcgactcaagaaaagtctcggggttttttggggtttttggcttacggtctctgcctcgagtctttgtgggtccaatctcggtctcgtatcgaggaaactacggtttttggcatttcttggggtctttggctctcggtcttggcctcgacattggggtaaattctcgagtttagggaaaatttctggccatcactaataattaggtcgcgtgatacctatgctaataaacacaaaaactttttaatgggaataattattgtccagcaaaataaacacaagtaattaactaactaatgaactgataacaaaattctcatagaagaaacattctctttttgtattattaaataaaatatttaaaaattaatttaattattattttctttttaagtaatatttttagaacctacaccatttattatgttatatacataaaaaacacatatttttaattacccaattctgattccttttgaattttaattactccaaccataattgcgtcactttttcttctttaatcactttttttcttcagtattttatgcattatcccaccacagagaagggtcattagcaacaaaacccttcaaaatgcggcaattgagaagaagccatcatgaaaagcatgtggtatcgtcgccaatttcaacttaccgccattttcaccaaaatgaaattattcattttgttgttttcttcaggttttggtgagagaaattaatttttattatctaaattacaaatttggctttttaacacaattaaaaagtgatgtcaattagtcaaaaaagggaatttacataaaaagcgaacttttgtaagaaaagaaattaaatggcgtcaactgtttgtggggcgacagcttctgaagaaggctctgatttttctcagaggtataaaatgcctaaattcaatattttttgctaagtaaaaaattaataattttggaatttgcatttttaataatactaaatagggcttcctttttaggcacaaaaaatcgcgaaataggcacctaaaaagcataaaaatccacaaataggcacaaaaataggcaaaaacaattttttattaacgctttttaggtagtaaaacactaaaaaaattaaatatttcaattgtaaatgaaattattaaataatttaaggttttttccaaattaggacaaattttaaaccaaaaatttttattaagaaaaaaattttaaactttgggatcaattttttgaaaattttcttcaatttttacgggtgtatttttgaaattttttttttttgggtcatttcttaggggtgtgtttttcatttttattgcatttttgttaaggattttttcaaaaatcttcaaataggcaacattaggcacaaaaacccagaataggcaaaaa

SEQ ID NO: 12357 - DNA, 3273 bp, Heterodera glycines
  misc_feature (27)..(27): n is a, c, g, or t
tttcaaaaaaaacatatctccaaaccntcggaatacaaacaaatgttctccaaacctcggaatccagtcttctgccgttccgtgcggttccgactcgcccccatcgttctccatggcattttcgtcgcccttcgtcgtttgatctttgacaatgcattcgtccaatttgctgttgtcctcctctttggcgtcatttgccatgacaatttttgtcaaaaaaaattggtggccaagaaaaaataggtaatagatttgtatgatactgaaaattcagttaaattaatgcaaataaaggtttcaatgtaccaggaagtgggtttgtttcacatcatttgcaagacaattcatctttttagttttacatttgtagttttttcactgtgtgggttttttcttattgtcagtttttgctcttgttctataatttttgagactaagcttttgaatggaaccaagaaactcatatttgaatgagggattttgtaaaaaaaatgatgtgaaatattggaatgtgggtcgttttggcggagccggcattccgacactagccgagttttaggacaacttttttaattgccgaccaaacccaacaagcatagtatcaatcgcaacaagcttaccatgtttggaagctattgcttcgtgattaaacaattacaaaaaagtcatacaatgagaattcaaaatagtcgaaatctttcttataacttttttgcatgcttaaaatagttacttgggttttttgtaagactactagaggcatgtgaagaggctttcagaatgataccaagattgttggatttggtttacaatgaaaaaagttaaaatagcacaaaagtttggccgaaacaatccattcctggaataactattttgtgaacacgagcagggaagaaatgtgatagagaagaatgaccaatttacatttttaaatgcccttatatatgctgctgcgtggaaaattgaagaatgtgtgtatctcatcaaattcaacaaatttttttttgcttttttatgaattttcgtgacttttttcactttttaatgcaaaatttgaatttaagcaaaagaaacgctgaccaacgaaatgtccaagcctcgaaatgtccataagagtaaaaaacacgaaatgtccaaaagtctaaaaagcacataaaaacccggaaaacggatctaatttagggtttttggagtcgctgagtacgaatttgacatttacctaacccatttcctaacccaggacccaaatataaatataaaaaatgaatgaatttattaaacattcaataactgacgctgtgtcaagcctatgtatgttcgagagaagtaaaggaaaaactcatgcattcctgcaggagctgacgccaaaataattgagaaagccattctgacaatgctgggaggcaaaagaggcaaagcaagaacacttctgaaaaggaatttgaatttcaccaaaattttaaccggaatgtgttgcgaacttcctccccacgttctgtcttctcaccgtacaaatggacaagaccaagtcgtttgaagttcctgtaaaggctttgcctgtagtggaacatgcagcacttaatctgtgccgtgggaaatgccgtacggaccgaagtaatttcggccttttcaaagtcacacaaaactaaaaatcacatttttgatttgttttttttgtaaatttcaaagggttgacctttgcttgggacctccggagagatgcgttcacggagaaagttcagtgcttcttcgtagtagcgtcgctgtttcccaggcagaagacaccacatacagatgcacattttctgattcactgacgcaccaatgacgaagcactgctcccacatcgctggagcgcatttgaaagttccgtcgaggtgccacgtgccacattggcgcaaaatgtccagtctaaaggaataccaataacaaacagaattttatagccaaaaaatgtaccttaacactgccgaaaataaggacaacgtccttttcgccttgcctgacatttagactgtcatacaagacgatgtcctcaccgcccttttcgcgtaacgttgctgggatgacaaaggccagtgggttctgcacgtcgacgtttcccagcaactttctcttctcacgccgcatcatttgggtcaacgcattgtttgaactcatggccacaaatgcttcatctgttgctgatcgcctcacttttgccaaaagtcgcgtgggcttcagacacggctcggccaggacactttctttgattttctgtcgccttgattccgcctttaacacagcattaattatttggttttaaatttaaacaaacttgttgtttctgaggcgctgggaggtggttgtgttctttttgacccaaggttccagtagctccaatttcgtcattgtttgtgatgtttgcatatgctgagcaactacgaattgtgcatctccaacggtcccctgagtggtgtgtgtaacgaaatcctgaacatttggagtctatttttttgcgtcgcttcaaacgtaccattcaaccataggcaatgtcccccaaaatttgtttttccgcgctcaaaggtcattactgagacttcagcttcgttcaaagtctgttgttcaacgttgtcgaaagttatcacggcattcggttcgccaaattccactcccaaattcacggcatcctcatttgtgtttgaaatgtctgaaatataacgcttcttccgacttttttgttgactttcaagcttattacgaatcatttggtccaaatgaatagaaaaatctaaagtcgtcagtacagcacacatttaaaataattcttgaacttatttcatgttcgggtggatcaagggatagacaaggggcaatgtaaatgtcatattcgtactcagcgactccaaaaaccctaaattagatccgttttccgggtttttatgtactttttagacttttggacatttcgtgttttttacccttatggacatttcgaggcttgaacatttcgtggcttggacatttcgaggcttggacatttcgaggcttggacatttcgaggcttggacactttgtaggggcgccattttgtcacactaaaatactgaaaattcgggtcggggtcggttcgccgcggggttttttcgccgcggccagttcgccgcccgtagaaaaatgtccttttcgccgccataattaaaaaaacccaaaaaatttttgcaattatgttaaaaaagcgctaaatactggtacgactactgaattcgtttggatttttcttattgctgatta

SEQ ID NO: 12358 - DNA, 3111 bp, Heterodera glycines
  misc_feature (3076)..(3076): n is a, c, g, or t
tttaattgatacatattttatcatttttaaagaaaatccgtacaaatgggtcggggttagttcggcacggccagttcggcgcgcgtttttcggcgattgcgaaaacttaacatatatcatgaacattgtgcatgctcttatggctcccagtagccgctcaaataacggcgcaaattggctattaaaatttttctttttttcctcgaaattaaaaaaaaaatttggaaaattacatttttttcgggggaagagagacgacatgggggagtgtagcgtactctaatttgagcccctcaaatgcgttgttcagcaccacaaattgtaattcgtgaaggcgaatcaccttaaaattaggaaattgttgaaaaagagttgggcggggaaagccggggaatgccgaaatcaaagagtcgggaatttttatcagactaataaaccggcatgaccaaggggcgaacataatctctcccgagaaaaaaaaaattaaaactttattgaaaaattattattcgtttcaattcaaaatttttcattaaaaaatcaatttaaaatattttagcgaaaaaataattgatgcagataatattttcttagattattagaaattttggaataaattccaaataaattaaaataaaaaattcaattgccagcagaatttaaattgtttgaaaattatatattaaaatttaattatcttacttttttcctctcatttccatcgtcctccttccgcttggcatacagcttcattttgaagcacatgaacatggtgttcatcatggatttgtgaatagtgttgctgtttttcttcgtggactgcttgcccttctcggattgaccgctgatcactccgtcgattacataagccgcatatttgtctaacacttcatccatttttgcgggctcatcatgctcagggttcagattctttaaaatgaatttgtcgtccttggttctgaaaaacacacctccgctgcctccgcgctctttcaacggcacaagctcggacagtgacacctgttcgaaacaattttcaaaaaagcttgcactaaggataattttcaataagggtgggtccggagtcgccaaaaattcaaagtcctaaatccagaattccggcttcccgaatccgatattccaaccctaacaagacatccgccggagaaaatttaagaatttatgttagattgtagttaattagcggtttttgaccaaacacaataatcaatttttcaatttaaaacaacaatttctaaaatataaaatggggatttttttaaataaaaaaaaacccgaacccattccccgaatccctggcttttcccataccagcaattgctcgtcactgatcccatttttgactctgatacgtccaaaaattttctccgccctaactttaaattcatttgaattcttttcaggcgtggtccaccacacattcttctccacgccataatccaatttctcattattttttccgtgtctttgctccccgcctttgccccgtaatttttggcacaaataattgcctaacaaagtgctaagccatgctttatttttagcatccattgtctcttctgccgctttctcttcccgcttttccttttcctcctgcttttcctccgctttcttctctttgttttccatccataaaacttcggcatttccagttttaaccttgaataactccttgaacttctgttcatggatggcacacagttcgctcatgcttctttgttcttcctcctccaccgcccttttttgtctgtcgccgatgccagcggcattggtaatgccaagcataattggaagcagcagaacggataacggtagcagttttgttgataaaattattatcattttatcagaatgagtttagagaattggaaatatattttttaaaatgtaaagaaatgaaaatgaataagcaataactgcagatgaatatgtaaattgctataattggataggcttttatatgcattaaaaaaactctactcaatttatgaagggcaccattagagaagaagaagcagagttgaaaataatgtaaaagccagagaaaggggcaaaaattgggtttttgcctcttggccatttcagttggatttggccataatcctactgatcatcctcacccaccggtcataatcctactgatcatcctctcccacttggctataattgtactgattatcttctcccatcacctatcattctaacccacactcattggtcataattctactgattgatcatcctcccatcgaccataattctaatttggacatcgatctcccgacccgaattcagacctgacaatttgctcgacccgcgcgactaaaaataccccagaaaaaactccaaatgaatgataagaaatatagttcgtcgatattttgggaatgtttgttatctggattccataattgaaatacaagtacattgaaaaaatacaagttgctgaaaaataacacctgtatctatacacctcgggagtccagcaggaaaagcctggacccagttagaacctaatctttaataagaaatttactaaaaaaaataacaaaaaccttgcttataaaaccgcattttttgactaaatcctttaataaattcattcaacttttaaaaatattctcgcattcggcaccgccggaacaaatactgaaattcttttgtttttgcatcataatgtcaaaatcaaaatttcaaattaggaaattcagttttgggtcacattaatcgctcgctaactatgtataagtaatctaatttaattatttttacagtttcgaataattagcaaaagaaaatttaaatgaaaactcaacaaataaaaatgaacattcaaaaatttatcccaattatcgcgtttttaatggattttttcggaaaaaatcggtcaagaggcttaatgaccacatttgctccacatttctgtcaatcgaacattgatcaatcagccatacccaaaatttcgctgagatcaatttctttccacaattaaaagtaaataaaattagcaaattagcatctaaaatagaaattaacaaattaatcattttattanatttaaatttattgaagattatttttcctaaaatc

SEQ ID NO: 12359 - DNA, 1909 bp, Heterodera glycines
aataattgtttttgctcgtaaagtttttgcgtcacatttattttcgccgatgttctgtttttagtttttgtattgtacacaacaatccgcccaacagaattagtaatgacagtttaatgggtttttgttcgtcaatcacagtcacagtcacatccttgacattatttcaccatttttggtttttaatcggttcagaattaattattattactaatgccatgggtgtgaggaaagcaatgccaaaacagcatataaaaggggcacaaattggagcaacaaatcattcattaattccgctcaaaagtgccgtcgatttcctcccaataaaaagcatcaaattctcgaagaagaaatgaagccatcattcaacttcaaacttttcgcatccgtctttcttgtgctttgtgtggtaagcttggaattagtaaaaattttctaggtttttttttcgtttaggcctcacttgtcctctgtcagcataagccagcagcagtaagacggggaatggacgaggcgggggctgaacccgggggagagaaaatcagcaaactaagcattaaccaacaagaaaattttttattggatatatttatagcataaaaataggttgttttttgtatgggcctattaagaagggtttcctcctccccgacccagttcggagaattacgaatttagtctttcattaacatatgcatcagatgctagttagtgtctttaaatgagtttctgattttgttttacaaaaatttctattttcttttttatgaagatttcctcccaggcaaagagatcctcgacattttttaaaatttcttccatccgcgacaattaatttttgtcgggaaattttctcaccgattcccgacttttctctccccgaacgtgtgggaggaaccctaccataagttcctaaaactaccaagataaaatgttccttcaaaattaggcatgtaaaccgcccaaaaacgtgggaagaggcaacttggcactcacgcgatggtggtgggacggccgtagttgtaaggtacaacaaaaagtacaaattaaatggacgagaaaagcaccggcggcttttcccgttttaatttttatttatttaagcaattcatctacaaagggcagggcggcaacacaaacaatttcccatcaaagaagctttgtgatcaagtgtgcaaggtgaagttgcgcaccagaggggcgaccatggtagagtgagtgcttctcgaaagtcacggtattgagtcattactcttgacttgagaaaaaaaactcgtcgaaaagcctcaaatctcgagaaatttgggtctcgagcagcactagcgccagggacgtacccataccaatgggggaggggggagggtaacccaggggctaattgaaattttgtaataatctcacaaattcttcattttcccggcggggtttattacagtgttttcctcacctatccattggtttttcctaaaaatcttaatttatatttctgtcgaaccttcctccgtccctaaaagttttggatgccctgtcaaaatgcgaatgattttttaactttagccctaaatgaatgaatgatgaatgagatgagtcggacggagaaagaatgtgctgcaacccaagaagagaattcaaagaaaaaaggagatggaaatgattgaaatttgtcaaaaaataaataaattcatagcggtagaaaatttttgataaataaatcatttttaaaaattcaaatttactttgaattaagtaagggaccggaacttttaattaataatttaaattctttaattaaaattcttaaaaaatattttatttcaaaaattcatttcttgtttcttttttaaaattcatttttctttttaatgtctgacaaatttgagtaagttgaaaattgctgagtttccattga

SEQ ID NO: 12360 - DNA, 2804 bp, Heterodera glycines
tataaattcatcagatttaaatgatgtttggaattgtgtataattaataaaaaccttaaaagaatattttaatttatttcctattttcataataaagtacgagtcgtacagttttcattattcgctataatataattaccatttatttttcgataattagtttattaattaattaatttacctgcacctccgatataaggggctcgtccagagagaattgactttgcatgtacatggagacggaggtgttggcgaagtggtggacgctgtgattgctcatgaggtacgaggccaaccgatcggtatggccacgaacaaaatgactcgtgaaatggggaaaaaataaaaaatgaataacaaagaataaaatattaataattaaattgacagggtgcaattgaaaaataaattgtctaatttccaacaaaataaaataagatggaaaactcagaatttcaaaagaatgttagaaccattaagcgtggaaatattttcaagataaatgactcccataccggagatgtgcccaccaaagttggagccactttattaattatagaaagtagggttcctccccgacatgtttcggggaattacgaaagtcgtaaattgcacttgaaataagatggacgaatctttaaatgagtttttaagacttttttgttctggactttttctttttgtattttttagactttttatgaaaatttcctccccgacgaaggtgttgctccccgacattttttaaatttctccagccatccccgacaaattctttcggggaatttcctccccgttccccgacattttgctccccgaggctcggggaggaaccctaatagaaagacctaattgtaagttcgataaaacattttaaaataaaagttatattttagtgaaaatttaatcccctcataattttttcgaaaaagtgatcagaagtgcaccagattttgcaggataacagctgagataaagacttatttataaaaaattaatttttttcaatcccataggctttccttaaaattttttggattttcaatgttttctaatttttgaaatacttttgccccaaaagtttttcgaatagtgatcagaagcttaccaaactttgccagggaaactaaaaggaagagaattaacttattttaatccttctcatcccatatcctgaatatatttcaacgcttattggcttttagaaattttttcgaaattctaagttttcgaattattttattttttgcaaaattattaaatatgtaaaatatttaataaatatatataaaaagggattaactaagaaaattaaaacatatttttgatattaaaaaaataattgtccaattcccaacaaattaataaaaagaaaacaaaacaaaataaaacacagtttgatatcaaatatttaaatattagaaaaaatttttttgtataatcccaaaaaacaaattaataaaaaaaggaaaataattttttcgttatgaatttaaataaaattttaataatatttgaaaaagataaaatgaattaaataatttaaaaaacatttttaataaaattaaatataatattaaaatttcattatttttaccatttctctcattcgcgccggaattcggtcccgaatcggcgcatattcaaaaaattccggaattgtcacattttcggtcaacaaatttgggttgggcctcagacggtcctaaaatttaaaataaattagtatttttttattttcagtttttttctacctcaacctcagcaaaattcagctgaggcgtttcggcacggaacaaaaagttggacattgccgtgataatgtgggcacatgcgatcagaaaagtgccgaacccaatccatttggcacggtttcctgacaattttttgattttgtaaaaaaattgtaaaaaaataaagggcaactgtttcgtttccctcccgcgaaaatttttgaaaattttctaaagtaagactttttataaagtgtttctaagaaaattataagaaaaaatttttgaaaaatttgcagcgattttttttttattttacgaagaattacactaagtttttcgtcaaaaaattttcccaaaaaatcgctggaaaatttttaaaagtgagctgcccccaaaaacaaatacataattttcaaaatttaaaaattaaataaataataaatttttgattaatttctataataaaataatgaattagtacatacatgagctaatttaaatcctttttcgaatttttaaacattttctcaaataatttaccccttaccttaaaaaacagtaaaatttaaattaataaaaaaaataataattccattttccaccacctcttgagccatagtaagaaacaaaaaccacagtgagcacataggaaatgtcatctgaaaaattggaaatttaattttaaaaaatttaaaaaaaaaattttgaaaaaattctgacgggctgagacgagaaaaccggacaattttgacggtattcgaaattgtcgctcaatgttttgaacagaagcgatcatatacctgaaaaaaatatttaaatttcaaaaaaaaaacaatttaaaaattttttacgttccgccaatggactccaaaaaataaataaatgtgaacagagccaagaaggcataaattcgttgaacttccaccataattcaattgctgaaagaaatttgcaatgtttattaatattatgggtaaaggaaaaaataattttttaatatgttagagcctggattttcttgaataaaatatgtatgaaaaaataaaaattaaattaaattttataaat

SEQ ID NO: 12361 - DNA, 2455 bp, Heterodera glycines
gggttcccagatctgaggctttagcctcattttgtggtttttggacaggtcaatgaaggctaaattttcaaaaatgaggctttttgtggttttttgagaaaattttgaggctttttgtggttaaacatgtgagcagctcgtttacacccacccgattttttttctgggttaatggcaactcgtacaaaaggcaactcgtacacaataaactcgtacactgttagtacaaaggcaacccgtacaaaaatgagctcaaattttacaaaataaagccaaggctttagcctaaacctaagcccgagcaagcctaagcctaatcctaaggcctagttgccttttgtacaagttggcatgaaattttcaaaacttagagatttttcaaaaaaaattttaaaaagaggggaataataggaagggcggaatatagtgtacctaaaaaagtacaccttagatggttcaaacaaaatttgtctttttagttctgagctgattaaaaatgcatagttttttaattgccaatttaaataaattggtgaaaaattaaattaaacaaaaaaatttttggtcaaataattccatattaatccatccgtcccgcgaaaaaaaaaatgttcaatgatcgaatattaagggataatgtgatggtgttgtgtatgatgatcattattcttcaatggaatgtgaggatggtcgtaaaaaatgggtgcgaaatttaaaaaaaataaaataaaaatatacccatgccgtaatggccatttcgcagtgtcctaacaattcgtacaatgaggaacttgtaaattttttttctaaaaagctagaattatctctttaaaataaaaataaaaaaatttttttttgattttttcgttttttttttgaaaaatgataatttccatgaaaaaaacgagaaaatttcaagaaaccaactacaataacatgttcgaagagttcatctcgtttggtcaaatacaatatttatggccaaattaagtaaattgatgatcgaattttcaccgaaattaaaacgagacaaaaatgttcgctcggttttcgatcactcaaacttttggtcaaattcaatcaaaacagatctacgatttatgacaatggcgtcattattttaaaacccagacaaaacttttcatgaaataattaatgcaattttagaaatttcacaattattttttcactaattttttattaaaactgaaaaaaataaaaatttatcgaaagattttcatttctataaaaatattttctgtcaacaaacttaaagcaatttctgcatcaacagcaaaagccacttgaaaggaagaagaagcttttccctagaataaactttcaataaaataaaatgttttgtctggcacaaaaaaaaagttgcgaatcatccaaaaaaaatttttcaaaattttatcattagaggcacaaaaatttatattatttttgaccaaaaaataaattaaattaaattaaaattttctttttttttactagccgacgaagatgaaagtttgaagcgcatttttgacatttgaaaaaggaatttttcgagccaatgaatgcatcaacaaaatgtgtcatggcttttgctttttgaaaaaagggaaagggcgcgcgaaagaaattccaaaatgaaagaaaaaaaggaaattgtgaaactgaatgaatgctatctttccattcttcatttttagcataatttctcgaatttttgactaggctgatgttaaaatggaatttaaaggatttaaaaggaggaaaactataatatttacacattttaataattacaaatgaataaaacggataaattttagacatactcaaattataaaatttttaattatggcctaatttgggaatgtttaacccagttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttacccatttgagtactaaaagttaaccattagagtactaaaagttaaccattagagtactaaaagtatgtatgtagctgcaactagagcccggagcaggaccggatcctgcgcaggattttgcaggatcccagtctgcaatcctgcattttttggaaaatgcaggatttgcaggattaatccgggccggatccggtcctgcaaaaatttttgaattccaatccctgcacagggttccgcaaatttgaatttccgggctctagctccaacctctttggcaggggggctgaggggcaggagcagttcccaagggggggggggg

SEQ ID NO: 12362 - DNA, 5381 bp, Heterodera glycines
ataataagtagggttataaattatacgctttaacatattttttctgcgcatatgctatgaagaaaggggctcaaaaatagcatttctgcattaaaattttttgatttgataaaggcttttagtgcatataaaagcatattttggtgggtttttgagaataagtgcatatttggccatttttgcgtttttagagcatatttcggttattgtttggaaattttcataagaaaaatgcgaaaaagcgaaaaatacactcctaaggatcgactttttggaattttttaaaaaacacccttaaaatcgaaaaaaaaaattaaatttttgtcagaacttttggaaaaaaatttatgtatataaaaatgtaatttgttttagcatataataaaaatttataaatttggaaattcaatatttttgcaattgtctaaaaaatgctccttagccattcgtgtgcgaggaatggcatgaaaaatgcttatgaacaaattccatgtgttttttattagaaataattttcggatgatataataacttactaacatgaattaaaaaagactaactaatagaagctatttttatatatgtaatagttaattaacagtcatttttaatttctttttaaagtttcattttttagtaagttaggaattgtcatttcttacattattaattaaaatgtatttcataaatatcttatattttatggtaatgatctcaaaattgtattcaataatgaagttttttcatcttacaatgtgtacaattattatcaaactcttttcaccgtcgagaatataagaattattaaaattaagaaatatattgaattataaatttttaattttgtttaatattttaaaactgagcaaaaattactgcacaatttttgttcgcatcatattagggctttataagaaaaataaatatttataaaggcacaaagtttcaaaaatcatctaattttgcataaggttggaatttaaagtttgtggaaaaaaatgtattatttttgtatactaattttgaaaaagagaacacgacaaaattttcagatgctaaatttaatatttctgttaggtctcaactgacttcaaaaataaatatttaattgacccgagttctgcgtttatttgagaatttggtcaagaaaaaacaattgtatgtggcaaaaatcgtataggtaaaaaacattaaacatttaaaaaaaataccaaatggacatatttataaaaaaaaagcttcgataatttatgccaaaaaatcaataatttaaattttatttttagtgcctggcttgatactgatccattagaaagtgacaatgataattagatttgtaattatatgaaatccatatttttttcctggactgttggaggcctgaaacgcatgaaaaacatgtttttagcttggtttgaagcctctaggaaggagttcttatccatatttttccatatttcgcgatttatttccatattttggcattaagtcctattaaacggcccccatcagctaaattagccgttttgaccccaaaggccgtaaaaatttccgaaaaagacattttttagcaaaattttgtcgaaaaaattgattaaatttaaattttcttaaaaattggttaatttatgtcaaaaataagcaaaaatggaaattttcgattttttggtttgttttctctagaaattgctttttttcttctaaaacgagttcttatacagtatttagccattttagatgtattttactagaatttgatgaatttgaataaacatttcaaaatttatccctcaattcggaaaatttgtgttctatttttgccattttatgcccatatttcgcgatttttggtccatattttatggccatatttcgagattttataatccattttttgcatccctagtaataacaattaacatttagtcatgcagagatcacaaaaaatcaatatttccctttttgtctataattttcgctattttcctcatcattttattgtttgccggaggcgagatttagtgataaaaattattaaaaataatctcattttttttcaacgaactgatcatatgtaattaacatatccattttccacacttaattaagatttaatttttccataatttgtttcagtaatttgcaaatgctcgaaatgcttctcgacctcgtctccatttcttttattctctttccttccattgggcttttcttatttttgatttaccaaaaaggaaattctgctgctgatgataaaaatgatgactcatttgaggacaaagtgaaccatttatcattttaatttattcatttgtctctgtttgtttaaaattggatttatacgcaaaatattccaattttctaatggtttccctattttcacttttcatttaatgatggcaaccaaaatttattaagagagaagaaattatgacaacgaaaaacacaaaaatttttaaatttctaagttcttgcgagtttactgggtttatatttccacatttttcggcatgttttaagagaatacgcgtccaatatatttgatatggcctatgattttgagcaccgttaaatactcaattgttttttacgcatccattcattttttcaatttttactttgggatctggctattacagagttcccaagtgtctttctcttgtgtcttccctttgaaggattctttcaaattcccgaattttattcagaaaaatatgctgtacgaattgtttgggattgtgcacagtttccgttcacatttgaacaagctctttttggagtgtgttttagttggcgaagtgccaaaaaattggagtgacaattccctttttgcattgtttggcgctgcattgaacggacagattgaaacccttaaaattctggtaattgcattcagttttagattaaaaaataacaaaataatttattttattaagtcggaaagcaacgacgtaaatctgagaatgggccaactgaaaaccgctggaggcacaatcggtgattaaatacaatagcaagatctggacttgctggccggatccattcctaaatttttctctgatttttttttccaaaaaatataggtccagatcagtctgaaaacagaatttagacatgaaaaatctgggttatttttcattgtccagctttgtctaattctgaagtcactttattagatataaattgtgtgtttagacggcgtctcattgctttggattgcatctgccgccggccattttgaaattgtcaaatttttggtaaaataaataatcaatttaaaatattaaaacttaattttttagcaccaaaagggcgacgatgttaatggaaatggatcagtgacatttggggatcacaaaataataagtgacaaatttaatttaattaataaaaattgaaatgtgataaaattccaagagagggaaagaggaaattcctataaaaaatattttattttttaattatttttttgtattacctaataatacaaataattaaattaagatggcatttcgcctctttgtgccgcgtcgtgcgcgggtcacctcaaagtgtgcgagtttttggtcgaaaacaacgcaaatattaaccatcgaatggacattggcttcacgccgttggattgtgcttacattggccgacattttgaaattggttggaatttaagcaaaacaaattaaatttaatggaaaataaatgtgaaaattgtcattttaatttgcattattttattttgttcagcaaaattcctacgcgaaaatggtgctgaggccacaattgagaagcaatttcagttttgtactgagggaactttggcagtgccaccgttaatccccggtagaaaaataagcaataaaaaattgataatttaaacattaaaggaacggtcaattaaatttggatgtgacggaaaataaagaaatgccgtcgaaaatgcaaattaaattcttccattgatgtgaaatgaatgccgaccaattaatttggattaattatgatggatgaaattcattgttttgttttagccaaaatggctataagctgtgcgtttacatacaattctttgttttcataatttttcaactgagaaatattgaatcgaaggaaaatattttgccagaataatttgggtgttcttgaaattctttgggacaattagcacattttatgttaattttttaaaaatagataatttactgctaaagactttgagactcattaaaacttaattgttgtctccaatctatgattcgaattaaactctcatagaaaaatttttctaatgttttattcagaatttaaccgaaaatgcataaataaaatagaataattgacaaaatcattcaaactcgaataaaatgacaaataaaaaagaataaatgcatagagtaaaaaacgcatgaatgatcagagcggcaaaagcacgaaaaaacagttcaagtagaggattaactttgcataatttggaagaagttcgtgaagctgattttgaaataaatggcaaccaaaaacaacaaaacgcatttgatggcaaaagcctgaaaaggagggattttaaaacaaataaaaaaaggaaacacggaatttatataaaaataaatgttagaaactaattgtaaatagttccgttgaataggaaaggtttataaaagatcacttaagaaaaggttgctaatcgattatcgggaatttactccaaaaaaactaattcaaacaaatattaacatttccgaaaaaagatcactcaaataatgtttttctataaatagaaaaattttcccatataaaatttgccgacatataaaaatatttcttaccataacaaaagtgtgatagcataagaaaacaagagaaatgaaggtgaagcagcaaagcgaaagctaaaattaaatgattttccatccaaagtcgagaggaaaattaattgaattaataaaggaaactttaaaagggtcaatcttttgatgctttttgttttttaatttatttttaaattaattgaattaatttaaaagggtcaatcttttgatgctttttgttttttaatttatttttaaattaattgaattaatttaaaagggtcaatcttttgatgctttttgttttttaatttatttttaaattaattgaattaatttaaaagggtcaatcttttgatgctttttgttttttaatttatttttaaattaattgaattaatttaaaagggtcaatcttttgatgctttttgttttttaatttatttttaaattaattgaattaatttaaaagggtctatcttttgatgctttttgttttttacatttatttctagatgaattgaattaatttaaaaggatcaactcatctgatggtttttgtctttcaatttatttttaact

SEQ ID NO: 12363 - DNA, 2894 bp, Heterodera glycines
agtaatgtccatcggtggaaaaatgatcaacaatttttacaatgcaaagtgtgtgtgttttgttcatttttgagtatcgatcggatttgaatagatatgactagttggttggtgcagaccctcctcctgctcgagcagaaactgttccacgtcggcccaactgtggcccagcgttgtgccggggggcgcctcgtccgagtcctccttgttgatgtctgctaagcatggggacactttggactggaaagccacccaatgttgtgggcaattactgagcagggtgtcctcgtccgggtccatgtcgccctcgaagccctcttcgaccggcagtttggccaacatgtcggtcaggtcgtggccgtcgaagccgaggtccttcgcgacggaggccaacgacacatccatggcttaaattcgtttgtaaattttacataaaaaggttttcggatttcccccctcctcagcaaaatttttctggttacgggcctaacaatcccttcgatatttagtctttttggggtgttgtcctgaacgcactttcatggagatggtcgtcccctcggtttgcgggcggcacactgctgggacagtacggcgcgtggtgcggcacaccaaaaggttcgcagcgaattgtgacggcggaggacagcgacgaatcgccgtgggcggcggtgcgctggtggtggaggaggaattgctgctgctgttgttggtgctgttgaaagcagtggcaattcttcttcagcgaatggtcgggacaagcaacgccatggtgcagcatggacaaccgcagatcgccctttaaggaggaaaattcaaaaattttcttttagttttcattttggggtggcgtgggaaccccccctccctcctgcggttacgggagcgacccaagctgcacaaacatgctaaaaaatcgccatatttttatgtgcattttcaacatggcaggtataaatctcccccaattaatgctcttaatgccatgaaattcctccgatgaatccctcccttacgctctgtgccatcgcgttgacaatgccgtggctgttgttgccgttgttgttgtgttgcagtctgtgcgggtgttgttgctgctcggtcggtgccaccaactgatgcctttgctgctgttgctgatgttgttgttgattttggtgctgttgttgtgcgtaaaaatggcgtcggcacagtccatcaaacagtaccaggtccgtggttggcatcgcctcgttgcacaaacgccacttgcaaaaggtgaacaactgctgcgccacgttgtacgtgatgtggtcggcacagtgccgggcccagggcaaacattggttaggacaacgaaacggcggtatgccaccgccaccaccgttggtgttgccgtccacgccggtgccatccgacgaagacggcaaatgatggctctgtgaatttggagacaaattagaagcggtaatttaaacggaaacaaatgcatttgtcaaaggaatatcttggtttttaagctttcagaaattataaaaatacgaaaaaaattgataaaaattgtttttaaaaatttttgccggacaaatatttcatttttgaaaacaattctcccacctgttggggctgtgcgatgtatgcgcaccgctgcatccgccgttgctgctccctgccgaggctgtgcccgcaacgtccgctcccactgttggtggttgtggtgctgctgctgtggttgtttgctcgcacacgtagcgctgcgcccacactgtttttgtactcgcgggcggtggtgttgatgggcacgcacagtttggcacgctggacgagccgacaactctcgagccgcagctgcttcttcagcaggtacagctccagccgacagcccccgttttgaatgggagcggcggcggcggcggagggaacgccgcaaccgttggacgacggcgccggcggtgtttggggcggcggtacgtagccgacggcgcttctgctacttgagcagccgattctttcttcacccaacgacggaaaggaatcgtccgaactttcgtcgtccgacggctcgagaccttttttgagggaaaaagaaaattgataatggcaattgaaacactgacgaaaaacggagcaatgtgaatttgttggaagaaaaacccacagagtttggattaacccgtaaccataggaaattaaatttttacggagtagatcgtttcccttactgttttccaaaaattgaaatgtgaacagtcagacagtgagtgaaatcaacacacacccaatgggaacaagtcggtccggtcaaagtcttgactctcgacaatgcggcacattgtgtcgaccatggggatggcacggaaggcgccgtcgatcagcactttttgccgcttctggcgcagtttgatcactttctgctgccgcttcttgttcaatggcattgtgccgctgccatcgctgccgagggcaaattcgccgccgcgttccctttggtattcgatcaggtcgaactggtcactgttgcacgcgttgagctggtcaaatttgcgctccaacctgaaaaagaaaggctcttcttacggaaaacaaataaataaaacattggtggagaggggcgccatggcggggagaaatgggtcgaactcttttcgctgttattgcatttctacctaccgggaacgtggggttgatccgggtcaagaaaaaggccgaatatgtagttttgaatcggttttccaaaaaatccggatcataaatgcagttaccccgctctatccctaccaccgggtgcacttaattccccccgccgttgccccccccaaaaaaataaaaacttttttcgaggggaaacgacggaggggcgacctgttccaccctaccacaacatgatatcgccactaatttaatttgggttttca

SEQ ID NO: 12364 - DNA, 987 bp, Heterodera glycines
  misc_feature (133)..(133): n is a, c, g, or t
tttgcagggagcaagtgatggtttgatgatgggtgttggctttggctgttgtcgttttgttgctggtcgttttgaaaggcgcgctttgggcctttttcatagtttgaggcaggcgcaaatgacgaagacacanaattatggtggttttggtggtggtggaaagacgcgttgttcgggtccattgggacgacggaattcgaaggtggcggatggagctgaaacaagaaaaagaaattcagcatttaaaaactttaaaacagagttaccaagtttctttacaaattttaaaaaatgcttcatcagacatttttgtaaaaaaattagtatttcataaaaattttatccaaaatttttttttttttgaccttcgaattggtatgaaaagtcaattttttaaaaagcattcaaaaaagcaatcttgttagaaatgtttggtaaaataagtaggtaaatattatacgattcttatgttttgaccatccaaattcattgcaaattgtcttgcaattaaacagaattccattttagaacccctatttaaagcaaaccaaaaaatgaatttgccctccctttttttgcaaccacattgaaacagcaaaataatgtgccaattcttcgttagaaaatataaaaaataatgaaattcatgacatccgtaccatgcccttgccgttgttgttgctgtcggccatcattttgctgtcgtttcgttgcccaatttgcgatggtccgccgcccgcgggttggtggccaacaacttgcgttcggcaactgccattgtcgttgttgttgttggactgtaagagtttggccgcgagttgggggtgcgttttgctgagactgcacgcagaaaactcctcagttttgagcctgataaatgatgggaattgtggaagaatcacggtgttcggcaattttttttgtcttcgtaatatttaagcaaaaacgtcggtgttattctaatatttgtacagtgtttttaaataa

SEQ ID NO: 12365 - DNA, 2793 bp, Heterodera glycines
ttcttggtgttggacgggtcgaaacaaaagtattctttttcttggccggccgccatggtacgaattcatggtaaaatttagcataaattattggctgagttatgggttatcatcgcatttaagtttttaaattaaaaaataatttaattttgcatttaaaaaaaaatatcaggtagatcgaaaaatttgaataaaaaaaagaaaaatttgcttgatccaacccaatattttaaagcggggtgaagcataatcagaagagcactcaatagttactcaaaaactcaaaatcactggactcaatttgatggggctgcttgactaaatgcgggcccccataattccgcacaaaattcattgacggggggacagcgaatcttgagggaataatgggcaaagaatgacaaacaaaaaatggccacaacagtggaacacagcaataaatgttgagtggtgtacaacaaatgtaaaaccaaaaaatattcatacgaacatgtgaatcagggatatgtatgtgccgacgctctcaaaaaatttcggcaatcgtaattccaacggaacaaaaaatgtctgcaatcggaaatcggcattccgacactttctcatacaaacaaaccccttttaaaaaacttttttgtaatcccattttaaatttaagaaaaaaataaatcatttaaagatgtctaaaataattttccattaaatatttgtatagctaagatggtggaaaaagaatagaaaaatttctcacgagaaaaggtgattttattgggccaggcagagaaacttttctctctcctcaataaataaaattattcctttttttatgaggcgtctacaaccataaaaaaggcagaaaacgtttaaaaatctattgcagccaattttatttatttaaaaaaatacatataaaatagaattaagaaaaatttattttcctatacatagtgtccaatttttccgggagcccttttttagtttttaccgcattttttggaaaaatctcaaaattttaagaaaattaaatattgaaactttgaagttttttttaaaatattatttcattagcaatcaaaaaagattttatttaaagtaacaattgaagaaaacaataaacaaaaatttgaattagaatcgccacaatctctcttctgtccttctccatctctaatttctctccacttttcctgtgctctctctctctctcttcctctctctgtcattgctccatttcttccccatcattttcctctgtttgtctcttctgctgtccatctctgtgccaatctccgcctttcctgcgctctctcttcgcttcgcgtctctgccgtctcttttccacccgtcctccgccggcaccgcctttccatgccgccgctttctttttgtttgcccctttccatggccgtgttcgtccaacattttcaatttgctgctgatttccaccatcatcatcaccatcttcacccatttgctttgtcgatgttctcaacagatgagcacttgggcttaaacagaatttttttttaatttttttaccatggcaaaatgcgtgccaaatttttttgcataggggagaatcaattagacaatttttcgaagtcggtcgttttccaatcactcgagaaaatttccatctaaacaagacaaactcgcaaactgtatttgcaatttaaaaattattttcatcatttttcaaaattttaaagatactatatttttctggctaaaaaatttttattactagatttttttgaaaaattctattattaaattttctcggaaggacgacagaagggggagggggggggctgtggaaatgagatgcacccgcttttttggaagcaaaaatgcattatgttccataaattgacactcaattaaaagcattttcaactttggcgtcgaataacaaaaaaaaaaattgggcatcatttacaatacttcaaatgctacccaaatgcggccgctttgccggcacttaaaaccaaaaacactgcgatgtctggccgagtccgggcggtcgacaattatgccaccctgaaaatgcgttttgaatatacaattttagaatgaattaaaaaaaaagaagttaaatttgaaatacctagtttggtgcaagggtgtaaatgtccgagtagtcgcaaatttttttccgattttcaaaaaattttggggatactcggacaatttccggaaacttttttgggaccttggaaaggccatctgacagtggacacacccacaaatcgaacaaacggcaaaactgcccacttaagcagttatgagaaattcagtattcagtgccacgtgcctggaaccccgcgcgcaacgcctgtccggtgatcagccgttgttgcgcatcactgtccgcgtacagttggaacacagcgcggccggacctcaaaattgattttcaaacaaaaaagtttttcttttttggtaaagttaaaattggatgtatgacagacaaccgcagtccaaaaattcgcaaattttaaaaattgtttacaaggtaacaaattgtttttggcgcaaaacgactataaattcctgttttccacggggctgaaaatttagaaaaataacaaaacatttaggtccgaaaaaaacaacaacaacaatttcggatgcccttcccgaaaattaaaaaaaaattcggttgagccaaccccccttttccatgtgtgttcggtactgaaaatgaatcggaattttcgctttaactcaaaaagtcatcaatgaacaatcttgaaaattgcttaaaaaaatttccctatttatcatttggaaaat

SEQ ID NO: 12366 - DNA, 2394 bp, Heterodera glycines
  misc_feature (1693)..(1693): n is a, c, g, or t
aaatctcgcaacctccccccccccccccccctaaaaaaataaattttttgcagtttggccaattttgttgggttttttttgccttaaaaatactgagattttgttccgaacaaattttgcaaaaattgtttttttttggttttacttttacaacaaaaaaacgatgcggtgggtaattccctatttcaaagcagaggggaagggaagggaggctttgcccctgaatataggtaagtccgatttttaggaccaaaattaaatgcttgttggttggagggaaaaatgcaaatgacaaaccgaccaaattgctccatcgaaacaagccggccgaaatggaagaccggcgcccatgtcagccagcaacaattgtccattcgattcggtgtcctcatgtgcaacgcctaaagaaaattgaaaaatttcttttccagaaaatccctgggttttcgtgcctaatctggacctggttttttttcatatttgacatggacaaggcttttctgggcatggatcgatccagaaaaaatttgacggaaaataagccaaatttttggaaataaatattccgccagtcaccaaacacgattggaaaaaaattggactggtctaaacatgtcaaaaaagccggacaaactaactgagcattgccctgctgatgtccaggcccacccagtggtggccatgttcagccaacacagcgccgctgaggcccgaaccgcagccaatgtccaacaggagcgcaggcgaccgcgccgaactggccgccgccgcactgtcgtccaatgccggcaattcaagcagttcataggcacgctgggcaagctcacgctggatctgttggatgaaaggataaaaatttggtctaaaagtacgggatcgggatttacgtaaaatcccccaaatcctgcgggaatcctggtcacaccagactctagcatagacctatatttgcaagaaatcttggggtagccaactctgaccacttttcctagtaatgagaaaatttttcattttgcgttaaatcgaaaatttcaaaaaattgccgtacatttcacaaatttataaatttaaataggggtgaaaaccatgaaatgtaatttctaaattcatttgctgccatactttttgtatgcgtgaatttgccgtgtatttgcgtgcttctgtgttgtcataatattgttcaggtggacccgaatattcgggacgtgaagaggccatttaattaaattatttggtaatctataccatttcaattaaataaaataatagagagttcagatatgtgaggatttatatcccgattttatggtttttttgatagaaaatgaggattttttgagtttttttgtttgtttgagatttttggataaaaacgtagccaaaaaaaaatttttttttttcaaatatacttaagatcattttgccaatataatgcttattttcaaaattaataaacaagtccatttcacatacttaccatgggccaatcaagtcgaaaatattaaatggactaacaagggaacctcgcgaactgttagtcaaaaagtgggtataaatttggtatcattggatagagcagggtcgacttctgctgttgtgaatttttaatattagcggtgtgagatcaaaaataaaaaagttatgaggcctcaaaaatcgaaattttagtataagagactacttaccggctttngctaacttttcccttaccctctctcactctattcccataagatatgagggtctacttataaacgcattcaaaatgtttttctacaaccttatcaaataataagcaatcaaaaaggattttttacgcaatgggtgatcataacccgacgacttcttcagcttcgataattccagacgattcaccggtaaatgtacaaaatcctgaaaattcagatagcatttgattttaaggtcgatgaaaaagatatgccggcaacggaccgcgcgattgaaaaactttttgatggaattgacgcaatttacttcatggaaaacggattcaaagcgattgcgcacgaattggaagtgcgtgccaattggaattcttacaaataaacataaaatttttgcagtagatttagttaaatttagaacaattttagaaactttccgccatttgttccgaattggaaattgacgagttggaaagggaacggtttaagcttaaacggcaaatgcaaattgtgtcgaggaaaatgtcggcgttaatcgtcaaaaattcgctgtctttcaatcgacaagtggaaaattatgaaagtgtccgaacaaatgctgaacatttgttacgaataacgaggcgaatgccgaggtgcgaagaatgaatccattcggatttttctctgcaaaaatgcccccgaattttaagttcgattgaaattggga

SEQ ID NO: 12367 - DNA, 3605 bp, Heterodera glycines
  misc_feature (3577)..(3577): n is a, c, g, or t
agaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacgtattagcatcggggttacgagatagaaaattgtcctaaaaagagatggccatttttctgagaattaattcacaatttccgcagctcttgcggtaatggaaaaaattttgaagaggctctgcggaacggattagcatcggggttacgagatagaatattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgtttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatggccattaaaatataatatttaatgatttttgaccccaaaatctgattttttgggcccgatgtcctgattttgaaaaattttcgatcgcatccctgattttatggcataaaaacgaggctaaaagccacgtcgcctccgcctttgaagtttaaactgcttttgcccattttgactatattcgcaccaacaattttatcagaaaaaaggaaaacgaattttgaaattttttcatttaaattagggtaggtcgggaccgggaattttgggcaaaaccgggaccagactttttcgggttgaaaaaccgggactttttggctggtgaaacagggaaaaaacccgggaatttcccggtcccggtcaaaactggtcaaaaccgagacttcggtactaagctgtactcagttgtccgtgttcaggtcccggtcccgctcaactctaatttaaatcaaagaaaaaaacttaaataattcaataattagggctttttttaggcaaatgcctaaaattctgcgcatttgatacgctcagataaagacgaaaaacgcgtttttcgtttgatttggggagttgacttttataatgcatacctatttttgcatattttgggctttttatgcttaaatgttcacacaattcataacgcacttaaattattcccagaaaaaaattaaaaagaaaatttcggagggtctcaaaatttacaaatgcaaaaattaattttgcatttatgtaacagttaaccatttttaatggaaaacattaaaataaaaatacttttcaattaatattttgaatttattgtatttaatgtacacaatgccattccgttccttttcatcacattctgttttttccactgtttgttcatttctttttgatcacaatggtgaacccgtttccaactttgtcgtccacatctcgccattccaccacattccaattgaaatgccggcacaactccagcaagtccgacgtgatccacaccgacttgtgccgttccggcttcagttcctccgccggattggtcggcttccgttttccttcgtgccgttcaagcagttcggtgagcggcgtccgtggcaaattgttttccatcgttcgctctttgtgcggcacatccatgtaaacgaagccccctagggaaacatttggaattttaattaagcaatttagctattaatttgcattcgacacttattctcccgttttacctggcttcaccacccttagccattctttgatggtttttatcggatcccaaaagtgctccaacacatgggcactgaccacaaagtccaccgaattgtttgtgaatggcaaattgtcgccgggtgccaaaatgtgcacttttgccacgccacatgaaaatagttaattaatggactgtttgctgaacaacagaacgaccaattggttttgtttggtttttttatagtttgctaaaagtgccattgcctttggccaatcccatcaaatgccaatgccattgtcctcttccaaatgccgaccttcaatttccgtttgatgttgctgataaaatgcgtttgggtcatctgagtagtccacattcagtgcacgtaaaccaaagggattctgaacagaagcgccaatttcaatgccccaaaggccgtccaacaatttgtgggcgagtgcactttctctgtgccggggctttactgtaaagggcaaagggtacggtagggtgaaaaataaaaacaaataaataatacatgaaatttaaatttatttaatttttgcctgcttttggcccattgtttccatttaaatatttatgaaatacaaaaaatataacaaataaatggaagagaaataatgcgatgaaaaagtttatttttgtcgattgaagcataaaaaataaaaactgaaattttaatttaattttattttttcaaaattctaatgtcattcctattaaaatgaaataatctttcttttagtgaaagcattctgattcaaattaatgcattgttttgcgtttatcttaatcgccatcattaatacccaacgaataatgtgaaagaaaaaaatgcactaataacaacaagaaacatcttatatccgcaaatcaatgcatattaattgaaaaaatattaattaattcattgaattaaattattcttttgatttaatttaatttccagaaaaaggttttttcattgaaaaaaatgatgacaataaaaaaatgtcctagtgatcaatgccataaaaattgcaaaagtaataatttgggatgatatttatagttgctaaaaagtgccaaaactcgccctcggcttgcggcggcgttgtggtggttgttgtcgttcggtgatgctctatgcatttccgggctccctctttaatatgctttataacctaaagaaaaaggcacttttaaactggtaagtaaagatggaaaaattttacaaaagtgaaaaaaaataaaaattttgtgccaaaaaatcaaaaaatttattaaattgatttttgctttcctatttcgtaaattttttacgaaattaaattcgttttcaattttgaaaatttttacaacattgttcattgttttaatgtaaaattatttgtggtatgaaacaggggaggggcgcaaacaaaaagatcctgcggtcgcggatcgcgcatttaaaaactcaaaaatttccaattttttaaaaataccttttttaaactttttaaaaatttcttattataaaattttcggcgctctttttctaaaaaacttttggggaactgatggagttggggtggatccagagatgccgantaagcgccaccgggaaaaatttgaaaat

SEQ ID NO: 12368 - DNA, 738 bp, Heterodera glycines
attcaaatgggacttcgagaaagggaatttgttagacgatgctcgaaaatcttttgagtcgagagtcaagaagtgtttcccaattttttgttaccgatcccggtccccatttccataaattcccgaccctcaagtcttaatgcaaataaagtaattactttaaatccctacattgttctcgaccctttttttcccaccgaccgatcccgtttaacgttttaaatttgtaacttcaattctcgacagaaattaccggtcacagcaggtccccccggtttttgagtcccaagaatctcacaaattatccgttcacagcacatgattgatcgctcggcaggactcttcttctcacaattctcccatgttaattaaattatccaaaaccttttaaacaaatattccccacatttcccctaattaccgcctaattacccaaaattaggtagttagttgcttttgcggttgcccttttccctcggtccaatccgtcccattgttatggcggcacgcggactttaagcattcattcttccattctccgtcgtcctccgcatgctttttcttttcccgcccttgctgctgaagggcaagttcgttttcggttttttgtttttgcccgccctttttcccttcactttgtgtaccaaaatgtcggctaaatccttcgcccctttgtcccccgccgccccttccgccgccggcgttaatctctcccgccagccgacccctccgcccgcc

SEQ ID NO: 12369 - DNA, 2712 bp, Heterodera glycines
tgatttttgtctattgcccgccccgtcagagagcaaaaatccgtcccttccccggtttgggctacggtacacacacagtatcccattcccattgaattttgattgtttttgtaagggcttagggaggcaaatagaaattttgtttatgcaaatttggattattagcaatatgggaaaacagaagtcgaagtttcatggtacataatttctaatttcattattataatcaatcatcacattgattgaggttttatgggtctaattaatatgttgcttcaaaaaatttgggaagcgtaattccgtgacttaattgtcggaaatcggcttgaccatccccaagttgtcgggcattggcttaaccatcccccaaattgtcaataaccgggaccaactctcgcacatgtctaatttgcataaacaaacaaacaaacatctgctcacaccgtccgaaaaaacgagatgtgtaccaataaatagagagtgccagagaaaaacattatctttttttctctaattttttgtctccttttggcgtactatctaatattttcattattaggaaaaacaacattcacttcgtgacgtttaacttttttcctgcacgttaaatacacaccaaattttgcatagcgacagagaaaaaaattctgcatcgattcatctgttattttttgattctatctgttagttcaaaagatataataaaaacaaaatttcaaagcatcatatcttttttctaacccatcaaattgcttaatgtttgcttagaaaaagcttctcctcatcaagggctttcgaatgataccaagattatccaatttagttggcaaaaaccttcaaaaataattcccaaatatcgtgattttttaatattttggacaaaaataaatgaaaatattcatgttgcacaacggactcgaaccaccaccctttgtccctttactatcttacaaaaaccactgagccacacatgcaaatcttttctggtacaggagctcatttcccggacgctgtgtgctgctgttcgtacgtgtgtaactgtgtgtgtttttgagcaaaaattgcgaaaaaacctccccccgcattcattcatcatcatccaattcctccccctcttccccatcctcctccataaatcaatgctccttcctcttcctcaccccccaccatcattcccctcctcctcctccttctgctgctgttgctgttttgctgttgttgtaccaccaccattcgtccgtccgtcttcgtcgtcgctgtcgtcgttcacattcattcattccattaccattcattcgttcgtttcttcgttcattctttcacattcccccgtcgccctccccccccccccatcccaaggaatggacgccactttttgtggcgggtgggggacaggagagtcctcctccccccccaacgacggtagaggcaaatttatgtatgtatgcgtatttatgtgggcacaaatcaccgccgccacctccgccccatcccatcccatcgattgtattgtgttctcccccccccccgtttcttcttctgttttgtgccttttaaaatgcgatacataaaatttgttgtttaaaagtttttcgttgatttatgtgtttgtggggggaggctgaaaagtgtccccatttaaagattaaactgagagagagagcacccgttgagactttgatggtttttgttcaattttcctgccctttactggatttttttttgtcggcagtcattaaacgcttgaatatttatttaaaacatttcgccaaacaccttaaaaacaaatttgttttcaaattttccaatttcatccaaaagtcgggaccggtgctcaatccttttaaaatcattttgtgaagcatacaaaaatgccgataccagcgcgggaaaattttcaaaatggaatttgttaattggatttgccctagaacttaaatcctccgtccaagtatcatccctgagtaaaagttagctagaccctgaagtgcaatagaagcgattttaaaatccccccgatatggattcccaaaatgatttcgcgtttccggcttttgtaatctatgcctcttaaaatgtcattaaagtgacaaatttcagagtgattaaaagttggaaaaaatttcttgttgactcaccaccacacaaatttcaaatgaacggaggcggaaacagtgaacacaccagcaacgacacttttatgatcaatgggaatgggggcggtgtgatgatgaacggcaacggcacaaccgcaacggcacgcttgtcctccgcggtgccgcccaaaccgccgacacgtcagtcgaaaatttactacggccagccccagcaagcagtagcggcaacaccaccgcagcagcaaacggcggcacaggtttttggctttgcctttttttgcgttcgaatgcccccccccccctcggccgacgacctttttttttgatttttgaagggctgaatttttcagtctaagggtgtgaaaaaagtcaataaaatatttacggaagcacacgaaattgattctgactcttctgaaaatgaggaaatcccgggagaagaagccgtgcctcaagagaaggatgataccccgcacaaaattgtcccggaaagggattttggccatgtattaaccaagcagcagtgccgaatcgtgctctcagattcctacttttctttaaaaaatttagactcgaaggggtcttgggggggggg

SEQ ID NO: 12370 - DNA, 1688 bp, Heterodera glycines
aagatggatgatgagatatgatgaagaagagtgggcgaatagcctcctctcctgacagaagaatcacgtggtgacatttgtgggggattagcaatttaaggcataagtgcattttcactgatgagaggagaagcagcgacaagagaggagggagggagggaagagctaggctttgaattatgagtcttttcttcattcactcttgaaatattgatgagaaaaacgaaaaaattaattggctaatgcatgcatgtgttccatcttatcttaattatatttttgtttcgggagtttcggtcccgtcctcgagtcttacgggattttgggtctgattctgggccggttctcgagtcgataaatttctcggattttggggttctcggtctcgcccagactcaattctggccacgacttccagtagggacaagcaaacttcgaactaggaaattttttttgtttttttggtttcaagcattgagcttcgtgtaccaaaaattatttttttttatttgaaaaacatattcttagagcttaaaaaagaaatggaataattaagtggataaattattaatttggtatgttaaatgagaaaacagaaacttatacataaataaatgcccatgtacacatataatatgtccattaggaataattaattttggaaattctctccagccaaacattaattatcccagcgagcgagacaaattagtctaattatttatttattgggcattaatttttagctgcgaagggaatgacgactatttttagcccagagcaattattaatgtgactttttgctgttccaaatatagcctgtgagccgagagaactttactttgtacatgtatcatatgcgtatttattggcattttgctgccgctgaatgaatgaataaattggctaattggggatgtgaaaatgtatttttagagcaatttaacggccgatttttatataatttgccattaaggccgacaaaaattaaccaccaaaagaaacatttaaaaaatgcaattttattttttgggaggaaattcgccaatttttgatacactttttgtgatgtctgtgtctcttcagtgtttgtgtgtgtgtgtctgggccccaccgctggtgttgggctgacattaatctgatttgatcagtgcaatgacactaatcagaggaaaaatttttttttcttttggtaaacagtacaaattccttttttcaaataaaatttaagtaaaaaataatatttttaaatataattcacattttcgagaaattgaagttgatcacttcaatcaaatgtcgggataacaggacccttattcaaactgatcataagtcaggaaaaagcaatatttttaatcgctatttgatccattttgatctgaattttcagaatttcgtttctcgtcggcatatctttcctcattagtgcttagaaattgtcatttcaacggatttgatggatcccatcatcatgttaatcacccgagtctgacgcttggaaaaagcgtttcgctaagacaagcaaaacaagttggttgtgaaaggcctaaattaccccatgccttttagggaatcataaagcctataaacagacaaataattattttaaaaaaattaattctagacggaacttttttaggctcaaaaaacatctaaaaaatatttatttataaaaaaaactttta

SEQ ID NO: 12371 - DNA, 3075 bp, Heterodera glycines
  misc_feature (2999)..(2999): n is a, c, g, or t
  misc_feature (3044)..(3044): n is a, c, g, or t
  misc_feature (3049)..(3049): n is a, c, g, or t
ttggcgcattgaaatgccacaaataaatgccaacaatttcccccccccccccccgccccgggtggtcccctcacgtcctgctgggtgtgccctcccctcaaatttcggagggcattgccctgctggtggaaattaaatggctattttttcctgccattcggcactttcacatatttttttgggcatggaggattcaaatttcgcactgttttgccttatcctattttctgcaccctttccttttttctcctccaatttcggcatttaactatttttgtttaatcgcttaaatatcttagagatattattattattatttttgacgtcatcatgctgcgaaagatatggcaatgccgcatgagaatgaatttgccgagtctcgaaacaggggtttttaagaatggcaccgagacccaaacccaaattgctcactcaaagtgagacaattattatttaattccaaaaaaatgtgtgggtattctggattgagtttggcaattttcgaagctgccaattggcactgagactaaaaattcttcgagaccctctgatttaaacactcaaaatgtctatgtaaatgctaatatatttaattttgaattgtaaaattgtctaaattaattttcagcatggtttcggactttttctgccccaacacgggcggagtggagacgcacatttatcagctgtccaagtgccttctgcgcaacggacataaggtaagagcggacatgtgctcccaaatggatttatccgggattttttagaaattgagtttgaaattttaagtaaaatatttttactatttaaaattcatctctcacttcattatgtgggtgtcaaaatatttattgcatcggaataataaaataaagccttcaaatagccggaaattcattaatttctaaccggtatattttttgaaaaaatatcggcggattgttttccatgaaatgctgctgaagaccaaagcaaaatggtagtttttctgtatgtgtttttttttgttgagaaaagtaatattaatctctgatcacttatctgtgattttgatctatgatttttatcatccgacggattaaatttacgatgaaaaaaccactaaaaaaacgagaactaaacttcttagtctttttttcatctcaaagttcgagcgacaacacccgaaaattaaaaaaaaacaggcggggacgggtagcaaagctttctagaagaatataaaatcaaatagttgttatatgcaatttcattttctccaacgtttattcaagaattttctttacaaatacataatcgacaaataataataaaatcttttaaattggtttttttttaaattgaatttttctatgcatatgcaatttaataacgaagaaattattgtatctctgaatacgtgtaaaactaaattaaattttcattgcttttggttgtatattaaatttaaaaaattattttcaaatacaaataaagtatgtactatgtttttgcagttttgtatattttctcaaggttatcgtactcacgcacgcgtatggtcagcggaagggcatacggtacctgtgcggtggaacactgaaggtgtactatttgccaggcttggtgttgggcaacaactatttgccgtctgtgctcggctcgttgccgtggttccgacgcattttcatacgcgaacaaattcaaatcgtccattgccattcggtaggaatcgcattttttattactataattattatgtttattaaaaaataaaattaattaggacaataataatagcatataataattacatttaattcttgttttaatcaataattaataaggatgggaattttatgtaagaaaaatcgcgaaatatgtaaataaaaaatgttaaaaaaaatgctaaaatatgtaagaaaaaatgtacaaaaatcccaaaatatgtactaaaatatgtaaataaatttttctaaatggttaaaaaaattcctcttaaagggtgaaataagcacaaattgccattaaaataatctaaataggcttagagatcacttttagtattttaaaaattatttttgatatctcacttttggaaagaaaaaccgattttttcggtaccttttctaaaaaaaattttaatttttcacaagaaatttatataaagtgtcaaaaatccacaaattgcaaaatatgtacgaaaaaatccaaaatatgtataaaaatatgtacatatgtaatatgtagaaaaaccttggcctaatgttttgtcagcattggtggatttatttgtgatcttcgagggttgaaatgggattggttggcgcattgaaatgccacaaataaatgccaacaattcccccccccccccgggtggtccctctcgtcctgctgggtgtgccctctcctcaaatttcggagggcatcgccccgctggcattaaatgactgctgctttctgccatcccgcgctttcacattttttttggcatggaggattcaaatttcgaactgctttgccttctcctattttttcaccctttccctttctctactcaaattttggcatttttttaatgacagactttctccaccatggcacacgaggcactgctccacgcctggtcaattcgtgcagggattcgcaccgttttcaccgaccattcaatgttcggctttgcgggtgccagcgcggtgctgatgaacaagctgctgctgcgctactcgttggccaacgttgaccggctgatctgcgtttcacacacgaggtgagaaccatttataggaaacagggaggggtcgacccccccccccccctagggggccaaaatggggtcatttaaagcgagggggaggccatgaagcaaatttcccactaaatttttccaaaaaccacaaagttagcaattttttgatgaaaattgttaaaaaaaatatggtcataaaaaattcattgatcgattttccaagtcccggccccggtccggtcccggccatttcaaaattccggtctctattgtnaatattaaattgttttttaaataacgacatagcaacccttccctncaccntattgtacttctctctctctctctct

SEQ ID NO: 12372 - DNA, 1391 bp, Heterodera glycines
taataaaaccatacaaaaaaatggagccaactaatgaacaaattagtcatcattttctaaatgcaattcgtagatttattgcaagacgtataacgccaaaaaacatttggagtgataatgcctctcaattaaaacacacatctaaaataataaatgatattttaaaaataaaagaaatatttctagatgaaactataaaaaattattttttaactgaaaatattaattggaacttttcaattgaattagccccatggcagaatggaatagtcgaacgtttgaatttaaatattaaaacagccctaagaaaaacaattggcaaaaaactacttgattatgacacttttaatactatgattcacgaaatagaaagtttagttaattcacgacctttaacttttatttatgatgatataaattcgcaccaaacattcccttttatagaattcgaaatataaactaggcaaaaaatttataccttttgcagggcgggtaactcgataaaaggctcattgaaataaactcattaatcaatttaaaaataaaattaaaactatctctattcctgtaaaatagaccggaaaaaaaattaaagtcgaatttttagttcattaaaactaaaagtgatttggtcaatatttgacttttatttatttatttgattcacattatatatatttttggcggtgatctcgttttaattgttttgctctttcttgaggacattttttatattaatgttttgtcctcaatgtaagtggatttttcccttttgtggactttttctttattgacaataaacaataaacaaaaaataacaataaaagtgtacgcgctttgtgaattcgcgcgccatttttattattttttaacgacccaaaaacggaaaatttcgaaaaaacgatgcggaatgaacccagagctatcgaatgatatgtaacgaaaaggatgagatgaatgcgaatgatgattagtgaatgatggggagaaaaaggagaaagggaaatgaagttggaatggacgatccaatgggttgagatgaagcatcaaccgaagatacatttgaattatgtagagttcgaatttgctcgactggtctgtttatttgcctcgagtaatttaggacgggcgaagattatttgttccctttgacgattatgatgaccggcgaagagtcgttcttgatttacgagagcatcttttttctattttgttttgcgattttatttttcgtcgataatgattaacgaagtactgaattgagttgaattgccgatgccggattgagtggccgattataagattgtgaaaagaagaagaggggagggggacggaagctagcataccgccgatttcgtatcccaattaatgaatggaattttgtgattgaa

SEQ ID NO: 12373 - DNA, 2604 bp, Heterodera glycines
  misc_feature (129)..(129): n is a, c, g, or t
  misc_feature (155)..(155): n is a, c, g, or t
aaatgagttagagatgaaaaaaagtatttacaaaaaaatagttcaacaacaattgatatcgcattctttcacatagttatattagggatgatacccctaagaaataaaaaattagattttaaaattctntatttcaatactgatttggcttaatntagcgctttatagataaaattttacgcttttatacccctaaatttgagactttttagactctattttccatttttagtgcctgattttggggttttccagaacctatatggcgcttagaatccgattctcaaattttgggttaataatcacaattgtaccagaatcttttttcctagtgccaagcgttatcttaattgtaccagaatcttttttcctagtgccaagcgttattttagggaaggtaccccggccgagatttgggattttctaaaaaaataaaattcaagtaacatttactacaaaattcaagtcccgattttaagtctcgagcagcaagactcaatttaccatcattatcattattttggacagcatcggaaaatgtatttccatatttccatcccatttaatttataataaccgcacaatgaattgaagaaaactttgcttttgcccatttctttctttttcacttccttttttgccacaataatcacgttttcggcaactttttatcgcttttgcttgaccgtgcggttaattgagtcccagctgagtttggcactccatttccggcactttttcagcctgaaaagggcaagcacgccgctaattctattttccttcccatttctgaatttttacatcggttctgaccctttttgagcagttttgagtttgtgacctaaagcaatattttccatattttctgatttctatgctaaaagaaaaaaattccttcaaaatttcaaatatggattcataaaactcggaaatttgactttttatagcttttctggcaaaaattctacaatctgtgataaaaaaaaatataaaaaacaaatttaataaattgctgtcataataattcaaatgaatttggaattttttaaatttataactgcagcaattaatacttgttttatttttgcccttttttcggcgccactttcttagttaattattttttctcttattttctctctctcactctctcttttctgttcacctaattcattttaaatccttcttactcttatatttcattgtctctgtctctcttctctctctcacgctctttctttctcttccctttcacttggctcattggcctctctgagtctctctcactatatcgctgcatcctcagccaatcgacacaaaacggcgcggtcccatcgcatcatttgccttgccctcttctcgcctcactcggtgctaggtcgtttcctaaaaaccgccaccatgggcgtttcctaaaaaccgccaagtgggcgtttcctaaaaaccgccaccatgggcgttttctaaaacccgccaagtgggcttttcctaaaaaccgcaaccatgggcgtttcctaaaactgcaaagcaaaaatttcgaaaatatatctttcctttttaataaaatttttatgtcagttgtttgccaacgttataattaatataaatcttaataatattttacgccatttatttgccaacactatcatcattgtcaagcgcaataaaattaaaatattaatatatttattgctacttataaattctaactaataaaatttataaatgagctcaacacaatatttaatattttttcttttgttgtgctgcttaaaaaatatcagtggaattggtttcgatgaatttgcaaaaaatgctggtgcgataaatttagctgatcagtatcttaaaaaagaaataaagacaaaaggagaattattggaaaagcttgcccaaattggagttgaaataagtctaaggacgctggagagacatctttcaaaaataaaaagcaatgtttttcaaaatttgacaataaatttctttttattattggccatggagacgaatatagaaaataccaaaaaacgaacgaaaatgcaaatactgtctatgcctaatgcgaaacgtggttttatacatttagtaaggcgttagtttggtgaaaattattgaataactatagatgaagaccatatagactactcagaaccgtttgaatggcactgtgtcaaatcactccgagataagaaaggatgtaattgaatatttggaagaaactgtttaccaacattctttttctaatcatcacgataatgaatggtggtgtaagtctgctattttagtttttaacatgtagccaacattttagtgctttttgatagtattgaaaacataagaaaacacatagagaatgctattgctcctgcaataggcacccatgaaattgaaaaatggatgaataatttggatctagcagcagtcaccaaaatgtttcgaataaatataattgtgtgtgaacgtatacaagaacgaattttccgttggcaagtgtactcaccagatttagaaacatcggttagaaatatttccaatatgcaaattcatataatttttagctttcgaacctccaacaaaaggaatcgactgcatcaatatttttat

SEQ ID NO: 12374 - DNA, 5216 bp, Heterodera glycines
  misc_feature (2356)..(2356): n is a, c, g, or t
  misc_feature (5210)..(5210): n is a, c, g, or t
tcgaaaaagtggtggggtttttagggccactttttgtccaccccgtgttcttatttttagaatcttaatgactgttcccctcttttcattcacctaaacagtcttctgtttttttaatgtgaaggcgtagaacaaattcgtatattatgatttgttaactcctcgcctcccttcaaaattgattgaaaatggacaaatcgtctctaattttcatattccattttttaggcttacatcctcaaaaagctcattgtcagtcgaagaaattgccaaaagcgttgaacttctgaaactctttccgttgtgttccgtcgcccttacgccggtgactttggcgagtgcgaagttaccgtcggtggtcggttgacttcgccattcgctccattgacctcacccttctgagtgtcgccacggcacagtgttttgggttgatccgaatgaaaggtatgtgcttcgtatcatttttaacaaagtttgcccctttttgttaaatttactcatgtgaggcgacacaaattgtccaatttatattgcctttttcagaattgaccctttgagattgtcaaaggagaaatccaagttcactccctttcccttcaaaaatgactgaaaatggacaaattgtcgaatttgattatttcatttccaggttgaccctcccaaaaagctcattgtcagccgataaaattgccaaaagcgttgaacttctgaaatcgctttccgccggtgccccttgtgcatgcgaagttaccgtcggcggtcgatgacctcgcccttctgagtatcgccacggcacagtgtgtttggctgtccgaataccctcgcgatttgtgccacggcgttttcaaaaatttgttgagaaacgaggcggccaaaatccaaatatgatgattgagtgtgagattacactgtaaactttgggtttttgaaaatgttccatcacatttttcaaagcattacgggttttcatcattgtaactaagttgttggtgtgatttttccgggttatcatgaaaactgacacccaaaaaaggaaagaagatctcatatgtctttttttttacattgaataattttttttttctacattcacattaaaatttatgcattgtgatttgttttgtacatttttaattttttggatatttaaaatttatttgtttttaagattctccgcatttttgacaatggacaacaaacgaggacaagaggtagataaaattttattttggtaaaaaaattttctgattttttgaaatattcaaatttgaattaaactaaatgagtttacctcgaaaacccccggtactaggtttcaggactttttaaactggaaaaatgtgaaaaaattagccaaaaaatttcaaaatactcttaactagcgcataaaaatcactgaaaaattttttaactttttttaaatttttaaaaactccaatttgaatttttttttgaattttcggggactgggaaacgatccgctccggggtcagtggcaggtgaccattggtcatcaatgcatcctatggctgctcaattgtaaagtgtattattttttacagattgttgcacaagaagaggaggaccaaactgttggtgaagtttctcctataacggtcggttgttttccattaaaattaataattgttggtcactaatttttatgggcccgctttcccgtcgcaaaagcaaaaaaataaaaggtcctcaaactcgaagttgagaccacttactaattgacctcccatgacattctttcgtaaacggtctgacagacagactgcatatgaatgcgttaatcgttatgagaaaaacaaatttgtccccatttttggtctttccattggaattgatgaccactggtcattggttaatccgatgcacttagtacgaatctggcctttagcaaactcaatttcgaacccgaacccggattcaaacattttttgaaaatttaaaattctcattttttataaatattgcttgttgaatgcagcctatgtctttttccgtttttatatctgaatcccttggttttttcttcatctttattgtacaattcggtcaattccttggtaatagtatcggtggtagcaaatttccaaattgttttctcgagtgttggaatcagggttcggggtttgatattgagcctaaagaaggtcagattcttaataagcgcctcggattacccctgaaaataattttctaaaaacttatttaaatttttttcgggaccaataatctctatcacttgcgtaatcgtttatgagaaaaaaattgtccccgtttttctttccattgggaattgatttttgcatttgttccatttgctcttttccaacccgcagaaggngaggagacccattcaccatctctgctgctatagccaccatttacccaaaccaaagctaaaattattcccattttcgtataattgttaccctgaagccatggactgtcccaaaaaagttaaacttccccctgaactccttacggagttggccaattgccttcattacaattcgctggtatggcatccgaatttctttgtcctttgaccattttctcgccaaaaatcaaaagaaaattcttcgcaataaaataaaggtaatgagttttcctctgcattaaatattggaaatgagaataagtgaaggtccattagagctcattagacattgtgtacttaatttttaatttaaacattttctctcgggtctttttcctcatcttaattgctgtttcagagaacagagggagaaattgatgctctgaaggaggctctcgcaagtttggagcaacgacacaccttggacgggttggaaatcgaacgattgaagaagaatatcagaagtttgtgccgccgcaaagcgaaagtacgagtcaacagcccgtcagttcggtactgtaacttcaaaaattgtaacatttaatattttttttgaaaaatttacaaagttgcaaaaaaattttttaaattttcttggcggggaaaccgtgcggggaactgagcccgggggggagggaatagctgctaccgatttaacattggccctaggtcagtttcggtgatgcctactttgattttctttttttttaatcaaaattttcatttttttgtattttatttgaaaaagccaaattccgatgcacttatgtaaaatccatctcaatttgtttactaaatcatcaattaaattcatatgacaaatttttatttagccgcccattgatccgccaattttggagaaagaagaagagggagaggagccagaagcaaagagactgaaagcaaacgacgagtgaaggaacaaaagggaaagaaaagaaaagggcacggcacactttgacaagaatgccatttgccgatctctgtacaacgaaacataaaggaattgtttaaataaagcataaattaagtgattttaaaacaaaatttgttggtgaaattcactcgcattttcttgagtctgaagtataacaccagggaaggcattccgaggtccaaaaaatttctgaattccgtgccatccctggtatgcaccaccaaccatttggcccagtggtaggaaaagggacaaatgggcgaaagtccccttttattttgggtacaataattggagaaataaatgaattcgtttgccataacttttttcttttatccgttgccgcgcataatttggaccgggaaaagaacggacttttgctttagggaagaaacggcgagtacaaggaataattattccataattggctcctcattagtggaaacccgtcagtgatacgatatttccaaaagtttaagtttactgtaattggtataccgtaggtagttgtttcctcttcatcccagtcacacaaaaattcagatcaccaaaactgactgcccctccttattttgtaccgtataccatttttctccattagtaccatacataatttgatcattttttacactgcctttgccgcgagcaaatcttgaaaaattttcagagcgttgaatttctgaaactctggcaatcatgtcaataattggtccggaaatttttttcttaatttttttctgaaaattcaaattcttttcgatatgcagtaattgtgccggtaatttcggcgggtgagaatttaacttcgggtaccgtttttccaatttttctgcgttcgacaccttttcctcttacgttgaccccttcaccattcactgacccccttccccctgcgggtccactgcgttttagcgccagcatgtttttccactatagctttctataacttttttcaatattatccaaatccaacatttttgatatcattcgaaagcttaacacgtttagaagctttttctaagctactgcttcgcgattagacaattatcaaaaaagttatacactgaaaattgcttaaagtcgaaatttttcaagttttttcttaataaaattttttccaggcttgaaaatacttttgattttggtaaggctaatagagcatgttaaggagctttcgaatgataccaagattgttagatttggatgccaaagaaaaaagctatcgtggaaaaacgagctggcgcccaaacggtgtgggtccccccccctgcacaggtatggtaaataaatagtgcatctgtttttttaattataatttcttcaaaatatgtagtaaatttttaaatttaaaatttttttattgtgtactgattgaattggtcacagattcctctttaaattctcgaatattcccatgtccgcccttatccgactaatgatcagtgctcgcccctcaggggcgggatgagttcactttgtgcgccaaatctctcgcgctcatccactccgtccgtctcttacacaatttaatcaatttacgcctctgggaaaataagggaagcagtgaacagttagttaattgatcgctatggcttggtccgttgccgcattggacttggacttgctgacctattggatgctaagtgggaagagttcaacgatgaaaacttgaaaatttaagagattttcgagattttttgtatccctccccccggcacagatgtttcttccgcctttatgctgtcggcagcaaataatgttctgttttttgtggtgagaaataaatttaaaaaatacaaataggttttaaatgattcaatttcactggttaatttaatcttttttaaatttattattctattttttgcctagtaattttanaatttt

SEQ ID NO: 12375 - DNA, 3807 bp, Heterodera glycines
agtctctctttactcaagaatggcacaaattgtgccattactcagcgaaccaccggaaggagggtatgggcgacaaatcgggcgtcaaaaatgctgacgtatacctaattttttataagaaaatttaaagaaaaaagtagtatttcatcataaaccttgaaaaatcgttggaaaatttttttcgaaaattttgttttcttgaattttaaaatttatgtttgaatttttctttttgttagggagagggacgggaaacggtgggggaatggatgtagtacacccatttggtcaatgatcagtatttaaaccccccaaaaatttaattcaggaacgtaacattaaagccgggattggtgatcgggtggcctaccgctgggagggaaacgagccaggcgacgagcggacaatcacttaccaacaactgcttgatcaggtggtgttttcaatggcaaaaaatgataattgagcctattgtagataatgggaaataattttctcagaattatgccatgttacctggcttaaaaagggttgatggcttttcgtacaatgggcagttagtttgtacaatggagtttcgtacatttttaatttccaattaaaacctagaatttctttctcaaaaagaattaaaattattatttttttctaggaaacacgaaaaatttctgctaattttttcgttatttcaaatttaaaaaaaattagaattttttaaatttttttagaaaaaataaatcattctaattttttttatagaaaagattaaaaggttttaaaagtttaataggtccgctttcattttttttatagttgccactttttgagaatttttgtcttaaatttcaaaaattttaatgaatttcttttaaaatccaaatttttttgactccggatgcttctttcataggtctttattttactgcacaggtggtcacgttagctgccgtattgcgcgcccgaggcgttcgcgctggtgacgtagtgtccatctatttgccaatggttgtcgaattgccggtggcaatgttggcatgcgtccaggtggatggtggcaaagtgattgggattttgctccgagaataattggcattgaatattgatcgaatagagaaaaccaccctttgtcttttttttgcagctaaaaacgcttgcggaccaagcggccgaaatgtgtgcggagaagggccacttgcttaaaatttcaaaaaaaaattactgaaaattttcatcaaagagtcgttcattgtcaaatggataactgtaccgacgactcgaccgttcaaatgaaaaaccccagcaaaaaatgtcaatttgattcagtttttcctatttaaatttttaaaaaaaaacgaatattttgctcaacaaattttcagttttgtaaatttcactttacctttaatgagtagtaattaattaaattgtttgaattttactcctttataactagggcttatttttttggtttttatctattttttctgagctcccagtggtctgaaaagcacgaaaaacgtataacttgaggttgtttttatgctacttttcgcgttattagggccaattctatgtttttccaaaatttttagaacataaaaattttaaaaatttgaaaaacctattttggagcgccacgggaccgggacctggtagcggacaactgagtaccaaggtcccggttttgaccgggaccgggactagtcccggttttttcccggtttttcaacccgaaaaggtcccggtcccgggtttgcccaaaattcccggtcccgtggcactttaattataactttttttcttttctctatttttttgccaatttttgtattattttttgctctttttttcactgttttcctcctccaaaatgtcccaagaggaattgctgctgtcgttccaagatgaaactgctctggactggttcgttcggcttgcccatccgtcgttgtcctttcgttctggccatgccgaattggacgcactaaatgccattgtcccgggcgaactggtcgaaattgttgggcgggaatcatccggcaaattgcaggtggaaaatgaatcaaatcgctgaaatgccatagatggtggacctctttttgaaaaattttttttttttaatttttcgcgaataaaatatttaggaaacccgagtttgccaatattttggtccatatttatcaattttcgagcattttagtccatataattgtctgccctagtaaaaaactaactcattctttttccgataaaaataatcgtcaaaaaagcaacaaaaaataagaaaacacattcctaagaattgaaaaattttaaaaaatgatcctctaaaatcttttttttcttgtgattaagtttttaaatgttttggctaaagcgttactaaaaatttaataaattttcccatttttgtgcctatttaatccccattttgcgcttgtttctgcctttttcacgatttttatgcctaaaaaatgaagccctacttatggccaaaaatcgtaattctctgttatatttttcacatttaataatttttttttatttgtaaaaaaatagagaaagcgctaacgaatgataccaaaaaatgtttaatttggtcgaccatttacaaaagttatgacaatttaaacagttggccatgactttggtggcggaatttttgttgtgcgaaagcaaagcggcacagcaccgggccgtggttttggatttcaacggcagcttccgcacggagcggctaatgcaaattttggtgaacaaaaggccacaattggaggaaaatgtatggaaaatgaatgggatgggaatttgtaaaataccgttttccttcaattcagtcccccccccctctcaattagaagcgccccctgaaataaaggcctcactttttaggtgggggtggaaaataaagcccctgggggcggagtagctcagttgggccccggcacgtttgggccccagcgggtttttggctataacttttttctttgcaaaccaaattcaacaatcttggtatcatttagttatggccagaagaatttaaaaacccagattttccaacctttttttgccataaatttgttcaaaattgacgaaattttttcggattttgcaggctaatagatcatgtgaagagctttcgaatgataccaagattgttagatttgattgacaaagaaaaaaagttataatccaaaaacatgctggggcccaactgacgtgtaccgcccgggggctttattttaggaaaaacggtagataagcaaaataaatttgaaggaaagtgccatcattggacatttggacagagtttactacgcgcgtgtttctctcgccgaagaatttgaacaatgtttagcagaactgaaggtgcggtaatgccgaccgaagacacccctttttctgaaaaaaataattaaaaaatttttttataactaattttttttatttgggttttcatgctcagatagaaattctccaaccctaaaaacctcaaaaaaatttaaattttttaaaaaaaacggatgaagaactgtgataacaaaaatttcttagcaaatggtcgctgtccttcgcttcgtcccctttatcattgtgaacaaagttggcgcaatgcttcacaacctttttgacgacaataacaccgatgatggtcagtcagttcaacggaaattcaaactttgggaagaattttagggatttgttcacgaattttgtccaaaaacgacaaattttgcgattttgagccgtttttagcagattttcatcaaaaaattgtggattttttggaaaatttgggtgaagcta

SEQ ID NO: 12376 - DNA, 1458 bp, Heterodera glycines
taatacgagaaaacatgagaatgcagcaaacatttatagaaagttacaaaaacaaaattaaacaattaattaattcttttttggtgattgacttaaaccagagattttgtataattttagactttgtgtttttgaatgaaaccaacaattttaggtttgctctaacatgagcaaagttattgaataaaaacgaggaatggttaagtgatttgactcattaaatgcattagaaaccaaatccgcttccccctcaaaggacagcgccagttgaagcaaatcctcgccacactgaaagagctttgcgcgagccatggggcaacagtggtgacgattaaccatttgatggattggcgcggatatccgaccccggcactgggaaacgcatggatcaaaggcatttcgcatcggatatttttgcaccgacaaaacaatgataatgccgaaacgaacggacgaaccgaattcagtgcattaattttgagcgaaaaggtcgaaaaatgagtcggcagtttataaatttcaacaaaattagctggacttttaaggttccaagtggaaaatttcgcttctcattgacgaatcgtggatttgattcgaatctttgaataccaaccaacaaaactttatcccccgaaatgaatcacattatggccaatgccaatttgaatgccgaaagcattactaattttcttgctggtattttcgaaactatgaaacgcgatcttattttattttgaaattttctattttattaattttgattaaaaaatttaattaattttcctattcgaagcacatccggcttgtttaaatgctaaaaacaagcatttgcgcgaaaaggtcttctggcccgcaatatgcactgcatacatatgtatttgggaatgcccaattttattgttcggatttaacatttaactatcgcgctagcatcggaacggataaataatataaagattaaatgagtgtggttctattgcattttatgagtccaaaaactaacaaaaaactaatttgcttaattagtcatcatttcttacgattgccaaaacgcatagctttaagattttgtgttttcaagtgataccaaaaatgtacggttttagttcggatattaaaaaaagttatggtcatagaaactcaggattgatagatgattgggacccataaacttttcattggactcataaattttgattgtactcattaacacggtgtgtgcctaatcaatcaatagtcaatgacatcatcaagcgcctcctgcagcttttcacgcaaatccttgtgatcactgatcggactgttgaatgtgaatggcacttcgatcagccaaagtgccgtgtaaccaacgagaccaaagccggtgatgaacccgctcaggcagccttcgttcggcttaaatttgattgggcatccgcaacagatgttggcacatgatggaccaggccggccagggag

SEQ ID NO: 12377 - DNA, 3296 bp, Heterodera glycines
gcgtaccgcgtgcgcaagaagcgccgcagcttctcctcgcttaatgtgccaatcaatgccttcatccgctcggtgtcctttttgtagatcgggtcaaaaagtggctctacctgaaaattgcatccaaaaataaagcatttttaactgttttgcgccaaaaatgactaaattttttccgtgttgggatcaaattttcaaaaaatgatggttcaatggagcatggcggtgcaaataggcgccgccgagaaattttatggcatatagaaaattgtgcaaaattttaaaaaatttgcccaaaaatggggccgatcggcgtatgcttatcgcaatttttattaaatatttactattttttctgtaaaaaaaaatatgccgttaactcacttcttcgcgttccaattcattgtccgatttcagtgcatcagcaacaaattccttaattattttacaatctcacagtgttttattgtttttgggtttttatttttttgtttttttcattaaaattgtaaaaccaaggctcccaactttttttttcaaaataagacaaacgaggctaaaattaagagtttgacctcaaaaatatgattttttgaaaaaatggctacgttttagaaataattaaaacaggactacaaaccgaaatttctcaaaaattagcaatataatcagctcaacataaaaaatcattaaaaataaaccactaaaaattagcgaaataaatcattaagcacagaaatttaaaaagtttaggggaagcctgaaataaaaaaattttagaaataaggacattttaagtttctaggacatggcccctccaaataagaacaaatcttagaaataaggagcggactcgggccttcacgcatttatcatcagggtcagatttatattttattatttttttgaattttaatcgcatcaacctcccatgtcacggttttcacatgaactttataattgctgttgttgtccttagtgctgcagatgacttcaactccaataagtatcagcagcagcaggattaaaggatgacggaattgaatcatctccgaaaatgaaattattttatttttttttaacgagacataatattttaaatttaaatttcagatttggtcgtgtcatattagcatgaatacgaaaatggaacaaaagatgaaaataaatttttacatacataaacaatttttgtcaaatcctttagcagtgatcggtaggctgggaatttaagtcaccaaaaatcttcaaaaagtcgactaaaaaagtcataaaaattgcaaaaggtgacaaaaaaaaagtcaagaaaaattgaaaaaactcctgaaaaaataggcgaaagttaaaaaaattccatttttaataatttatagaataacattttgatcgtatttttaggcacttaattttataaataggtacctaaaataagcataaaaagagattcttccacaattaagaaaaaactcattcaggtttcattgccttttcaccgatcaaaatttcatttttcagaattttttttttcggcattttcttcgctaaaattcaaattttgcctcaaaaagtcaaaaaaatcatgaaaaagttgcaaaaactcaaaaaagtcataaaaatcccaaaaagtgtaaaaaagtcacaaaatatgcatttgacttaaattcccagccctaatgataggcgccgaatgggaaaaattaggcagaatattaatggaattatccacaatttatgtatatgtatagcgagcgaactgtgttaactgctttacattttcccgtgctggctggcacaaaatgaggggggggggggggcggactgactggcttggagggacagggacgagggctatggggccaaagaccacccaaacgaacgaaaaaatagaagaaaaagcggggggggggggggggggggagcagagaaaacgtactggaatagaaaaaagaccaagcatatccaatcgattgctaatgttggttaatgactttttaattgaaaaattttccaaagaaatttttgtgacaatttttcgtaaaatttatataaaatcatcttttatcgccgacaataaaataggtataaaatttggactgcaatttttaatatggaacaattgatgcgattcgcgttggggtcctttagtgtaaattttggccagcacgggaggaaaaacgcggttttttctatttaattttttaaaagaaaatttctcggagaacggcggatttataaaaatagaaaaaaatcgtagcatcaatttcactgccaattaatgatgggctgattgatagcaaagaatatcttctgctggatgacatcattcaaatttacgtagtgcctaatataagcccattttgcaataaaattacttggttcaaatttgaaattcgtttgaatacaaatgggaatagcgtttggaatgcctggcgatatccaatattaaaaataaatattttaaaaatatttttaaataattattcaagtaccttgtgaagtataaaatgggtgcgcgcattcgatgatgcaccaatattctatgaaattccgttgatcacctgaccaaaccaggcagtgactaccgtaatccggtgaaatgttcgccttccctaactatcttctgcctttctgtttatggtacctgccaattaaataatgaattgcgcttttacatttatgctaacaattaaataataaatgtttcatgcatttttcatacataataactaggaaccggatttgtatggatttccatattttttgcacacttatttcggcctaaaaaccacgtaaatagtgtttttagcttggtttgatgatgcttctaggatgccttttcacttccatatttttccatatttccataattgacagccatatttcggcattttcacaaaaaattcgaaaaatacatccctaaagatggaaaacttttggaaaatactctctaaaatagaaaaatttttgggaaaatttccaaaaattgcgacaaaaatttttcatcagcaaaattcttgtaaaaattttactaaagtcaccttctaacttcaatttttagtaaagaataaataggatacctcatttatcaaacactataaatcatgtaataaatagattatttttctttttttgacaaaaaaaattatggatatatgaattttttcaaaaattcaacccaatttttcagaagcttattgccccctcccccccctccacctcttttacaccggcccccctcgatgcgaaggggtcccccattttggggcactttgcggacgaaggggggggggtcgacc

SEQ ID NO: 12378 - DNA, 1574 bp, Heterodera glycines
  misc_feature (1422)..(1422): n is a, c, g, or t
  misc_feature (1445)..(1445): n is a, c, g, or t
  misc_feature (1458)..(1458): n is a, c, g, or t
atcggactcatatatcttcttttgcggaagcgattccatgcattcggttgtcttcctcggaatccctcgggcgggattccgccgattttttgtcacatcattctccgcagaccaaattgtgttccgcgcaaaaacgtcgacaaccctcggcctctctctccatctttctccagcatttccctgatttctttccctttctctccaattttcacatcccatttcccgtcgttccccgccaaccagatttttccatccttcctctctttcatccttccttttcactcttatttcatcctccttttctcgattcgcgagggctttggtcatgtcccagggttcttccacttccgccctgggatcaatgacctgccctatcactcgtccgtggacgtagggctggttgatcgtctcaagaatcgatttttttgcgtcggcgccaattaacggtcctttttgattggcatttttgccaacttcctcctggtctttcttggctgctccttgcgcttcttccctttttgtcttttcttccttttcctcctcagtcatttttcttctcaaaattccttttactacactctgccctttctctttttctgatgttttgcgcaaatcattttttgccttcaacgcatcccttcgctccttttttcgtaatttttctcttatttcttcaatttttctttcagcttcttctctttctatgtcatcttcccctaatgacaattccgaatcacctccttctttaccttccttggctttttcttcggcatctttcttcgctttttcttccttttcttcggcgtctttcttcgctttttcttccttttcttcggcatctttcttcgctttttcttccttttcttcggcgtctttcttcgctttttcttccttttcttcggcatctttcttcgctttttcttccttttcttctgttttttgctcttcttttgcattttcactttcgagtaagagaattcgctgcttcaactctcgaatttccctttcccgttggctttctgttgccgtttcaggaaactgtaccattttttgttgttcagaaacacggcgttgctcaattgaattaagaactcggacattgctcctctcaaattcatgaagtttcggattgtaggggcgttgctgaatgccgaccacagtttgttgttttttcgactgttgctcgggttgttcttctgcactttcattgtcggattcatctgatgatatggacaccaatactgtaggtggcgtaggagacaattggtttcgggatttacgagggtttttggggataaaggattcgtgacgggacattttttgcaggattaatttttctggctgtaaatttttggagtttttagacgaataatatggtgaaaataatgtattatgcatagaaaattgtgaattgtagcattntaatgaattgttatgaaaaatangcgcatttcttgngatttcctccgtgctttcaaacaaatacaattaattcgacgctttcgtccccgtattccctaaagtctcggtgagtcactccaaaattcggtaagaacatttcttcccatccaaat

SEQ ID NO: 12379 - DNA, 1204 bp, Heterodera glycines
tgttctttttttttttcaaaaatagcttcgcttggtagtctggggtcaaaccccaggatttcatagaacggtgatgtccaatttgcgaattattgaagaattatacgcaaaacaaagtattggaagggcagaagcccaatctttcccccctgtcgttgtaacaagcatatccaccaatgttcggttgtaccgttcaacttgtccattagcggactgatggtacggtaccgtagtttggtgtttaaagccccaattctcagcgagtgactcaaaagtcgcactcaaaaattgtgtgccgcaatctgttatcacaatttttggtagcccaaatagacatagaaatttttctacgaatgctgaagtaacagttgtcgctgtttgttctctcagtgggatagcggccataaatttggaaaatgagtcaataatcattagaacgtattggaatcctcccttagacgttcttaggggtcccattaagtcgagatgaagtctttcaaatggtcgagctgccggttctattggacaaattggttccgcgcttttattaatgccaataattttcctcctttggcatgcgtcgcagtttttgacctgatttccaatatctttgtccatcccttcccaaaataaacttcgtctaattttttctttcgttcgtttctcgcccaaatggcctccttggaaagggtcagaatgatattcactcattacccggcgtcgcatacactctgggacataaattttccactctcccctatctgtaacgcacaaaagtcccccaaaaagcttccatcttccgaatgtcccctcagaattccctttttcgtccgcattttttattaattcgcaaattctctgcgattctttgtcctgtttttgtgctgcgatcatttcttctcgtgttatcttctggtcgaatttcaatgaattaattccttgatccgttttgtcgcccaaatatcgagataaatagtcacagaattggtttcgttttcccggtctgtgaataatatctacatcgaatgccataattgccagctgatatctgcttaatcgtccttctaagtcctttcttcggaatagtgatgttaatgctgaattgtctgtaaccaccgttgaccttccagctccctccaaatatgggcggaaattctttaatgaagcgcaaatggcaagtgcttctaattccactactgaatat

SEQ ID NO: 12380 - DNA, 1794 bp, Heterodera glycines
cgatgcgatggatgtctttccttaaaaagtcgcacttctcctggtctaatgaaagcttcttcgttgtcactaataattcccttcaatctttccattgaattaggactgaatatggcctcattttaaaggaaatccgttccaaaataggcttaattttgtcatcctttttcgggaataccaaggtttcgtcggtccaatccgcctctggtggaatttggtctctttccgatttaaattttccccattcttcgtcattcattagcatgtttggatcgtcgggattctgatccctttttaacgaatttatttctgctgagtcggaaataggctcaataaatgccaatcgcgagccggcgtggactttcacaacacaattgccgaaattaagtaatcgaagcggaataactcaggttgacccgggacaaattaagcactttccgacacgaataggaaaatagccgtgttctttttcgacagtgatgaatgtgtcctcgggatcaaaatttcgatttatctgcccccacacgaatgagtcagataatgggggaagtgtctgtgtttgtaagagtcgaacttcggttggcttattttcgaagtttattgcagcgatcattggaaggtgaatatggccgactcgaacagttccctttttaaaattaagcccaatttcctcttctcctccttgttcactgatatgatccatcaaatccgttccgattatcgctgcacatgggcatccttcgtcttcgcttactaatatcggaaatttgccttcaaattcacccattttgatgtctacatttgttgacccaataaaacggattgctgtcgaattagctgctcgagcttgaggaaaatccccccggcggaccttcagaaggtatttatcagcagttgatgacttaatgtatgtgacgtctgccccagtatcaaataatgctctcacaactcggccattcagaaaatattcacataacatctctttttcttcggtcctgatcgatttatttgacagatttttggcatataatttaaaacgtatgcttttgtttcgagtaacgcttcttcagggggtgccgttggttttgtttgctcccgtaattccacttccattaccattggataacggacttggtccgcaatttctctgcctgatgaaaagcagctcaccaaagtggtgataagcgagcggattagttggaggggaagcattagtgctgaggcgtataatttagcctttattaggagaacggagcagccaatgagaattataatggcaataataataaaagcggtccatttaatatatttaacgatcccaatcggatcttccatccattccttgcccttttcgatggtttcactggctttttgccttaaattttctccttcctcttgcgccgcttcaaccaatatttctccaaccgaaaaaattccagagattgaatttccattgtcatcagtgttgttgacttccattgcggtgatttcaccgaaatcaagttcgggtctggtcatccgttttgacaagtctttaagacttttttccaggcgggcttgttctgactcaaaaacagaaccacgggtgatgaaaaggaaagggttttgccgattgacgaatggctcagaagcaaagcggtgatcagcgctcgtttgttggagtgcttcggaagttgcattaaaattcacggcaaacggattacttccgtccttatcacaattaatttcggttccctccggagtcaggtctctcgttcagggttttacaaataaaattttcttggctgagacaat

SEQ ID NO: 12381 - DNA, 4249 bp, Heterodera glycines
atccgcgtgataaattggtgcagatgcgtccgtgcaataacagccgggtttcataaatgcccatgccaatgcgttgacaacattcatgcattgaatatacttagcctttttgcaccaacgaaatttgcatttcttattcggcacatcggtatacctattgataattagggttttaagaaggtaataatttaaatataccattcggcaaagggctggtcaaaggggcacgaatgtccgcaattcaacattgcatagccatcagcatcgttcaaagggattgtgcaaaaaacacatttgttcgacttctgtattcttctggtacttctcgattgtttcgatgatggagtgtctataatgtgggaataaagataagtgaatatgttacacttttaccgaagccctcatccagttccttcagtcgtacagcagcacttgtaagctcgctgtcgccagttggatcaccagcagcttccagttcctgcggcgcttgcagtggttcttccgactgaaccgattgcgctggcgacacgctttcacgagctgacgaagagcgttcggatggtcctattgaggtagacagaaaatttatcttgaaagtggacaaataataaactcacttccgcgctgtctcaacgtgagttgaccattcagaaaattggtccaccatcgaccgtaagtttgcggcgaaacggcgtttttgccaaattgacgcttcagtgtttcgaacgcttcttgtttttgcgctgggcttctttggaagcagtccaggaggaaggcgtgttgttcttcgttcctcgttggagttcgtaacggctcgctttcaccagttgggtcgcctgcagcttgcaactcctgcggcgtttggtgttgtttttccaactgaaccgcctgggctgaaggcccgctttctcgctcggagaggctgcgttcggatgctcctattgaggttatcaggcaattttccataaaaaatgtatataacaaactcacttccgcgttggctcaacgtgagttgacctttcagaaaatgggtccaccatcgaccgtaggcttgtggcggaacagttttcttgccaaattagcgcttcagcgcttggaaagcttccttaatctttgttttgcgacaggacagaatggctttgcaacttttttccgcatcttctactattttcatcgccaaacgattaatttgttgatcggacgcacgtttatttagtgggcgttttgccaactaaaagcaagaattttagcagttttgcgccggagttcacaatttttgccatttttggggtcaaattttcaacaaaaaaaagtccaatggtgtcaagcggtgccgacaggcgctgccgtgaaaaatttggaaatttttatgatatatgataagaaaatctccaaaaatttgcaattcgggtccgtggtttagaattggccaaatggatgccggattcatgatcaatttattttgaattaaaaattttttcaaaaaggggggggtgggaaactacagaattaccaaagcaaaccattattaaaaaggtaggtatcacaaaataaaccgaaaacaatgataatatttttttaatcgcgataattttactgttttggcaaggcccattgcgatacgctgatctgattcgtctcccaaagccgaatcaaaaaagatacgctcgccaaccccaccggcgacaaatgtgataatacaggcatacatgtcatttgttttgtaatctctttttcttttaaaaatggtgtacccgtctgcaccatcaaatggaattattgaaaccttaatacaataacaattaaagcaggacattacgccctaaatacctagacaaagtgcgcgaatcaattttaagtgtcgctagtcaagaaaacccattatttttttaattttccaagcggcaaatgacagtacaccagtgctacaagacttaattttcttaaacattttctccaattgcgaattgacatcttttttgaaaaaacgccgtaaaaagggccggagatttcagttactttaattattaatttgaaaaattattgaaaaaaatccacgcattattaccatatcaaatttatcgcagtgcattgggttcagccacgccgagagggtgtgacatatctcgtggatacaaattctcaccagattatattcattttcattttttgcagcaatgaacagatcgtcaaatttttttgattttgccgcaacttttgtccccgtttttttgcctgtaaacacgccggaacagttctttttgctttccaagcaaaaaagattaggagaaagctgacgacaaacgctccaatgtacgcggacgtagtggaaaattgcgagacgcttaggatgatcggctgctgatgccaattcattccgttgagccttccgtcaatgctttcgatgctttgtccgatggtggcactgtccgtgtcgggcattgtcatcctcagtccggtgctaaagcattggttaatcattcgaaatgccaatttcagcaaatttcctctttcaatttcaatgtgacgttccgcgtattgtttatctgtcgaagaaaggattttttaatggattgtcaaaatcgttctccccacgggttaccccaaaaacgacaatgacaaaaatggtgaaaacgacgatgaatggtaacgatgaaaatttctgggaggggggcctcattgaatttctgaataaaaaggatttttttggatttttctccgtcgttggcacttttttaatatgtaattagatgattagatagtcttttgctttagaatattaatggagatagagtttaaactttctacgtactaggaatcgggttttaaaaggcgaaaaacttcaaaataagggcgaaaaagttccaaatttaggtaacatttttaaattgctgttttttatgtgaaaacaatttcaaattaaggcaaacaattttattcattgcttacagttgcaaatagttatatatattcgaaaattttgaatacatataaaaaacaattaagtggaaaaatttttataatttttgaataaatcgccaaaaatgtgatcgcgtcaaaaaaatttttaaattgtatttttgtcggaccggctcagttcggccccggcacggttcgaccccagcggttttttcagctataacttttttctttgtcaacaattccgatctctactatgtacttccattttgcaatcgcgaaatgattggcggcaaagtgcccgactcgttttagttacgcttcatacaataattttggctcattcccaatttacacgtccaatatataatcattctcaatcttatgaactataacttttttcttaattggccaaagcataggttcttggtatcaaaaaaaaagcttaaaagcagggctgccaaatgaccagatttacgatcttgagtcaatttttattgaaaatttaagaaaaattttcatagattttacgaaatcttatttaggaaaaaattaaatttaaaaattcgcttaaaacgatatatcaaaattattacaattttatttcaaatccaagaataagcctaaaataaggagggaatgccaaaacaaaggacaaatcttagaaaaaaggacacttggcagccctgtttaaaagtctcgggaattatgtatattaaattttgacttaaatgcaacacacaaaatttatgcttggaattatgtaccgtattttctctaattatatgcctttcaactgatttatttcgatggaaaatttttgaaaatttattttgaatatgtctccaaaaatgtaatcgcgcaaaaaaaaatcatttttattgcattttttaaatttctgaattatatatgaaaaattcgaaaaattccagttaaaactccccaaaatattgaaatcggaatatgaaccttattttacgttttagaaagttggaatttttttttaattttgaaaatttttattttttgggaccgggaaatttgtgctaatttttgtaaattcatactcagttcagggttggacaatattagtgtaacaaagcttaaaaaataaaggaaaatcgggataattttatattttatttggttttcttacttaaaaatgaaataccagaaaaggagaagtgcacggagcaaacccaactcatactaggccatcgtactgccccaaagaaacattctgaggggggaggggagggttaggttcagatccgggtgagtaaaagatattttgagcaacgagcaacttatgattccgaaaattatcaaa

SEQ ID NO: 12382 - DNA, 1506 bp, Heterodera glycines
ctccccgccgaagatggttcagctacgattgtgccttcatcggacgaggcaccgacaaagtttcgacatcgggtggcgggtgcagtgctcggcgcaacgatcgtaactcaaccgtctggcgatcgacttcagactgcaacagtgtgatggcaatgaccaagccatcactggtggaattggccaattcgttcactcccatggccatttgtcccacactctcttggacgtcgtccagtgccgtcctcaagcgtttaacaccgccgttgtatttcttgagtgcttcatggatggggactgccagatcgcgcttcttcttctagaggaaatggacggcctcttcccgctcaatcgcccacttgttcacgtgaccgtgaagaagttcagccatttctgagtcgacaggtggcggtggcacaacattgatcggcgaatgggatggctgcgtagtcggggaatcggatgaagctgccgcctttggtccctttttttcctgttcttcccgtgggggggggctcgtcagggttttggcacttctttgggcgtcgggccttcccttccggcttttcattcgtagctgaagcgatcagcttttccagttccattttccttttttccaaatcggcgagctcctgcgagagagagttgggcttggcgggcatggcacagaatgtgtttggaattggggagtcggagggaaacgaatgatggcccattcttgcgacccatggcttaaatagcggccaattgtgaactagtccagagagcaaaaatggcagaatggcagaaaattttgagcggccgtggagaacaaagagcaaatgaaagagcagggcagggaccagcaatagatgattggccatcgacaagggcaacagagaatagtgcaacaagaagtgcaccagcatagattcataggatgagggggccagagatcgtgagttctcgaccaacaccgatgcggtattcctccgcggcacctcgactcgttgaatcaccatggggcataacgttgatcaccaattctcgggaccggggcggatggtcaattctgtcccagaacgcgaagtgagacgggcgggggcgtggatgtgggcgtgttgacaagccccgtggtgtggaaatttggtcaggggccacgacgctgatcatttcgattgggaaaaaatcatggtgtccattaccgccgggctccatcaagcatggggcagaggggtgccgaagagtgatgtcatggcgagagcggtacagctcggagatagttgggccacgggcacttccattgtaggcaccgagacggttcgcaccactttggctcagctcagatccctgaagccgcacattcctctcacgtgggtacagatgccttgtcttgagttcgtagccgcgactgtgcagtccctctttgtagaaatggtgaattgagtggcgcagaaacagcttttatagagcagccatttggcaatttttgatctttggcgagatgaattcatagaaatatttgaaaaa

SEQ ID NO: 12383 - DNA, 2531 bp, Heterodera glycines
  misc_feature (101)..(101): n is a, c, g, or t
  misc_feature (111)..(111): n is a, c, g, or t
gttgatttttgaataattttacatatacaaaattttttattaatattattaatttatttaaatataagagagatatgagggtgatgggcgcccaaggttcnagatatgacnccagggtgacccgatttcaccctgaaactccaaagggttcatttcgttgtgacaacgaagcggaccccaggagcttcaggggcgagagtagacagaataaaagatatggtttattataaaattattttcattaaaacgtatataatttattttataattgattaattctcaaaatatatttttaattcataactgattaataagaaattcaatagataaaaaacatggcatgaaatgaaagaaaatatgcttttctattattttggtgtacataaacggcatgaactttgctgatcaaatagcgaccgtgctcatccggtgcaattctgctgtccggatttccttcatcaatttggactgccaacttaaaaggcggattgataatttttattagagcccggtaaaaaaatttccggaggcgggagcaggagttaaaacttttctgggacgggagtcccgatcggggatcccataaaaatcccgctgccgttacaatcccgttcaccaaaaaaaacgggtgccggaccggaaatctcgtaaaaatcccgcgggggtcccaatcaccaggctctgattcttattattatacagaatttcacgattcaatttttatatttcgcttttctaccgggttcggcttggtgcgtttgattgcgcgttttctttgttgttttgccgtgttttttgcccgcttggatgatgttgaagtggcggtgaaagttgaacttcaattcccatcatcaatgtcagactcggcaccaacaagttcaacagttgcaccaatgtcgagaaatgccgaatttgcgtcagggtcccagtcaatttgctcttcggtctcatcgatttggaaattttcgacaattgtgttactttcgttgtcctgaacaaatttccagctcaagatcatttgttgaaaagctatttgttaacagattttcaataaaatttctaagtcctagcaaatttttaagaaaaataaagaatttatggacgagcatgaaatttttggaattaaaaaaaacaaattttagccgttctttctaccgtctattcctacgattcgaccaattttcctcacaaatcgagattgatcgatcataatttgattatctaaaaaaaccaatcgtattgcctatgagatttttttgcgtaaaatttcgtttaatttctttttcgatcgacatttttgctcaaattttctctggcctgaccccctcggccttaacaaaattaataatacgttgaaagattttttttgaaatcatttaaaattggacctaatctccaaaaaccggtagcgccttcgatctccctatacaaaatatttttaattacttagttttattaatactttgagatttgacctgtcgtgtctacatgaatttgttaagatttaccaaattaatatattttttgttaattaattataattattctgtttttgatttaatatttaccattctgaaatcgtttggccaaatttcattgatcccgccggaggtgcccttgactccttcattacgggcaaaatcattcttggtgatgccttggatgttgtcatggtgtgcctgaaaagatttatgtgtttagtaaaaattaattttcagaaaattctaaaatggcttattttttgaatgaaatttcaataagcttatatattaaatccactttggaaaaaaattaacaaatatcaaagaatttagaaaaattatgacagccaaaaaaacaataccattgaaatttcttcgtaatccagaccgggaatgcgcttcagacctccgcaacgtgccagtctgcggatgacaggcttggtgatgcattggatgttatggagaccagtctggaaaataggaacagacaacagttattttgggaaaaatttaaaaaaacgaaaacgtcattttacatttaattacataatttatttatcataagtattaattgtctcgaaaaaagcaccaaaaaatcgcaaaaaaggcatttaaattttatgaagagacttaaaacgtaagcaaaaaattcaaatttgggtatttaaatgtttattaatatatttatagctttttcgaataagaaatttttttttcaagcaaaaagatcaaaatttggcgatcaatttttgaaaaaaattccaagtcttaatggtgtatttctgaaatttttcgggtcttttcttagggatgtattttcccgattttattttctattttttgtaaattattctattttgtactcactttacgatagcgttttgcgcctccctttccaagtccctttcctccttttccacatccggacatgttgcagacaattggagacttttaaaaaattttttatgaccgtgatgctaaaaataaaaataaaacataatcctacaaaatatacaaaaggagaaaatcttgtggtttcataggatattc

SEQ ID NO: 12384 - DNA, 2335 bp, Heterodera glycines
  misc_feature (154)..(154): n is a, c, g, or t
aagcagctgtgttatgtgtatcacccaaatcatgttatgtgaaagtatcaaacgattttttaattcattaaaattacgttctttaaaaacatcatcataaatttcatctattaaatttgaatcgttggctatgatacaattattaggtaatganatagaatcgccaaaagttccattaccaatttcaagtatctgttcagcgaaaatttggtctttagcccgattatttattattaatttcatctgctcaaatttactccaaaatattgacttttttattgtcaggtcaataatttcgcttcttactgcaaatttttttacaggtaacgtttgtctaaaatcacctgcaagaattattgttttgccaccaaataattgtttacagttagttaattcacgcaattttttctcgatagcatcaagtgcaaatcgtggtgtcatcggcgcttcgtctataacaaaaaaatcactttttattatttcttcggcagctttagtgccttgaacaactccagaaataatatgagcattaagattaagcggaaatttaaatcgattatgtattgttctaccattttttaataatgtagcagcaattcctgaaaatgccatgtttgtcatatgttttttataactacgtactaaatgatataatgcattcaatgtaaatgatttgcctgtgccacccgggccatcaatgtaaattaatttaggattaagtttgcctgatgctatttgttttattttttcgtaaataattttttggtcagcgttcatagacttatacaaattttctgcgattttcttttcttcttcatagtttatattttcgttttcatctgttaaagaggtttcttggggtaaatttttaaaatctttcaaagatttcccctcttgtaataaatttttattgatacgggtcaaagccaatacataagcaatgtttggttggtttttaattaagaaatcttctgataaattatttttaaattgttcccacaaaatttctggttgttttgggtcaccatacaataagatacttgtgaacaaactccttaacgctgctggaaacctgaactgacttgcttcatttaagcaatgcttccattcatcatcgtctttagttaatccacgtgctaaacacgcctttgcataagtattatatttaattccattaacagttttaaggtcttcaaaacttgtaccatgaacatgaagtaaaagataacggagataatatttttcgccctccgttggactaatcggaaacattcgtccgattgttttacttatttctgggttttttcgcaatatccactttccttgcttagggttccaaatacaatatttaggcatttctgtgtacaaaaatttaggtgaacaatgattttcgttaaaaaaagcaaaataagccatcaatttactttttttatctcttttttctgtaattgtttcaacatcatcattttcatcaaaatatattatctgttcattttccaaatgcactgggagcctttgaacagaatgtgattttgcttgcaaagggaatttaaacattttccagcaagcctctacgggacttaaataacgtgcgccaaatagtttccggtctcatcataaactaattcttttatatttccattttcgtttgatatacagcgaagagttgctgcatcataacctttaaatatatacttataaatatactttactgcttttatgtcagctaccttttcaacatttatatgtgatttaaacctttttaataaatatcgattatatggaactatatcttggttagtcattattttgctctttcctgttttccaatcttttttaacgaatgttttgccattatttggccttttatacaaaggataaccattttcgttggtttctgttttttctctaaattgttttggaaattttttaatacacttttttgttttttggcaccaacacatagcatttggaaactctgaaccgcaagggccatgagtcatcaatgaagtgactaattcatacaaatccctatcattattttcattaggtatctccgctgatataaatttatcaatgtcactcgtgttcttccatttatttaatgggtccaatgttaacaaaacatgaacatgaggaaggcctcttttttggaactcaattgtataacaaaaatcaacaactcttccaaatattttaccatcaattaatttcttttaaaaattgtgtaacttttaaatgaaaaaacccttgctacaatgtcgggtctatcaaaagaatgttgacctgataatatccctttttgaatgtcctcctcctttggattacatgtaaa

SEQ ID NO: 12385 - DNA, 3053 bp, Heterodera glycines
  misc_feature (19)..(19): n is a, c, g, or t
  misc_feature (27)..(27): n is a, c, g, or t
  misc_feature (3047)..(3047): n is a, c, g, or t
tacaaaaatttaggtgacnaatgattntcgtaaaaaaagcaaaataagccatcaatttactttttttatctcttttttctgtaattgtttcaacatcatcattttcatcaaaatatattatctgttcattttccaaatgcactgggagcctttgaacagaatgtgattttgcttgcaacgggaatttaaacattttccagcaagcctctacgggacttaaaaaacgtgcgtccaaataggttccggtctcatcataaactaattcttttatatttccattttcgtttgatatacagcgaagagttgctgcatcataacctttaaatataaatatactttactgcttttatgtcagccaccttttcaacatttatatgtgatttaaacctttttaataaatatcgattatatggaactatatcttggttagtcattattttgatctttcctgttttccaatcttttttaacgaatgttttgccattatttggccttttatacaaaggataaccattttcgttggtttctgttttttctctaaattgttttggaaattttttaatacacttttttgttttttggcaccaacacatagcatttggaaactctgaaccgcaagggccatgagtcatcaatgaagtgactaattcatacaaatccctatcattattttcattaggtatttccgctgatataaatttatcaatgtcactcgtgttcttccatttatttaatgggtccaatgttaacaaaatatgaacatgaggaaggcctcttttttggaactcaattgtataacaaaatccaacaactcttccaaatattttaccatcaattatttcttttaaaaattgtgtaacttttaaatgaaaaacccttgctacaatgtcgggtctatcaaaagattgttgacctgataatatccctttttgtatgtcttcatcctttggattacatgtaaaagtaataaataaatcaggacggccaacttcattaacaatagccatcgcatccataaaattttcatgcaaatttctagggccgccattaaagctagagggcaaaattatcttttttttaacctgagcacctgtttcagctgcttttgcatacaaaaatttatcaattgcattatacgactctttacagatttctttttgatgtaatcttatgtaatttaatctactccattcaattctggcagcctggtcgacacaccattgctgaaaaagtctattaccataatgatgaggcaaaaattttccttcatttcggaaaaataatttatattttgtaaaatcgcacaacgatatttttttattgtttgtatctttcatattataatgccaccctcggtaattattaggataaaataggggataacacataggttccaccaatggacttaaagggaaaatggtttcaatcttagatctgtaccttcacgaatatcaaataacatcataatttcggggatatttgtgcccatgttttttgccttttctaccgcattttcatagacatttttcatcatttcgtatgaatgcgagtaaacataattttcacgaagataattttcaacatatgcaattatttcaattatattatcatttgaatcagaggatttttcacccaacatgttaatcgaaaatcaattgcttggtctgtgtcaataaaatacaattgcccgtttgtcggtaactcaccgttattcggctgggcaactgcattataagaatgataaatatttccttgtattttaaaaatcggaacatttttatcaggaaatttaaacctcatacaacccaacgaagcacatgaaaaagaagaatttaaagttcttatattttttataaaacttttgtgtaaatcctttatttttgtgtaattattttcgtcgatttcaggttgaaataatacccttaaatctataggatattcttgcagcaaatcctccaaattacttaattttccataattgcaacattcaaaaaattcgtttaaacctttggttttgttttgttcttctggaaaatgaatggccggacaatgattacactttatattcaattctccaagaccataaacacctatatgtaggacatcggattcggctgcttttaaatataagtcaccttctttaattctatctctacgtgctttaacaaccttagcatccatcgctcttagttcatttctctgttcctcactcatttggatgcgcggtatttttctatttttatcatactctcggtttctttcatttttttctttgttcatattaatagataagaactcatcagggagattgtctaaatcaataacttcttttatatatgcctttctttttatcgcatgtttttggataaaattttcatcactttcttgtaaaaattcaatccgcttttgaacggagcttggaaccgttcactttactgctttttttacgggagctttgaaccctgtattcaggtatgatgatgtggttggcgaagaatcatcaacttttaaattctgtttatgtcgaaccattttagcacaaagaaaatttcacgcttaaaaaacacaatgtttaaaaaattaattaaataagcgaaaaaacaaacaaaaaaagatatataccgaaataaaagattgccaaaaaggaattaaaaaactaaaagttccaaaaaggaattaaaaaactaaaaggttacatctaattttttaacaccaaaataataaataccattttatacaaataaagctttttagacgttggtgagagcatttttgcatttaaatgcagaatcaaaaagcatattttcccaattttaaaaggttttaattgatggccaatgccttttaataaaggcaagtttaaagataaaaataatgaatgaaaaatttatgtaatataaacaaaaaataatgaatgaaaaatttatgcaatataaacaaatttcagtggtgaagaaatcaatgccttttgttactttcgtttcaaaaaaaactcattttttcattcgaaaaaagcataatttttcggaaagacattctcaaataantataat

SEQ ID NO: 12386 - DNA, 1703 bp, Heterodera glycines
aatgcttgtccattcctgtagtgtttccccctttgcgtgagatttgaactccacaaattcgacattttgcatttttgtcacccttattgaattggtaataacgcaaaaatgaagcggagggttcagtcagttcaagctttgaaaggttgttttcattttcatcaataaacacttcatcgctttgctcattttcagccggaaaattatcagaaatttccggatccattactgtaaaaaagttcaaaattaaggactacaactaaaatatgtgtgtgaaacgaataaaatatttcatctttattttaaattggcataatgtcaatatttttccataaaaaactctcattcataagctcattttcttattatgaaaagccaaatcattaggggtgtaaaaaagtctcggtctcgagtctcgaaaatcgagaccgagacttgaaaacccgagactcgagaccgagaccaaaaaaacccgagacttttctcgagtcgagactcgagaccgagagtctcgaacagcactagttatgatggcactcaaaaacccatcaaaattggcattactcaaaaaaactatcaaaatataaaatttgcctatagaaattttaattttgattttcaatagaaaatgagagtattgtgtattatcctgccacgtcctcgcctctccccaagccgaagttattcgaaatttggccagcattgaattgacaatgcctcgccacgtgcaaagggcaatttttattaaaaatgggtaaataaaaactaatttttacacaaaaaaaagtatttctcgggggaaggaggtggaatagtaattacacgttgatgaaaaggttgtatgaaggtcaaccagcaagtgcagagcaaagagttgcgtaaaattagcaaattcttagggggaaattagcgaaaaatttcttccgttgggacgccgtggcgagtgggcgcatctgcaaaagtgcagaaaacaccgtccgacgaactcatttgtcagccaccgcctcacacattccatccgtggcgcccaccaccaaaaaaccacccatttttgggttaatccgcgcctcgcgcgcccattgttgggcaattaattttcagctaattgatgattaggtaaatgaaaattcaaataatagaaccgcgtcaggatcagtcaggtacccgtatgcataaagatcggatctcgcacggttgtcaggcaactctacaaaaggcagcaactgcaaaaggcaactcgtacaatattaaacctaagcctaggcctaagtctagagaaaagaagctgatccttttaaagagattttgagcacaatttatgcatacatgcctccaaattagcccaaattttattacgtatttcttggcagtttggccaatattttgatgattttgtgtttgttgaaaaaaaactccaatttttcgagttcgggttatttaataaactcaattttatgttgagataaaattctgaaaaaattcatactaagctatcttttgatactgatcaaaaaagtcttttggaccaacttgatcagatcactccttcatggtgatttgaaaagccaaaaatggcttgaaaacgggaaatttttcgaaaaaatttcctagggggttgaaaatttttttctgggaaatttaagtaagcttatcagatagaggacaaattctctaccgaaatgccttttgaatggtaagtctac

SEQ ID NO: 12387 - DNA, 1901 bp, Heterodera glycines
aattgttttatttatgtttttagggaatcaattgaattcaaagaattatttgaacatataagaaaatgtgataatttcagttgccaatgactatgtgttattgtctctctcatccccccaaaataaaagtccaaagggtggcaattttaggcacattattatttttttaattaatgcctccttttttatagttttattgggcctcaaaaattgaaactctgatggcggcatatggttttatttatgtacacgctgaaatagccagaaaatgttttttggagaaggaaacccgaagacttttttttcttttttttgcttttcgggtcaaaaatttaaaaaattttattgaaaaatccctcctcccccggctacgggcctgaagggggcatgaacatcaattattaaattgaaattttggcattttaatataaatttataattttatttgaaaaaatgaatattttacccatttttcctgttgggtttcgatccaaaaaaaaaactctttcaaccttggcatacttatgccctcctctaaatattataatgcaaaatttttaaatttaattttttcttttgcaaccaaaaattgattctttccgcggctccatccaaaaatcattttttttctgttggaccaacaacaaaatgaatgaatgtgtgtgattgaggatgagtggatacggaagaatgaatgaatgtctcactttttttcggcctcatttcaccgctgccactgcttttgggaggtcctaaattgattaattagcgcccgggggccaaagaatttcttttcctgccaaaatgtttgactccctggggggtggggggagccacctgccgctgctttgctgctaccaccgctccttaatccgactcctaattagcccaattaacaaaaaatggcacttttaggggctttaagcatgccaaaactaggcccgtagccagtgggcggaagcggggagagaatcccccagaaatgaaaaattttaaaaaatttcaagaaaaggtgggcaaatttttttttaaagtaaattcacttaggtttgtggtccgagttcatctctaattaagccgattggttcattttgtccattgttttaattttgtgccaatcaaaaataacaatttttgacattaccgccactctattgcaaaaaccgcagctgcctggcgcacgtgcgcgtatgtgccgcagcggaaaaaatgatgtacaggcaaaacctacagcatcagcagcagcagcatgcatgctgttgcagcatgcactgctgctgttgcacgcactgcgcgcaccacacgcaacaattgcggcaaaaagtgtgccaccaccacaagcagcagctgaaccaccaacagcagcagaaggcgcatgaggaggaactgttcaccgtacttacattgaactatgaggtaaatccccgaaaaagcttggatcgtatctccgtttaaaaaaaaaaaacactttttcacaatttttcctaattttagcataaaattggatgtgatttttgccaaaataggtaatttttgcttcctatattaattatttattattttacaattttttcttttaatttaatcttcggacgaatttttttttctttgaaaaaaatatcaatttttataggtgtgttttttttgaaaattttttgtgtcgatttttagtaggcgttttttttcggttttcaggcttttttgtaggaatttggtggatggcggaggtgtaaaagatcagcctgcggtgggattcgaacccacgtcccttcctttccgtggaatgctctaaccactgagctacacagggcaccctttacacccttctattgcactttttcatcagtgcaatgagaaactctctgcctcccaggcactttttgagagagcccgcactacat

SEQ ID NO: 12388 - DNA, 2038 bp, Heterodera glycines
gccgttttcgcgtgggcccgagtttttgaactataactttttttattgtcaaccaaatccaacaatcttgctatcattcgaaagccctcttcacatgctctatctattagccacaaaaagcaaaacgattttgtgaacagtaaaaaagaaatttaaaatttttttcgagtttttcgcaattttcatgttataaactttgtcttggtattttaactgtctaatcgccaagcaatagtttactaacaatttctaaacatattaagctttccaatgatacccagatcgttggaagtttttttgatttaatattaaaaaatcttttttgtaattaaaaaacccgcaatccattcggttatcccacatttgcgcctcggacatttgcgtgtccaaaatacggttcaaacttaagtttttttaaaccacagatagattaatcagctttaaataagcgattgaaagtgattgcatgcaatatttgatggtcagcaaatttttgaaaaaataataaatttttcaaaataacagaattattgttcctaataaattgggcttccaaaatatggatataaaatcgcgaaatatggccataaaatattgaccaaaaatcgcgaagtatgaatataaaatggcaaaaatttggacataaatttcccaaaatttcggtaaaactttcaaaactcgcaaaatttttgttaaaaaatgattttcggggattttttcaatctttagggggtcaaaaaggccaattaagttgatggggccgttttaatagagatttttggaaaaatgcaaaaatatgtatataaaatatgaacataatgataaaatatggacaaatatggaaaaaacttatgtttgaacccgattttttgcataggcgcaagtgtttggacatgatccattcggagatccaaaaaaaaatttttttgttgaatgcatggataaattaaataaagtatattttttctttattctaattctatttttttcaattagaatgcatcggttgacgaaaaaaatggtagagataatgttaagaagataaaattaaacaaaaaggaagacgattataagctacagaaaagatatcatatagacgataagaaagaagcagaggaaaaggttgacaaagtgaccaaagcaaaaagaagtgttaaaaagtaagtttgctttttgtacttttaattgagggggtgaatagcagggatgggctttcgctttcgcgtttcgctttcgcatgtttcgctttttggtactttcgctttcgcattttggcgcaaaacgcaaatattacaccccctaagaatgagggataaaaagcccctaaaattttcaaaaatttgatatataaattggctaattgtcagtgaaaagctgtttaaaaatggtcaaaatttccaatttttcccccagcagcgccaatcggcaccgccgtgccccaaaaagccctattttttcttataaaaatggtccaaaaatcgcaaaatttgataattttttagtgaaaatctgttgataaattgtattcaaattttcaaaaattttcccggcagcgtaaaaaagttgtagaaaaaatttcgctttcgcgtttcgcaatttcgcgttttttggaatttcgcgtttcgcataaagacaaaaaaacgaaactagagaaattttgagaattttaagccacaaacctagaaaggaagaaggcattttgttgctcattgttgagaaattggattttccaagcattcaattttaaaaaaaattttttttttaatttttaaaggaccattgattcattggctgatattgagaaaaaagatgaaatgtatttatttggaaattttttcaatttgccagtgcgccagaaatcagcgccgtttagagcagaaattttggcaagagagaatgaaaaggtcatagaaatgggcaaagattatatgacaatttgggtaaaacgtaactcacaaagtaagtgaaaaaaagaaaaacattgaaaaaacagacccatagaaacggatatggtaaatgcgtcaacgaaaaattttat

SEQ ID NO: 12389 - DNA, 1123 bp, Heterodera glycines
aaaaacccgatcaaattaggtaaataaactaaattgatctgctcttattaagaacatccactgcttaaatatgcaatgtggcacccacaaaaagagaatgacaaaaagaaagcggggaagaaaaaaagtacgaatgtcgaacccaaagtcgaacccgacccaaaaaagctgaaagaagtcaccgaatttctactgcttgatgcggcactcgatcgggaggcgcgcaacttgtgcctgaacttgatttttagagtgccaatgcgcaattgggcagcgattgcgaaagacatggacgacaaggaaattgaaaactacttcataaagccattggaggaaaagcatttaaaaaataataatatttaaatgaacggtggtgctatgacgttactcaaaacccataaaatttgggcgttagacaaaaaatcattaaatgaaaatatatatttttttgatataactttgctcaaaagcaaccaaatttttaattattgataccattcgatagccctaagtgttttctattaaaccttcaaaatttcataaaatttcgttacatttcaagaaagctatgaccaaaaatgttcaagaaaacttgcttttttgagtttctctgctcataactatatttaaaattaatgaaattttttgaaattttgcaatataataaaaaaacactttgagcaatctaaaggtatcaagaattaaaattttattcattttgtgcgaagttatgaataattttctgtcaaaaattttccatttgatggttttttgagtaacgacccggcaccaaatgaactaatttcattttaataaattgccaaaaaagcaatcacctgcgattgctccagggattcatacttttagggccagaatcaagcctcttgacgggttttaaaattaaaaatttccccaaattcggtcttttgagctcgaagggaccgggaccaaaaattagcacgcttaaaatggaagttaagcagaacaattcaaaatttcttgtagattatgtaaaagaaattcactctaatcgagagacacgggaggctttattagaggggaggggggggggggaaagggttcgatggagtgggacataaatacatttaaaatttatttttct

SEQ ID NO: 12390 - DNA, 1409 bp, Heterodera glycines
  misc_feature (14)..(14): n is a, c, g, or t
  misc_feature (1385)..(1385): n is a, c, g, or t
ttcattgtattatntagtgttattatataaaatttttaaagtgtgcggtttcgcgaaaaataatgaaattcattcttaaatttaattatttcaaaaatatttttatttaaaataattaaatattatttagattatttttattagttctttgttctctttaccttttcttcattttatccatttgctctttttatttttcgtcactgtaaaaatcgcgagaattttgtgggggcggcaaagggtcaaacaaaaccttatgcgcatattaaatggcatgcaaatgcataataattaagggttggggttattaaggagggcgaatatccgttggcaaatgccatttttgggttgggtaattttaaataaaaaggacggacgatgcctttgcctttttttcattgaaattaaaaaattaaacaccgtccatctcttcaagagaatttgtcgtttcggcgccagcccgagtttttgattataacttttttttcattgtcgaccaaatccaacaattttggtatcattcgaaagctctttacaaggtttattagcatttcaaaaagtaggaaatcttatagcaaattagaaaagtttcccccaatctgtgccggatcgaacggacattaaggccattccttgcccaattccttcactttcgctgtgcgttcggttgcttttcgtcgtccgtttcattgcttctccccccccccccttattgtttttgactgttttccgttcatttcctccgaatttactttttatttaccatttgtttcatctcacttttgctctgcgcacatttcgcagagaattcgaaaggaaatgccaatgccaatgacgtcgtcgcttctcatttccccctcctcccgtcgccctaatcaaaatattgcgtggatgtgtcacaacattcattccttctaatcccaaaaaactcattttattgcacacaagcattgccattatcatagatagcattattattgccctgaggggccaattgtttgtttccgggttccatttttaaaatagaatttcaattgaggtattttctgtcacccattctctatttcgaatttcaattcaaatgccgactttctccgatccgtcttcggcttcttcttcgtcccgcctccctttgctcttctctctgctggcctttctccaacttctgatgagtgccaactcggccctgctgctcccgctcgattcgagttggtattcaaaccacagaatgaaaatttgtgcggagaaatgaatgagtgggtcggtcggtcatttcgtattcttaagcacttttcgctcctcacaacggccctttcgtggcattttatctgcaccctccgtttacgaatgcccgcctcaccagcagtccaatgatccgtgaattncatttcggccggggcgatctatcc

SEQ ID NO: 12391 - DNA, 2165 bp, Heterodera glycines
tcattcaaaaaaccaatgtcttattcctaaagtaatcgcagccaaaaggagagaaagaattctcatttcttgttttttgaaaagctgtattttgcattttattgtattgaaattggaggcctgggattttgcgggatcacagtccgcaatcccgcattttttggaaatatagggattttgcgggattcccattgcattttgaaattaaaagaacaaaatgccaaaaattttctagataaattcataaattaattaaagttaaagaaagccattttcaatcgcaaacgccatccaaaatttgtgaaatttatttccctgcggtgcctatctcccgacggattggtttccaccttagtacgcggaacgaaaatttgaaatttccattctctaatttggaatcaacaaatgacacatttgaacatcatattttccttgttaaaaatctgaaacgaaattttaaaaagaaaaaaattttgagattgattgttttgacaatttctaacttccaatgaaacgaaagaggagtaatacatcacgaaatctgcaagtgcaaagtaatggcgtcccgacgaaaattccttcggaacaaactgctatcgcagctgccgccaagcaatttaaaactgatcagtcaaatcttaggctttctgatttggggggatgcgaagcgcaatttttggtttgaaaagattttcaatcatacgaagttgcgaatcagtggtttctcaccaaaggaagcgattcaactgatgacacacctcaaacatcccaaattatgcgaacaaattggtttcacaccgcccaagggattgttgctgcacggaccgccggggtgcggaaaatcggcatttgcgatggcattagcaggtttggtcggtttttgctaagacagtttgtgagaacagaaaattaatttaggcgtattttaatcttttcgttagccgtttggttaactcttaattgccttaatttttgaattatgccaatgtgttaagtccaattctctttttaactcaaacatttaggcgaacttcagttgccaattctttccgtttcttccaccgaattggtcgccggtgtttcgggtgaaagtgagcggaaaattcggacgcttttcgcagaggcaaaaatggcggcgccggcgcttttactcatcgatgacatcgatgtgatagcagcgaaaagggaaaacgcgcagagagagatggaaagacgaattgtgactcaactcatcgcatcaattgacggttagcaaaaggaaagagacggacaaaggcaaagtgaaggcgtactttgggacggtgtcagtcagtggccgaaccgaatcagtcttcagaaagaaatattatttgtgggaaaatccattggactgaaacttatttgcagcaccaatcgcatttctctcaacaataaaactttaataaaatgaagaacatgcttgatgatacgtttatttctttggcagggctaaagtctgaaaatgacaatgagtcgtgtacagtgttcgttatcggcacgaccaaccgattggaagtgttggacgcgtcgctgcgcagggccggccgattcgacagagaaattgcgctgggaatgcccgaccaaagagcgcggatggaaattctgaaaatagtgacgaggtttggacgaaggaatgcaccaaatatagggaattcaggcacatgaaactggacgtggacgtggatttggctgtgcttgcccgactttcgcccggttatgttggcgccgatttgctggcattggtgcaggaatcaaattcaaaggctatcagtcggtattttccttgtttctttttgacacattttcattttttcagtgcgtgctctttgttccgtcgttgatgcgaatgtaaacactgagaatattgtggaaaatttcccacctaaaaacatcgacgacattcgtggagaactgacaagaagtaaaaatgagaaataattaggctctagttcaattttatacgtccaatcaatgattattcttaatttttagggcataacttttttcacttaacttacaattagttaatgccaacattcatggcatcaaacgaaaacttatgctctagctaacttataaatttaagaaaaagcaaataatgccactacgaaaaatgcaacaagaaaacataaaattcatctttcaag

SEQ ID NO: 12392 - DNA, 1701 bp, Heterodera glycines
cagtgaattgtgcggcacaaatgccaaaaaaaacgagtctaagcccccaaatcagcggcaaatcctggataaatgttaacacatcatttcatggatacttacgggctaaaaacccgtaagcctcgtgatccgtctctgatgccgaaacagcagttggacagtgacatgcccttttcatcttttcgcccatttcgtcaattcccccacccattttcatatggtcaattcctccgtggcccttctctaagggccaatccgccgattttcgcgcggatggacaattaggcttttcctctttttcaaatttatctattcccccggcccacgtgaagttgatgttgtcgatgaggtgttcctgtcgcgccctttcgagtgccaaagaaacggcgggcgcggattggccaaagccgaaaagcattcgcaaccgttggctgccattgacaaagagaaggccgattttcagctgaatgggcggcaacgccccaaccaccgccggggggacggacgaattgctaatgggcgaactggtcggaagagagattgcgccggagggagtggtggcgatgggcgtgccaatgccaatgtcgggcaacggattgccggtgccgatgagcgattggtgccgggacggaccgaacaccgaaaggagcagcaaaaggacggggaaaaatgccggcggaggggagggcatttaacagagcaaaacgacggcacaaaagggaggaagaaaagacaaatgaaaaaacaaaacggtacattaaatgcgaaagagccaaagggacggcattttgagagggaggacagactttgaaaatggcatttcaaagtgatttgacgaaaaagggaaccaaaagcaattggaaacccaacaaattgagacggtgacgaggtttttttttcgttttccatttttaatccctttaaaaagaaagcattttgaagggcaaatttgagttttattttcaaaggattcaaagccaattcgtcagcttaacggcaaagccaccaaaagcaaaatggcatttgaattgaatgccaacgttagaaaatgaaaagaaattgacgcaaacaaacaccaaagctcattgtcaacgtttttgaacccagagaaaaaaccacaaaaaaggatccgctttcaattaattactactgtataaggattttttaattgtaattcattgaaaaaacagtaattaagtttttgtcattagagagaggtgtatttatcatgaggcaataaaattaacacaacaaaatttaaacatcggtgtgatcagtttggcggatcataacaaagttttggccacccaattttggccacttgcttcaacacaatttccactttgcgttcgctgataatgacctgttgcacaaatgccaaaattaagtgtttcccctcaaaaactgttgcattaccacactttcggacggcgcaatttccccgaacagttcgtaccgtttggtggacccgttgatggtcacttccaatgtcagaccgtccgatttggcggatgtttcgctcggaagtgctccctggaaaaaagtcgaaaatcgtaattgaaatcaaattataaaattggtcataatcgctgtaaataccttgcagtaaattgtgatgtgcacttggccacctcgttgaaaccaatcctcgcgcgcatttgtgacaatttctttctgtttgagggaagggggggggggggg

SEQ ID NO: 12393 - DNA, 1389 bp, Heterodera glycines
ggggggggggccagggtgaattttcaaacgtaactcatcatgtgctgtcgaataataccaaaatttgtccgggtttgacccttttaaaaggtttggagtagcccataccgcgtttgaaccggttcaaaaccccatttttttgccatttccacatctcacaaatcaggaatattcctgagcattacaggccacgagagaataaatggtatcaatgttatttatttattttttatgggtggtagactatagtacagccgtatttttctaaaacttggggaacattaggagtgcggcggtgccgacagacgccggcagtaaaatttgtgtgtacgtagccaacagattttgtcccaaaaaattgactaaattttgtgatttagcgaattttttgggaaattgggtaagggagaccttgaaatgagtaccaacaaggaaacccggaaattttctcaattatttttctcttcccttaaaaagtaatacctttttccagcagtgtttgccccgagtgcaacccaattggtccaaaaatgtggtaaaatcggtggttttgcgcccacaacacgaccagtatttgagcccttcgtgaaaaacggcattgcccgggtggaaaacgcactcttcggcatcgctctcgggaccggtgaacacataaaatgggaaaacaattagaattttttaaattactaatttgattctacttttttgcacgtattgtttgtacagtgagctcccgccgtcgcactttgctcaatttctcccccgggcgtttttgtttggaggaccttcagagcagactaaaaacggaaaccaaaaaaaggaatgaaaacagagaaaatatgggatacctcagcaatttgcaaattgagcggaatcatcgctttttctgttgtgaaacgtttacagcagataataaaatatggaaaatgcgcgccttcgcagcactaaaactaaatttttgtcctaatttttcttttcttttgaatttatataaatgttttcgttatggtaaaaaatttttgtatttgtaaaatttgggacttaaaatacattccggaatggaacacaatcagaaacacaattttttacatttgtaaaattgggtctaaaaatacattccggaatggaacagaatcggaaacacaattttttacatttgtaaaattgggtctaaaaatacattccggaatggaacacaatcagaaacacaattttttacatttgtaaaattgggtctaaaaatacattccggaatggaacagaatcggaaacacaattttttacatttgtaaaattgggtctaaaaatacattccggaatggaacagaatcggaaacacaattttttacatttgtaaaatttgggtctaaaaatacattccggaatgga

SEQ ID NO: 12394 - DNA, 4090 bp, Heterodera glycines
  misc_feature (24)..(24): n is a, c, g, or t
  misc_feature (95)..(96): n is a, c, g, or t
  misc_feature (107)..(107): n is a, c, g, or t
  misc_feature (114)..(114): n is a, c, g, or t
  misc_feature (4014)..(4014): n is a, c, g, or t
  misc_feature (4029)..(4029): n is a, c, g, or t
  misc_feature (4045)..(4045): n is a, c, g, or t
  misc_feature (4065)..(4065): n is a, c, g, or t
ttattatagtcgcgagaattaaangcagcaatagtgcgaacggaaatttactcaaaaatatattacgggtaaaaacaaagaagaagcgcaaagtnntagttgcactnttccacncagaagcatgtcaatgccacggaggtgattccgttgtacattgtgaatgtgaaaaaagtccacttaccgaaatatttgctaggcaagagaaccttttacccattaaaacacagggaagttacgtatacttcgattcccaaattaaagctaaaatacaacaaacaacttctcttcaaatgcaagtcacacttaaaggacataaggttaaagctatttatgataaaaatatttgtaatattgttacaatatcattggaaggatgttattcctgtactagtggtgctaattggactctatcatgcaaaacaaattttggtaccgcattagccaatgtggaatgtccaagtcaaaaggtccgagtgaattgtgataaagaaggaaaagaacaacaaatccaactcgcatataataagaaaaatattacagaaaattgtgaagttatatgtcccgatggtaagactgaaattattagctaatctggaatacatacaccaacaagatacaaaaatcattcccactaacaatactaatgaaaaccccactattggaatttcatttgaccaagtaactgatatattaaattttatctattcccttattaaagccaattttttcaatatatttattattatcatattcatactcattatgattttcctaattccatgtctactacctattctatatagaattatgtgtcgttgccttcctctttcgcgcgggagtgtcgcgacaacgcgaaatcctaagataaaacccaaaataaaaaagaggaaaaataaaaaacaatagaaaataaaatggggaaaaataaaacataaataataaaaaatatttttacatttattttggaaaaataatattataaaaaactatcgaaaatataattacataaaaataaaaaaaaaaccttttgaaatgaataacggaaaattgtttgaaaaggaaaagtgcatttcctcaggaatgaaaggaacgaaaattaattaatattaaattgcgaattctgttaaggattgttcgtaaacaaattattaataattaatatattaaagaaattggaattgtaaagggaaaacggaaaagcaaacaattaatgggaaaatggcaaatccaaacggataacacacaaaaacatattttaattaaaatgagaaattgtagcgtactttggtgcaaaaaaatcgtatttaaaggggtggacttttccggaaatttcagattcgagacaaacggttccctccgaagtttcccggcacccgcccaccgcctttcactgcacccggccttcgctgctctctgtctgtgcgagtgccctccctgtccgcgcctactcgagtgccctccctttcctttgccattgtgtggccccttttggaccagccgttgcccgaatgcccttccttttcccatcgccgttctgaccccttttgattttgccacatttttccatttgtgatttatttactgtcaccgtttttgtgcccccttttccccgttcacattatcatgtttgtcccccatttttcgtttccctcaccgtcccgattgggacggtttaattacccaagtttgaggtcgacacaataaacatactcttattaaaattgtgcccaacttggtctatttgcctggacgaaaaccggcacgactcatcgctctccgatcggtcccgaccccctacattcccccgaacggctactctgcgcgcctcgcccatttcatccccttcccgtccccttcaccccgcagagttcgacgcaaatttcttgtcgccacgacattttttgcctatcaaatattcgcaataaatgcccatctatttaaaaaatattctattctattaaaatgttctgtattttgctatatattaagaatagccgtacatctaaaggagtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaacatgtttaacgggccacaaattaatagacaaattcaggcacattcttaaaaaattctgcttttaattagttcatttaatagattatgcttttgctttgtttttttaaattctacgcccgcgattatctgataggacaatgatatcaataaattttcttctgaagaagcgaagagttagcccaaatgttttccttcctttctatttaatgatctatcatttcagatataacagtcaaaatttaatcggccggctaaaaatgaattcggtaggattttatgaaaatagtttgaaaaaattgaaaatttctttcaaagatttaatggaagctagtagaaggatacctttttgagtaatattcgagatgttgccaattgtttaatggcaccccatacctcaaaaaagcattattctttggctaaaaaatatcattagaaaatagcgggcgtagatactgaaaaaactgttcttataattttaaacaattagaaacgccaaaggttacaattatagtaaatgccaaataggttgtaagaataggctcatttgctacaatttagaacagaatgtaatcggcaagaaagggtttttaaactaatttcaatgaaagaacttcataacaaataaattaatgacttttctaaatgaattgcctgcaataaaaatgctaattttctaaattcgcatgtgccaaccttgagcaccttccattaaacaccatcttttttgaggcagacaatcaatgaaactcacaaccttcggttgtaattagtggggctgttagtggaatagaaatgttaaattttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtagaaattgtctatataaaaacaatggcgatacgcatttctgcactaggtcctttttcaaaattgatgtgcttttattgaaaaaacatgtttaacgggccacaaattaatagacaaattccggcacattcttaaaaaattctgcttttaattagttcatttaatagattatgcttttgctttgtttttttaaattctacgcccgcgattatctgataggacaatgatatcaataaattttcttctgaagaagcgaagagttagcccaaacgttttccttcctttctatttaatgatctatcatttcagatataacagtcaaaatttaatctgccggctaaaaatgaattcggtaggattttatgaaaatagtttgaaaaaattgaaaatttcgttcaaagatttaatggaagctagtagaaggatacctttttgagtaatattccagatgttgccaattgtttaatggcaccccatacctcaaaaaagcattattctttggctaaaaaatatcattagaaaatagcggtgtagatactgaaaaaactgttcttataattttaattttacaattagaaacgccaaaggttacaattatagtaaatgccaaataggttgtaagaataggctcatttgctataatttataacagaatgtaatcggcaagaaagggtttttaaactaatttcaatgaaagaacttcataacaaataaattaatgacttctctaaatgaattgcctgcaataaaaatgctaattttctaaattcgcatgtgccaaccttgagtaccttccattaaacaccatcttttttgaggcagacaatcaatgaaactcacaaccttcggttgtaattagtggggctgttagtggaatagaaatgttaaattttttgcctatncaatattcgcaatanatgcccatctatttanaaaatattctattctattanaatattctgtattttgctatatatt

SEQ ID NO: 12395 - DNA, 1879 bp, Heterodera glycines
  misc_feature (1665)..(1666): n is a, c, g, or t
  misc_feature (1719)..(1719): n is a, c, g, or t
  misc_feature (1731)..(1732): n is a, c, g, or t
  misc_feature (1799)..(1799): n is a, c, g, or t
tgcaggtcttaaaatatataaattacaatttattatattaaagttttcttatttctatttcccaattcttaactttagtaccaattaaaaatgaaatttagcaaatttatgaaactttctccaaagcaacagaagttaacggactaataaagctggatttaagacttttagttttttgattcaattacatagttttacatgaattcagaaatgctcccacacaaaatttaaaaaaggtttttgaatttcatcattagccacccgccgaaatatttatggcaaaatgcatgttaaggaaaacaaaaatttcgaaattgtgccgcaactctcagtgcgacacactcgaacaataagttgacacaaaatttatgtctattgtgtgcgcgcaacaactaaatgcgggtaaatgaatttatttattttttggggaccgcccgccgtgggttgggaagggatgggcggagaatcatggtgataaattttcttttgggatgactcttccttcatcaaatgctaaatgcaacagacattgctgcggaagtaaattatgcgatggaaaataaatggggagagaaggggaacaaccaaataaaatatgacaaaaattgcccatataatgaggagtgatggaggggggggggaagtttttcaacggaaccctcctcttttagcagcgaaaatcgctgccccatgattcgtccgggtgcaaattcatccgccggtggggggaggggtcaaggcttagactcccaaaaatgaatgctaaaccaattgaagcaattaaaacaaaattggccatcttcatttcccaatgattggcctacaacgattggcattgtcataaggtcaccgaagtacaaaaattaaaaatagtgacgaaaagatggttgttcaaattaacaaatcttaaatttgaagaaaattgatgtcttttttttttgctaacttgaacggcttaatacgcacgaaaaagaagttttacttagttaaagcttctacctttaattttttcgtgccttttttcatgccttttacattgttttttaaaaaatttcttataaaacgaaaaaatcacccctaaaaatcgtactgaactttaaaaaaaaatttcacatatttactaagttgaaagggcccttgacatgggtgtgcaaaatcaaaaaaaaaaccgacgaatggtggaagcgagggtaagcatgaggtgtataaaatgcctttttatttctaaaatataaaatttaattaaaattttgttccttattgtctgttttttacggttgggtactgtaatgaaggaactaatgtagtgaaataactgctgctgattggccgtcatataaattttctaccatttgctgaataatttcgaaatgttcatttaactgtaaatcggtactgtcatttcgtcaattccggacatcttgtatatatgagtgtgtgtttgacaaaatttgaaacctatcgattctttttttcgaatttttgcaggcaaatagaaaactcgtgcaagttttatttatttaaatgggttatatccagggtagccagatctgaggctttagcctcattttgtggttttttgataggtcaatgaggctaaattttcaaaatgaggctttgaggttttttgtggtttttttgtgaaattttgaggatttttttagnngtttgggaaatttcgctatttttaaattttgattaattgggcatatgttttancattatttaatnnattgggtcgtaatagagcattaaaacgaaaatagaaccatttttttcaaaaaaacacatattttcantaaattttttgcttaaattgcaaaattagcccattttgtggacaattctgtaacaaatcgcataaaaattattaaatttt

SEQ ID NO: 12396 - DNA, 2552 bp, Heterodera glycines
cgacgaatggtggaagcgagggtaagcattgaggtgtacaatatgcctttttatttctaaaatataaaatttaataaaaattttgttccttattgtctgttttttacggttgggtactgtaatgaaggaactaatgtagtgaaataactgctgctgattggccgtcatataaattttctaaaatttttggttttccatttgctgaataatttcgaaatgttcatttaactgtaaatcggtactgtcatttcgtcaattccggacatcttgtatatatgagtgtgtgtttgacaaaatttgaaacctatcgattctttttttcgaatttttgcaggcaaaaagaaaactcgtgcaagttttatttatttaaatgggttatatccagggtagccagatctgaggctttagcctcattttgtggttttttgatcggtcaatgaggctaaattttcaaaatgaggctttgaggttttttgtggtttttatgtgaaattttgaggatttttttaggttttgggaaaattcgcctatttttaaattttgattaattggcataatgttttacaattatttaatatttgggttcgtaatagagcattaaaacgaaaatagaaccatttttttccaaaaaaccacatattttcataaaattttttgcttaaaattgcaaaatttagccatttttgtggacaaattctgttaacaaatcgcattaaaaattattaaaattttcccggcggcgcctatcggcactgtcggacccctgttccccaaaaaatttttggaaaaagagccgcaaaagtaaaaatgaggctttttgacccaaaatgaggttttttgcatgctaaatgaggattttgaaaattttaatctggctaccctggttatatcaattttaccttcaaacgtctgacaccacagtttcatccatccatcagatttagcaaaggttaggcaataaaatccatgcaaattacgttagttttgtgttataccggggattccaacttcatcggcacctttttatagccctctccctccctcactaattactgttttcctagtctagacacagacacagtccattaactcactcctctcgtgaatcgttgcgcgtgactggcgggcacttaatggtcgccccgccgaaaattgtttatcgaccgctggcgacggcgggctttgcgatcgatggaggtttttagtttcaaaactttggtggactactggttgtgtggcaaatccaagagtccaggctcgggatcaggcccaaagaaatgctaaaaaattcaacggccttttttttgctctttgccacccaaaaaatgtgtttattgacacgatttggctatgaaactaccttggcactttcataaccaaatccatttttatcatttaacaaagtttgttctgtttaggaaatagatagtccaacttttttttattataaaacccaaaaactgaatatttagtggcccatattttcataccatggcatgcggcttgataaaaaaaatgattttccatgttgcatgccgtgatgatgccacccaattaattggtcgttaacttttttttctaaggtatcgtaaaaaattaggctttctatagcttataaaccgttttttttttataaattagttttttgctgttactcaaaataagacattcagtccgtgcgcgactttcctcatcgaaataaacgttttctgaaatcctcattttgatgtcttttctgataaaaataaaaataattgtttccactgatttaaatcagcaatagaaagttgtggcgcaagacttattgtttacactgtatttggaaaattgacttattaagttacactatgtttggaaaatcttttttgtagcactttaaaaaaaaattaaatttaaataattgcaatacacaaaaattttaagtttaaaaaacgaaggcaaaactgcaatataagtaaaattgctaagctattttcatctgtcttattgcccttctgctctcctcagtttacacactctttcttctctctaatctcctagctgcaacacacatcaaaatgtgaactattttcccctgtctcgttgcactctgctctccacggtttacacactttcttatgtttctctaacctcccagctacaacagttgtcaaagttgcgaggcgattttgctctgtctcatcgccctctgcctatttcgtggtttttgtgcctaaagtgcctattttaggctttttgaaatgacccaaaaaaaatttcagaaaatacacccttaagaattgaaaaaattttcaaaaaaatgatcccaaaatttaatatatattttttcttaataaaaatttttggtttaaaattttgtccttatttaataatttcatttgcaattgaaatatttaagtttttactttgaaagcgcaccccatttttttaaaaattgcaacaaacagatttcaatgttaataggcttatttttggagaagaaaaactctaaattaactataatccagaaaattttagttaatttcattcagcgtgaatcattcattggctat

SEQ ID NO: 12397 - DNA, 2518 bp, Heterodera glycines
catatgatcaaacataatttcgcatttttcaaccattttttgaagaattttccagaaaattttccttcttttggccacacactccgccgacgcatcatttggtgacacagacaaacaactccatcaatatgcaaaactatgagtaaaaatgcaatgtttgtggtgccaaaattcgtataaatagtcaaaggatggcaccaaaaaaccattggaattatttaataaacaaaaaaacaattaattaccgccaattgcccattggaagaaatgttcagctcttccaatttgtctgctctctttttggcctcctccgttttggccgtgcttataattggcattaaaatggacggaccgacggaggcaaaaggcgccgcccctccaaacgccgcggggccaatgggacttttggttatgatttttaattgtaaaattaaacaattcaaaattcattcagcttttattgaatggcaaacaatcggcggctaatgaaaagggaaaagcgccctctggcgaaagtaagccaaatccggggcagaagccgagcggagaacggcgaaagagggacgttttggggcacgccggcggatacgtcggaggatgggaccatcccattgactcgacactgtaagagcataaatttaataaaaatggcatattcaaaaatgaaaaatacattttaaattaaataattattattaatttgagttattatttttaaaaagtttacaaattaaaatatttcttttgaatttaattgtcctttattttagtgattgggcaaagagtcagtggaatgatgccaattggctcgccgatgttgtcaacagaaacggatgggaaaacaccggcactccaaccggcggacgatgaatcagtgaattgtgccgaccaaagaacgaaagacggcatttttgcttgggaatttaattgactttttggaatcaaacacactttcctgtttaaattttagatagttttgcggttaagcattaacggcaaaagcaataaataaatgggtttaactgttaataaataatagagttgcatattgtttttgtatatttgagccaattaagaaaataaaaaacggataagtgggaattggtgtttattgtaacaaaaaagaattgatagaataagttagaagtttgtatatccgtacaaaaaatgattaaaggaaaacaacaataaatgcagttttttggggatttgaagaaaataattaagccttctgaatggaaaacgaaaaaatggaacaaataacagaaaatgaccaagaaatgaaaaaaagactgaaaaattcaaaaaggtaaattaggcatttcagaatgattgtgccgattaaaaaatttgaatgatggcatttttatttttaattctcatttcgggccaaatacaaaatgacaaaagtattgttgcgcgggttttgaaaaggaagggccgtttcagtccaaaaattattcgaatatttaaattaattgatttaattagtagggctggcaaaaatatgtacaaaaagtggtaaaatatgtacataaatatgtaaaaaaaatcctgaaatatgtaagaaaaataccaaaatatgtaaaaaaaaattttaatggtaatttttggaaaaaaaattcttagtaaagggtgaaataggcacaaaatgccataaaaatgacctaaataggcttagaatcacatttttgtatatttaaatattaatttttggtatctcctttgttgaaaaaaaccaatttttaggggtacatattcaaaaaattttatttttttcacaagaaatttttataaattttcaaaatttctcaaaaaaatttagaaaaaatgctaaaaagtccaaaatatgtacccattgaaaatatttgcaaaaattacaaagaaaaaggaaagcactgacaatgagaaaagtttgggcattttccttttgtgtgatgctccaaaagaaggtgcacaataaatgttcatcaaaagtaatcaagaactaattgcaattaatcgaaaattggaattgcaaatgttcggcaatcattcgaattgtctcgcaaataaacataatggaagattattggggagaattcagcgaagaagaacttttagcagcaaatcgaactccggctggggatattccaatttcatttcattttcagtgagtaattaatatgaattaactgattaatttgaaatgagcagaaaattggtaaaagcaagtcaaaatttcaaatgcatatttgatgactgccgtaaaatattaagtttatttttaagagaacattttttgaatttattatttttcaataacttaaaatgttattttgttttattcatttttcattttctgtgttttttcagttccatccgaagttttatcagaagatgaagtgcacgctgtttatcagttcaaatctcttccaaattttcttgggatttccgacggacttttcccaatcccatttccgaccaatgaaagatatatggaaaaggacagagttttgctgtacattgaaaaagtgtc

SEQ ID NO: 12398 - DNA, 2177 bp, Heterodera glycines
ctacgccccgaccccttggggaacaaattctctgggagcgcgggggagggcaggtccctcccggggagcgtagagcggggaccaggcctaaaaaaagagacggggatttgggacggggagcgcaaaactatcagagatcatggaccgttggggagggcaagtcggagatcggtgaggttcggggcttaaccttagcttacgggcattctctgtgactatcaaatcataataaaatattagaatttctctttgaagcagcacaccgcgccgcacaacacattgatttggccacggtccgtcgccgacaaaagcagcaacaaaaacaagttggaggaggacaacatgacgatgatgacgacgacgagcatgaacatgaacagcagcaacccgttgctgaacaacaacaatggttgcgacaacgtcagcaacaactgttgttggccaacaccgagtcgtccagtcaggaggcggcggatgaagctgatcagagctgttgctcatcatccatcgcctcgtccagctccgttacatgccgtgaggaagtgtcgggtaaattttattttcgaaatttatgggggaaaaaatttgggaaatttttctccaagaagcggcttgaaaagcaaaaaaaaaaacgttgatttatatggaccggacgcacttaattaaaaagccttagcgacatcacttattagggtattaattaccattaattaattcttacccgcactcgtttagattttaattgccattaattaattccctgccgagtgttaattagcattaattaattcctacccgcactcatttagcttctaactgccattaattaattccttcccgattgaatattaattagcattaattaattcctacccgcactcatctagctttaattaccattaattattcctagtccgcactcattaccattaattaatttcagccgacaacaatttggtgacagccgtttcatcttccactgttgctgctgctgatcatttttgtcactctcaacaacaaatgccaaattcgtctgttgccgaattagcggcttctgctgacccattggcatcgtcggcattggcacataaaccggcttctgccgttgttgctgttgatgaacatgactacactaccatggacaaggtcagctgttcgtccgactcattctcccacttgccggtgccgcaacattgtgagtttttttttattggcattagtagttaattaacttttttggcattatttaaaaatattttgggaattctacttttttctgtttagacaatttaaattttgtcattaattaattaatagtttcttggatttaaagttaattaatcttttttgtaaacagtggcaattaatataatcaatcataaccactaattaacattcttttactaatttttaggaatttatttttaagggaatttatatttagttttcttttaaatttaattatccattttctgctttctccaggggatcgtcaacattcgtcaattggaattggcggctgctgccaagaggaaatttgttcctgtgccagcgacagtggggacagttgctactcatcaatggtcggtcattaaatttgaataaacttgctgactcattaattaattaattactaattaaccaattagttaattagggccatatatgtaattactaaaaacagttcgttgccgctaattgcccagttaataattaattagtatcgattacaaggaaggctaaaatgaattgtggtgttaaaccaaaaaactgcgctaaatatttttttttgataaatttttatggcattttgcccaaaaacttttttgttggcactttgccaaatttcctgctatttgtgtatcatttatccgctgtgccatttcaggcaaatggtcagctgaacccgcgtgccttttccttctcgtctaccaccgatggcggcggctcggctggcagcagtggcattggctgcgccggcaccggtggcgcagacagtttctgctaccgcttgcgcggcacggaccgccgcaacgctcgccggacgcatcagtggcggcggcttcagtggacgtgccgaaggccgtcattggacaagggccagcggcgtggtgccgggcatggcggccgcaatagggaggagcatcaccggaactgcgctgcgaataatgtgcgca

SEQ ID NO: 12399 - DNA, 1698 bp, Heterodera glycines
  misc_feature (1421)..(1421): n is a, c, g, or t
  misc_feature (1423)..(1424): n is a, c, g, or t
  misc_feature (1499)..(1499): n is a, c, g, or t
  misc_feature (1609)..(1609): n is a, c, g, or t
  misc_feature (1660)..(1660): n is a, c, g, or t
gcaaaatctcaaaaaagtcatgcattgtcctctctcccctaaaaagaaatgaggcgctggcccgaaaacccgtcataaatctcaaaaaatccggcaccgattccaaattactgtatggatttcccaaaagctcaacaaatccggcacagacccgcaaaactagtttctaaagtttctaatgatcctaaattttcaccatgatcaaagactgacttcaagatttccttgataagttgaatatttcagcaacatcatcatttctcaccgcgcaaccatcagcaacaacagcaccaacaacaccatcagcaaatgacaaacagcatgaacggctccaacatgatgatgatgggacatggctccacaaattgttggccccctgaatcgtcctcctcctcacgcttctccatggaaacgtcgttgatcacaccgttggaggaggacgaaaagcaggtggcagcattattaaatgtttttaattacagagattaattcgttgggattgggaggacgggaaggaatttccccgaggcattttttccggttccgctaatgagggataatcagtgatttttcaatatcttcaaagttggccaattttaagagtcaattttcgagtcaaaattttattggctcaattgggagcaactcttttcgctcctatcttttcgcccttgaaaaactttgaaaaaaatttcagcagaaacttttcagaaaaaaatcttagaaatttttaaaaaaaagaatttgaaattttttgcgatttttttctttattttaatgaattaccaaatacttttttaaaaaatttccaaaaaaattgctgaaactgaattttttttcttataaaaaaattctaaattttccaaaaaaaaaactgccagtttcccctaaattttttaaattacattcctattattttatagatcggcttcgtggacgaggaggaacgggacaagctgtgcacggagatgagccaacaacgggtgggcggcggcacggagttgcgcaagcgggcattctcgctgggctccaagtcgtggataacgtaaggaattaattaattaataaatattcattatttctcctagacattcaatttttgtcgggtagtagtgaggtttagccatgatcgtccaacccgaggccttaaaaactaaaaaaacgaaaatccttaaaaaatagtataattgcaaagaaaaaaaaagtctttaaaatttatcaagtttaagttttttttatattttccaaatgtttttaagcaactttggcgacagatagaaaaacaattttgtaaaaaatttcgttttttttcctgaaaattctcaatacttgttaaggcttaattttctttgtcgggacgaaagacctgctcattgtcagtaagagggggtgctcaaaaattttagttttttctgcttgantnntttcaaattattttacccacctacatatcgtttttcttcaaaaatttactaatttggcgaattttagggggttanattctacaaaatttaaacaaaattttcaacctaatggacctgatcgaattgccattttccagaaaaccgttccgtaaactgtcctcaacgcatcacagcgctggcagcgncgccagcagttcggcacaccaccaccatcagcaacacaacaaccaattggntgcaccaccacacctctgctgatcatcatcctcatcat

SEQ ID NO: 12400 - DNA, 1167 bp, Heterodera glycines
  misc_feature (613)..(613): n is a, c, g, or t
cgacatgtccgtgactgaacttctcctaaggcacatgaaatatcccttgatcacaaaaaaaaaaaaaaattcagaaacggaattcctaggcaccaaaaattttcgatataatgttcaaaattccgatttttcggactcggaaattccttcccctccctggcccagggttctaatacttgaaattcagttttttttttttttttaaatttaaattagctaaattactaacttctcagatgatcattttcggagtgatgaccttgttgagctggaattcatgccacaaaaaaagcagcagcaacaatttggtggagttaatggcacaccggcagcgatgccggtgccattcttgacaaatttcacccatcattcggcacaatgtgtgccgacaacggtcaatgaggacgcactgcggagcagtccaaggtggaggaggccagcaaaaattctgatcaattggaattagagtttttgatcaaaatcgttatgtttgccaacgaaatttttttcaaattctcgatgggcttaattgatgattttcttatagaaccacttttctgagatttttttgttttggatatttctaggtttaaaaaaaatttaatattttcgngggtgggcggggagggaggaaacggcgggtgggtggggcagatgagcttggtcccttttgcattcatcatcgaatctaacaccccttaaacagggtagccagatctgaggctttagcctcattttatgggtttttgataggtcaatgaggctaaattttcaaaatgaggctttgaggctttttatagttttttgagaaattttgaggctttttgaggcttttggggaaaatcgtcagaatctgttaaattttatgattaattttgataaataggcataatgtttgacaataatttaataatttgggtttttaaaaagttcaccgctaaatgatcaatgattattccaaattgaaaaaaaaaccaaaacattttgcaaaatgacagagcgcggacgtcaagctgtgatgagcacaacaacaacagtcagcaacaccaccactgccagcagcagttggccacgttgcaccaactgcatcaggcgaagagcacgccgctgaccacgagccggacaagcgccagcattggagccgcgtttgaccgcagcgttggcact

SEQ ID NO: 12401 - DNA, 713 bp, Heterodera glycines
aactcagtcatttgtaacgacaaataattctttcttttgcataatgggcaaactcagccatcatcttctttctcatcacttgcatcgtttaacaaattgaaaggattcgtgtcaaaaaaaaacaatttcaattatccaatgaaatatccataaaaaataaagtgagtgaagaaataatttaacaattctgctgagggaacgacgaatttatgtacccaaaaacactccaaaaaaccccagaaatttggtaaatttatttcagctccgcctccctctccgccccgcctgttcagtaccaatctttgcatttcccattgcacgccctttctccgtccgtttgctctcctccctcctcattcctcacaatttgcactttcatcccccaaatttcttgtccaaacgtgcgttgttctcgcccctgtcgagatttgagtgttttgttgctcttttgttagcccaagtgcccttctcacctctcctccccccccccccaattgtgatgcataaccatcggagacgaacacaaaatgatgaccaaaagagtgaccaaagggtgaccattgacccttcccctctccccatctttcccccttcccttctcccacactctcactcccttcccattcgcctgctgtaatgaaattatataactattagttaatttttataacataatctattgatgatatttaaacattaatttgattatatga

SEQ ID NO: 12402 - DNA, 1922 bp, Heterodera glycines
actaaaaatgcgccataatttattataaatctttgcggaccatggacgtcggattaaaaaaagcaaaatgtttgggaattaccgcccgctgagagagaaaatctgttgaaagaatttttagaaattgcggggaatttggggggggggggggagagaaggatgtgttgccggcagaagaaaatgcaaaaaggagggaatttcaaaaaggaatccaatattttgcactcattttgccccatccttcgcttttaaattttccaatttttacttttccccgcattttccccgtttctttcctttggccaaatcattcatttaaatgcctcccttttggccatttccttcgcttttaatcacacaaatcctccgtttccgccctcggacgacggattaaaatgtccaagtcatttcgtcaaaacatttcgtcgtctaataatttattatggagggcaaaatccgactgaatgaatgtcagcggatttggggctcaaaatcggctccgatttcaaatttacagctttttcttcttattcatatgtatatgatactggaaacaaagaaaaggatttaaaatttcaaagttttttcggtttcccatgataaattaattttaagtaataatttgctttattcatcttataattagcatatacaatgatttgagagtatctttttttctgaataaagttttccacaacagcaatactttttttttggaattattggacaaatcggaactgttaatttttttcgctttttaacaataaaatggtggtcaatgcaaaataagaaaatggaaagggattggagtgggggataatccgttgctaaattctcaaaaaaaaatcctcaaaacgatgcacaaaaaggggtaaatgccgcgcggcactttctgtaattatggcaaaatgccgacagacaaaaaaaaatgaaaaaaattgagaaaggtttagtgaaagtgtgaagaaaaaagagtgagcatttattttttgtttgctttggcactttttgtccataaaatggcaaattgcggcctttgccattcattcgttcgttctcgaaaggaaacagaaaaagaacaaaagaacgaaaaaagaacaaaaattattattatttatcaacagagtgaaggaatggcaaacattggaaaaaagggagaaaaaataagggagggggggggggggtaaaaattgaaaattcagtgagaaaaaaagatggaaattttgtagaagatgggtcagtcgacctttttgcgatttttcgtttttttccaagaattacaagcaaaagaaaattcatagaataaaaattaatgaaataatttttattttttatttaaaaatggacaatatttgagctcagcaaatgagcaaagagcagcagatgtgctcacacttacatttaacatggtcaatagcaaatacaatgtgagtgatacaataagcacttgaccaatgagtgaaatgcaataaataataattgaacgaagtgacaaaagcgaaaagcgacggagaaaaatggtcaaaaattaaggggaaaagcattgaaataaaagggaaaacacttaaaatgctaatttggaaaagaagctattcaaagtcaaaggttgtctcaacgtcctggacatttacggcgtgacatttgaagtgcagacaatttcggcactgttaccaatttgcgggccgaacttacagcgcccaattaaaaagacaatttgcggcggggcctattataaattatttccatgacaatgacggggtattttgtaaggaaaaagatgggaaaatggttgggcgattaaggcacaaaaagcgggggttaataagagccataaaagaaagggcgaagccgcatcacatccttattatgtaatgggaaaatgaaaaatgaatatttatgagtaaggtgggattttaggagaa

SEQ ID NO: 12403 - DNA, 1886 bp, Heterodera glycines
  misc_feature (20)..(20): n is a, c, g, or t
ccgaaaacccgtccttttgnctatgtaagaaaataaataaaacaatgtaaccactttatgcactgatagatgaattaattagtgttgcgacaaaaaaatgagtttttttaaatttttggatgcatttttgaaaatttttcaaaaactcgatcctaaggggtgaatttttacagcaattggggtgagaatgaatatgaaaattaaaaaaaagtgaaattgcaaaaaaaaaataaaaaaaacacccgccccccttaattacaaaatttggcagaacaatgccgaaacgcgtcgcctgattcggcatcagatgagcacactgtgcaaggaagacactttctgtgcatcggtgaaattttagaaatggaaactttcaaatgattttaaatttcaaattgattttaaattaatgccaatgctttctcatttctcagtgcattttgccgtgtcgcgaatcgctgtacgaattcgacgtgtgttcccacactttgtgcagggtaaaacaaacatacccgacaattcactttgcttttccacttttgaggacactcccgacccaacgcattgtcgagagtcttgcgttttcatggaacaaattgcggccaaaaaggcgggccattgcccaccacaaaaaccgtcggtccccgtttcagtaaggcaatttggcaaattttttattaatttttggcacatttcgaaggaatgttcggcattttgtgacgtggacagcgattgtgccgaagtgctttctgcgaattgctcctcaaattgctccgaattcaggtggaaaaatgctgcgtggtcggctgcagtcgcttttgtctgtccccgtccctcaacgactcgcgccttctcccgcgccccgagggcataaccgtacacgagaggaagaggaaacggtaatgacattaccgtaataccagggagaagggcccttgttggacaacaccgtattgtgaaactacagaaggacaaacactcattttttcaatttaagctcggccattttgcgatgggttatgaagcgattgtcgccacaacacaccgccacaaattcgaactgtatttgccaaaatgaaaattgctcaatttgcttttttaagtgtttgtcatccaatggcgttggtccgtccacaaacaatcggacacaatggcaccttggcaaaccgtgggcatttttgaaattactaataaaaaataagaagaaattcttcaattctaaaaggcagcacttcacccattatttttttaaattttaattatttcttcttttttcagattatggtgcgcaacaaaatgtacgccattcttaagcatttgctttcgcccggccgcttttacattttccgagtggcggcagtgaatttgcacgggacatgtgagaaaagggcgaatgaatggggtgaaatatcggcgaatgtccgttcagacggattttcggagccaagtcgcccgcccttcaaattgagcaaagaagcgaaggcaccgccggtggggggaaagattaaaaattcacataaaaatggagaggaattgaaaatattcttaaaaagaactaaaatcattttatattaaactttttcctttggtttagaagctttaaaacacataaaatacattaagaaatgggcaaaatgttaggccgtgggtgggaatcgaaccaaacgtgcccacccaaaccgtggggagctttgccattgagctaccaagacacatccgcccggcttttattaatcccaattttccgcattttaacctctcattagccatcttcttctttacagtgtcaatgcttttccgtttaggcaccactcaatttgacttttgtttacgaccctttttcaccaacgccaaaaattgttggaatgcgccaatttcggaaattcctc

SEQ ID NO: 12404 - DNA, 2176 bp, Heterodera glycines
  misc_feature (11)..(11): n is a, c, g, or t
  misc_feature (17)..(17): n is a, c, g, or t
ttttataatantgaatnaggagtcaataaagcaaaatttcgctttgagatgggagagcgaaaggaggagggcatgaattaattttcacgtcccaaaatggcgcctttcacgcaaacgcacggtccacccgagggctgagcccagtcttattgttggcaccaattgggacggcacgacaccgcacagactggttcggctctacgggtagaccggacgcagcggcacggcacaaaatggaatggcacgggacggcacagcgcaaagaaatgacgacaatgcgaatcaaattttctttattttttcaaaatggcgcggagatgatttgcaacattttttttataaatcggggagaattttagttattttttgttggagattagtgattgttgagcgaaagggattttttttcaatttttacttaatttaataattgctttctcgcccactcaccgaaatgctttgatgcgtgaaaagcctttgttcggttgccattcccatttcacatcctcgggccaaaagtcgttgcgccgtgcggagagaaaatgctaaaaaaaaacaaaatcattttttttctgtaaatgttgtaaagttgcgctacgagtcatacacggggtgtcttacttaacccaagggccatacgacggacgagtgggacagtgacaattttggggaagggggtggcaggcggtccgctgtgccgaggggggaggggtgtgtcgagacacctcttgtgcatgtatgtcacgtgtccatcgaaaaagcggcttttttgaagggcgaaacaataaaaatcgtgaggcagcccgttacaatgattttgcgacattacgaaaacccaaaaaatagtttatgcttgaatatggagggattttagttctaaatttgacggggaaataaaaaagtggcaaaaattaagggacggctaaaacccccagaaaatgctttcaaaaatctttcactaaaaatgacaaaaaagaagcataaattgttgtacaaaattggtaataaatatgtctgaaaaacaaaacctgtgtcaacccgtagaagtgctttgcactggtcacattgtgcaccggaataccaatgcccatccggtggtccatgtaatagtgctccatttcgtccatccaaaactggaccgactcgtccccgatggtgtgccgagtgttggcaaatgcgtggaccatcgagcgaatcttttgccgttcgtccgggtcgcccaagttgggtggattgttcacaacaatctgcaaaaaataataacttcaaaaatatttttaaaaaaattttgaaaattataaaacaaaatgaaacaaaataaattggcgaattaaagcaaaaatttccaatttaaaatgggaaaaaagaattccagctggacggatttgaaccatcgacctaaggatgtcaattgaacaactacagtcctccgctctaccaactgagctacagctggacacaatgaagccaataacaaaatactttataagtagaaatttttaaggcttaggttggaacaactagttacaccttttaatggataaaaactaaaacgaaagaataaaatttgtataaaacacacttataaaaaaaatcaaatcaaaatcaaaatgctgttaatatattcgaaaatagttcgattttatctaatttttggttaattaaatccattcctacaaaattacgtacactgttcgaagaaaaaaatggaaaaattttgattttttttttgtttaatttgccattttaaaagcataaaaaaacagacaacgaaaaacaaacaaaaaaggtgtgattattgtagagactgatatattttaaaacaatcttaaaggaatatcttaaaaagagcccacccagacgggaaatggtgctctcccaaaaataaattcttgacacatgaaaaaagggggggggggggtttcttggttttttttgtttttgtaaaccaaatttttgaggggaggccgcaaagtcgaattcgacaatcttctttttgttatgttacttttaaaaatgcttttatatcaaacatgaacctgaacggtggcgccgtagtgccaaaaatagttctctagcgcccggtagtgggggatggcatacgagtctttgaccagcaggttgaccggctccaacccctcgcgcaactgactgcacccgtacacggcgaacacca

SEQ ID NO: 12405 - DNA, 2069 bp, Heterodera glycines
ttcttagaaagctaaacgaaaaaaaaaaataacgattcgctcccccaaaggaaataattagagttttaatagtaattagtcacctctttcccttctgtttaaaaatttttttataattttttcttggcggagtttcgcagacggagttttgtcctgctccgaacgtggagaggggaagtgtacccaccgaaattgccgcgtccgccatcgcttcgcccatccgtcgacagacgggcgaggcccgatttgtccgtcgaacagccgcaatcatcaggaacatgttgtccacaccgacagctaaattatttttgaattttaaaattaaaattattttgcacccaataaacaatcaaacaacaaaaaggttgcaatttcaatggaattaacagaaacatttatccctgaaggctcatttcaggtccgttgaaactcaaatcccttatttataatttaaatgtatacaatgccatttaaaatggcaaatgtgggcattttagccaaaaaaatttttcttcatttgagggaaaacagttgaaacgaaattgtgggttatatttttttaaattcagttttaatttttggacgacggtgcctttttggtccattttctcggacagtaaatataggtcgtcactttggcagaccatattttgaaaaaaaatttcagcgtttttttggtaaaatttgcgaaaaattcaaaaaagctgctccatcggtacttttcggttttgtgcctacacctcaaaattttaaaaaatgtcaacaaagggcgcgctgaaggcattttagtatgcgccctattttggggccataaatgcaacaatctgaagcaaaatttcttcaaaagggtccacattgcgtcttttgcaatcctcgcgccaaaggaactcgcacaaataggagttaagcatcgctttcacattatgtaatttatacgcaaaattgggaggggaggacctttaccgttccgttaatttatgctatgagaatagtaattgtaaaaaatgccttcagcgcgctcttgccccacacaccaatttttacgggctcggcacaaaaacactcaccaacaaccaggaagggcatcacgccgacaatgtcgttgtagggcaccgagcacatgttcagcagtccgatggccgtcacaatgcccatgccgcgttggccacacccaaaatggccagcaccggcttggacagtgtccagtcaatgtaacagttgcgggcacgacaggtggacatgttgcacaacacctgcaaattataggataaaggcaatgaaaaatttgaaaaactgtgaaaagttgggctttgaaccaattttcgtagcaaagatttcgccaatttcaaaatattttgcacatcgtgccaattatcgacatggtcaaaccaaaacatttgcgttgtgtttatcaaaattgagacaaaaaaaaatattaaaaattgtttcttgaaccaaatacataaaaaatatatattggacaaattaaaaattattgggtgctcaaattgagttattcctttaagcatgtggaattgtcaccaaaaataattgccatagtttaaatttagtccgctgaaatttgaaaaaaaacatcgcttaccgagaacatgatgaggatgaaaaaggcgaacacaaaacggggcaccagcgtgtccgcgttgcgtttcaactcttcggccaatgtctgacaaaaaaaaagggtaggcgggtatgaaaaaaaatacatacagtaatcaatttagcgcaaaaaccaaagccaaccgtaattttttttattggactattgccaaaagtaattggttgcttacaattaactgtctacaatttgcacccaattgtataaaaatttcggattttacaatgcttttaggggaaaatttttttgtttcactcaggcgttggctatcctttaaaaatatatcaaaaactggctttttggctctgttttttgatttgattttttaaaatttcgattttttttgcaccctattgttattccataaaaataaaaaaacctgtgagtaaagataggtgaagctgatgtatgggcttttgtaggtgcgaat

SEQ ID NO: 12406 - DNA, 1073 bp, Heterodera glycines
  misc_feature (269)..(269): n is a, c, g, or t
aaaaaaaaaaaaaaaagaaaaaaaagcgggtgggggaaaaaaaaaaaaaagggggggggggggtaaaaaaaaataaaaataaaaaaaaaaaaaaaaaataaaataaataaaaataaaaaacaaacacaaataaataaggataaacataaaaaataaaaaataaattgaaaataaaaaagagggaaaaaaaaaaaaaaaaagagaaaaaaaaaaaaaagaaaaaaaaaaaaaaagaagaaaaaaaagagggcggggggggggaagaaaanaaaaaaaaaaaaagaaagaaaaaaaataaaaagaaaaaaataaaaaaaaaaaagggggggcggggggaaaaaaaaaaaaaaaaaaaaaaaaaaaaaaaaaaaaaaaaaaaaaaaggggggggggggaaaaaaaaaaaaaaaaaaggggggggggaaaaaaaaaaaaaaaaaaaaaaaaaaaaaaaaaaaaaaaagggggggggggggggaaaaaaaagaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaagggggaaaaaaaaaaaaaaaaaaaaaaaaaaaaaaaaggggggagaaaaaaaacaaataaacaacctaaaaaaaaaaaaaaaaaaaaaaaagaaaaaaaagaaaaaaaaaaaaaaaaaaaaaaaaatggggggggaaaaaaaaaaaaaaaaaaaaaaaaaaaaaaaaaaaaaaaaaaaaaaaaaaaaaaaaaaaaaaaaaaaaaataaaaaaaaaatgaaagaaaaagtaaagaaaaaaaagaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatacaagaaaaataaaaaaaaaaaaaaaaaaaaaaggggggggaaaaaaaaaaaaaaaaaaaaaaaaaaaaagaaaaaaaaaaaaaaaaa

SEQ ID NO: 12407 - DNA, 5485 bp, Heterodera glycines
atttgctcgtgaaatgcgaaccatcttcacattgaatgtcggccaatgtttggccgatgtcggtgtggcacgagtaaaagaactgagctcccgtcgcacatttataacaaccagagatgttctttggtgttatggcgcacaaactctggtgcatttccatggacattcttagactgtccatttgaatgttcaattggaccggactgtatccggttatggcgaatattcgcctcccgatattccgcaactcgtaatggcggaacgagagcggaagtctccgctgagggtcttccattagaccctcgagattggcgacgcgacaatggcacgagactgtcccgtctgtgtgatcgggaagacagcccgtgcatgcgtcaattcccagagtacagttgaaagcttgggcggctttcaagtctgtacaatggaaagagtccgtgattttctcacggacaagggcgacatttcgcccttcaatcaggaagtcagcgttcaataggggggccggtgcttggctgacccctattgttgaaatgctgatgttgtgccatttgagcacacgacctggaagaagcacagtttcgactgtggcacttcttccagtggtagagtcgaggcgaagttgaatatggatgccaaactcccaagagttgcatccaatgacttcgtaaatggctgatgagcgtggtttggcaaaccacttgtagaagagacaagaactggcggcgaggagacattggtttccccaaaaagccgtgctgtcgatgcagaaactgttcccggggaacatttctgtctccctcagctctcggatggctgtggagggtcggacttttgtacaaaagtctccgaaacatgagccagcagacggacatcgtttgctggctatggaagcgatctcgtgatcgtttccatgccttggtgaaggcttggcattcgagggagagtcctttcaagatcacttgaagggttcccaaaatgagaccatcatcggtctttattgacaggacattcggttgtcctgccgggagaagcgcaagagtcacgcttcccttgacttgacacattttagttgtgccgttgttgagacagctctctgatttggccattatggccactgtctcaattcccccgtgtacaaacgggagagatgccatgacaagcattgccatttggctaactcggccactggcccagtttcttgttgctggcctgggccggcgtattcgtcggtgaggatagaggaggttttcctcctcctcactcaatacccatgtctcttttcgcggcttgaataagcgcgcgaacaagactgagaaaatccaaaaaaggattctcagtcctgccatggcgtatcccaccatggaacacatggtgaagatgaagcacaagagacttagggacaggcctcctgccagcattgccgcaatgacaggctggcatgttggattcacaagttgtgtgaaacaaaaatagcagtcgatgagatcacattcatcgactgccgggcaggtcgtgtttgatgtgaaggtgtgctgtgagtcagtccaaaatctggcctcacagtgatgattgttgagtaggacttcgattggtagttcgaagttcaaggctttgatgccttgccgaactatgcagctttctgcacagcatatttcgaacttttggatttcgggtggcactgttacgacgattcctttcgtgtaacaagtgaggccacactcatcacatttcccaattgggaaaccacttgcatagggaagagcaagtgtgagaatgatcatggccactactggaagcatttccagtagtttggcctttcttctggtgaccatttgatgtcccggctctcgagcgagcttgggatggttttcatttggctgttcagttgcagcaacagcttcagttcctgggtccgtcatttcaggacccgcttccaaagggaagatgcggttcactggacgagtaaggactgtctttcgtggcatgtcctttggtttcctgttgttggtccctcggacagggatttcaactttaacacttcggatggctccaggccgtccgtgtgtttcaacgattcgtcccattggccattgattgcgaggaacgaggtcctgagagattaggaccaccatccctttcttcggttcaccgaagttttggagtcgtgggcctttgtggtcccactgggctctttctctgagtaatgttaaatactcagagtgccatttggcccagaaaacgtcgttggcttcccgaagtgcttgtattcgggaagctagacgttcgtgtgtggaggaaatctgttcctctgaatcaattgggtctgttgcggtttcccaattgatctgaatctctggttgtaagagattgatgggacgcagtggaactggtccatccactgcgtctgagaccgcagtaatcggtctgtaattgagggtggcctccacttcggccacgaatgtgttgagttggtcgaaggaaagaatccttcggcccaaagttcgcttgaagcagtccttgactagcttcacgaggcgctcgtaaaagcctcctgcccaaggacttatttgggcaatgaatcgccactggattcgattatgggtcaggaagttttgtacttcctgatccggccccggagcactgagaagctccagggttttctgagcgagcttgaatgtcgtagcgttgtcgctccaaatgatgtcgggttttccccgtcgacttatgaatcgacggagaacattgatgaatgattccgatgtgaggtccaatgttgcctcaaggtagacagcgcgcgtggcgaggcatgttatgatgaggatccatgcctttattttttctccggccaacgagattgtcgttggcccgagatagtcaattccaatggactgaaatggcgcgtgtcggcgcactcgctcacccggcaagggtggcatggttggtaatgcaaattgttgtgcattcattcggcgacagagaagacagtcccgaagagctcgtttaacatttaaacgtgcacttggcatccagaattcgctcaggaattctgtcagagtagtgtccactccaaggtgatgccttttttggtgccgatccaagatgatcagctttgccaaagctgaatgcttggcaagaagaatgggatgagagaagctgtacggcttctcactcatctccagtctggttctcagacggagaattccgtcgtctccagtcactgttttaaagtgctggaattcttcagcgtcatccatctggtctaggcggatgagaactcgctccgcgagtgcgaagtcttccgccttgaagtccccagacttggaaatctggcgaatttcctttctgtgcttcacgagtgaagcaatcggttcttcgcctcttttgaacattaaggcgaggaatcttaatacgaacattgttgttcgcataaggcgtttccatgagctgaagcgtgaggggtcaattaagacctgctcatttggctggtttgagtgagtatgtgcgagaaacgcaccactcgggccaacattctctgttgagtctggctgttgatccgactctgttacttgaaaacagagttcgctgggccaatggtgactcgcttgtgcgagccaaggtggccctttccaccaaagatgatggttgcggagctccgaaggagttgctccgcgtgttgcgaggtccgctgggttgtccccagtacggacgaaatgaaaggtacatccgagacattcttggatttctttcagccttcgctcaacaaattgtggttgagtttcatgggttttgacccatgacagagcgatttgtgaatcgctccaaagatgaaggctggcaattggacggcgcaactgcctttgagcaaatttgagtgctctggtccccaccaggatggccaaaagctccatcctgggtatcgtgagtgcctttgaggcactctttggcttcaaacgatttttggagaaaatcagccacgcttgaaccttgtcgttcatggcgcagcgtacgtatatcgcggtcgcgaatgtgtggaccgatgcgtccacaaaagcgtggagctcaattgactgtgtgtcattgagcattgctcggcgaggaactctgatttcctcgtctttccattgtctttggatagaattccagcggattgagtcctcttctgagagggcatcatcccaagagtggccctccttccaaagttcttggaagagtcgtttggctggcaaaatgcatggcccaaggacccccaaagggtcgaagagcgatgctagatggctgaggaccagtcttcgtgtgactggcctcaatggatcaggtgttgggaatttgaagacaatttcgtctttctcggtgtcccaaggaaggccaaggactttggccttcggcttatcaagctgatcctcctgagggatttgtttcatcacctcttttgagttagagatgaactccctcaggttgaagcatccttgttggaggatgtccttggaaaatttgtatttttccaaggcctcctgtaccgtctcgcactcgaggagtacattgtccacataaatggactccgaaatctccctggacagtggggagtcgaactgttgcaagtgatggcggagtgtcgccgccaaaatgaatggcgagctgacgaccccgaacgcaactcggcaaaatcgaaatattgccaagttgtcgggagtcagtccctttgaagtgtcctttagccagaggaacttcgtgacctcccggtcttccggctccaatgaaatttggagaaatgcggcttgaatgtccgcgagaagtggaaaagtcgggcaacggaaccgaagaagcatgcctgccaaatctggcagaagcaatgggcctcggaagaggcagctgttgaggcttggtgttccgcgtgtgtgtgcactcgcgtcataaacgacgcgtagctttttggtgagcactccatggtgaaggaggaagtgctcaagctgtccaggagccctttgggcctcctcgctgatgccctgttgcagttgatcgcagatggtggcatcgtacttctccagaatttctggagaatgtcggagtttggttagcaccgatgacagcctgctgtgggccattttgaaattggaagagaggtccggattggactccttccacggccatttgacggagtatcttccgtcagcttcctgacggatggatttgttaaacagcttcagagctgtttggtcgtcatcctgggcaggatcatcctggatccccaaggattcgaggttgaagaaatgctcaacctcattgatggttggcatttgttctacattagtgctgtggatggccatcattgagagagctttttgatttgagttcggcggtccaatgttggactcgccatttatcatcgggccaaacgatgtgttgatcacaaacagcccgggagacacttctctcttcccttggaagaattgccagaagtgtcttgcgctgaggagtatcattg

SEQ ID NO: 12408 - DNA, 4564 bp, Heterodera glycines
cgcattccgtgccgcacttcgcaaatgtcgcgtcttttggtctccggtaaattgaaaaacaaaaagagaagagcgatcaaaatgggctgaattgcttttacgttattttcacttttaatttttgctttttttttaatgactgaccgtaacaaaaagcaaaaagtaagcggaggcaacgccaatggaagcgcggagggggaggaaaatagcgagaagaaaggtacgactgatcagatggaaaccgaagtgatcggaagtggacagaaatacctgatcatttggcagagattagcccacccttgggcagccgaacgcgcactttgctcgacgagttcagaggccaaaaagtaacagatgggaccggggccaaaggcaaaagcgacggtgaaaagcgaaatggccacgatcagacagaggccgagccaactcagctgatcggaaacaatttgatcagaaagccgatagcatttaatttatttgatattcctttttcaattgccccggcgatggcttcccttcccaccaacttccgtcttcgcataagcatacataaggccactgattacgatgttcatcaagagaatggccgttaacgtgacaagaagcagacgacgtcgtccaaaacggtcgatcagaagggcggaggcgatgttggagatctaatgagaataattaatgtggtaattagcggggaaggaatcaaaagaattggtaccaaactgagcagggcaaggccaacattgtcaatggaagcccaatactcagagacaccagtggtacggaaaagctccacagcaaaagcattgatcactaacggaaggggaaaaggcattatcacaaggcaaatttaagaccggcaattccgctgaatcccatggacaatgagacgacgctgccaattctgaaaatgaaaaacccaagtgagaattgacacttataatgggtgacttaaaaagtgccctttcggttggctcccttttgctttgccagccgaaaaagtccgatggaacggtgccgaacacttcgcagagtttctcttctcagttcgcccattcgctcttccaaaatttggcccgaacaattatgataaaatgccaaagaatgtcgcgcgagtgtttcattattacgaagcaaaagaaaactgaactcaaaaagagttttattggaatgtgaattggcaaacctcggactttcttctgccaccattgtcaaaatgattgttgtggccaaaagttgagtgccttcgattgtgaacattacccaccacaaatttgaagagcccaaaacgcgcggaattgccacgaaagagccaaaaacagtgccgagctgaagcaatgcgccggtgctcatcgaaacaaaaccacggcaatatttgggacttaaaattcgaaaagggatgccattgacagaaccacgggaaagcacctgcactcggccaagaaaatgccagccaacccgagacataaagccaataaaaagccaatggcaaaacgagaaaggcacagcaattcgaaccgattcagcttaaagcaaacaaaaaaaaaatgaataaaaggcattggcatacaaaataggaaaaggcactgcagaaaaggccgaaggtgcacaacaaattgctgaagaaaagaactcgaagacgcccaaagcggtcagccaacggacggatggaaagagagccaaagatggcaccgaggaaaagcattgagacgatcaaactccaaaagaccttttgcggaaagaggggggggggataattgtgggtcactaccaaaggagaaaaaaagaaatccctctggaaaatatgccaaatttcgatttcgtacctccaattgttttgtgtccattctcttcccataatttatgtgaagcgatgagttgagaaacaaaagaaaggtttgttgggacggatttgtgatggtaatttgaatgccaaagtgaaaggcaccggagagaccgaccaaaagggcgaccagcgaaaggcgcaaagacggcatagaggaagaggaaggagaagcggacgaaggaggaggaggaggagaagcgggggaagaggaaggacgaaaagcggatggaagaggaggatggacggaagaagcggcagaggaaaagcgacagtcattcattagaaagatggaaaagcaaatgaggaagcagaatagattgatgaggaggaggaagagaagtgaagaaaaagaatggaattggaagaggaaaaagagaaaggtaatttgatgggaggatggaagtaggaaaagaagaaaagtgcgggaacaaatgttgcgaacgcatggaaaaagagccataaatgggaagtcgacccttccattgttgaaaacatcggcaaatatttgttttttaattgaaaatgaattgagggaaagtcaaatactatgtaaacgggataaatttattattaaaaaatatctttcaaattttaaattgtgcctttgccatttacacaacaaaaagtctataaattcataacttttattctttttttaatgtttaaattttctgagatcattagcgtgtctgtctcgcattaatagatgagcaaatgatgagtaataattaattaattgttcaattaatggtcttttgcctctctccgtctcttcgctcactttggcactttctctccccccttttctgctctctcctccctattttctgctgctgattccgtcgtgtccttctgtcggctgttgctcctctgcttgtggtaacggtacacagtgtatttccgattggcatttatattaacggaagtgctgtggcatttgcgaagcattgaaatcggaggggacgaattggacaacggcgagtggggaggggagaaagagtcgcggaatcgcctgctaaagagcacaaattgggcaattagtgacggaccgagcggatgaaagcattgagaaaaaccaaaaagacagctaaagcaccttttgttgagcaatatgcttcggttggagcgaaagctggactgattgtgggcggatgaaaactgattggttctgctaattcgtctaattagcgtcgtcgtttgtgctccgcaaattgccggcagtgtgccgctgtcgccgaatgcgaacgttgtccgtttgcgacaatcgccgcgacttttgaaaatgccgaatcggtagagaaaggggttgatgcaagtgctgacggatgactcatcagaaattaggccatagataattagtaattacctggccagcagaatggactgaagccaattgaaatttgaggccaactgttcgcactttgactcgggctcacagaccacgcgaagaagtgccatcacctgagaagcattgaatgattgattcattgggaagggggaggggaaacacctgataaggcagccaactgagcacgaaagtgcacacaatggcggcggttgccttcagaaagcgcaattttgtgttttgctgaagccgtttgtgctggtcggtgttggccaaacaattggactgacgcagcgaagcgccctgatggcgaagggacaagccgatggagacgtagcagaacaaaatgacacccaaagggatgtagaaggtggtgatcacatggaagaagtggaaactgaagcggcaataaggtggataagaggaaaaaggagagagaaaatcacacatgggcgaatgaggggggggggtgggatcaatgggggataggcggcacaagaaagggggatgaggaggagggataacaaaggggatggggatgtaaagaaaaagcgacaaaggggggagggggaatcaaaagggacgagaaaggaggggggggtaagggggagagtgccagcaatggaaaagtgacccagaaaaaagtgccaaaaggaaaaagacactgaacgggaaaccaaaatggagaagaacttacacaatgatatgactggcgttgaacccttgaagatggtagcattggacgaacggcgtgtgggggatgggccgagtgccacggaagacggtcatcggaagagcgcagagaatggctagcagccatgccattgcgatcagccaagtgacacggcgatttccgtttgggacactgcccaatggcactctgagaaaggcacaggtcaatttgagaatgaaattgacaaaagaaagagagaagccgaaacgaaagccaatgagttaccgaccgaatacagtataacatgtcgatggcaattgcggctaccatattggaccagagatggaaaggaagtgcggagagaaaggaatacattttgcaaaggccgttcccttgggtccagtgaatgttctgaaggggtcactggtcatttcaggctctttgcggtggtggcatgggatgacgcgttggcttcgccggcgccgaacgcgtgccgcacgcagcagacgacgcggcacaaattgccgcagcccagcgacacttcgccatcctccggcgcctaattttatttttaaatttaattgagaaacaaaaaatttataagatttttaaattatctaagtaaaaatatttatttatccgaaatggaaaagaaatttatttaagtaaataattgaataaaataaatatttactttaatatt

SEQ ID NO: 12409 - DNA, 1024 bp, Heterodera glycines
  misc_feature (9)..(9): n is a, c, g, or t
ttatttttncactcatttttaaaaatattttataataccatattaatttttcttatagttttttaaggaataatttttacaaattaatattattttttcggcttcatcttacttctttaaatttttatttcaagtttttagggaatgtagtagtaaagctgtgccaaaactttgtgcaaacgaaaaagattttaaccatattttatattttaaattgataataatttcgtaaattcaaaaaataattgtttatttttgctcgtcttcatataagtttttgatttttgtgaaacattaacagttttatattaattgttttttgtttttctttacgtgtaattttaaagctgttttttttaatttaaaatatataaaaaatattaaaaatatcatttttaaaaaattttaaatgtttggcgctactcaaacgttaatttatttgatttacgatataatattctgaagataatcatatatttaattatttatttcacattccactgtcgcagtgttttttctctaatttattaaaatatttgctttccatgtgcaaagttcacaaagcatgtctttttgtgtgaacggtattacagacaaatgttatagtataatttgttttttaataaatatattatgaataattttatatttaaattgcataaccataaataaaagaaaatgggtttttttacaattttattttatttacatacaacggttgtttcttattttatttaatgaattacatttaataattattaaaaagcaatcaataaataattttaattcctttaatttattttattagttaaaaatttaatagttattgaataaataattcttcacaaatcaattgttgtctcattttgttttattgattacgatgttaaatatgcaattataaatatattaattttttttataagttcatttctgtaattttaaataactgcaatttttataagttctttcgtttaatattatgcatttttattttctatgcataagtaaccaggttaatatt

SEQ ID NO: 12410 - DNA, 1856 bp, Heterodera glycines
tcagtcagaacaatcatatatcaattaaattcctaaagacgattaaaatttgaaaaaataaagaaaaattattataaaatccatttgataccattcaattgcccgtaatcaggttaatgcattcatgtgacgaacagaaagttatgacgaaaaacgttcaaaaactctgtttttgagtttctcaggttataacttttttgatacttaatgtattttttgagattttgcaggataatagaaaaatcaagcctttaaaatttggaaactttaggcaatgaataattttttgtcaaaaattttccatttgatgatttcaaaagtgccgaggacagtttgtaaaatttgtctaaagcgatttttgtcccaaagaatttaacataatcgaaattttaacaaaagtttaaactccatgatcaaaatttttcaaataacttttttcacaaggtgcaatacggagagccggtgctaggtcgtttcctaaaaaccgccaccatgggcgtttcctaaaaaccgccaaatgggcgtttcctaaatccgccagggcgtttcctaaaaaccgccatgtggtaggaaaacaaaaaatgtaagacatataaattcataacttggtccattttcaaccaaattaataattcttggtatcattcaatagctctaggtgttttctatcagaatataattttattaaattttttacttaagtatataaaaagatatggtaattaaattccacaaaaccttaagtcagaattttttgtccagaacttttttgaaactcaatgaaattttttgaaattttaaagataaatagaataaatagagtacttgaaattctaaaaagaaaatttaatctatttgcttctgaaaaaaagttataaatcattgaacaggctatgttttttgccatggtcatgcaaatgtaattaaaaacatttaaatttttcaagtcattaaaatgcaattaagtcaaaatgaatttatatattcgatacacctaaaaattctctattagcttgtttcaaaaatttcattgaggttcaaaaaagttctggacaaaaaattccgacttaaggttttgtggaatttaattaccatatctttttatatatttaagtaaaaaatttaataaaattatattctgatagaaaacacctagagctattgaatgataccaagaattattaatttggttgaaaatggaccaagttatgaatttatatgtcttacatttttttgttttcctaccacatggcggtttttaggaaacgccctggcggatttaggaaacgccctggcggatttaggaaacgccctggcggatttaggaaacgcccatggtggcggtttttaggaaacgacccagcacggacggaactgacccctacccgcggttggtcgatcgacgaaaagtgcaaaattagctaaatttttgagtaaatcaactcataacttttccctgacgcaaccaaattgcacaatcttggtatcatacaatagcccttcaaatgcattattaattgtgagctaaacaattttccttttaatgtacactaaaaacttgaaatacaattcactttatgtatcgaaaatgctttaaatttacgtgcacttgtcaccaaaaatgtgaaattacaattcattttatggatcaaaaatttttcttgggattttcccttgtaaaaatggaagagccgatctcgagttaaaaactagacagctaaaaaataaactgtgattcgatagagggggtcaaaatatgggcctatgcaaaattttaagaagattggtcaataggaaaaattttttttcaaggacaaagttttttctttttcaggtttaaatttccttcccatttt

SEQ ID NO: 12411 - DNA, 3912 bp, Heterodera glycines
  misc_feature (105)..(105): n is a, c, g, or t
  misc_feature (133)..(133): n is a, c, g, or t
  misc_feature (3694)..(3694): n is a, c, g, or t
  misc_feature (3704)..(3704): n is a, c, g, or t
gaatggtcctcgaaacatttagcagattttaattaaaaaatacaatgaaactgatcccgtcaacgccaccaacggaatgcgcattgtccaccgaattcagcggcncaatgacaacctgtttgaaaccgtttcncagagacattaagccaaatctgacgattaaaatatattcttacgggatctagcataaaatatgagtgcgaaatgccacactagtaatactaaaaataagtgatgtctaattctttatcgaataaaaaaaatatttacaattacttacaagaaaatgtacaaaaagatttggctctgtgcacttaatgtgtccactcgacttttaggcgtccaatcaatgaccacaactttttctgaagatggtcacttacacgccaaaattggaggagattcttcctttctctcccgcattcactcttcctttttcttctcttcgatggcttcttctttttgttcgatattttcgttgtatttttcttcaatttcacaaaaaacaatttgattcattgccgaacaaattgcaaaaactgggccactgaaaatcggcaacagccaactgtcgttgaagaagtgagcagaaacgatgcgaatgatgcgagaagagagccgatgccaacacttggtgggagaattgcaaaagtcggaagtattgcaaatgagcagcaaagagatggacaacggatgaaagacgaaaaaggcaataagacgaaaccatttgcgattacttagaagaaatgcgtgaaaaagggaatggtagaaacatcacccacaaaatcagcgtggaaattgcttgaggaagcaaaagggacgaaagcaaaagagccaatgggaaatggacgagactcagagagccgaggaacaacgccagctgaacagcgagcgcaaaacgagcgaagtgaatgttggcacgaagaggagaactgctgaaaaaagtcagtaaacatagagttaaagtgtagaaactgacatcggaatgagaaagaaaacgccaagaatgaacagagggaggagcaaagtgagcggaacagccaatgttcttgcagggaaacggggatcggcgtagaggaacagctggagtccgtagaaagagagggccaccaaaggtgcaaagagcattcgagcgagtgccggactaacggacgccaaatgcacagcaccgcccatgcggaaccattcacgcactgcctgaacaaccgaatgaacaagtctttcatgacagaatgaaccaaaagcagtaaaggcgacagcaaaaggcccatcaaaggcatgtaaaaagccaccgaaacgaatcggtgagggctgaccaatacatacaacaaataggagtggtggaacttctccaaaaggttgttcaaagagcgcacagcaccctcaatcaaaaggactgtgtcaaccaagtcgacaatggtcgatgagtgatgctgttgttccctttcttcgtcattatttttcgcagtgtgcgcactcaaagccaccgcattaatgccgtaacggccgatgacactcgccaacgactcgacttcgttcatgctctaaaatgttgcagatacgatgggcccagtttctgacgaattacttgtgccaaaataccgcgaatgacagttttggccgatttttgataatcttcgtcgtccatcccacgattctgaggcactccatgaatagaagtcacagtgccggctttctcaaccagaagtacgcagagattcagcagatccatattgggcagtttgccattgaccttttaaatgaatggatcgtaaaacaaataaaagcagaacccaccatgctgaattggagatcaatgtgggagaaaatggttccagaaaagtctaaaacataggcacctattatttggcctccatgaagttcaagatggaaatcatcatcatatccgcccaaagattttatgaaggggtgacgatgcccgtgatagtcagcgaaccaagcttcggccgcaactttgtcgcctccatcgatgaacaagaaaatcaaatctcgggcccagtaggactgtcctatacgaagtgtgaatcatgtccgtatgagtcatcttgggcccatagccaaaaagggagcacaccgacaacatttgttttctcatagaatagggagggcatttgtccctctcccttggctacgagccgaaatggcacaacttttagcataatcagcaaaagctaaggcaacagcaaccgcttcaatcttagaagaacgcattgggacagcgagaagaatggactcggccgggttggcacgaaaggaacggacaattccatagacattcactttatccacggaagagttagtcttaaaccttcgattattgtgattactaaactgaaataagcgaattcgaaattgccaaaaaagatgacggagtcagtctgaacgagtgtttggccacttcaacgcccatttcgaccagagcattaacgatgtaatcgcgaagttcactgggaataggaaaagcctgtctcttcgaatccaaatggcatttccaaaccatcacctctttttgtcaccaacattcctgcgcaaatccctcagaaaatggtccagtttcgaagtatccttccaattttcctcaacaagtccagccagcagcgcgttttcttgaattttcgctttctccgtaccaaaatgagaaataacaaaaacggcgtatgcgaatgccaaaaaatggagaaacaaagagacggggccgactcgatcgatcagcagccgaatcagtttgggaggcttggccttggaggtcccaataaattgactgcgaatcatcgcactcaatcaaatgtgtgaaaaatagttgaaacgttattagagtaaatttgatttaaaacaaaagacaaatgcaaagaaaaatgttaaaatacaaagttttattattttaatcattataaacaatattttgaatttaaaacagtacaatatgaaaatgaggtctttcaaaatgaaaaaaaactggtacttttccattatgctgacacaccacaaatttattgggctttatgctgacacaccccaaatttattgggcttttatgcttcttaaataatttttgcggcgttttaaaggacgacgacgatccattcgatggcattttagcgcaaattgcggcctttatgcctcctaaataatcgttgcgtgccaaaactgtttggggtgtgtcagcataatggaaaagtaccaaatattttgtgttctttttctgtctatttaaatacctacatatttcgcgattttccgtcagttcattttgtattttcctgtttccgagaaaaattaataaatatgtatgttgcgtggtccaaaacaactatataacaatttaagggtttctcacaacataaatgtctttttttcatgttgaaacaaaaactacgattttggtatcattcaaaatagtgatcaaatatagtcaaaaatggatgattagtgaataatttgacgcataggtaaactatgtttagaatactctataaagaataattacttaattctttctcttcaaaagcgcttttccgttgtaatgaaaaacaaacgctgcttcggatgcatggacaccaaaacggtgcattttaaacatttcttggaccttttccgggttttgtgtacacatccaaaattttagtgacaaaaaacctttttgtgccatccaaaaactccgtgcatcttttgntacatttttntttaaatttggggggtttgtacacacaaaaccgaaaagttacccatttctcgtccataaccttttttgtgtaccttattggttttgctttttttcagtggcgtttatgtggcagcatctgtcggcattttgctcaacattgtcactggcattgcattacttagcacgagacatttttgctggaggcgttcgtaagttttgaaaatgaa

SEQ ID NO: 12412 - DNA, 1940 bp, Heterodera glycines
tttgaaatcagtaaaattttgaaggaaattgtagacatcaaaaagcagcatttataatagcaaaaaaagaaataaatggtaaaatcacttttctgctgaacaaagatagtgaggacgccattcggcatggatgccaaagagttcctcgttgtcctgtcgaagatggtcaatcagttgctataacttgggagacgtgttgacgaggacaacttggtggacgagggacaattggcagactcactactattcaatatgttggatatgtagtcgaatgacaatgtgtttaaatgtgtgaaaatgtcatgaaaattggataatatcactttcgaaatagctttcggattgaaatgctcttctgtagaaaagttcggcgccccaagggacgactcaaaaagttgagagggcgaaatggcaaatgcaattggaaatttttgcgatggcatcaaaacaggaaaagcaattttaaaaaattcattaattgcaaaagaaacacggattaattaccgaataaaattaggtaaatggacaatcagagataccgaaataatttatccgtctctaatacatcatctgagaagagacaattacataaaacattcaaaatatatcacgagtgatacattcaaaaaaacagtcagtgaaacggaagaacaacaacaatttctcaaaacatccaaattttccacctcaatcttcggcattaacttcttcggcagatacagtctgaacataacatggaatagaaaattaaaagaaatcaggaacataaacataaattcatttacatgtgtagggaaaacccaggcaagcaaattccaaatttcaagtttatcagtttttctttgttacctgcgacgtgtcaatcggtgacgttctgcccaagcggtacagacgagccaactgacgacgaatacaaagcagatctaaaaaagatataattgcaaaaattgataaacataaaatatttactttcaatatgggcgttgcattctccttcatttgcccttataacgtcatcgctaatgttttgagcatagaccaaaaccgagttgatacaatgaaccaattcgattttctaaattctttttttattgacaaaaatttgtttattttgtttctgccttggacttgtaaaaacttttatgccaaaaatggccatattttcctagtaattagcctacttttttccttccagcattcttgcggattagctcagctctaacccatgaattttgtttctgccacacaaaacaatcataggccttggaaacccgggtgaaggcccatcgaatgtcaaacggaagattggaaatgagttcgaaaagcaattcggatggaattctcccattcttactccccattttttgaatggaaatcatgggagaaaatggcgcattttgtacttttcaaatagaaaaatgaggcggaaagaaaaaaagagagaggccgtgggaaagggataaaaaaggattatagtaaatcatttaagtattttctaataaaaataatgtacaagcgtcatgttaaaattaaatcccttcttacttttgaaatggaagaagaaacgggggacaggcgacgcttaaaaataatttaaatagtattacaataacttctcagatcgtttaatattcatttcccacactatctactatatctctctcttcttttcagctagccttcctccccccttagttaatttagttggatactgtactaattagattttataagttagatgctttttttctaacttttttaatcggcggagtgctcgtgtcgatgcccatccgttggcgcttccattgcttatccccatgatccatccgacggactagcatcagcaaaatgcaatcgttgtgctgcgcccactcgggcaaaccgacaccgtctaacggcaacagatcgacatctgaaagaaataacaaatcacagacggc

SEQ ID NO: 12413 - DNA, 2454 bp, Heterodera glycines
ccgctttcagcgtgaacacataaccgtctttgattgtcgggtggtcgacaaagtccagcacaccaatttggttttccttgtcgcagaaagtaacacattcgctgtatttgtccaaaagttgccctcctataaaacaatttttgtaaaacgacatcaataaatggattgagagaaaagcaggaacgaaaacaagtgcttaattacataccttcgggtttgttgatgatcatcatacacaccttctcatcccagctgtccctcagctccaccacgtacttccaaacagcgcacgagtccgtcagtccgatcaaaaagatgcgtcctcctccgtcaccgcttccactctgttcgccttccgacacggttgtcatcatctcacgacccgcttttgacactgtaggaccaccactcaaaggtgtgcacgtacagtcgaagaatttttgttccctccatatgaactgtcctctccacacgtcattgttctcaatgtatggaggcgttggaagctacaaaaattttttaaaagaattttaataaacgttaggggtaatatcaaaggaagaacagtaatttactcccatctgtgctgccagacagacattttatttcgttgttaaattagttccattggcaatattttccctccctagcctcacccaacttttaaaatttaaattatccctggggacaaccagcctacaaagcacaagatgagaattttgtgataaaactgacttaccgacgcttggggactgccttgggctacaaaatgagtggcggcgtcagtggccacagcagcggactccggtaccaacggtgacgaacggtctgattcggtcacagcagaagggtcgagaatagcgaccgatgttgacgaagcctaaaacacaaaatatgttagtgttgccaataatttcattgtctcattaaagaatgacacggcacaggcggttcggcaccgctaataacaatttcttttctttgctgacagccaaaatttatgccttcatgaaccgtttcgttttgacacataggtaaatgtggagcccatatagattttaaagcatgccaatttttggatgtaagtttacactttggcgactgtcggcgccgaactgactccgacccgaataacacgaggcgcaatgtgaaaccactgaaaatcaaacctcagtatttgtcacgcccggattttgctcttgttccattttaatgttgtaaacctttgaagtcaattaggtatatacgtattggaaccaaaataaaagcaattattgcatgtgtggcagttgttttattaagataaccaattaacaaagcacggaggttcgaatctgttcagtgacactaattttccgaaaaaatagcttttcaaaaattattttagtgtttttgcggctctaagtgcactttaggcatccaatgaacttttaggcgttcaatgttcattcttggtttcattcgaaggctcatagagagaaactaagcaattgttaaacaattgggaggcaattgtgcagattattggtcccataaaaagagaaaaaaaacaaaaaaacatatttttaggggttatttgatgagctgagcacgaatatgacatccattttggccaatttcaaaccaggacccgaattcgaacaaaaagtcgaaaattcaaatttcgatttagcacttattctaaaattgattaaaactagcagaaaataaatcacaggtaattttaacagcaaatgagccattctatgcagattcaaacatagaactaaaattcaaaaaatttaaattttcgtctttgttcgaaatctggtcccgggttcgaaattggtcgaaatggatatcttattcgtgatcagcgaacccgaaaaccccaggaaagatttttatttacatgactttaaaaaaattttatttttaataaaaaaataaataaattgttcgaattcgggttcggggttcgaaacaaggccaaaggaagaccaaattcgtactcagcgcatcaaataacccctaaaaatatgttgtttttttttgcctttttattctttttttttgtgggaccaataatcttcacaattgcccaattgggatgtaccagaaaagttgcgacccttcaacttttctttttttgcgtatgtttattagagcccggaattttgaaatggccgggacttggaaaatggacccgtacgggaccgggacttggaaaatggacccgtacgggaccgggacttggaaaatggacccgtacgggaccgggacttggaaaatggacccgtacgggaccgggacttggaaaatggacccgtacgggaccgggacttggaaaatggacccgtacgggaccgggactcccgtttttccgggacccccttcgccccactacttgctccgtcttcgcatgctccctagggagaaaatttacttcattttgtttatccatttttcgttggt

SEQ ID NO: 12414 - DNA, 2722 bp, Heterodera glycines
gcaaagaaaaaaagtagaaagcatagagaaaaacaaaagaaaagggggacaagagaaaccggtttaacaggtaaaagggcagagaaaaaaaaaggaaaaagaaaaaaaacgaacacatacggtcggtaggaaaggaaacaaaaatttcgccgccaggcactgtctgccccgcagcagcaaaacagacgcacgcgtgcggttgtttacgccaaaatgtgggcgcatcacttaataatttggtcaatttgatgggcggtaggacgggagcacaagaggggtgcaaaagcggcgagaaatagtgtgccaacatggagaaccagagaaagagagacatgaattctctcctagctttagccatctgccctcttttgttaggctttcatttccacactattttcttgttttctctccatctttgccttgccctactcactcccctcagtttctccatggtgccctttttcttttcatgtctgccctcgctttcccaattttatttcgcccatttctttgtttctcatccttccccctactcgtgccacacactctcgtcagtcaattgatattccttccgcagcggatgctccaaattggtgaaaacaaacggcgccacaggggagcggctgacattgaaaaatgaaaaagggggggggggcggtggcaagaagaggaagaaacatccaacagctttttgtggaattttgtttgtttggaaaaggaagtcgtgaaaagcatagtgaagccaacaatcgttcgactcgtgtacagacagacagttcgccaactagacatttcgtcaaagggtcatttcgccaactcaaattttgacttttcgccaattcttctcgaaatcgaacacaactagcctactgtatatgctctaattatagcccatggggattatttttcaacctcctcagaaaagggggggataattagagactgggggattatgatagagggattatttttcaaaacacctcgtagactgggggataattggagactgcgggattaatagagactgggctataattagagcatatacggtaaattgatattatctttataatgaaaaaatgaaaaaattagcataaaatgcacctaagcaatgaattttaaaaaataacacacaaaatatggaaaataagaatctttacaaagtctgaaattcaagccttatgtgtctgaaaattaggcgaatcttgggttggccagctctcacttcctgataaaaaatgatataaaatcgcgaaatatggccataaaatatcagccaaaaactgagaaatataaacataatttgcaaaaatggacataaatttttcaaatttgaaggtataatttcttaaaatttcttcaaattcaataaatctaaagtaaaattttcaaaaatggctaaacacacatggtattacatttcattttataagaaaatagtaataaagctaaaatttactattcttagcgaaaacaacatggatgagaaattttcgctattttgcatatttttcacacagtttaccaattttttcagaaaattttcagatcttagggatcaaaaaagtcaatttagttgatgagggccgttgtaatagatggaaaaatgtcaaaatatggtcgaatatggaaataaatcgccaaattttgaaaatatgaatatagaaatccatcctagtagcttcaaaccaagctaaaaacaagcctttcgtgcatttcagacttcacacagtccaggaaaaaaaaatatggctttccatataattatcagccctagtcataaatgaacacgactcatctttcattctacaaaaaatccaggcgttttgcattttcagtgggtaggctcaattaactttttcaacaaatttttttgttctaaataatgaatcggtaccattattgctttaaaattttctttttgctgttttcttattcgatattctttacaaagatatttttttgaatttttatttaaattttttttttgaatttatttcgaaattaattttactttgtttttttaaaaattttatttttacatttcaatattattagaattagttttaaaatatttcgagttttttgaattttaattttagaattttattttatttttaaaaagtgtcatgtgacaaaaaatggattttttctttttaatctattatttttttaaatatacactaaaaatccctcaaatatgccctaaaaacccgaaaaatgcccaaatatgcactaaaatatgcatttaaaaactgccaaaatggctacaatcaaaaaatgccaaaaattatgtaaaaattcagaattgactttaaaaacaccaaaacaaaagctagggagcatttttttaaacaattacaaaaatattgaagttacaaatttttaaatttttgaatttcaaaatttacatatgcaattttgaatttttattttatgctcaaacaaaattacttttttgtatcttttgtatcaaaattttttttcaaaagttcttgcaaaaagtccaaatttttcgatttccaagcgtgtattttttaattcccaaaaagtcgatccttagtagtgttatttttcgtttttattgcatttttcttataaaaatttgccaaaaaggacctaaatatgctctaaaaattcaaaaatggcaaaatatgcaagattctcgaaaaccccaaaatatgcttttatatgcttaaaaaaccttcaccaaatcaaaaaa

SEQ ID NO: 12415 - DNA, 2438 bp, Heterodera glycines
ttgaaatttagagctctaaaattatataatcgttataaaattatggagcaaaagtgcatgtataattgcaaatataaactttcataaagcaaaagaaatggcctttattatgagcaacttttttgaaatacaaaccttaaaaatagggcaaagaacgaaaattctggaacaaaattaaatctccgttttattagtttttgtacgacttttgcgttagtgaatttcataaaagtcaaaaattgacctactttatgcggttttcttgaaatttagagctctaaaattatataatcgttataaaattatggagcaaaagtgcatgtataattgcaaatataaactttcataaagcaaaagaaattgcctttattatgagcaacttttttgaaatacaaaccttaaaaatagggcaaagaacgaaaattctggaacaaaattaaatctccgttttattagtttttgtgcgacttttgcgttagtgaatttcataaaagtcaaaaattggcctactttatgcggttttcttgaaatttagagctctaaattatataatcgttataaaattatggagcaaaagtgcatgtacaattgcaaatataaactttcataaaaacttacaagaattaagcaaaacaatagatttctcatcaataaattccatacaaagttacagaaccaaacttaaaaaattgttggagatctaaacatatccaaatgtgtaagcggcttttgtccttcttttggattttttatttgaataaagtttggaaatttgatatttttatttttcgtaaaatgccatacactttcgagtccttctcgaagatcggtaaattgttgttaattttttcgttttcaaatttatcatatatgttaaattttcacgtaacgcattgtaaactcattatggctaaaaagaaatgtcattttcgtgatcaagacaaaaaattagcctagaaaaagagatcggagaggacccggtttttactggattcgaaaaccggtccaacgatttttggaaaaattcttgattgaccggttttgagaggccgggtcggaaaccggttgcttttgaaaatatcagtccggtccggtcctgacatttttgaaaaatccgattttaacaaatttcgaaacccgttcccaagtttgaaaaagtcgaaaattcaaaattttcaagattcacttttatgctcgtatctgtatagaatgattattttttgatgttgcactggttcgtggttaaatacagtttgttttaatcaattttggaataaaagtgcgaattttgaaaattttggattttaaactgttcgagttcgggaccgggattcgaaattgtcaaacgaaagttagattcgtgatcagagaccctcaaaacctactaaaacattttttcacgaccttatagaagaaaaaaaaaattttacaaaaaaggatcgaccatcggcagttatgtattaacaaaaatctcaataaaaacttgtgtttaatttcttggattttttctttttcccctcagcccccccccctgctacgccgcacttggccctatttattgtttaaatatatttttataaaaaaatttattgcaatatttttgactttggcgcctcggctttagtaacacatgcatacatacttattgcaattgaaaatttagccttatatttttgcattttctcaactactgattataaatgttaaacggcaaccgatacatgcacttttgctccataattttataacgattatataatttagagctctaaatttcaagaaaaccgcataaagtaggccaatttttgacttttatgaaattcactaacgcaaaagtcgtacaaaaactaataaaacggagatttaattttgttccagaattttcgttcttgccctatttttaaggtttgtatttcaaaaaagttgctcataataaaggccatttcttttgctttatgaaagtttatatttgcaattatacatgcacttttgctccataattttataacgattatataatttagagctctaaatttcaagaaaaccgcataaagtaggccaatttttgacttttatgaaattcacaaacgcaaaagtcgtacaaaaactaataaaacggagatttaattttgttccagaattttcgttcttgccctatttttaaggtttgtatttcaaaaaagttgctcataataaaggccatttcttttgctttatgaaagtttatatttgcaattatacatgcacttttgctccataattttataacgattatataatttagagctctaaatttcaagaaaaccgcataaagtaggccaatttttgacttttatgaaattcactaacgcaaaagtcgtacaaaaactaataaaacggagatttaattttgttcctagaattttcgttcttgccctatttttaaggtttgtatttca

SEQ ID NO: 12416 - DNA, 3021 bp, Heterodera glycines
catccagcagactgctgctgcacagccgcacgcgtctgttcactgtatgccctcccacccgccgctgccccgcgtagacagacagtcagacagcgcactactatttgccacctttccctccctctaaccaccacagcacggaaagataaatcttttccctttcaactatttctttcgctttttcttttcctatactatttcttttgccttcttctttttctaaactatttcttttcatctctttttcttttctaatctctcctcacagcaaataacataaatacaaaacgccacattcaaaccatgttacaaacagacaaacactcaactttattatataggattatacataaaaatagattatacaacaagtgaatctttgaatttaataatcttaaataataaaataattattaaaatggtaactaattgatttttttatttgtttaaaaggcaaacaaaatgataaaaatttcattttaatattttttttacaaaaactacaattaattgctaggaatatttgtaggaattttacatttatttgttgctcaaaaatagttatttttaaaaatatagaaaaaatgaaaatgccaaatctctcaaaattattttgtgttttatttgttttttcaacatttattgaaaagacaattggtacccccaaaaaaggaactgcttctccactggaaaagcagagcaaaaaggcgatgaaccaaaactgggaaaagaagacaaaaaattggtgaacaacaaaaaagaattgctaaaaaaagaggtgaattaaaaatatattttaattgaaattgaaatttaattttaatatttttgattgaaaaattgcaaatgcaaatgggccaacagttgaacacaattttggaagaaaaaattcctacttttgtacttgaagtgaattaaattgccgaaatgattgacaatgaacaaaagccattggaacgcaaatttattcaacaattgatagacaaagtgcgaccattgtacggtaagtgaaggaaaaagtactgtaattttaaataaaaataaaatattaaaaaaagtagttgatacgaagaaggaccatctgcatttgtggtccaaattgcgcattttggggcatgacaagcagataaaagatgacatatccaccacggaactgttggtaaaaaatcttatgtaattgttagacactagcgggtgcgtgaaccgtcggctatttagctgggaaaaagcgcttcgcgctttgggagcttcgctacctagatttgatcgaattggttggagagatttttttgaatttttaaaaaattattaggggtttttagtccacatcgaggctcaagacgggcgcttcgcgcccgtttttaaatttgttggccttggacgggcgcttcgcgcccgttatttaaagtttgttggttcatacgggcgcttcgcgcccgttattcaaattttgttggccttacagagattagaagaggtacaacagtgattaaaagacgtcaaaagtgattaaaagaggtggtacatcagtgattagatgaggtacaactgtgagtaaaagaggtacaactgtgattagaagaggtacaatttgatcgtaaatatacacctaccctatcccgagttatgattttttgaaaattccttcaaattcccagtggccaaaaaagccggaaagtgattaaaagaggtacaaaagtgattagaagaggtacaagagtgattagaagaggtacaatggtgattagaagaggtacaatagtgattagaagaggtacaacagtgatttgaagaggtacatcagtgattagtaaattcattaaattaaaatgaaaatattttttaacaaatttaattaatttattaactcaaaaaatattttaaatgaataaaaattgaaaaacattagaagaggtacaacagtgattaaaagaggtacaaaagtgattagaagaggtgcaacagtgattataagaggtgcaacagtgattagaagaggtacaatcatggtttaaaatgaaataaataagaaaattgtattattggatgtattataaatttatcaaattaaaaaaatccttttacttattaaaaataaagttagaaatttataatatagaatatttattgaaattaaaaggaattaatttctcgaaaattcaaattaaataaaacaccttcgatttgttatgaattttcaaattttaacccaaatttccaaggaccaaaaaattgaaaaatattttcgaatttttaaaaaattctaaaatttccaaaacttaaaataaacattatattcgtattcagcacctcaaaatagcccagaaaaaaatttttcaccctctttttcaacccaaaaaaaatttccgaaaatttctagggggcctagctcgaaaatttttgaaaatttccggccatataatacactattcgatagcattttaaaagctctacaattttgctctaaggcaatttttggctaaaaacgatccctgacgagttataggcccgggactcaaatgtcccgctcaggccaaaaaatttttctatttccgggaaaaaatcgaaatttttccgaaaaaataccaatcgatagagctcgaaaaactatgttttggaagtggtctccgtttctctgggaaaaatcgttaaaaaatcctaaaattcaaaaacccgaaaaccgttttttaggcctaactcgaaaaattttgaaaattttagaaattttaaaatttggaaaaatgcagctttaaaaactctacaataagttcgctggcaccccctcgctcagaccaaaccctgacgtggtattcacctggtactgaagtgggaaaaaaaaattaactgagtctccgtgtctgtacaggtccgggatttggtctgatcaaaaaataaaaaataccggattatagaggacacttctgcggagtgccctcacagcgggcacaaaagcgcttcgcgctttgggagcttcgctacctagattagctctggttttggagatttggaatttttaaaaaa

SEQ ID NO: 12417 - DNA, 2496 bp, Heterodera glycines
gcccatctcttccagtttttccgattcttgtgccaatgaaagttcttgttccaatgtgaactgttcatctgaaatgatttcacatatgagagatattgaaaaattagtttaaaatattataaaatttaaattaaatttttgtttaatccacccactttttgctccgattggtgccaattcgtccagcgccttttcattttgttcttcttcttcttccggtgatgaaatggtcctggtggaagtcgtgaacgaaaagtggccaattgccttaaatttcaaaaaaataaacttcgattaaatgcttcttttcaaaaattattgtgattttttattttgtaattgataaaattcatctgaaatactgtatgtttactgtataataataaaataagttctctcattaaccccccccctattttttatttttaaattcataaattatcatttgaaatactgtatgctactgtataataataaaataaattctctcattaacaccccccccccccctattaatagccaagcactaccgaatgagaacgttgctgatgaatggcgctggtgacatgctgaaccaattctaggtcgctttccaaacggcgaatttcagccgcgttttgcgcatcattctcggctttctgtcgtcggactttgtcgagatcatctttcagttccttgttgtttttatttgctttctcaagagctgcttccactttgccaagtttgtcagcgtagtcacacttttgttggcattcctcggcgactgcctgtctgagcgctgccttcgcgacttcgtctttgtgcgccttctgttgcaattcttccaattttttgctctgctcctcgataattacgtcctgaaattgtaagaaagcataattattaatttatataatttaatttaaaagtcatatttttacgacctttttctcagtttgttccaactcgagatgaaatttcttttgcacacttttatgcaattcggaaatatgggttttttctttcgaacaatgttcggaatggcagtcgttaatgtcagtttgtgtagaattgtcctccattttggcttcaaaatttaataaaggaaaaatggatttaggacaaaaaataagtgaaatattgtcaaaaattcgtttgaaaaatgaggagaaaaaacccaggggcatgtcgaattaaggagaaacgagataaaaatattgaaacaaaacaaaacggattgggttgaatggcacaaaataagaaagaaaaaaaataaagaacccaaaaattaaaaaaaaagaaaatattaataaccttaattcaaattagttaattaagaggatgagagagcaaaaatataaaaaatgaaaaaaacccaattcagaatgccaaaaactgaaaaatttggggggaaatttcatagaaagtcgaaaactcagagttgattatgaaagtagagcaaagatttaaatttttatatacgaaataaaagaaaattgtcaatttatggctaagaaaaaagaaatttagtaaaaacgagttgactagaaaaactaaggttattgagcaaattaatgggataagagactaattaaaaaatggcatgccgatataatgaaaagaaatgagatttgaaaaaagtgagacctatttatacaatttctaatttgcctaacttagaaataagttttaatccgttcatcaaatttcaaatatctttccgaaatgtgccgccagcacaatcagcaagaagaaagtgccaaagtacgatggaaaggagtgacagaattcgacaaccggatatgtgaacaaatgtgggaaaaagagataagacaaagacaaagtgttgaatttttgattgaagacatatttgaattaaccgtgtaattaggcaattaatgagttagttaatgatgacaaggcacacttactcatagcagtgttatgtagtgcatttgattagatatttgatggtttaatgatttttgatgtttagataaacattcagaaggaaaaaagagtaaaggatggcaaaatgatagggtagttccagaccgaaagaaacaaaaaatttcaaatcttcatcgatgcctatgcaggggtgggcccggatgcgcaaaaaattccctgaattcggatttagggcctaaaaaatctgaaattccggaaccggaattaggcctgaaaagggagaccaaaattttcgaccattaccgaaagtaattttttatgttggtaaaggttgagtttctgcaattttgtttcggtaataaaatatgaaaaatgtaaaaaattagaaaaagttgaatttttcaaagaaaatatagagaagaactttagatttttaaggaactagaattttttaaaattcaaaaatttctataaacatttgttttatctaaaaatgactaattttttgaaactcaaaagtcagtaaaaaatgcataaataattgaattcagcaaacatatttttttatgactaggtctatgcaagggcgtatctaggggggggggg

SEQ ID NO: 12418 - DNA, 1801 bp, Heterodera glycines
agccattgtcccttatctgccgcattaattttctttcttgttgtaatcacaaacttttggcaaaaagacagaaaattttgtcactattttgcattgttcattgtttttatttattgctaattttttaaatttcattttattttaataaatattaaaaaaagataataattttttgcccgaattttacccaaatccataaatttttaacactaaaattaccgtacttactgaattagtagctccgggggttctatttttcaacctcccccctcgaaagggggggttctaatacagaggagggttctaattcggaggggggtacgaattcagtaagtacgttatctatgcctttttttatcagaattataattaaaattgtacaaaaaatgaaacgttcttcaagtggaaacgagtctgacagtgcgaccaaaaaaattaaatggtaaaaaattctttttttaaattgtttttccatgtaaaaatcctctacaggagcccaccggaaaaaataaacttcaatcactactggactgggtaagttatgttataataacttaataattattacttttttaaaaatttaatttttcaataattaattcatcttttaggaaggttacgtttgcgcagtactgggacgggtaaaaaatataatgttaatatgttacttacaatttttaaattcagaggctaccttcctcctgaccccgaatttgcgaattggtgagtcagaaatattaaaaaaaatgtaaacaatataataaaatgggacagttttttggcaattcttcggttcttttctgttttgtgccccctctaaacaatttttttttaaacttttttctatggcaatttcaagcgctgaaaataaatcggaaatttatttaaggctaacaaaatgtttattttaataattattattttttattattattttgttaataaaaataatttaaaattattgaataacagagcaaatatttgttattttaaagaaaaaccaaaaatttttctgaatttcatatacaaattgtattctgttttgataatttttcactgtaatattttaagcaaattgttttagcattttttataacattttttgcgggcttcctaagggataaaagttctcaaaaaagcgctaggggctaggaaatttttctgcgaaaaaaatagaaggccaatcacaaagagtaactaatgctctaccaaatctcccgcaaatttaaatactgtgcgggattactccgcggtagcctgatcaaaaatagaactttcggggctctagtcttgacctccctaaaatggtgtttggcacactcaaaggtttctctagccaacattatttggttataaatacaagaaactaattactggctttatagaaaaaaaatcaaaattagaaaacccgaatttaaaacccgaatttagttttttttttttttgaatatccaataaagttttgcgttattggtcaaaatctgttataaatcagtccaaagttttaaaatctttttcgagtctaggcaacccttaggaatttttcctaaacttttcccaattttcaatgttttttgggtgtacaatcaccataaaggaatgatctgatcaagttagtgcaagacttttttttaattataataaatttattttttgtcttgattttttcttttttaaataaataatttattaattactttatgatttcataaagaaatctgttgttttggctttattttttaaattttttcatggcaaaatatgttaatttaaaacatcaaaatcggcaccgatctgaaaa

SEQ ID NO: 12419 - DNA, 1336 bp, Heterodera glycines
  misc_feature (1319)..(1319): n is a, c, g, or t
gaacaaataggcaaaaaattacaaaatgaaaacgaagaaaaaaaaattcaaaaaaattagtataaaagtggttgctccaccgctattttcattattattttttcatcgtttatccatgataatgcgttcaaatgcttttctacatttacccttatctgaattttaattttaaaaaacccattcgtcttaccattataaatttagctaatatgagttgcttatgcttatcttcaacaaaatctgcgtctgccgctgcttcctcttcttcttcatccatcgtcattggtgcaacaactttcgtcaccgtcgaaacttctgtgcgcaccgctggaccgtcgtcttccattgctggcacttcgacacatccgaaacaccaacatcgtggacatggatctcaaacaaccggcacggcatctgcttctaagcgtatgtttgatgtaccaaatttctatttaatcattcaccattcgtttttaaggacgccgtggcactgtgcgcactgctggaacgtcgtcttccattgctggcgcttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcgcttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcgcttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcacttcgacacatccgaaacaccaacatcgtggacatggatctcaaacaaccggcacggcatctgcttctaagcgtatgtttgatgtaccaaatttctatttgatcattcaccattcgtttttaaggacgccgtggcactgtgcgcactgctggaacgtcgtcttccattgctggcgcttcgacacatccgaaacaccaacatcgtggacatggatctcaaacaaccggcacggcatctgcttctaagcgtatgtttgatgtaccanaatctctattgatcatt

SEQ ID NO: 12420 - DNA, 1108 bp, Heterodera glycines
tcataattaattgatatttaccccatcgatctacgccactaaaacttcataataaaactgaaattccacatttggctttccttttgcttagccactttctttgcttttccattccattcattcatttcccaaattcattttcattggtactctgtgtctcttctgttggtcggctgtggcaccattctttggttcttttgggacaacgtcaaaaaacgacgacgccccaacaaaaaagaaatgtaaaaaacaaaaattaaattaataaatcttctttttttcagcttcatctctgccgactgttggctcgaagtgtttgctttacttccgccttctcagcttggactcggaatcgctctgatcagtcgccgattttaccgccgcgtggacaaacatttcaaagcacgcaaatggatattggacaccgaattgcgaattcaagagaaagagctatggtttggcaggaagcaaatggaaattgtcaatgccaattggaagcgtttgccaatcccacaaaatccgttgcccaacaaagtcatcggatttaaacacattacgttcatgtaaaattgataagtttcccattggtttgagataactttttcttgttttagttacttcgaccacaatattctcacatttgtccgccgttttcaccgctttttcactttaattacaacatctttgggcattatgagtgaaaatgttcgcatttttgagttcttcctgtccaccatttggccaatttttggtgacttgatttttaaatttttgataaattttctagatttttttcctaaaattagaagaaaaaaaaattttcggcggcgggagacgttttgtggtgtacccgggacggacggtgccgaaataaaccggcacaacaatggcaaaggcaagtgcgccaacctgatgacggaggatgaaattatgtcaaattttgtgattatctagttgatgagatgggacggattaaggaattggcaaaatgatcgattgacgaacaagacaaatttgttgacattttgactggcacatcaaataaaatggcatttgttgtaatattgtaaagagaccgagaaaggcaaaaatcagtaactaaaagagg

SEQ ID NO: 12421 - DNA, 4907 bp, Heterodera glycines
acagaaaaaattttttttgggcggagcccagatttttcagtattaccgtttattggtttgaaaattttattaaattaatttcttttcatatttttcatttgccagcattgtctgtttattggcttaaaatagcaagatgcatcttaaagcgtaacaaaaggaaaaaagaacaacttcatctctatcaatttttcgtcgattcactgaccaggcaatcccggcatttcattcttgttctttggatttttgatggtttggtcaatgctcagaacaagacaagctgcttcggttgccgatacaattgcattctgcaggaattaaatgagtacggttttgtgaatttcccctaccctatcgtttttttttgcaaaaatttcgattcaaggtttgtggtgtggcagttttgatacctgttttctcattcaaataaatactttcttcattgatagttttttatttttaaattgcttcgatttttgtgggaaataggcgattgaacccctcccccatgaattaaccataatacacttttattatttgcacctctttgacaagtgcgggttcccaaacacatccctccatgttatctgcgacgcattcccgctgaatgtcgacacccgcccacttttcgccccgttgatgggcagcgcgaagttcgccaagcatagaaatggagtccaaaccagcattctgacaaagttgttgtgggatcatctgaaaatggggaaaaagcaaaaacatggatcgaaataaagaaaaccagaaaaaataaacctcaaatgatttagcaaaagccttccaaaagaattggtccttcatttcacgagtgtttgccaacccaagcaaatgttttgccaattccatttcaattgcccctccacctaaatcaattatatttgacacgaattcaaaatactaatccaaagatccaccaaccggcaacgattgagtcgtttttcttggcacgtctcacgatcataatcgcgtcgtggagggatcgctcagtctccgcaatgaattgctcggcgcctcctcgcaaaagcaaagtgcacgatttgtgtttagacccatcaatgaaaaaattgtagctaaaagtgtctttttaaaaatatcgagcctttgtatttttttaattaccgttcactcccaacttgttgttcatagaattcagcgcattttcccaaaacaattttgtcgatctgagagaccgtagtcagtgttgagccaccacaagcagccattatacgacctaaaaacaaaaaggaacataaaatagcaatcacaaaaataacacaccgagatcgtcttcctgaatccgtccagcacaaaacatatcgctaggtttgagagaataaatcatttgtaattttggctaaatgctattaccgatccgcaaaccattgggtagcaacatccccaatcggcaatttagacagaacaattttggcaccactttcatgtattttctccaatttttggtaaagaatagtccattccgcattaaccacctaagcaaaagaagagccacaattttaatgggttttggatgtagtatagccaaccacccacaagatttataaatcgggtttttaaaaaaccaaaatgaagaaaaccacgcacttctaactttttaagacgctcaaaccccgagtaagtattatcccaaagctgttgataagtagaaaaatcaaaggatgaaatacacaactcttctgacaatgaggtttttgagccggttcaaaacccaaaaaaattaatgaaatgaacgaaaattgaaattttgtttgttgcacaaaaaccagcgcacacccatcttttatgctccttttcttgtcaaagagcctttgaatgatacgaactagtcagagtttaaagttagtgataagtaattttttaatttaaatcggtttaaaccaattttcatatcttgaaatctatttttcgtgcttgtcgagacgaatcggttagtataccaattgtgcatttttacgggggttggctatacttcggtgggttttgtttttgtctgggtttcatttcggacttcctgataatccgcaacattgccaattcgcaattcggcgttgtcgcgttcggccttcagttccaactcgatgttaagaatggcgatcagaggttctttgtaatgcttcggttgcatttcgaaaccagcataactgaacgcctttttgaatgcaactcccttaacaagtcgcgaatcctgaacgatgattgtcaagtttggcgatgtgtaataccgaattcacctttattgagccaccgctgacttttttgactccgatcatattcagtggcaaatcaacgtctaagtaatccaccgcattgaccaccatactcgcaaagtgatgacgttcttgtttgagctgaagtaaatattaactcgccgtttcttttggtgcactaccaatttgctgctaagtgttgtagctgcacaacggattagcatctcgcgactctcttcggtgcccgtcactttcacagacaactcgcgcaatttgctaattgccttaaacaaataaaatcccttttcccgcctcggtccaccctcaaacttctcgtgaggctgcgttaaatgctttgatgattaattgcggactcacaccctcctcaataaaaggcttagcggatttaagcagttcagctgccaatatcacaactaaaaatggctctaatgcactttgtgagtccaatcaattgacaatacctggtttttatactcgtccatgtttcgaacaaaccctaatctttttggcatcattcgaaagcacaaagtctaacgaagctaaaatatataaaatcgcagcgttcaggcaattaccaaaaaagatttgattaattaagtaattgctgattattttcgtttgtaactttcttggaatgttagaattctgttgttttctcgtataattacattattcagactttgtgcattcgaatgataccaaaaagataggatttgttcgaacatgaacaaagttattgtatagaaacccgggattgtcaattgattggactcataaagtgcactagagcccctaaaaataatgtattttcaattaagaattatttgtttttgtaagagaattgacgtggtgataattaaatatttgcaaaattaaacaaaaaaaatataaaccggttataaaactcaggaaaaggaaaaaagagcattgtcaagaagacttgcataccactggtcgtgccatcgccgacttcggcatcttggctttttgcaatgtcacaaatcatgacagcagcaggaaaaacaatgtcaagttttttcaaaattgtagctccatcgttagatatcgttgtttgccctaaattatatttaaataaatcagggaaaatgaaagtgaacgctgaaagccgcgccttggagaaaatgtctttagttaccctttctgtccactaacaatttgtccaaccctcgtggcccaagtgttgtgcgaatgttgtccgcgacagcgcaacacgcgttgatgttgcttaaaatttggtcacgtccctgcttagattgtgtgccttcacaaaggagaacaataggaacggacattgtaaatttttctaaaatttttatgatttggtagagatttgacggtacatatctttcaaaagtgtctctatcagtatacctacgaaagtttgctaaaaaaaagttacgatatattctcaatcctaactaggaatggaaattttaggcacaaaatagtagatagagcccggaattttgaaagtaccgggaccgggcttagataattgaccgcgaccgggccgcccagtaaaagcctgccgggcccccgggtccgtcctggctctattaaataggcacaaaaaccctcgaatagacactaaaacagacaaataaaactccccacattattgttttttaacagaaaaccaggaaaattatcattttttctttttgcgtataatttaatgtttaaagaaatccaggcgaattattgaatgaaacggaccaataacattgtcggtaacaattgaaacacacacaataatgctagcttagggtttggatcgtaccaagaatatttatcgaacatttatatgtaacaaaaaaaattagctaggatcatttttacataccgtatttactcgattatacgcccccctcgaatggaagccccccccctcgaatataagccccccttggaggggggttgaacaatagaagccccggggcttataatcgaggaaatacggtatgtatctcttaaagtaaaagcgatgtttttaaataagcgtgagagcatttatttgcttcccttcctctcttctcttttcacaaatgactctctccctcctccgtttctttccctctccgccgtactctctcctcgcccttttctttcgttactctctttctcattccgttttcttttccatttctcgccactttctgttgatgttcttcttccaacatttgcatgcccgaattttggctagaactataaaaggacaactttccttcttttgcagttggacaactcagccgaagggtcaatttgactgagggatgctttttttacaaagttttcgcataaagttattcttttttaactaaccctttttgcttgtttaagtagttcattcccgatattggtagttttctacacaaacttgaaaagatcactcctttagatctggacaccataatatacgttgaaaatcggggaatctttggaaaatttctctggaaattttgaataggctcattttaagagcacaaaattctatacccaatttctttttgaatgatgtgactaactacgacttgtacatagaaacacattttctccgaataatttttgatttagaacgactttattagcacctaaaaaccaaaacggagggggggggggggg

SEQ ID NO: 12422 - DNA, 1658 bp, Heterodera glycines
  misc_feature (14)..(14): n is a, c, g, or t
tcggtttaattacncaagtttgaggtacttgacgtatcctgcccataatatctgtggcatggaataaattttggaactgcgctgcctaacggcggtgcttaaaatccataacgtatgatgaggtgatttttttcatttttttattttgtttaaattccaaagtgaattcgaggcccaaaaatttattcataattcatgtggtaaaaaaatggattgaaattaaataaaaaatttcttgaatttttgcttcgaaatttttaattttgatatagaaaattcctttttctgaaattcacaataacaatttggcgaagaaattcattgaaatttttataaagcattttgattaaaaatgttggcgggtttgacaaatttgtacaccgactattggatctcagcagcaatgagaaataacaaacagaaaagagggagaaaagggcgttggctttggaaaatagctgatacaaggagaggcgagcagacgatgagtgagataaaaatagtggcaaaaatggacaactgctgcattgggagagtcataaagggaacacaaagtgttcgcacagcatcgaatatttccttcattttaggcgccattttcccccactgcacctctttcttcggtttaattacccaagtttgaggtacttggcgtatcctgcccataatatctgtggcatggaataaattttggaactgcgctgcctaacggcggtgcttaaaatccataacgtatgatgaggtgatttttttcatttttttattttgtttaaattccaaagtgaattcgaggcccaaaaatttattcataattcatgtggtaaaaaaatggattgaaattaaataaaaaatttcttgaatttttgcttcgaaatttttaattttgatatagaaaattcctttttctgaaattcacaataacaatttggcgaagaaattcattgaaatttttataaagcattttgattaaaaatgttggcgggtttgacaaatttgtacaccgactattggatctcagcagcaatgagaaataacaaacagaaaagagggagaaaagggcgttggctttggaaaatagctgataaaaaggagaggcgagcagacgatgagtgagataaaaatagtggcaaaaatggacaactgctgcattgggagagtcataaaggggacacaaagtgttcgcacagcatcgaatatttccttcattttaggcgccattttcccccactgcacctctttcttcggtttaattacccaagtttgaggtacttggcgtatcctgcccataatatctgtggcatggaataaattttggaactgcgctgcctaacggcggtgcttaaaatccataacgtatgatgaggtgatttttttcatttttttattttgtttaaattccaaagtgaattcgaggcccaaaaatttattcataattcatgtggtaaaaaaatggattgaaattaaataaaaaatttcttgaatttttgcttcgaaatttttaattttgatatagaaaattcctttttctgaaattcacaataacaatttggcgaagaaattcattgaaatttttataaagcattttgattaaaaatgttggcgggtttgacaaatttgtacaccgactattgatctcagcagcaatgagaaataacaaa

SEQ ID NO: 12423 - DNA, 1437 bp, Heterodera glycines
  misc_feature (6)..(6): n is a, c, g, or t
ctcccncacttggtggacattttggagtgtatggcggttctccactgggcaagtctaaatgaaattacgacgaaaaaggctgctggacgcattgcttctgatgcggaccgacccgatgaagagtaaggaaattcttgaaaaaaacctaaacatttaaaatcaggaataaaaacaatatttaaaaattattaaaaagtatttaaataatattatttatcatttttggctttactccacatttccagtgatgttgagctcggtgctgcaccggacggaaacaaattttcggtggcacaaaaattctcgcggagcatttcgatgatcggcggcaccatccacaggcaggacaccgccacgggacgtgccaaaaagaaggcgatgggctcgccctcagaggcggccatgctcaattacgtaaaccaactgatcgacgtggaggagacgcgcgcaaacaacaacgtaaaatggccaaatcacacaaaatggcaaaggattggtacttttcagatcgttttcgaagtgccattcaactcgaagcgcaaatggcatttggtcattttggaacagtccgaggacaatgccgacggactgaagcagtacaaaatgttgatgaagggcgcctcggagattctgtcgcacatgtgctccacctttatggacgagcatggccaccaacagaagctgggcaacgtggagctgaagcagttcgaggacgcgtacactcacttcgcggaggggggacaccgcgtgatcggattctccaccaaaacattcagtgcaccacggtaatatttgataatttataatattgtgtaaacagctaactaactggcaatccttttaccctgaaggggcacaattttcgacatggacgaaggcaatgtgccattggaggacctgaccttcttgggaatgtgctcaatcatggacccgccccgtgacgacaccctcgaggccatcaagcagtgtaagcaggccggcattaaggtgagctcattggcatgccaatgccaaattcaaaaactgaagaattttagtaatttctttcattaggtatttatggtgaccggtgatcatcagctgacagcaacagccattgcacgtcaaattggactcattgaccacaatcggaaaagcgcaacagaacagtcaaatggacagtgagtaaagcgaaaatgaaattaaaaacgaacccaaaacaaagtgaaatcaattaatatttactagagtccggcgggatcgggactcccgcgggattttacgggagtcccgctcccgactcccgcttttttcggtgaacgggatttttaacgggagcgggatttttacgggattcccgttcgggactcccgtcccggaaaattttgaactcgcgatcccgctcccgctcccggaaatttttacccaaaaacgggagtaaaaatgcactggtaagaa

SEQ ID NO: 12424 - DNA, 2208 bp, Heterodera glycines
aatatttacttacatactaactgtcaaataattaaaaaaggaagtttatctataataaacccctgctaattaatgcagaattttgccaaaagtgctgaagaagtcccaaactttcgcctcgcatcagcagttggcactttgcgtgcccaaattgatgatgaaaacgctgagctcggaattgccattgagcaaagcggaaaaggatttcgaggcatggcaaattcgaaaattaaataaataaataattgtaatttaataaatttgccaaggtcattcatggtgaacgaatttcgcgtctgagtccctccgaatgggacgaactgatcgaaaaggaatcggtcgtttttgcgcgcacgacgccggagcaaaagctgatgattgtggagcagtgccaacggcggggaaaactcatcgcaatgactgtacaaatttcaaatcgaaaaaatgaattttaaatgcattttagggggacggagtgaacgacgcacccgcgcttaaaagggcggacattggcatttcaatgggttcaggtgcaaaaacggcaccgccattttgacattgatttttgcatttttgtgcttttcataggcagtgaagtggctaagcaagcggctgacattgtgctggtggacgacaacttttcctccattgtccatgccgtggaggagggccgcgtgatgttcgagaacatcaagaagttgctggcctacacaatgccgcactctttccccgaagtttggcccgtgataatcaacttttgtttcggctttccccctggcattaccgctttgcaggtgcaacactttaacaaattgcataattagctggttaattggttgtccaatttgtgtgtccagattctctccattgacttgtgcaccgaaattctgcccggcgtttcgttgtcgcgcgaactcgccgaaggcgatgtgatggcacgcccgccacgggccatgaacaaagtgctcatctccaacactttgttggcttactgtaatttggtcatttgaattcggaacggttttgtcgtcctacttttactttagcatatgcctacacgggccaaattcaatcgttgggctgttttttggcctactgttgcgtgttctggtaccacggcatcgccatctccgacttgtggatgtccgccctgacaagttggaagccggacggagtggcatttgccaggtgttctaacaaatttagcgaacattcgaatttttggcaaaatgaatttcagcaatggcaaatcgttctccgtggagcagcagctgtacattgggcgtcaggcgtgcagtgcctggcaaatgggcatcgtcttcgggcagttcttcaacatttggagcgcccgcacgcgccgagtgtcgctgttccggcacggctttctctccaacaaagcacttctgttggcattgcttgtcgaattggcactgatcaattgctttgtgtatatgcccggtttgtgagaaaagattttaatgaattcccacggagtccgccccatccgcacaactttaaaatgttttcaactctttcatatttcaattttaatctccaatgagctagcttttttaggtgtcaactcttttctcggcggtgctcccatcccttggcactgttgggccgttgtggccgcggttggcttatttatcaacgcgtacaacgagatcaggaagtattttgtgcgtaattaccctcaaaacagaattgttcgctgcttcaaatggtgaaatgatttctcaaaaaaattgtttttttaattgaagatttctttttatttgtatttttgcatgacaaattgcccaaaaaatataattaatttaataataaaataaaaagccggagaatgatttttaaaagagtgactgaattttatatttaaaatttttaataacgattaaaatatatataataaacacatatttcaaaaattcatttataattaattttgaataaaacccaaaccatttaatgcttcaatttttgccggtattattttattttgttttttaattaaaatgatgtcatttttattatggtgcatgatccttattgcatttattacgttataaacatatggtctgaataatttagaaaattccatttaaaaataataaaataattccacatttttatcgacttttttatttaaaaatgtaaaaatgaatgcaaaaaagtcattcactttatttttattacatatatgcc

SEQ ID NO: 12425 - DNA, 1271 bp, Heterodera glycines
  misc_feature (6)..(6): n is a, c, g, or t
  misc_feature (14)..(14): n is a, c, g, or t
ttttgnacatcgtncgaccaaaatgaaagtgccgctgtccgcggagtgcgcgaattcaacccggaatacacggcacccgaatattatgacgagatgtacgggcaggtcagcccaactaatcgctaattaataactagggatacgatttttcggctctaaaaactgccaaaataggtcggctttaggtcctaaaaacctcaaaaataggctctaaaaaatggaaaatggcactaaaattacctcatttctaaggtgtgtaaaatgacaaaatttattcaaaaaagtaaaaaaattaggccaaataagtaatgagctaaataaatttaaaaaaaaattttggacatgaatttttgagaaatttttcatttcttaggggtgtatttttcgttttcttacgtttttgttaacaaattttgggaaaaatgccaaataggtcaaaatagatttttttcagcattttttgatttttggaaattttttgaatttaattgaaattttttcgaattttccaaaatcccgcaatcccgcacgggatcccgcaaattttaaatgcgggatttgcgggattaatcccgcgggatcccgtcccgcaaaaaattttgagttccagtcccgcagcgggatccgcaaatttgaaatttccgtctctattaataactattaaatgctatttaaataaatatttaccaattacagatttccacaaaatttgatatttggtcagttggaataattgcctttgaaattttcattgatcaactgagtttggaggagaaaaaggcaccaatgaacggggtaagcatggatcaatgtatcatcagagacgggagccaatcccgaatcatttcaaaatcttggtatagttcggtagccctaatgaatttattaacatcattcttagtttaagaaaattccatcaaacaattaaatttcaattatttgtcgaacaaatgaatagatgaagaaaagccggacaaattttgggtggtgttggtcaattatttcgcactgacttttattagtttttttatggatatgatgcaattttttttttgaaataaacaatcaaaacaaaaaagttttttttaaagatggagcgaaggacaatgctttgcaacatcggcaatttgttcttcggatttaaacggaatcgcttcggagattaccccggcaatgtcaaagaagtgccgcttttgtactcggaagacccaaattgggtgtggcaaaacaagagacgccattcacgcggtgctgcgactttggcttaaatt

SEQ ID NO: 12426 - DNA, 1823 bp, Heterodera glycines
ttctgtcccctccctcctccgccgccgcccgcccattatctccgattttgatcaaaaatttatttcaaattccacatttatttttcgtcatcaaagtgtaaaaaaaggtaccttcattattttttaattcaaattttaataattttttttctggctcttaaattagcggctatgaattcattgttttggaattaaattaaaattattaattgatttaattctaatatatttaaattcattacacttttaccattagtataagaaatgcctattaaatttaattgagtttttcaataaagaaataaacaatcctttattattaaattaaatatttttaatttttaaattaaaattattctacaattatattttgcattattattattttttaatatttttacttatgcttaacttttttttattacttaaaattaatatttcaaatgcctgcacaacccccgagaagcagaaaattttaactttaaattattttgatatattaatataaaaataattactatgtaaatttgttgtaatgggcttcacttgtttagcaaatggcgaaaattgaaaaattgtgacttttgcattgatcgttaagaccatagttttcaagataaatagttatatttatttcatattgcaggtgaatgtagatcgggcctgtttatagaattaaattttatattgaaagttgattcagtttatgattattatcacaacttattttatttcattaatttcattaatttttttaatttttttttattgttttcgaagttataattagtttaaacagccctttgaatttatcaattcagcgtatttttattttatttttttctcagctaagcgtcgagtaccccttcatctttgaggtatcgtttcgcacccccattctaatatttttgacattttatatatttttaaaaatttgtttttaattatttttatttattttattttcattcccatctaattcacatcatatttatgtttgaaaccttgtgcaattaataagtgtaagcattctaaaaataaagtctgtttaacttacatcaatttatttttacatacacacaacatggtaaataattaaaattattattgattttctttttgaatcatttatcaattaataatacagtttttcagcctctcgggtagtccaatgatcacaagcgaccgattcgctccatctcttttgctgcagtttccatttcgttattttattatttgtttatgcatccgatcataactagtttttaattatgttaatttaggatttttttccatctaaaatacaaactttataaaaaaaattactataaattttgataatttttgagttaatggtaaattttatatgttaaaaatttgttattaatttgtttggtttaattttgaatattatttattttatacaccattaataatttgcaattattttgctcctcctctccttcactcaaacttctaattgtatgcaatattaaaatttcgaatgattaatttttcgcctcaccgttaattatattttttaacttttaattataattgttgatttttttaaattgtagagtttccaataaaatttgtttgaataatttcatatattttatttttcattttgctttttttggggagggggggcagcggtgccgataggccgcctggcgaattttgaaattaaaaaaataaatcaaaagagaaaccgtcaacctgcatcgaactcatgccagaaaataatgttaaggttgatgcactatccactacacacactacacatcaaaaccataataaattaactttaattcataaaa

SEQ ID NO: 12427 - DNA, 2175 bp, Heterodera glycines
tttttattttatattgcaaatatttcatcgttttgtgtaaaacgtctccgaagattttttgatccataactttgttcgttatcaatcaaattaagcattcttggtgtaattcgatagttcattgtgaatattattctgataaatccaaaaagatttcattaagtttcaaaaactagtgtccagaaggaactcaaaaacctagttgatcggagtacgaatcttcaaacattaatgcgcattgtgtttcctaaaaattgatataattataacgcctatttttatccagataaaattctgaaaattgccccttaaccagtcagaaagttccaatcattcaaaatactggtcctgatttattaaaaaggatattctctagcatgaccgaggctttatgccacgcccaaaatattcttcagttatttttttgtgcgtttgactgttcgggtcctctaaaaactttgaaatttggctaatttcaaaaattgctcgaaatcatttaaataaaaatcattttttataacagacaattacatttgaaagagcagattttgtaggctatatatatggtttacgtgaatataaagcattatgaattttgtaaattaatcccgaaaaaatattttcaaagttgcgtgccggagggattttttctttattgcatttgtctgtttaattaataaaaatatttcagatttcttccaaaattattattaatacaaaatttaatagaatttataaaaaaaattcttatatgtatttattttttgttttaaactttttatttaaaatttcaatgttcaaaaattcatttaaaatacaaatatatgctttatttatttatcgaatatattcgttgatattgcgaatgctgagttaaattctcgttcagcttttccgaaaatttttgactccagcgcttcgccgcacactcgactacggcggtcagtaggtggggtgagactacgggctacggaagaagtccgcgcgtgatccgcaggcggttgactgacgtcagacttttcctccgccctccgtctcgccccactacttgctccgtcttcgtatgctcccttttgcgaaattttgcaattttatacttagctcgttaagattatacaattttaagtctgggacctatgatggatattttccgtttttcttttcatttatgcatttcgattttttgttcgaattagggttcgggtttcggaatttagcaaaataaaggtcatattcgtgatcagcgccacaattaccgtagaaaaattatttaaaatgtcttttgagtgctttttatagtgcggtcacttgagtcccagttgagtttggcactccaattccggcactttttcatcctgaaaaagggcaagcgcgcccctaattctatttttcgatcccatttttattcagtttacattgattctgaccgtttttaatcaattttgagtttggtgactatgatcaatatttaccaagggtgcgctttttctgaattactttcctattgtttcgaaaattttaaatttctgtataaatgggctgatatatgtaaacaatattcaaattttattcgttagagaatttttaacagggaatttttttcatcatgcatgggtttgctaacaatgcaatttcttttacaaatttaaattgttttataataaaaaatatagagtgaatttggcgaattaattttcgatttttaaattttatacacaatagtggcaaaaggtgatgcagaaaaaaaattttgaattaaattttaaaattatcttgtttatggccacatgttaatacgaagtgaatcttttaatataataaaatggatttttctctgaatgcgaaaaagggaaatcattggtgaaaatggcattgtaaggataaaagaagatcaaagaaggaatgaatgaccacataattggaggagtgccactgaagcgatgcgatgtgttcgcgtcgtttctattgattcacaaagaaatgtttgagaaaagaagagagtaacaaagagattaaattatttttcaacatttcatgacataattttaaaatttattatttttttctatgcctattaatttagatttttattttatgtatttttatcttttatattaatattttatggacgaatattataaataaaagagaattgtgatgattaatttaaatctg

SEQ ID NO: 12428 - DNA, 1778 bp, Heterodera glycines
  misc_feature (1688)..(1688): n is a, c, g, or t
ttaattttcaagattatctttgatcctttagttttaattttttttcaattaatgctttttcaaaatcaaaaaaatatagattattaattatttatttatgattaaatccttaaatttaatgatttgcttaaagcaataacacgcgaaaacaatacaaattatatttagatttttaaaattttttgtagatatattttttgtttttgcgtatgaagaatttatttaatatgctttaataattctattgatttttcgaaattaatatataatatattaaattactttattatattataattttaaagcattttcttcgattactcaatatccttcatcctttcaacacaacgtccttttgacacattcatttatattttaaaaaatttaaaaaatttattagttttctttttttggttatatcttgaaagccatcggctgttatatttacaattgctgtgataagcagaaatatattcaatattttatttaaaatatatttcaaaaatataatttctgtgaattgtttctgttctcgttaaagagaattataaataaataaatttgtcaattaataatataatttatctctttgacataaattaattatgaaaatttaataattccacttgaaaagcataatttatgattaagagttactgaattttatctaatatttataattgttcacttgtacacaagcttaaggatcgattagagctgtgtgattatacctagtaattaaagattttaaaataatttttctttatatttaccgaataaatattatgtttcttataaatatttggtaagattttcatgttttatgtttttcataatagataatttgagtttttcccactcctcctcccgatattaatattcttagtttgtaactgaatttttatattcaatttatgtaaaaagtgttgtatttaattttatgttttgctttttatttgtagtttaatcaaagaagactttatttttctgaagattttaaaataacaaaacctaaatatgtttggaaaagttttggtacttttttagtaattatcgacatgttttctaatttgctttcaatttatagtttcttacaattatttttgccatatgtagcttttggtttaatcgtcagtttaagccatgaagttcccgtagtgaacatattctcgacgattataaaagctttaaggtctaaacatttactcacttttgacacttactaatctttggaataactgattcctcgtgtatttttctcgtttcacagagaccgtcactccggtatgtcccagttgaaataacacataataaaattataccaattatatttagatttgctaattatataacaaaaggtttgcatttatgaagtttttaacttttttaaataatttatttctttaattgcaatcgattaatatattaatttattttttaaatatgttaatttatttgttatgcattttattcatagtattgattcttttttagaaattaattatgttttctttgttaaatttgttttcttatgtctataaaacttttccatattatctttttctgctttttaattgaatgtttctcttttttgttaagttaagtaaaagcttttttgtttgtcttataataaatacatttttttacttctttttctttaatttcactcacgcgcaaccacaaatcanagtttcattgtccagtcctttcttagttattttcccggtattttttattgtatagttttaatcttttttcaatctcattctcaaaatgaa

SEQ ID NO: 12429 - DNA, 1470 bp, Heterodera glycines
tttatgaattttttttagcttataactttttcaatactctcccaaataaaaccattttatgctcattttggagggaaacttctgaagaatatttcttaattagtcaaaagtttaaaaaaattgtttattggcaaataaatgattcatgtgttattttatatgtcagagacatggaaatagtatgcccaaatgagagaaaaagaaaaaactttgccctgggaaaaaattttttcctgtgggtaactttttttgaaattttgcataggcccatattttgaccccctttatcgaattctcttttgttttttgaaagtttcttttctaactcgagatcggctcttgcatttttacaagggaaaatccccaataaattttaagttttgcaaagttttggcgttctgattactaaataaataataaacttatttgtacttggagcccaaaattgaatcgccgtgtgatatgaaaagctgtccaattaaaattgagacaaaaaaaaacagcggaaaataaaagcgcttaaaacatcaaattgcccaacaattggcgtggtgttcaaaatggtctccgataaaagtctggataaaagcgtagccgtggtcgtaattgggatgaagtcggtatttccacgtcagattcggattttcaacggccaacaaattggctggcaaaaggtcgccgttggcaaggaatgggtcggcacttcccttcaaaacattccatcatttttgatcactttttgttcctgtttttctactcgcctggtcaattagcacttcccttttgggcccttcgtattttttagccaattccgtggcgtcgtaatttgcccattttccctcatcgttccccaaaaagacacgcaaatatttctgtcctttcgccttcgacggattgcaaattggggcaaaggccgacacggagctgaacaattccggatgcttaagcgcaatggtcagagcacctgggaaaaagtcagtggcaaaagtgcagagacatttaacaattcttttaaactcaaacaaaagtctggcaaaatgaaaacattgtgaaagtattttggttgagtgagtgaatgtcccattttaatgccaactccgaggacggtgctctctggattcattatgtctggtagcggattgggatggcggggttgggtgtcccatgggtggtgggggggggtgttccatggttgggtgtgtctccgtgtaccctccctctaaccgcggacagattggtccgtgcctacaccgcgtgttcaccacttgccatggcctcccattgaatgtccaaaaattccgcatttatttttctccactgaaaaagtgctgaacacgagtggcacgagttcatccaaaatgtaggaatacattcgataattctgtgcccattttgtttccgtcgcgtccaaataactgaaattgacaccattttgggtttattatttctgatcagaagagttcgttcgac

SEQ ID NO: 12430 - DNA, 4343 bp, Heterodera glycines
caaaattttcctcggtgcatttcaaccctcaaatgttttttctcagtctctccctctccagccgttcaaattctattgacttcataccagaaagataaaagagcactggcaatttgctttccggctgattgtccggtaaataaaccccaaatcgcattcggcactttaactgggcactgtaacaataaaataattccaatttgctttttttcatttcactaaacctgttatgttcgaaaattttctgatacccattgaaccaccgggatttgcttaattcgaccagcgacattgtcaaaaacgaagtttaaatttaaatgctttcagctgcagcggtttaacggctctttaactaacaattagccaattttaaatagaaatggatatgcaattaacgaattttataatttgtaaatgagtgcttgggcgcgccgctattatctgtaataatctgtaataaaggccagcttcttaattacacacaccattaaaatttggagtttttgatatcgctattgaatcgtttatttgccataatcactcgcttaagttttaatatccaaaaagttttacaacgaagtggcgtgtctaaataaaaattgttcaaaaatacataaaacggaaaacattgaaaaaatgtacatacacaaaaaaagagtgaacgacgtgaaagaaggggggggggggggtgattccgcgataaagcgctgaattggaatggaatgaataagcatcgatttaacaacattagcatgtttccctttgaatacataaaaataagcttcattcaattctttaattggagataaaaaacattaattcgcctttgtttaaaaatttctctgatttgatcaaattcaattacctaattaaatagtataaattacagaatgccttttcaccactaaatattatctgattgtaattaaaatttaaactaaagaatcagggcaatgtctgaaggtttggtacaaaggcgacggaaagcagccgagtcgaacaattcgtcaaacggtggtcaacaattggatgtgtgtaattttaatgccaaatttacactttttggacttttcctttcagaatgatgacaaatcggcgggtacttacagacagacaaccgactcaaatggtgctggtgatgaggacaacgacaaaatgcaacggctaacactgatggaggaaattctgctgcttgggctcaaggacagagaggtgggggatggctatttgtcaatctttaacttattctgtattttttgtcccctcctaaaatttttcaaaaacttaggggtacacttccttttggaatgactgcatcagcagcggactgcgtggctgtgtgctcatcgaattggcgttgcgcggacggattgagttggaaagggcggggatgcgaaaaaagggcttttcctctcggaaggtcccattttgggacgtcctttctttaacacgaaaaggcatttaaggtgattttgaagaatgagaaaatgaccggcgatgttattttggacgaagcacttaaacacatcaaagagacaccacaaaaagagacggtggtcagttggattgaatatctgaggtgggccaaaaacgcgaaaatgcattgttaagatgtttttttttacatttagtggcgaaacgtggaaccctttgaagctgcggtatcaaatcagaaacttacgagaaaggcaattgcaatttattcataaattcgtgttaaaaaacttatcttttaaggcttgcaaaaaatcttgtggaaaagggcgtgctgactacggagaagcagaatttcctccttttcgacatgaccacgcatccattgaacgatggaaatgcaaaggcaaaacttgtcaaagtgcgttttactcaaattgtgaaccgaaaatgcccaaattcagcttaggtgacatttccctaaattagtaattttgtaaccaatgaatttgtttaccgatcaagccctatccaggggaaagaggggggtgggagaggaggtaattgccccctcccattcgaaatgaaaaatacgagggaaaatgggctttaacaaattaacaaaaatgcagttttttgtcagaaggtcttcgttttaattatgctttcaaagtatttttttgttcaaatgtttcagagagtacaagaggcggtcctctccaaatggacgaacgatttccaacggatggacaagaaaatgctttctctgctcattttggcacatgccagcgacgtgctcgagaatgccttttccccactgaatgaccagggtattcggggattatctgctcaattgttttccatttgtttatcccaccgtttccataagactacgaattggcgatgaaacgcgtgcggactttgctggagacggactatgaggcggagagtgtgaaaagcagcaaattgcaggccaacggcggaggcgaaagttccgctggctccgccttcgatgtgatatacgccgtgttcgaggcgttttcaaagtgatacaaattagccaccatacccattaatctatcttctattcaaccttttttgctatatttacattacaaaattttagatgaaagttacaaaaaaaaaatcgacagaaagtggcaaaaaagcttggttgaaattacccttttgtgactttttctggggggagccaaaccgaatttttgtgcgtttcttcgcaaattacgttccgatcacaacaaatttgtagtgtttctacgtgatttggtgttttcattttttgttctatttctgtcacacattttagctgtatacctatttttgcctaacattcgaaattttctgtccataatccctattccaaacgcaagaggtgaagaaatgttgaattttattacttttacctgtattgtgaaaagaatattaaagttatcaattccaacaaattgctataattatagtttccaatgaccattacttaaatttctttcaaatattccaaagtgtatcccatttaaacaatttttggatacgcaatgtcaccaattcgctatccctcgggagttaaattgcctcccttcgcccgcttttatgataatgtgtactggaaagtgaagcgctacatgaagccccaattcttcggagttgtggccactgttacaattattggtgcggcattttgggcgattgccattcagccgatgatcagcaacgaatattatgctgagaaacaacgcgagtggtggaaacggatgcccgtgtcgagggaggaacttgcgggagggctgcccgtgtggagggacccattcgaccgcgaggaccgcaaaacgccgtcgtacgccaaatagcaaccgaaaagcgggaggtcgttgaatccctttctcattgcccacactttgactgcatttttcgtttgtcggcacttttatagatacggcagtatgtatagaataaacctaatttttaagtccaactaaatcaccttgttttttgaaataagcatcggtcttcctaaatcataaaagtgtcctttgcttttgctcatatatattattgcatcactgttctttatccaaatgcatttttattacactttaattggtaacgtggaataacttattgttagtttatcatgtggaattgctcagttccaaagttgttgggattggtgtcacttggtccagcgttgactgttcctcgtcctcctccccatttcgcccttttctttgtccatttttgccacttttctgtcctcctccactgtgtgcccttctctcttcggttaatgttttggcagacagaacttcgaccagttcgtcgtcctccgcttgtggcgattgcctccgtgacgtaatgacaatgcgccgctcctccgccaacgaatgattacatttgttgctggttgcacagctacaaccgatttgtccaaaaattaatacctaattatataatctcaatatttttgttgttattgcttttctcaccactttttttgcggcttccgccgttgtgcaaaagtgagaagtgcgccttcggtgtccgcattataaacatcaatgccacttctgaaaccggaaccgatccaaatgttatctttgtgaacactcccacctcgtggccaatattcgcgccactttccgtccattcacttccccaacactcatttcagtggaatttgtcgagttcgctgttgttgaaatcgaactttctttgccattgtaaattgaagcggcactgacactttcaacaagattttcatcctccttttcaatgccttccacttttaaattggcaaaatccaagtcactttcgacttggaccgatcggtcaacaaatttgcaatatttttcctttccaagcgaaaaggcatcgatgaatggaattcgagt

SEQ ID NO: 12431 - DNA, 913 bp, Heterodera glycines
tcaaaaagccacaaaaatcctcaaatcctcattttccaaactccatctcattgacctatcaaaaagccacaaaatgaggataatcctcagatctgggagccctggatatcatagtgattcaaatatgtttcacattgcaaaactttatcttctcaatattttactcagatccccattcttaccggtgcatatttttttgcctatgccgcgggttgagaaaaatttcgggtttcgggttgagaaaaacctcgggtctcgggtttcgggttcgggttggcatcactgtatgtacagtatattatatcccccggttactgtttaagcgactgtaattgtctgtttgctgacttgactgatcagtgatcaccattatcaatgtgttgtgtctctgtgttaatgatcaattgttgcgcctaatgtgtgtaaataaatgtgaattcttgctaatgttttttaattcatttatgtacacaaaccaacaaaaacttaaattgaagcttttttctctttgcaaattgaaattttatgttaacatccccaggcttttttcggtttcctgttgttcgagtgaatttgaaaaaaaaaatgccattttgcgctcaagccgactccaactgaatgcaagcgccacatggcatcattgccttgccggacttgtgccggacatgcccaaccctcgacctaggccgatcggctggcacaccctttacaatgcgaatgggggcgcgaaacagcgccggcgagcagacaacgaaactgcgttgtcagccattatatatgctgaaaatttgttgttcttttttccgttggggtgtaaaagacgcgaggaatgggtggcagagggacccaagtcatgcactatttctccactgcgctgttttctttggttttggtcggttttgtgcgtctcatg

SEQ ID NO: 12432 - DNA, 2226 bp, Heterodera glycines
tttttaatttttaaaaatttaatcaaagaaaatgtgaaatggaaatgaacaaataaaatttgttgggcggtattatgatcaatggtgatgccattgagactgttagcagggtgccaaatgtcaaaaaagtgatcggacggtgtaaatttcgctgatcagcggttgccgagtttagtgagggagaagaagcgcgatgccacgtgttcagcgatgccatgtcaatgcctggtgccattctgtgtccagcaacagcaacgaggtcctaaatgccagaattgttttttacgattgaatgaacgacgatttatttggaacttaactgatcaatctgatcacattttttgggtcgtcaaaaatgccgggtcccgattgacttaataatttttgagccaaaaaattcaattagttccttaattctatgaaattaaaactgattctgggccgtttttcatttttccaaagttgtttttttttctaaatttgcaagctaattgaaaatttaatgacagtttatgtccgcgtggttggtacttttttataatttagcccaaatgagtttaaaagtcaatttaattcgggtttcaaaacaattaaaaattaatacgccaaaggattttcgatcctggaaaaagcccttaaattcgagaccacgaccgagacgaaataaatcaaagaaatttctcgagaacgagaatcttaatcagctcaacaccacattgaactactgctcctattaccgcttctgttgagatgggtccgcgtgcgctgagccgcacctggcgctggtccggcgccagccgcgccagcgcctgcgcctcctccaacagacggcacagtttgccgtgcacgtccacataaatgcgatgactgttcccgcgcgcaatctcatcgctgagcaccagcgacctgtgagggaattagggtcagtcaattaatgagcaattaatttactaattgaccaaaacgatcatggagcaaaattgggccccaattaattaaaattttataatgcagaaaaatcataaaatatttgtcagaagatggaaaaacgatgataattagggctacaagttttcattgatgaaaaatctgttaaattagaaaagcccaaaatagagatgtcaaaatgttgcaccaaaaaacaattaaataatcagaaattttttaaaatactggccaatattcacttaaattatgtttcgtgtcgatcagttttctcgaccgataaataaaaaattatgatcatatttgatcaattttctcgatcaggaacagtctcaggattcccatgggttggttgccattggtctgtccggccctaatggcttaaaccataaacaaatgccacactttcgcgtgatcctgttgtacttgggccagaactcgatgggttcactgaaatgtggatttgaaaatgataaatttatcgtttaaatgatttatgcaatcccaaaacttgcccagtgcgcgcaaaacgtccccaaaagtccatgatttttgccgaaaatgcccgctccatgtccaactctttttggtcgtatgcttgtgggtgccgaaatggcatgccgaacacatacctgaaaatgggaggaaaagccatgaaaatgtgggaggtgacaatgccgaatagatgatttggacctgccgttatctgcgctttgaaaaggacacattgatcgaaatgctttaccatgattatgatttgaaaaattgacaaaaatttcgtttcgatcaatgcgaccttttcggcgacccggtaattaccgtaatcgttttttcaccgaaaccccgaaaacgacttgtaatgataaatttataagggttcaattaccggctttttttgccaattagaaaaatcaatatttctttgggtagctttcgatgattggcggtaaatgaatggttaattttaacggtatttacgacaaattactacggtaaacgatcctactgtatttgttattcaaatataaaacccactcaatttcatagccgtgcataatgcccatccaacgaggccacggattggcggaagaacgttttacaaaatagtacatgaatacggagccgaaaatgttctctgagctaaaatgaaaacaaattaaaaacaattaagctaatcaatgcgattaaaaacttacacaatgtcagcaaattcaatgagggcacaagtgaagaagctgaaacgaaaagcataaataaattgcaccaaaaaagcagtgatca

SEQ ID NO: 12433 - DNA, 1346 bp, Heterodera glycines
aattagagataatctcactaatcgccgaggaaccgtgccacaccgtcccgccaccgttccaccgccttggcatggttgtgatcaggcgtgatgcgcgcataggcgtgcatcagcgcgtgccgtaccaactgcgagttgccaaagtaaggcaagaaggcgtcaaaagctttggtgtattcagctctaagaaaattttcaaaaatagaaaaatgaaagaataggaagtttttttaattcttaatttttctaaaaaattgctaataaatttatgtaaatttttaaatgttgaaattctgaaattttcccggatttttctgaacatgatccttattttggaagaaacaaatctcggtcccgactttaccggtcccggcgtttccaaaaatcccgtcccgcccatccttagaacaattaattgatcaaaaatgattaaataaaaaaagtgatcagaagcccaccaaattttaaaggaatgatatggacaaaaaacaaggtaataagcctaattgtaaattccaacttactcagtgaccagtgcctgattgtactgatcctccggtgatatggtatggttgaagccgaacccgtatttgtgaaggtagtacggtagccagtaagtgcctgtaaagtttgttgtgctaagattttttttcagcggctctcaaaattcaaaaaaactctctggagaggctgagtttccggtgcctaacggcaaacgcattcatttaacaattatttttgcataatttaaattcatttttttttaatgatgggatcaaaccggaaaactttcccagattgattgattttttttgatcaccacccaatcaacccgaaaaaattcttcaaccttcaattcgatcgatttttgcttctacaaattgatcgttagttgatttaatttgatcaatcaattctcaatttgaaaaccaattaaatgccagatttggcataaattagggctgcacgagaagctcgacattgagtcatgaaaggtttcgcgttttttggggtttcgtatctctggctaaattctcaaggcctaatcgaatgcacggtaattgccggcatcaagcagttgtggcacaaaatgccgccccagtgccggtgccatcccccttttttggaacaccttcgtcccggaccgtgccgagcatgatgctcacatccttcttgaactccttgcgttgtaacttctcgaacagattgcccttgaagaaattggcgtcctcatcgattggcacaaacgcaaaattcatcggcaacagcagagggcggagatgtgatcagattctctctgaatttttgtgatttacaggtctttctggcaccgctgtactgtacat

SEQ ID NO: 12434 - DNA, 3425 bp, Heterodera glycines
caaaattattatgttaaaacgatattaaaattattttgcaaatgtaaaaacaaaaaacaattatttgcagggtgggggaaatgatctttagaagaagaaaaaaataattgaaggcatacccactgggccatcaacgctcacattggcttaacattctttgaaaatgatattgatatgtcaaaaaggaaaagcttcatatctcggcccagaagcttcatgttagcaaaaaataaaaaaaaattttatgtcacttgggtacctctcctttttgcagtgtgggcgttccacaaaaaagctcagtgattgataaaataaaataaattttaaaatattaattattgaacggcaagtgtaattttgatttaatttctattagatgtgttataaaaaagaatttataatatttattacatagctaaaaaaggaaaattcacaaattaattgaacacaattgattaggtgctaattttctttgcatttcatgtaaagattttataatttcattcccgaaacagtgaattaattgataacataagaatgtcatagtaaaattttgagtatttaagctaatttttattaatctataaatcacaaatttaaacaaatattcactctcccaatcgctgcaatgcatccaatcaaaaaatttatatttttgtatcttatactttaccaaagtgtgaaaatcgaacaaaaaccggtacaccgtcgtgctatcctctctgtcttagcaattggaggtattgtcgctcttgttttggtaccaattgtggtcggatcggcggtagtagggtatttgatatcctacaacatacattgtgctaatggaagatgttagtttgtttatataccgtactcaaaaggcttatatcataaaaaaaatttaattcccctattaaacagatgtcgaacgattgaaagtcttttttgcttaaaatgagaatctacgaacaaaaatttagcagcttctagctgaattttagatgcaaaaagcatagttccaatttctcgatttctatagatcatccattctgtttcagtaaatgtttttcccattagtagtttgagtgatcctaattttgttagttgtaatctttcaggaacatcaaagggatcattcgaatctgtgccttgtaattggtgccgcttacggttgtaagcgcgtcgaactgatatccaagaggggtaattactcgaaatcgaattttcatctaacggatctctatctgtttttaagtcggcttctcgtgcttttcacaaaccttggcgccaaatgatattgccttctgactcaaatttataattttctcttctttgttctctatcaacctgttctgcttctagtttctctaatttttctggcttacagttagcattatgagttggctgcaacataacaagtttggttccctgtcgcagaacagctgacgcgacgttcgatttgacattaacatttttttcttgttcgcgaaaataacgacattttgaacaagaaatatatatgtcttcattattctcatttgtttgaatatattttctccaaatcttattgtcttttaaaaaattggctctaagctccaccctctcttatccaggcgtggatttttgcctaggtccagaggttcacgccatttttagcaacatgtatttttcctgaacctggatttttgtaaagaaaagctatgcttagacccgtgctgagtcgttccacaaaaaagctcagtgattgataaaataaaataattttaaaatattaattattgaacggcaagtgtaattttgatttaatttctattagatgtgttataaaaaagaatttataatatttattacatagctaaaaaaggaaaattcacaaattaattgaacacaattgaatttattttattttatcaatcactgagcttttttgtggaacgccaacagtgcgcttggtgcttaagttataaaaactaagattagcgggaggcatcgtggagaagttaatttaaaatgcaaaccaaataagatagcaataaaagtgtaaaaaatgaaaaagcaataacaatatttgttactttttattttctaatttaaaaaatatacaaattttttttataaactattattattctgaaataaaataaacatttcatattttatacaaatttcaataaattttacatttaattacacaacgagatagattaaaataaatatattagtaaataataaatatcttttcaaaaaagtaaaatgcttgtgtgtaaaaaatttaatagaagtataaagcgcaaataaattaatacaaattaaattatcaaaatcaataatttacatattagaatcaaataataatttaaaactttattcaataaattaaacattatatttatagaaaatttaaattacgggaggcatcgtggagaagttgcgcccaatttggaagcaatcagaatgacgatttatgcgccgatgccatctcacatcgtcaaacgacggcaacataaccgtttggacgataccgccaccgtgaggaaaaaaatattataaacattactttggtcggaatgtaaatgtttaaataaataaattactaaaaaaaaattctgttggtataagaatttaaaattgcaaaccaaataagatatccgcatttacaataaaattaattaaaaacaatttttaaaaggatttgaagttttagtccgtatttttgtccatatttggcatttttttagtccatattttataattcttatgtaaacaaagaaaaatgttcgaggaattaagcaatttataatttaaaaaagtaaaattattagcttaaatattatttattgtgcgtcgaaattcggttcccctttcacaattactattattttggtgcggtccaccttcggaataatggctattatctcattcaatttatgtaattacttggaatggactgagctacgaatgccaaaggccatccggtaaaatcataggtgtctcgacacgggactataaataatttttaagaaaaaatatagatctggaatttagagattgatagaatttgaaattcataaacagggctgcaaaaaatatgcacgaaaatgaccaaaatatgcacataaatatgcaaataaaattgccaaatatgaatcaaatatgcacaaaaatcgaaaatatgcaccaaatatgcacaaaaaaactaatttaggggtgcaaaataaataaaaaaatttattcctcataaattttatcggttgtttttgtaattgatcatcaaaaaatttctcaatgttttcggcagtgaagctcactgttggacccactcgcgcattcattcagatttggatttaattttaagcataatcaaatttttttcctcaaagacattcaaatcggaaaatatttgacgaaaagtggcaaaatatgcaaaaaaaatctgaaaatat

SEQ ID NO: 12435 - DNA, 2461 bp, Heterodera glycines
  misc_feature (20)..(20): n is a, c, g, or t
acgctgccgctgcgacaccncggaggtgcacgccgcccgtccaagcttggaagacggcgtaaaagaacaaaaggaaatgactcagatggcataaacacttgtccatttttctattgttgatattctgatggactacccaagaataaacgaaagtgaactcgcttttcccatcccttcggggataattgtcagtgggccgtcctcttcgggcaagacccagctggtccttcgtctgttacggcatgccagcttgatgtttgacccgccgcccaaggcaataggtatgtgcaaagggggtttctgtgcagtggactgttgctatttagtatgggcatacggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaagttggccgatctgtacaccaaaaagtcacaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacaggcatgtgccctaccgtacggctacctgttggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgcaaaagacatcagacagttggcacgtgtgcgaagcgagaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagacaaagaatgacgacgacattgctgagcggacaaacttgggctttgtcaaacgacaggtgaccgctgcagtacagaagcggaagggaaacgtcagcgaacggaacgcaatgtacaaccagcacctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagagattgaagtgccaaagtttttaaccccaacaagcccgacgcagggaagcagccgatcacccaggaccaataagaaagcagcaaaacagcaaaaattgatcgagaagaaggaccacctgttggccatcattatgtctgatccgcagagattcggcgcaacagaccgtggaaaaatcattaacccaaagacgggccgagagttcattgactcggacctggcctggtcaattgaacgcctggtggaccctcgcccggagaatgccccttcgccaagcggaaccaaagagttgaagaggaaactcgcacagaatccgcttgccagtagcctactcaatcgactgtttgttgggtctgggttcgtcggacaagtcaaacaaacgagaggatttattccctcaaaatggacaaaaaaataaacaaaatatacaccgacccggccaatccgggcgggtatgcgggggcgagtgctctgtacgcggcggtgaaggagaagcacccgaagttgaagcgtgccgagtttgaggactttttgcaaaggaacaccacctacacgctgttcaagccaaagagggagaagttccgacgcctacgcactgtgcctacgggtttcatgaccggtaagttgtaccggggcttattgcgcacaattcagggttcagatgttcaggcggacttggcagatttccaggcactttcgtgcaagaacagcggctaccgttacttgctgttggtggtggatgttctatcgaggcgaatgttcggcgcgcccgtaaagagtaagcgccctgtggacatgaaaagggcgtttgaagagctatttgagcaaatgccaagggtgccagacacaatgtacaccgatcgagggctggagtttgtggcaaaaccgttgaaggagttttacgcggagaagggcattcaaaagtt

SEQ ID NO: 12436 - DNA, 4108 bp, Heterodera glycines
  misc_feature (115)..(116): n is a, c, g, or t
tgcaaaaaaaaaaaaaaaaattttttttttatttcaccgattttttttttcttatttttgcatctggccagctttttgttgtgcgccaaaaagtgccaaatatgtgaaaatgacnncaataaaacaggatttttctggttttggttttcggaaatgggggaattcgtaaaaatttggcatattttgttatttttggggttcatttttgtacacctggtcctctctcaagcgaaaaacgcgtggccgatcattgccaatttgcgcttttggcgtcaccgtgccaatttcgatgaagccgaagcccgacttgcgcagcccgtcaatggcctccccattcttgtcaaagccggcggccaaactgaatttttattttatttatttaattatttgaattggaatttttaaaataattattttccgacagaaaaagttttacagaaatcgaaaatcgtttttgaaaaagaatttttttacaataaatttctcgccctccaccacaatcgacaaattcgtaaaaaaaaaaaaaaaatgaaaataggggtcatttgcaaatttgttgtgtgttttttccggattttattggctgaatttgatgatcgaattttgttttttttccgccattaaacaactaaaattagaatgaatttttttttaaataaatattattaaaggcccacccgattgggttgttcaactgtttgccgaacatttgacatgccaactcggggtactccttgcgactctccacaaaatcgtcgaggaaacccaatctgaccgccttgacgccgagaatgtgcgcactttcgggagcaaaccaacggtggaccatcggaacaacctcaaaaaatgggggaaaagttgaaaaaaattagcaaacttaattttgatttaaaaaatcccgaataagcgtgttaaaaaatggtgctgttttatattgaacccttcattcagaaggagcagttcttctcaaaattattacggcgaattaaaaaactttttcaaaaaatgcctgcaaaaaaatggaggagagggtaaaaaaaacagggaaaaaaactctcgtaaatttttaaattttcaaaaaaatccgaataatcgtgttaaaaaaaactttgtactatattttatattgaaaacatatgcaaatcttcattcatacggagcaggtcgtttatcgccaccccggaaaatgcgtacaaaatttttttgaaaattttctaactattttttccccaatttttgactcccttccttccgagagagtcatttttcgaataaaaatgccccgtttttttgttttgctcacccattccctgtgtaagcgctcgtcgccccgcaatattttgtacatgtaatagccaatgccaccggagaggagcactgaaatggtcaacgacgtgcgcgtgtacaccaaccgtctcggcttgggcaatttgagtcccgacactttgtcgtagggtacagaggagggggaggcggttttctgagaaatggcacacgaattaagggacaatcattgaaatcggagggctcataattgaacaaaaaaaaaaatcggatttgggcggaaaacacgaaaaattttagtcttggccataaaatttgttttagccagtgtgatgctttgaaaatcaggtggctcgggtgaaaaaccaaggcattttagctgatttatggacaaaagatttggccaaaaatgatatgtgacaacaatttggaagcattttaagggtttcattttgaaagtttgtagtccatgcttggcattttttaaaaaattcaaacgaaatttgtcaaaaaaaaagtttaaaaaatgtagagattttttaattcaatcgaaacccccaacgaattgaaattttctcgcgttttttttctcagggtttttggttaaatttaaccgttaaaaaaaatgtgcaaaccgaaaacatcagtgcgacagttggcgattgttgttgttgttgatatttttggcggcgtcgacctgggctcttaaactgaggaaaaattgacggtgtgtaaaaaagcaaagctgattttaagaaaaatggagcatatattgggggtattgaactaacacatgatctatggaaatctattgaattctaaagaaaaagaaagtatgtgatatattgcgtttatatagcatcggaagacatattttgtgctagaaaaagcagagcgtcgcggtggaaacgtcgccgggacataatgacgtcgcaaaaataaattaaaaaatttcaagaaaactcaaaagtattttagctttttgaaaatctaagtgttaataaaaaataaatttgctgaatttccggaaaaaacccaaaacttgaaaatttttttttaatttccttgataatttttttttcattttttctaaaattaaaaaaaaaattttgcggcgacgttttgtcctgctccggtttttgggccatttaacaaagaaaatggcaaaaaaaaagttttttgtacctccgggagagtgaattcgaatgtgcgcactgtgccacacttttgtcggtcctcacaatgcaaacggagttgaataagcggaacaaatttggtggttggggaacaatcagtgtcagagacaagctgagaatgaatgcatcagagtaaatgaaaattttcataattttagggttgcaaaatggaaaattttaaatcaaaaattcacatttgacaaaaatttattgcattcaaacaaaaaaaaaggttaagattttcagtgaaacctttgtggtgtagtcaaaactgcggaccaccaaatcggacattcacaaaaaatgggaaaaaataaatttcaaaaatgaaaaaatatttaaaaaacacaacaattaaaaatgtattaaaaaagaaagcaatgaaaattaaaatattaatcataagtaatttattcgtaataaaaaggggaaataaataaaacagagaataaatataaatgtaaaattaacaattggtggtcattcgtttttaatgttcataaaatatggcgcacgagaaatgacaacaataaaaaaagaagagatttttgggagaaaaaacaaaaaaaatggaagtgagaattgtggcaaaatgacaataattatgcgcaaatttaaatgaataaattatcacattcatttcaacaaaaacaatgaaaacaaaagggggaagagaattaattggcaaattaaataatttggtgtaaaaaagtaatcacttcttgggtcattccaattattttcatcataaatccgcgtccaacacatcctcaaaattttcatggtccaaaaatggcatttggtactgttggcaaattaacagggacatgtaaaaagtattagcgaaaatttacaaaaaaataaaataaaataaaaatttttcggtgggttaaccccatgttaatgtttttgctaatttgtgtgcgagactaaaatatcaaaaacattggtcatatagatccgaattggaggcagtaaggctcgactaaaacgccaaaaaatttttttttttattgttagtcacgaaaaaattttttgagtctgaattcgagaaaatcttggttgggctacctatacggctagggcaataattctaacaataagcgcatagcggggggggggggggggaaatacccaatttagcagcactgaattttggcacaaaaaaagaagatcaagcatccattcgcttaaaattttgtaccgaaatcagtttaatgcgatattcagtgccatcgccaccggcgccgttcaccaatgcgtccagtgcgcagctgctactgttggcatggttggatgaggacgagttgttggagcaggacttcacactcttttggtcatcgccgactccagcaacaattgaactgcttgccaccgcggacgacccgtcggacgctgctttcagcgaaatggcgtcgtcaacaaatttgaacggagactgcagcacataaatgaatttgaaattattaaaattaatcactattattgggaagaattagaggcgtaattattgagtcctattgaaaaaaaaaattttttttaaagaaattatggccgaaaaaagtctaataattgtaatgtccttaaatattttttatgaaattgtgttaaacaggctcaaacggaat

SEQ ID NO: 12437 - DNA, 792 bp, Heterodera glycines
cccaaatgtcgtggtccccaaaagtcgggtccccaaatgtcgggttccaaagtgtcagggtcccaaatgtccctaagtgtcgggtccccaaatgtcgggatccccaaaagtcaggtccccaaatgtcgggtccccaaaagtcgggtccccaaatgtcgggttccaaagtgtcgggtcccaaatgtcgggatccccaaaagtcgggtccccaaatgtcgggtttcaaagtgtcgggtccccaaatgtcgggttctaaagtgtcgggtcccaaatgtcgggatccccaaaagtcaggtccccaaatgtcgggtccccaaaagtcgggtccccaaatgtcgggttccaaagtgtcgggtcccaaatgtccctaagtgtcgggtccccaaatgtcgggtcccaaatgtcgggatccccaaaagtcgggtccccaaatgtcgggtttcaaagtgtcgggtccccaaatgtcgggctctaaagtgtcgggtcccaaatgtcgggatccccaaaagtcaggtccccaaatgtcgggtccccaaaagtcgggtccccaaatgtcgggttccaaagtgtcgggtcccaaatgtcgggatccccaaagtgtcgggtccccaaaagtcgggtcccaaatgtcggaatccccaaaagtccggtccccaaatgtcgggtttcaaagtgtcgggtccccaaatgtcgggttctaaagtgtcgggtcccaaatgtcgggatccccaaaagtcgagcccccaaatgtcgggatccaaagagtcgggtccccaaaagtcgggtcccaaa

SEQ ID NO: 12438 - DNA, 3162 bp, Heterodera glycines
gtcccaaatgtcgggatccccaaaagtcgggtctcccgaatgtcgggtttcaaagtgtcgggtccccaaatgtcgggttctaaagtgtcggtccccaaatgtcgggatccccaaaagtcaggtctgcaaatgtcgggtccccaaaagttcatattaaacattttctatgcgtaaattctttctctatttatcgaatttacatatagtttttccttttataaagcggtaaagtgtatcgatcccccccccccatctccgattcgcccttctgctgatcctttctgcattaaaatacacacattaataaaatgtacaaaaatgaatacctaatcacttttaagcgaattcgctatttctccgatacatttaaatgaataaattaattctggacggaatcccaattttcattcgattctcaatcgtcaaacagttattttacgttcttccaaattaattgattcttaacttttgacacgttatttaaaaaatgagaagggtttaattaataacgcttacatttttaggtttttacctattttttcctgagcttcatatggtcttaaacgcacgaaaaacatatgttttttcggttgttgttaagctagttttagttattagcaactattttctagctttttattttctgcacctaaaaaactaaaaaaaatttcgaagaaaactattttaactattttggcgttttgcccagcattaaaaacgaaaaatacacccctaggaatcgacctaaaaaatttttcaaaaaatacatccctatgaatcgaccagaaatttttcaaaaatgcacccctaagaaatgaaaaatttctcaaaattcatcttcaaaatttagttatttacttgacaagaatttttgatttaaaaattatttatctcaaaaccagagtggccaagtttttttttttcaagataagacaaaatggctcaaaaactaagactcggaccccaaaaataagatttttttcaaaaactaatagtagaaggaaacgcaataaaaacatgaaaaatcgacttgaacaataaaataaaaaccagggcctgtcaactgaaaattttcaaaatcaacattttgccgacaaaaaatcatcatttgggatcaaaaaatcagggtaatcgttcacatcattggtcccataaaaaaaggcaaaaaaaaaggtgtttttttttattctaagaagtgctcgggggttatcgagggcgctgatcactagggatcggattcttagttttttaactattttttctgcggctttaactcgacgagaaatgcacgaaaaacacattctttttcgaaaatttttcgtttttagtgccactattcatcactaggaatcactattttggagcttcgccactaaaaaaaactatttcggaagttagccactaaaataattttttgccactattttggcgtttcgtcattatttttgccactattttggcattttttggaaaatttcccaaaaaatgcaataaaaacgaaaaatacaccccaagaatcgacctaaaaaattttcaaaaatacacccctaagaatcgacctaaaaattttcaaaaatacatccctaagaattggaaaaatttcacaaaaattcttcccccaattttttttttcttgttcaatattttctaagaaaatattttgtaactgcaatcagtgaataaaatctttttccttaattttaaattattttcaaattaaaaaacagctatttaaaaaattacacccctaaatttggaactttttcaccactatttttgtcactattttggaatttttttctcactatttagttaattattttgggattttttatcactaaaaatccgatccctactgatcactaatctgacatcagattgtcatataaatcatctaatctatgatttttcatcaagtgatttctcgtcagaaaatagtttgaatttttttttaaagtaacagcgagcgagtggaattgcagacccattcgaagagatcttaactcaattttggtatggcatttatgcctccgcaataattttggcgcgtagctttagcaattccacacgcaagttgttgattttaaaaaaaaaattcaaactttggcctcaaaacggaaaagtaccgaaatttgttaattagcaactattttctagttttttaaaaaattttagagcctaaatgcataattttttttactaattcgatgtcttctctcctcactcattgaatttgttagatttttcttttgattgacatgccgcctcctctctatctgtccccaataattgaagtcattcgttgccaaatctgcgcccattcccaattcgttcagagggatgctcaattggtccctcgtgaccaattgttggcgcatatcgctgcgcacattaattacggaccaacttctgtattaatccataattaaaagaagggagcaaaggcttacttattcttatttataggagaagaatgaacgtcttaaacaaatatgccaacgggagtacgaacattgcatttgcattgactttgctgaacgacttggccatttgtctggcgaggacggccatcggcaccatgaacaacagcaggcgaacatgacggtgagcacaaaaggaagggcagtgagtttgggcaaaaacttaaaaagatgatttgtttattcccgtggtgtgttttagcgagttttgttttgtttttttccatcgggtcaacaatttccgtccctttgattttcagttccctgctgcccctcctcctcctcactttgcgtcttccatccccaatatccgttctctctcgtccaattcgtcgtcctgtctccctccgtcttcctttgccgatgctttgccttctctcgccccgtcttcgtcatcttccaaatctgtgtcctcttcatccatcagcggagcggcggcgaacaatgggccaacggacaaagccatcggaccaagcggggcaaacgccatcaaattggagagagtggtgaatttcgttggggaatcggaaagacaaaaacgaacgaaaattttgaatatacgcctttaaaggtgccatcggattgcttatcggtggcagagaaagtggacgacaatcgaaggatggacaacaatgaggagaaggccactaacttctacaacaacattcaactcatggaaatg

SEQ ID NO: 12439 - DNA, 548 bp, Heterodera glycines
cccgacatttgcccctgtgtccaaaaatgggttcagaatttaaaattgcccccgcttttggacatatgcgcaaatttggggtaacccactacgccccccccccccgtatcaatgcccccctccctgaaaatttttatttttctaaatttcttagaaagaaatgattatacttttatgcagcacatccgtccgctgttccaaatgcaagtgccgctttcacgggaaatgcgttaagatccgtccgcaggaggcaaaacgcattccgtactggcaatgtccaaaatgccaactggaagagaatggggcggaagaggtgagcaaattgggaagtcgggggaacttatggtaattagggaatggatggacaaaattttacttttcaggaagaggacgaagacattcagcagatgtattgcagttgccttatgccggacaacaaagaaacgtgattttaaaaacactagtaatttgtttttggtgttcattcgtctgtttatttcaaaacggtaaatggcctgcgacggatgcaacgaatggttccacccgaa

SEQ ID NO: 12440 - DNA, 4110 bp, Heterodera glycines
taagcatggcgaaggttgacttttcattgacattttgtaaaaaaaataaaaatttaaatccgaaaaatgatttttggctaatcacagatcatctcctcgtttgtctcctccgattctgacgactgttcttcgtccccgccaattgctcttcagttggaccgtccgtcgtccgcgcaacgcttctacagtaatctgttgacaatgagctacagtaagcacaagcggcggaatggcaaccatagaggttggaaaattccagaaaatattgaaaaacattgaaattttaacattttctgctgaagcttcgcgtgacaagcgcttttggcgacgaagccaacggcgacgaagaggcttagaagtgattgactttgagacggacaaaagctcagtgacatcaagcataaaatcagcagaaagtgggggctatttcaaaaaaattatttaaataagaaaataattttttaatttggtattttattttctttgcattgaaatttttcgtcaatgaaaattattagcagctaaagctcaagtgcaaaataataataaataagattacggaatttaccggcaccgggctctggcggcctggtaaaagcccgtcgggcgccttagcccaattcatctcttcaaaataacaaaaaaaaatgaaaaagaattatgtaaaataaatttttaattatttaaaattgatatccttcaatgtctcaattgttttccaaatattcgtcatgatttaaacaattaagactaaactcacaaattagttttttaatgataccatttaaatcctctttcagctgacaagataacggttagataattttgccgaaaaaatacacattttatggatttatgaagccaaaaacttaatgctttcatctgtattttaagaatccgccggaattgttgacaaaaacaaaacagttactgcggcacaacaaaaggaagtgccgactttgttgtccggcgggtggggaaaatccggcaaaaactccaaggaacactttggctacaacggcacgagcagtgcccgaagaaatgcactttctgcggaatgtccaacagattttgcatcatcatttttggatttattggacatggttttggcaattaattcaaatccaaaatgccattttatttttcaagcgttcgcttggccaggtgttcatcgacctcgattttctcgattccagcgcgggctccgacttttttgccgtcggaattagtggaaatgtttttagggacccgccagtgccggtaaaataacccataaaattgcaaaatttttgctctccagttttactcaatcggcaaacaaattaatttgaaatttcctttaattccccgttttaattgctttttcgtctccatcagatgacaaatgtcaacactgatttggtcgaagacattgtccaaattaattaatttatctcagatatttttttgttaataagtaaaaataataattattatagtgcaataaaattccaaaattagattcatcattcattcattcgatgatatgacgaagaaaagctcaagaaatccaattaaagcaagattaattattttaaaattcaaagaaatattaatttattaatttttataaatttaaattattaaaaatatatattaaaattttacaacaattatatgcgtggtgagaccaagcaaattatttaaaatttatttatttaaataacaaataatagaataattttgcgctaaaataaatattcattgctcatcgttttgcaaaacaaacattagttttctttgaattttaaaataattaatcttgctttaattggatctcttgagcttttcttagtcatagcatcgaatgaatgatgaatctggtttggaattttattgcactttaataatattattagggatgcaaaaaatatgcacgaaaagtagccaaaatatgcgcataaatatgcaaataaagtcgtgaaatatgcaccaaatatgcacaaaaatcgcaaaatatgcacaaaaaaacttaaaaattaggggtgcaaattcaataaaaaaattttttttttttactagtgacttgccaatgagctgctacatttcttttataaaattctctttagcaaatattgacattttttaaatcaaaaattttctcatgaaaaaaaatttgggggaagaatttttgagaaaatttccaattcttagtggtgtgtttttaaaaattttcggtcgattcctaggggtgtattttccgtttttattgcatttttgttaacaaattttccaaaaatggcgaaatatgcataaatatgcacaaaaagccaaaatatgcaaatatgcacaaaaaatctcgaaatatgcaaaaatatgcaaataaaagtcccgacttttatacgcaaacacaaaaaagaaagtgtttttcctattatttagagcatggagaaaccaggaaaaaaaatgcatttgcataaaatttgcaccctaattattatttttactaatattaacaaaaaaaatattttaaataaataaattaattattcgaataatttttctgggactgaaacggcccttcccccaaaactcaaacacacatacttttgtcactccggctcaccacggttttattactttttcgtctccatcagcagatgacaaatgtcaacactgatttggtcgaagacattgtccaaatgaggccgaacagtgcgaaaaaattggcggaggatgaggacaaaagtttgctgagagatgttgacgaattggagacggatcagcaacagcgggagaacaatcgcaggacaaaggcaccaccgccgccaatgcttcgcttccccggcgtcggattaaacggatatcagcgcaaagctgtggaaatgattatctccgaaatgagcgcaaatgcggcattgcagcaggcatttcggtactcaattggaattccgattcaaaattcgacaactttaagtgttttttttgcatgtaaaatttaaaaaacccatcaaattttggcagtttaattaattttttaaatttaaattcttgagtaattttaaatttttgagactaaaagtgaaaaatcatttaattcgggaaatacaaacaaatttgatatttgtatttgtgaatttctgaaattaatcttttctcaacgagaaaaaataattttcaaataaaaaatagaaattttggaaaaaactattagacaatcgaattttttcaaaatttttctgtctttaggagtcctttgaaattttcttttttttgtgtgagatagcacaaatatgaataaaaaatagaatatagagaaaaatatgatcaacagaaaatataaaaataaaaacccatccttgatgcttcttctaaccaagctaaaattattattcacttggtttttagactaaattaaatgtgccaaaatagaaatacaaacaaatcagtccttatttgttagcgcaaaaatgatgaaagttcggctgggaccaaactcggcaatgtttggccaaatgttgcgcaccacttgtgggccggacgaagtgtgcctaagcgattccattcccgaattgggcgagaaatacccggaccaacagttggaaattgaggcaaattagttgggagtaaatgcaaaatgccaaatttggtaattcacagattgcacctgtgcaagcgcccaacataaaatttgccaaaggtattttatcagggttgttgcaaacacgaaatgatcaacccccgggtatttactctttttgtgagaatgatttaattgaatagaaatcaattttatattaaacatgaaaagcagaggccaaaaaacagacgaaaaaagtaattaaaggaaaatgcccaaatttaatagaaaataaaaacgaaaattatttacccgaaaagtgggaccaaactctactccccaaaatttcgaaggacgaagaaatgcctatttatagtatttgtcacgaaatgccatcacagattcagtgactgtgcaccttgttggcaatgccaccatttttctgtcccaaagcggcaaatccatcggccgaattccgttcgaatcggacgtcgaattgggcatggcactgaacaacagcagcagcaaaagccaatccgcaacgacaaaat

SEQ ID NO: 12441 - DNA, 1264 bp, Heterodera glycines
aaaaagagatagccattttctgagatatctattcttagttatggagccattttccaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaccgaccatttgtagggctcaaccgtatata

SEQ ID NO: 12442 - DNA, 2108 bp, Heterodera glycines
ctcaagcggcggtttctccaccagcaccgacacatccacaatgttgattcgtgtctcgcacttgacataacgctgatatttgatggaaaaccatgtgcccaaactgagcacccgaaaactaaaacgatcgctgtgcaaatgcatcgatggaatgtccgattgggactgacttctttcggttggcctgacaatactcatcgaagcgacattctccaggcagaaatgtcaaaaggaccaaatcactgccattataagcccacaacaaagcaatcgatcgcctcaccaaaggatcaagctgcgcctttttcttcgttgccggcataaagcgccaaaaaaccaaatttaaaggttaaaataatcaaaaaattaataaataaaagactattaaacttaattaaaagagagaaaagtttgctttgcccaccattccttcaatataaaatatttttattcacaatcattaaaatattaattaaacaattgcatagaaagtatgtaaaaatgaaaagaaaagagattaaagcaataaaggagaaaaaatgataaaataaggcaagataattcaaatgttgtgaaattctaagttaaattaaaaaaaaagaaaagtatggcaaatttgtaagtaagttaacaaaaagaatggaaagtcgatggcagattagttatagaaacactgggtgataaatttcaaaaaaatgcgaaattcacatggataagtagcgtacggtccacaattgattagggtctcgtaaatcacatgaaaaagtttgtagaacaaattgcaagccgtttccctcgtgagtttcggaggcactgccgagacattttaaaccaattttgacaagaccatttgcctcgtgctgattctgtccttgcaacggagttggaagacgccaattgaccgaagcgacctaaaatcattgggtattaatctcaggcatttgataatttcacaaaccttacaatccccattgaacgggacgcccgaagaagcattgaccgtgagacaaaatttgaaggcgttgtgtctgagttttccacttaatggactgtacatccattcttgattgcctccgtcacataaacaagagagcttcgtcccgtatttattaccaaaaaccataccatgacattggtagagccctggcgactgattccatttgaactttcccaaagtgtccaaacacattccttgttgaatgatttgtacacggcgctccccggaatttttaagcggtttgagttccgggtaaacttctttcaaataccatgaaaagtttttgcaatttaatctttctttaatgcgtaggcgctcggaaatgctaaaaaaatcaaaaattcggagataaattttcattggtttaaacgcactctccgaagtttacgtatctggcagaaggaacagtttggaaataaaactccttgtaatcatccaaccaaacttcagcagctcttcgcgtatttctgaaaaataaaaaagcgaaaattaaaagttaaaacacaaaaacttttggaaaatacggccgcttcccccggggaacgtgtaagggtgctgcttgcgaaagacatggccaaccctaaaataggtaaaccggaattaacgaaaaaaaatcggatgagaattaaagaaagtgagtgaaaatttttgaaaaattttccacgattttcaggaaaaattatttatggggtttttaatcttaaattttgacataaaaatcggcatctgtagtttgcagtcgaaatgattaaattggcgattccatttattggttacaatgaaaaacagcaattaaagattatattgctcaaacaataaatttaaattggtgccccccccccattttgcggattgccaacctgctgcatggatgaatttcaaggcttcctccacattgccaaatgcgaaaagacatttcttaaattaggtattaaaatgaatgcaaacttttaaataaaccaccaaggttttctccaccccaaacatccattttctaaattgaaatgcttaataattatttttattttgtgtgtctcacagtatcgtaacgtcctaaggcatcgaaccattttttgttaattgagaataatcccccagcacataacaggag

SEQ ID NO: 12443 - DNA, 1220 bp, Heterodera glycines
ttcctttattggttttttccggtttttttccccggaatattttttttctcttcccaatgcctcccatctgaacaccaaattccaaccaaatcctccgcgtaaatctgagctggccgagacataattgaagttgtccatgtctaaaataactcaaaaccgttaaccaagcaatttctaatcacttataacgtcaatcacaggtgcaacgacagctttgtcattctgtaaaaaaggaaatcaaaagccgggtcggtaacagtacttcgaccagacgttgaagcaccggttccaaccatccgacgttacactcacaatgactgtctaaatgggaattaataatatatgaaagaaaaaacaaacccaaaaaagtgaggacaggagcactggcgataatggaaccatgaactcgagaacgaataagcccttaacggacagaattaacaaagccaaaaaggagcacaaaacccaccctctcgctttctgtttcggataattcgcattttgtcaataccaaataaatctctgccaatagtggctaaaatgcttactcatatgttgattttttcgttccaaatgcaaaccatcgaaggagtaatcatcgacaagaataatttctttaagtaaatgcgatggagtgcgaatgaaaatggaccaaattgtacgcaacaatgtggaccttgcctcgttgtggaaagttattataatcgatgtgggtggaagaacatgggaaaactgagcatagtttgagtctgatttgcaacttaataatgtacaaaataagactgttctttttgcacagcaaaacatctttggatttcttaccttcgttcgcgagtgtctggcaaatgcctagaaaagactcataaatagagtatttttagtggtgaaaaagtcaaaaatagggacctaaataggggcgaaaaattcgcgtaggggcgaaaaagtttctaatgtagggatgaaatttattaaaattgctgttttttctatgtaataaggcaaacaattttattcatggattggcagttagaaatgaagtacatttcgaaattttcgggatttaagggtcgattcttaggggtgtatttttccgtaattttttttgggtcgattcttagaggtgtatttttttgaaaatttttaggtcgattcttagggggtgtatttttccgaattttttttggtcgattcttaagggtgtatttttcgtttttattgca

SEQ ID NO: 12444 - DNA, 1758 bp, Heterodera glycines
  misc_feature (60)..(60): n is a, c, g, or t
  misc_feature (1604)..(1604): n is a, c, g, or t
  misc_feature (1733)..(1733): n is a, c, g, or t
acaggcaccgttgcactcaaaagtccactaaattttcaaatttatccaaaaaatttattntaaattattttacattgaaaatattttttataagataagcttttatttttgtgaaaaaagtaatttttagaaattaatttttttttttttttttggattttttacccacttggacccgatacccggacccggttgaaaaatttggacatgggtccggctcggcttttctggacccagcaatatccgggccagttttttcctaaaaataccgggacccggcctaccccggccaaccctaaaaactcctccctcacccatccctttgagtcgtcgaattttgaatccaaaattatcaaagttttgtccccatttatttcatcggctttcgcttttggccggccatcctttgccctttcttccgcttttttcagcattttctccaaattttgatccagtgtttttcgtattattcggtccacacttttatttatttggtattgataatccgtgtctatggccaattgtaaaatcatttcattaattggcatttgtttttcatctttttctttttcatcggcgtcctttttggcattaaaatttattattctcttttcattcaacaaatttagtttaaaatgagagttaatcaagtgaattaatttaagttcatcataattactaattgttgagttcaaataaaactgccaaattatggccagacaattcaccgcataaattattggcccttcgatttcaaaatgtctatttttaaacacgaattttggctttactgttggaattccggcatactctcctatcaaatattcatacaaaatgtccaaatatttgcgatatttttggcattttgtctgttcataatgtgctttaaattgctctccaattttgtcacattgccaattcttttccataaagtgcaaaatgccaatgtgtgcctcatatttttgcattgaaaattcactgattttgttttcgttatggcccttcataaattcaattagcatgccttcgtcgacctatcaaattggaatttagccaaaataattgtcctaattaattattttgtgtggtaaactcaccgattgaattgcacttgaaactggaactaaaagcagataacaaaagatggtaaaagaaattgaaggaaaaaaataaagcattttctataaaaggattgccttgtcaaataaatgtttaacaacccaagttagaaatatgttttttaattggactaaagtaagaagaaaaaaacaaataatgatatttgttaaagagagacataaaataaaataaaataaaaattatagccaaaatatcgataaaaataaaatttatttaaaatatgtatttatatttttgatgataagtgtataaagcaaaaaaaaatcaatgatagtttattggcattttttttacaatatgctaaattttatctatccttttttacaaaatattacccctcttatgcttttttgtttgtgttggacacagggctgcatgcaactggatttgcaattacggaaatccgtaatccgtaattacggcgattttctcagttacggaaatccgtaatccgtaattacggnggtccaaaaaccccgtaatttcccgtaatccgcaatccgtaatccgtaatttttaaaaatcaatttttctcagaatttagaaaaaaatttttaaatagtgattaataaaatcaaaaactgatttcttgnattgagttcttcatttttttattaa

SEQ ID NO: 12445 - DNA, 2917 bp, Heterodera glycines
  misc_feature (955)..(956): n is a, c, g, or t
aatagtattagtgaatttaactgctgtttttttctggtattacaatttatattttaactcaaatttgtcaaacaaattaaaaatttaaattaaaaaacttattctttttgttaattatccattgtaagattgaaaatataaattattattaatgttattttaaatttttttcaaaaattaaataaattcattataaatatttattattttttcctttctaacaattttataatttttattaatttttaatttttaaatttttatctcttataagctaacatattctacgaatttttcaaaaaaaaaactggaaaaattattcatatatcctagtaattataaatttatttaattttttgatgctcacaaaaattcgaacaaatattctcagttacggaaatccgtaatccgtaattacgggggtccaaaaaccccgtaatttcccgtaatccgcaatccgtaatccgtaatttttaaaaatcaatttttgtcagaattttagaaaaaaatttttaaatagtgattaataaaaatcaaaaaactgattttcttgatggagtttcttcattttttatttaaattttacaaataatttataattttgtgtctgattaaatcattctttttgaatttatgggttgatttttgaaaattttttgaaagtctgatcattataatcgaatttatgtatatgtatataattatttcaacattttaatagccagaaaaaaattacggaggggggggggggggaatccgaagaattttttttggtaaaatttatttagtgttatttaaaaaagttcagcgctggacagcaaaaacaggaattgtaaccatttttagccaaaaaaagactaatttttgccattttgtagtcaaaatttaaaaaaataaggtaaaatcgagtaaatcgtggtccggcggtgccgataggtgccgccgggcaaatttnntttaaaaattttaatgattttattaagaaaaatctacaaaaaaaaattaaaagtcccaatttttcatgtaaaaatttttaatttttcatttcgggcgggggaaggggggaattcctcccctcacctggctaaggttttatgaattttcataaaatgcgtgaaaaataggtgtgacaaaaaagtgatgcctctattttctaggcgaactacccaaatagccttaacaacaacaaataaaaaattataaatctattttaattcttaaataaatcgaaatacgggtagccctttaaataaaaaatagaaaattttgttttttataaaaataatcgtacaagaaatcgtctcgaaaaaataatccaaaagtcaaattacggatcaaaattacggaaaaatcccaaaaatccgtaacccgtaatccgtaactcccaaaaccccgtaatttccgtaatccgtaatccgtaattgcgtgcagccatggttggacacgaaagaattttgggctgaaatttaataatttaaaatggaattttggtccacccgtatactgtttaaaactttaaatatttacctattttttaaatttgatgtaggcaaaggaatttgttgccattaaaattttcaaatcaattatgaaaattttattttagcttagaattataccgatcggccttttttgctttttcaaaaccctttttacggcgaattttttcaaaaaaatttgggctacaagggggggggggggggggggggtcgcggcgtgccggtaggcgccgccgggctttgtgtgtgcttgttaacatatttacaccaaaaaaaatgacaaaagttttgcgattttgactcaattttttaagagaaaaaggatttttatgtgccggcgggaatcacaccttaattaaggaattttaggagaattcaaatttaaaaaaataataattttataacttttatgaatttatggtaaaaaattgtgactataaaatgattttgaaaattttttgataaaattttaagaatgattgaaatattttttagaatttgttagtaaaaattacgtgtatcatgtttagcggtttgtctttttgtgtctttggggtgtttaatgtttcgtatttcttcgtattccgcattttgaaacgtttataaagttgtcaaaatctttccaatttcaagctagactcttcttgaaaagctagtattaaattgaatttattacataaatgtacagcaatcagcaataaaaataattgccaaaaatgccttaggctaatcaacgaatgtaaatggtaaatgccggagaaatcaattatcgaaattttcatggtaataaattgtcgagagaaccactgctatttaaaactattgaaaatctgaaaagcttaattatatttgacaattaaatgaaataaaaaatatttaaaatttattttttcgcattttttgcctttttgtcccagcttcaatattaaatgaaaaattaattcaccccgatttctttttcgaattgctgagaataattaaaagtgttatttcatcatttcccaatgttttttaaaggaattaatttctgacattttcaaatgatttttgccaaaaaataaatgccgaaattatattcgtagatgtatttggaagcaaatgtgagactataaaaatgaaaaataaaacagccaaaagcattcaaattttctattcttaatcattgaaattttatgaacactaatattttcatattttaggcattgaaacttcatattttcgaattttttcgattttaatcattcttaactctaaaagcattcaaatttttctaatttttaatgcttgaaatctctctcatcattatttcttccttgcatctatgtcatcgtccccccgattgtaccatatatttaaataagaacctctattgagcattcaaaatttcaactttttcgatttttaacatcgcaatctct

SEQ ID NO: 12446 - DNA, 2293 bp, Heterodera glycines
gacacaagtaccattgcccacccctccagtcgccacatgtcaccacacccctcaaataagttttgggttatacgaccacaatttggcaggttgccaactaaattgttcatgctatgccacactacactaaaatgagtcgccgtatgaccaacattttatgccatccacggtcagtcattagcgcttaaatgaccaccagcgggcactcagatagcccatgcgggcgcttaggtgacacgtgcgagcgctcaggtggcctggcatcccttccctccccaaaggccacgacagttgatgtccgtccctccaatacgatttgactttaataattatttaattaattaattttatatttcatttatttttaaatttttatctattattttaattttattttaatttatttaatttacctaattttaatttaatttattttattttaaatttaatttgaattaaatttaattttttaattaaatttaattttttaattaatttattattattattatttatatttttgtgtggtattagagagagcaagaaaaaagagagaaaagaaagaaagagagtgagagagagaaagaaaaaagagagagagtgagagagagataagagagagtgagagagagagaaaagaaagaaagagagtgagagagagaaagaaaagagagagagagaaagaaaagaaagaaagagagtgagagagagaaaaaaagagagagagagaaagaaaagagagagagagaaaagagagatataagagagagaaagaaaaaagaaagagagtgagagagagagagtgagataagagagaatgagagagagagagaaagaaaagagagagagagagaaaagagagatataagagagagaaagaaaaaagagagagagtgagagagagataagagagagagtgagagagagaaagaaaaaagagagagagagagaaaagagagatataagagagagagagaaagaaaaaagaaagatagtgagagagacagaagagatatagagagaatgaatattagcttttttattcaattattttttaaattataaaaatttttttttttaatttatttattttaatttataatttattttattttaatttaatttattttttaatctttttttatttattttttttatttcaattaatttgaactttaacttttatttaattttaatcctattttaatctaatttcatttattaatttaatataattttagttttatcaactttaattctaattcatttaactcgaattttatttttagcgctcaaatttaacaagtgggctcacaaaaggcccctgcgtgcgctcagatggcacgcgcgagcgctcaaatggtccctacgtgcgctcaaatagcatacgcgagcgtttaaatggcacacacgcgggcgctcaggtggcatgcgtcccttccctataaggcatgacagctgacgcctatcctctgcctccctttccttctctaataggatttgacctcgggttttatccttcagatgttttttcaattatttacctcttctgggattggatatatttattataggtgttttttaaaggtttaaatttggtactgaaatgtccctttccagtgggactgaaatggcggggctgaaaattaagggccaaaatctggtggggtaactactgttatcaaaattcttttaaaataataggcatactgtaagcaaattatgtatcacttgcgaattttccggtcattaaaattagagagcggaccggaccgggcccggcaaaccggtccggcgatttttgagaattccggtctctaattaataaaaacacctgacaatgaccagaacaccatgtgcattcatgttctccaacagttgaagcaactttgaaccggccaaatgctcaccatcatcatcttcaattattgggtcgcaataaatttgtaaactgtacaaagaggtggggggggggggttcacaggcaaatggggaaataggaaaattgtaaatttgaaataattttttaacaaaattcattaacaaacccaaagtttttcctccggcgcctatcggcaccgctagacccttcactgttgcccaaaaaacttttgaaaaagcgcgtcgcaaaaaatctagctgttgaaaagcaaaaaaagtcgtcgatttacatgtccttttgaccccgtcgcaaaattttcgaattatgacctccaatagcagcgggtttgcttttatccacccacaacttatagctagacgcaatcacacaccacaatcatgcaacgagatc

SEQ ID NO: 12447 - DNA, 2982 bp, Heterodera glycines
ccgtgccacactgatgcacaccctccagagaatggcatttgaaataaaaagaaaatatgtaaacttcggataactgtttttatgataaaacaaacatttaacatgccttaaaactaattaatgggttaatgagaaaatgactaattttgtctatagcctaaggacaaataaagaagaaaaaacttttggtgggaggagagaagaaattgctaaaattttcaaaactttggactttttcaggaaggtgatatcacagaattcgaatatgatcttccgtatgagaaatttgacataattgagcgcatttttgacacccaaatgaccacaatttgtctgtttttccttgacaaattccttgaagacaatgagaaaaacagaaaacaaattggaatggtacagacattatacaataaatactaatattaataatattaaattgccaatttcatttaattttttaattttttgggatttagataatgagaaatttgcaaaaagaacggaaagtgttggacctcgaaagatatatgcggaaaagagagcaattcgagcagattttaaaaagcaacaaaaggcaaattgagaaaaaacttccgtttttagaagaattcctggcaaaaaagccaaattcctttgaaaaaatctatgccgacaaaggcaaaacaaagacatacacaaatgaacaatatttgaagggacttaaagcaattgaggacgaattaaacaaatttgaattcgtttggtggcataatgaggagaaaagatggacaattagtaaaaaaattaaacaaaaataataataataataatattttctatttttaaaaatatgcgacaatcaaaatatttacgagttcaaagggctcatttaaatgcctttctttttaaattttatttataaatgaaaaatttttttatcacagaaacagaagcggaaaatgtcgcctctaattattaaattatcttgtcactttttgcaggtgatcgtccggcaatccgacaaattgtgtgggtggtccgacacgcggaaaaaagaaatggcggaacggaagacgaaacgctgacagagaaaggcgaagagcaggcgaaagaactgggcaaatggtaagaaatgactatttaatttgaaaaatagaattttaatttcaaaagtttggccactttttggacatttaattttatgtggccactttcacaaaatttaaattccaacaaaagtcaagtatctcgctttttaaaaattaaagccagaagactttgctgttttcaaaataaaaatttcaaagtctcaaaattaacaaaaattcaaattggttttcctgatcagcgagtgatcagcccaaatttacaaaaaactatgcccgttcctcgcgttaggttcaaaacagtgcccatcaccaaagtgttcgcgtcgccattccaacggacaatgcaaaccgccgcttctctgctgggcgaaggccatcgcgcgttcgttcacattgagcccggacttagcgaagtgtgaaaatattttaatacatttgataaaatccgaattttcagttcgagaagccatgcgatttgaaaattggacataaaaaactgacggagctgcacaaagacaaagcctttccgcacacaaacccaaactattggcctatgtacagcgaaaagtgagcaaatcgaattaattaattattatttaaatggaaatgtttttaaatttcattgcttttctaattaattttaattatattttatttgcctttttagagcactcaagctgattaaggcggaacgagaagagagtaagcggaaggaagaaagcgactgccattttgtggtggagcaaacactgcgacgcattttgacggaaaacaaaaatggtacgaaaattaatgcatttttttgactcggataatttgtcaccggccaaaacagtactcagcagggattaacaaacattgctttaactcagccacccatttgaccaatttggcccatttaattgttttttatggaactatttgggtaataagccaattaattgccaattaggacaatcgtttaattatactttttttggactttgcttttgttcagccgaacatattgtgctggtctcccaccgtgacgtcattggccacgtcaacgaattgttgggtggcaattgggccgtcgtcgacaccgctaccgtaaacaaatatgtacagtatgcgaatgggaaggaccaacagaaggaggatgacgatattctgagcaaatttgttattgagcacacgggagtgcacgtgcactaaaaatagcaagcgaatcaccagcagacaggggtaggggtggttccgtattctggcaaatttatggaaatttttgacaaaatacggaatttgaatcactagggatagaatttttgaccttttccccacctcctagagaaaagaaaatggaaaatttttggctatacaatgcgacgaaaatataaaacagaacagacaatttcagaacaaaaattcttacctcaattgtcaaattcatttttatcaatacgatttttgtacaaaaagttatttaattttaaaattttgctaattactggatttagcatttaattgatgctcctttttgtaaaccaatttttcctcagaaattcgaagtcattttcgctattttcggggctttttcgaagcctatatgtgctgacaattttttgtcaacaattccatccctagtcatttttatttattcattcattttttatttgtttggacaaattttctgttggataaaatgcgattgctgttttaagttattttttatatttaaaaatattttttcaattttttataattatttttcctcaaaaatattaaaagggggagagaagcgaattttttaattttttacaatttagtaaggaataaccccaaaaatcacaaaaattagttttaatatgcttttccatttccaatcattcgttcatttttcggcactctcaaaaat

SEQ ID NO: 12448 - DNA, 2489 bp, Heterodera glycines
  misc_feature (99)..(99): n is a, c, g, or t
  misc_feature (114)..(114): n is a, c, g, or t
gatggcaactttgtcaaaaaatgaggtcactttccgtcgggcgtcgcattttgcgattttaaattttattgtaaaataggctcaagtgactttcgatgnggatgagttggattngtcgccatatattcacgaaaagtctctgcttcccaacacggcatttactctttatgccatgacggtgaccaaatggctaaaactgtcctaattacgctaattgctttaatgcctttaagaagcatatcggcagtttgcaccttggtcattacacatcgactgtggttaatctgacaagcactgagcagcaatggctaagctttaacgatgagtcatgcattccgtgtgccaccgccccatcgcccacagtgagaatttctccccattcattagggaatcattttgaagattttgtttatctttttcagagcaaagaggcatatcttctgtactacaaactgaccaactcaactaactcacaggccaagtgatataatattatcattattatttatacctgtgtactgttaccaaacattttcaaataaatatttttgtattattttaaaattaaaaagataaaatatcggactaaattggaaatactgactgtaaaattgcagtaacaaaagcgagggcgaaagaaacgacgctgacgacgacgacgacgatcaaactgagatagaacagtttaacagagaactcaatgaaatttgtcaaatgttgcgtgaacattaccgtaatgaagttccgaaaattggccgactttgcgcccaaatgagcgaaggaactcgccaagcgttggccatccaacaacaagtcccaaatcccgacgaagtgcaacaacaccgggagaacaatgctagggacaacaaaaacaagaattcgtccaacaaaggcatttcttcgagcaaaggcaacaactgtgacaatgccaatgtcaagtgtgaatcggtgagcaacaccaaacaattgggatcactaatttttcttagctcggattatcaatgccataagttaaaaagctcaaaacaaaatactgggcatgaaaaattaaaaattggagaattgccccattttttagggtttgcatcagaacgcgtggtggcaacaacaatttcatgaaattgagcaagcacttgataatgatgctgatgatgaaggcatttcgtctggcgagtgcagcgacaacggaaccaatgaaaatgataacaaaagtgacgacgatatcgaaagtgatgccgaaagtgacgacaaaccctatgaatgtgattgcgaaagtgctgaccacccaatggagtgtccgttgctggccgctcgtcgtgcgcttcgtcgtctcaaattgccgaccattcttgacatttgtgccgcaaccgaagcagaagtgcgacaatacggcacaaaattaagtgacattgtcaaacaaatcgccaaattacgcgttcaaaacggcggagcactgacaagcgaattggaattgcggagcagacagaaacaagcacaaaatctgctgcaacaaattggaaatttaatgccacaattggtcgttgaagaggaggaagtggcagaaattctcaaattcgtcgaacaaagcgccgatcgcttttccattggatttcgggacagaaagcagcaaaagcaattcaaaaaagcaattcgacagccaaaaaaggtgtgcagcaatttgaaattagcgagaagtttcttccttttatctctagtcgaatatttttggtattttgttatttaaaaagttacaaaaaaaattgctgagaaatttccaatgagtgaatggttggtttgcttaagctgcaaatttatatcccttcgttcaaacaaataattattcggctaccaccaccaacaggctttcgaggttctgttaaagcacaatttggacagtttggtggagccattttataaggactgttacaaaaaactgtattctattgacgatgaaacacgggaacaatcagaattgttcgtgaggcttttggccgaaattgcttttgtgcacgtcgtgggattaaggttacagctggaaatggtcagtagagaaggcatggtttaacaaaataataataataataatgcattttggcagtgatttttggatattttttatgggatgttagactagatcagctgatagaaattataaattacatcatagaaactaaaaatatttgaaaactcattaaacaactttcttattacttataatttgtgcacttttcaattatttataaaatttaaagatatatttaatgaatttaagtcataaaaatttgacaaaacatgctttcgtaggttttctggtccctttttcaacttgggtccgttaattattcttttatgccaaaatccaacagataattaattcctcctgtattgttcaggtggaaactgaatggacgcatattgtgcacgcgatgttgcagatgcgtaaattaataaatgcagctcagtatttggtggaagaggcacaagcgaaa

SEQ ID NO: 12449 - DNA, 868 bp, Heterodera glycines
gattaatcaaaaaaagatcaattttacccaaacacttggaatgtatttgatttgcgttgtatgggcgaaaaatgataaagaatgagatttttgggaatttttatgcaaaaacacacttgatttttccaatttttaacacatattttagcacatattttggcatttttggggtttttagcacatatttcagcattttttagcacatattttattacatatttcaggatttttagcacataaaaatcccatccctagtcatttcgctttaattaataaaaatgtacaaaacaattctctaaatgggcttaattttgccgggacttaagtcccgctctgctacaatttaaattaagtattcatagactatatatatttaaaataatgaaactccctttttttggcagtttaattaaagtatgtttaaatgcggtgtgtgtacttattctaatgttatacagtatacgtatctcccgtcggacattttctttgatggccttggcaacaaagttcgctcaaccgttaaacaaaccttggctgaacagagtacaaaaaatgcagaagtggcggaagcatttgcgttgctcaaaaagctcaaaaaacaccgcactcaaatggacagctgcgaaagtgtcggcacaaccgacgcggaaggggcagaacaaaagcagaacgtaagcaagctaatgattaatttgtaagaagaaaaaatactctcagaagtattgctaatacaatataaacgagctggggaagttaataactttagcactagaaacaatttttattttggaacttaaaaaaatattggttttaacaaaatttaaaaattcaattattgtaaaatggggtaggtcggtaggtcacggtc

SEQ ID NO: 12450 - DNA, 1178 bp, Heterodera glycines
  misc_feature (107)..(107): n is a, c, g, or t
tttgaggcatcgcgcgggcataaatttttgtgaaaatggaaagtgggaatgatggtgggattataaaattaccatatgtaaaaatgcgtaatcaactatttgcctanatatacaagcaaaaaaataaccttatgagggggctgtccattctcatcccttctcggaaaattttccagaccctaagaattttccttcaaaagccctgatttcaagccattttggcattgcagatcacccaccatgaagggatgatctgactgatcaagtcagtgtaaaaacttacctccgggaaagaaaacggaaatttgacatttcttttaacccttttacaaaaaatccaattcttaccagtacatttttactcccgcatttggtgagaaaattggagatgagtcccggaaaaatcccacggaaagaacggtgcaaggcaaatttgcttgcgagagagagagagagagatatgtacagttactgtactgaaactataagagaaaacccagacgaaattcaaacttataaaaaggccggttataattctaattcagtgaatggtattatcttttaacagttttaacatcactgattgtgaacatggcgaagacgacatttcaaagttggcagaaaaactggcgaatgctcaaattgatgagaaacagaaattgaaaaatgcagcggaattggcaaagaaagcagcgatttccgcgcagaatttgggtctgccggttgttgaacacataaacagatatatcgacgcaattaatcgtgcacaaaaggtgaaaaacggcaagataacatgctcgagtcctgtaaacagcggggggggggggggagggctaactgaccgccggaacaccgatttcgtcctccaccctcattcactcctccgattttgttttaagaatcttagttttccgttttgccaaatttttgtaaattttttcttgtcttttattgaaatgtttatataaaaagaatttctgtttttaaaaaattaaaaattcttaagtccttgtaaatggtgctaggtcgtttcctaaaaaccgccaaggggttggaaaacaaaaaaatgtgagacatataaattcgtaacttgtctcaacttcaaccaaattattatttcatgatatcattcaatagcacaaggtgttctctacaagaatattaattttaaatttttt

SEQ ID NO: 12451 - DNA, 2404 bp, Heterodera glycines
  misc_feature (2350)..(2350): n is a, c, g, or t
  misc_feature (2394)..(2394): n is a, c, g, or t
gtcgctctttttccaccagcgaagtccatttctgatccaatcgttcttccatctccattcggaaagcagctgtttcatctgcgtgaatgcggcaattgtcaaagaggcggcatctatatgaacaatctttaaaaaatgaacaaatgtttattataaataataataataaataagcattacagtatatcattcctcaggtggtggggatgccgatgatgatgacgatgacgaaatagtccgttttaacgatgcgagagcagtttgcacaactgccatctctacattgccgtggcgcagaatcggatcggccatgatgttatgcacattttcttgctgcttcagcaaatcgaacgattcacgcagaacggatggcgaaaacgacgaagtcgtgtcgaacggataaggcgaaaagtgctaaaatgataatcactaaaaataattaaatttaattattttcacttcactggccgcccatttctctaacatttcagttcgagttaagtaaacggcaaaaaatgaacaatatggtctttcttgtgcctgtcatcaccctctaataattaatgatgtttcagcggctcatccccacacccccctccctcccatcactgttcagattcaactgtacgagtgacgcctattaatcatagatatccggtcgaccggctaaagactcgcgaaatgaacacagtggggatattctcactaaataatttattaacaaataaaatttaaagaaagagaaatatttcaaaaattttattgattgttgatcactcaaaaaattcatctctcatgcattgttcagctttttcttcataggggcaatgagatcggttacgcgacaattggcccacgcgcattcttcacagagctcaaagctgaccgcgaaacggtcatctcccaagcgcgcaactttctgttggttatggaacagtcggtctcagtcgtcttaaaaattttatttcacaaaatttaaaattattttcatttttaccttcgcacaaatatgtcgctagcatgaactttccttttgccagtttccatagctcccggtcctccaccttgcgcttttttgtagtgtccgtctttggtggctccgcttctgaattaggctggttaatttctttttgctcagggacagagatggtaacggatttcttcattttgacgaaaatgaatttgggttttggccggttgtttcaatttcgctaaaatgggcggtgtcaaatttgaatttaatgggcatgactaaaattttagagtataaatttgtgtcctattttgcaaattgagcattcttcttgaatggtgcttgtcactgtcttttgctctaaactgctcaattgtcaacccaagtcgctgcgcgatcggttaaatcatccaaatgatcggagccttgtcctaaagcatcttattggccgaaaagtgcgcacaacctacaacgatcggaacggaatgaccaaaacatttttcgtcggcggcatttcgagtaaaggggcggcatttattccagcatatggacagctgcgcgctccatttaacatcaatattaccgcgcatttttatgcacgccaccgcataaggcttcacttcccctatttgccatgcataattgaacgatttttgggagaaggaggggaggaccgccactacccgatggagttgcttgaacttgctgatgatgatgatgatgacaacaataacaagagtgaacattgtttgggccgccttttcactgaaattgggtcatcataaaattcatcgtcaactcagacactgtgcctatccattgatgaagagatgacagaaaacaatgggcgtagtgagtgcagccaaaattcatcattatattggtgattttttaaattgtttcttttatcgactaattttgcaattttccttttaattcaccattgtgtattcattaattgccgcgttctaaaaagtatttccttcccactaattatgctttttcccacccaaaaacgacatcttcttatcgattataatgctttatcagaaataaaattgttacaaagtgtgaccaaaattcaaaagtttgaagtttggaccaacaattcccttgcccacaaatggtcgataacacttttgcataggcatagagacaacccgaccgccctccctgatgttcggtcgtaaaaaattaggataggtgacgatgatcggttcataatctcctctcttcgcatagttgatcacttcctatttgaaccgttcatagcacagtccctggttattgatcacgtcatagttgagcgtcatcacacggactttaagcacgtactccggttcaacatcgggtcccgctccctttcgcagacaaagnccatagctcttaggagagttataacaatttttttaaaatgctanaaatttacct

SEQ ID NO: 12452 - DNA, 1533 bp, Heterodera glycines
tttaccttgctaatgcctcgtccaaaataaatggctcctcacggtgctgttcgtaccacacatcaaattgtcgcctctttccaggcatcatcccgttggccaaatagtcgtcaggcgtagggtagatctgactgccgtagttctccggtctattggccaaatgggggaagaagggtttgtcctcgacgttaaggccgtaggattgaatcagggctgccagtgagcatggcatcaaattgaacgagtcacggaagactacatttgggttgcgcctcttctgcttccgcaccttcatttcatacattttgtttccctgaaattttgaatataaggtaaaatttaaaaaatttatacccgtcgcaacatctcgggattaaagtcaatcttgaacagctcgcggaagacgagcaccatgtcaaagcggccaccaaagtgcgaataggcgtgtgtcatatttttttggaagttgaagttgaaacaccagccaattcgcgaaagcctccagcgggttgtcagcaaccatttggtgatcaacgttagtgtccgcaaagaggcgctggcagaaagcgacggtccagtgaggcccgcagattaggcagcctgccaagcgctccatataagcacagctctgataaaaatcaatttggtggacgaaaacgaaacacgaaaacgaaactcaaaaagggccgaaaatatacaacgaaacgaaaacgaaacgcaatttcgtccatccctgctactgatcacgaatctgatgtttaaacgataaacgtaagtcagatccgtgatcaccatcaaaaattaacctagaaaaaatttcaaggaagcggctgacaaaactcggaagtacccaaaatctggcaataagtttcttaaatttcaaaaaaaaattttcattttagcctttgtttcactttggtagttattaaatttattgctagaatctacgctatcgttgccaagaaaatatcctaaataagaagactttcctaaagcacgtttttttaaagtttcgcatatatttatttgtctctaatcaaaaaagggccgtgaattagttttgcaataatgttataaattttagcaaagaaaattaagaaaaataaaatgttcagaagaatcatgcccattcgaaaaaattgctcactttagaatatttctttctgttttgttgtttcttaatttattgccagaatctcctaataagttgccaaggttatgcatcctgttctgtgagtgcttccctagctaaattgagattttgttaccgggattcacaaagtttttaatgttctgctcatattcgaacatttttccgtttcacttctataagccaacatacttttgttgaatccatgcaaaatgacatcattttcaattttttaacaatgtgaacacgataaaaaatttatttttattattcggtgccgctacatatcgtttaaggttcttgttgtaacgccaatttaaaaaagcgaaattgccagcgctttacctaacgcgtaagatattaatattgtttaacaaccaaaa

SEQ ID NO: 12453 - DNA, 1360 bp, Heterodera glycines
aaaaatgcgaaatgaaaaaaaaagcgaaatgcgaaaagccaaaatatgcgaaaatgcgaaatgcgaaaagcgaaattttttctacaaatttttaatagttaaaatcataaagcaaaaatcattttttaaaattttataaaaatttaaaaatcaataaaacgcttttttgaggcgcgctttttccaaaaaaactttttgggaagagggggcaggcggcgccggcaggcgccgccgggaaaatttttgaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaataggagttttgggggcgcggcggtgccgataggcgcacccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgatacataattcaaaaacctaattaaaaaactgaaaaattgccattagttttttaatatgttttcctcccttccagctctcaacaatggtccataagcgagaatgtcttttcaagtacattaatttaaatgatttttgaaattaaaaaaaaaaataattttttaataaattttaccccgccctaaattttttttatagaattattgtgatcggcgacatcagcaccggcaaaacatcgctgatccagcgattcattcacaacagcatgtcaggaaattataagcccacccttggggttgattttgccaccaagtaaaatcaatatgaaattttaaaattcaaattttcaaattttgaattatgttttttcagacttgttcagtttgaggatacgttagtccgactgcagttttgggacatttctgataagttttttgccccgaatcatgtcgaagcttaagctaaccctattaaaaaataaataaaaataccgcaatttttattccgtcacccttttaatgattaaaaattgggcagctgggtttttttttaaatattttttgatatagtatgccaatatttttcaggccaggaacgttttgcaaacatgacccgagtgtactacagggattcgcacggtgccatttgtggtcagttggtgtaaagagaacaacaaatat

SEQ ID NO: 12454 - DNA, 1968 bp, Heterodera glycines
tattttaatacatattttttcggaaatcggtaaaatgcgttattcatcgggttattcattctattgttgtttaagcttaattttcgatcacattttatggaaccataatttcaaaaattttcccttgttcatgttttcatattgccttctccaattcaagacaaatttgaaaaacgcagacaatttgaacctggcttcagtaaaagtgcagtatgactttgtctgataaattattagttagtaataacaatttttttaattttcatattttagtccttcacttatattaaaaatattaatggaaaaaattttattaatataaataaatgaatattaattagagtagagcgggaccgggaattttgggcaaaaccgggaccgggacttgccgggacctgagaagccgggaccgggacctcggttttttttcgggaccgggaaccgggaccaaccgggaatttttaaaaattcaaaaaaattcaaaaatttttaaaaaaattcaaatttaaattttttttcaactgaaaataataaattaaatttttattttgtttttttatttaataaaatccaaaagttaaagctaaatttaatttttcactcagacccccattcttaccagtgctcgtttttcccggttgccctaccgggaccgggacctgagcttttcaaaatccgggaccgggacctctgaggaccgggaattcccggcccggtcccggcgcactctaatttaaaccccttaataaatcaaatttaaaacaattgttccaggtttacgactgcaaaagaagcgacacattgacaggggtgccataaaaataaaaaattttttttttccaaaatttcttgtccccaggcctatcgatggaagaaagacctggattcaaagttgatcttggacaatgggcagccaatccccgccattttggtggccaacaaagtaattgggagcgcaaattttgtattaaaattttgggaaaaaaatcgacgaattaagtgcgacttggaaaattcgctaaacacagaaatgttggacgattatgcaagacaaggcgcattcagagctgggttggtaaatgaatgaacggataaggcaaaaaagggaaattatttaaataattgcagatttaaactgagtgccaaaacgggcgaggggattgagtcggcgatggacttccttttacggtatatatttgaataaaccgtagtactgtattgtacaaaaaagaaagataggccaactgtatgattaccgtattctaagggattatgacagataaattaatttatgaaattaaattatgtctctacagaagtgttgtcagcgcggaacgtgatggcctttatttcatgccaatggtaaacaaacaaattaattttacattttttttttacaataaaatgcttttttattttaataatagagcaccgtgaggctggctctattattcaagggggaggctttaatggagggggggggggctcttcgaattaataaagtaaataattatgccaaaatatgttccaccatatttcagctacaaagggaccaaaatttgcaccgtttgtcagcccaagaattggagcagaaaaagaaacggatgagccggaaaaattatttccaaaacgcttgttgttgaataaatacataatatgtaatttatttggcttttttttgtaatataaataaattttgtttttacgaaaattcaatgggcgggcgtaaaaaataggggggcggcggtgccggtggtggcgtttgttccgcttcaatcgaagcaccgccgccgccaccgccagcgacggcagcggtgttccgtctgttcagcagttcccaatggggcatgcgaagctgctgctggaaacgatggtgtccttgaaaagtacgtgaggaatagaataataaacacaggactttggcttggggctgggaacttgagaattcttttttttttgaagggggcg

SEQ ID NO: 12455 - DNA, 2231 bp, Heterodera glycines
caactgctcctgcgacttgcactcgcccaggtcaatgctggccaatcggtgccacgttttgccaacaaagtccacgtaatcaccgtcatcattacaaccggcaccaatttgggccggcgcggaaacagtgtgacaacgttcggcatttccattgccgtctccgcttttctcaatggcatttgccgccaaggcactttttgcagggatatcattggtgacgaaaaacgacgatgaagcagacgaacaggactgctggtcagcaacagcatttgctgttgatgccgaagcagaaaacgaactaaattgagcgattactcacggagatttcgattaaaaatttaaaaaatgggagacaaaaatctttaggttcccaattcgataaaaatggtattctcattagcacactaattactttgttgtcgattgtacgtgtttgccagttggtacgcgaatcgacgccccctttttgacagcgccacgagccctcgggccgttcgtaccagtctcgatcgaatgattgtgcattttgcgatcgaaaacggcacgccggtccaccacataaatggcacgatatgggcatttgctataaatgtggtgtgaaaagtttaaacattgtcagcgaaggggggggggacgggacgaaatctcgccgccggaatctcgccggccgaaatctcgccgagataaaatctcgccgccaaaatctcgtcggctgaaatctcgccgcagaaatttcaaaaaaaaaaaaattcaaacttagaaatttttcaaggaaaaaattttagaaaatttttttataagaaaattccaaaaaaaactatttgctaagtttttttgaaaatttttcaaaaaaaacagtaaattttcataaaatttcaaaaaaaaattgctgaaaaatttttcaacaatttttttatttaaattttcttataaaaaaatttttctaagaattttttccttgaaaaatttctaagtttgaaattttttttttgaaatttctgcggcgagatttcggccggcgagatttcggcggcgatattttgtctcggcgagatttcggccggcgagattccggcggcgagatttcggcggcgagattttggggtgcacccattttattaaactgtcgtattcgacgccttatataaaatgccatccctcctcttccactttctttcattcgctcacttttccttcccttttgctacgcaaattctgttttgaatatacggttttcgtttcatagctaaattccttaatacaacagcctttgtcgtgttgttgttactgtaggacaaattctggtaatcaaaggttcgctctttgctattcgaatttgtcaatgattaagctttgtcatcacattttttcgacgaaaacattttcccatgagcacaatttaacttattacggtgggggtcggtttagtctggccggtttagtctggccgttttagtctggccgttttagtctggccgttttagtcagagggtcggtttagtcagagggtcgttttagtctggcaagctgtttttgtcctacattgatccaattctgatttgtttctcgaaaattctttaaaattaacaccataacagattatcaatgtgttaacaacaaaaaaataacaaaacattgaaaaatgaatacgggcatatttaacaacgagaaaattgatgatattatcaggattaacattggcatggtaattctgatcattttggtgagcagggttaatgttgttgatggtattgtaaccctgtaagagtcgaagaattcgtatcaacggcacgatattttcgcgttttttgaggagggacttcaccagcgatgcatcgtgcgatgtctgcatcaattgactcatatcgaattgtgttgatgaagcggaaaacagttggatataaacaagcaaaagcccgttgaatgaaaaaaaaattagggtttactttgcctgaagctataaaaaggcggtgccaaactgaaggtttcgctttgtttttattttctaattgggatattcatttatattgtagctaaacatagatattttaagtttttccttatttataattgacaaaaaacatttgtaagaattatgggcgaaaacggcttgccagactaaaacgaccctctgactaaaccggccagactaaaccgaccctctgactaaaccggccagactaaaacggccagactaaaccggccagactaaactgacccagtccgtcttt

SEQ ID NO: 12456 - DNA, 3827 bp, Heterodera glycines
  misc_feature (2162)..(2162): n is a, c, g, or t
  misc_feature (2226)..(2226): n is a, c, g, or t
  misc_feature (2229)..(2229): n is a, c, g, or t
  misc_feature (2258)..(2259): n is a, c, g, or t
  misc_feature (2304)..(2304): n is a, c, g, or t
  misc_feature (2348)..(2348): n is a, c, g, or t
cggtgtcttccttttgcctaatgtttgtgcttctcccctctttttttctgatgggtgcgattagcttctgcttcttctccatgctgctggtgatcagcagcagttgttgctgcttgtgctgctcgcggttgccgcctgaggcgcgcaaaaatccctcgcggcccgcggacggtcgcccctcggccgaaccatcagcgaaagaaagggggaacaaattgtgagcaaaaatacaatcatcacactgctgccggtagagatcgacagacatttatcatccagaacgaagcgaccagcacaatgttttcgtcccaatttcttccaagttcttttaaaatgtcaaattttggttttaccccttttaaaatttgtgaaaaatgaaaataacaaagtggtcaaactatcaaccaacaaacaagtttaatttcgaattaaattatatgtatggtcggtccaaagaaatgctgtcttttttggcatcactatcatcattggcacttttcaactctggacacaaaaatacggagaaatgcaaattttaaacctatgggttttacagtgaacaggaaaataaatttcaatttttacacaatgatttgtcaattaaatagacattcgttacagtacaatacaatatgatacataatacgttttcacactatagcatggatttgaattgacaacggacatttaaaacaacaaaacgcaatattagttaagcgaaatgattgctccctccgcccgtccttcctaagtgaccacttccgctttgaatgtcaccgcgtcttccttcgcgtcgtaaatgccattgtccgggtccatcaaatccttaatgattgcgcaattgctcacttaacaattcttttgccgtgttcacctcaaatttggcgaaatctgaccacccccaattcgatttggccaagtcaaacaagtcgaagtcgtccaatttgcccttctgtttaacgcattcgttgcagttttggcacgaaacgatgctcagccgaaaggcagcccaacggcaaaacgaacggaatgactgaagacacaaaaaccaaattcataatcagcttccaattggatcgcacttacgaatcttcagggaggaacagttcagaaacaggccgatgtttgctccgttgttttgaatcgcaatttgccatggcattccgttgatgtacccaatcgtgtcacttttcacttccttcggcccatttccttgcgaaaacgctttgaagtcggtcatccgaaacaaaaattggccacgacgtcggacgccctttttggtgtgcgagtgaatgatccgtttggcaatttgcaggaaaatcactgcgccgatgccaatgccaacgcttttcatcaaaaacgaggaccatccttccgaagttgagcccagtttcatgtccatctgttccagctttgccaaaatgttcttctccagctcgtcaaatgctttctgatgatcaaaagttttcgtctcttcgaactgaaaaaagagaaaactccatcgtaatgtgaaattgttgacagcagtaaaacgataaaaactcaccgcaaattgacgctcgaacagcaaaaaaaggaagaggaggacggaaatagtcgccaaagcacccaaaacaaccaaaccaatgatttccttcttgacaaggtcttttttgctcaatgaaacgccgcttttgcataaatttgcggtgcgatttggagagcctttgaaaataaaacaaaaaatgaaaatgaaaattggatgttatttttgctgattttttacatgtttcattgggcgaccgttgcatttccgtcggcgcttcttctccaattaaattggtcatacacaaaacgaataattgtcaaataaaccaattttttctaaaactgattttgtgatgctcaaatggaattaaagaacaaataaaatgacattttttgttaatgagcctgccttttatagagaaattattttgaaaattttttcaacttaggaggggaaaaaaagtaaaattttaagaagcctttttccggggttaaaaaatgcgctgatcatgaatctgaactcagatttttaaaaatctttaattttgaatttttatcaagtacttgattttttactcattttgggtcaaaaagcctcatttttacaaaaattattcaaaacacgctatttggcntgatggaacgggtaaatgtgatcacggaatggtcacggaaaaggaaataaaataattcacccanatnttaatcaaaaaatgaaaaaacacaaacannaagtgtaaaaatcgcttttaccaattaaaaatgaattatgccaanaattatacagcaaaaataaaagaataaaaaacttttattatttnttatgttcagaaaatgctcaaaagatctctttttctactcccacgaaaaagaacaatcttttgcgaagtgttgctgtgaattccggaatttgctttggtcgttctatgttcagtccttcatgcgttgacacctgaaaccccaatatttaaagaacaatttgcatgcttatttcgtgctgagacgaagcacgaaaagtgcagcgattaaaattaaaagcaaaataattattttaattaaattaataatttattactaaatattcgccagataattaaattatataattatatgcgtagtgaaccgaagtttaaaaattaaattttcttatattgttttctttgttgcctggcatatcagactttgaagaaagaagcctttataattttggctacaaaagcggatctcgaaattgtggtttttcagtttataaataaaattaacgcataatttgaaaagttatttgctgttatttagaaatttaaataattgaccattgaataatgtagcttcagtccatcataattaatataaaattttcttatctagcgaatatttgaaataataaattatatattaaattcaattaacataattacacctcataattaactgtcgttagcatttcaaaaatttcacaatgcttcggggccatttcactgaacactttgcacaaactctgcacgaaccaagcgccgtttgcactgttccgccacgacacataatggggggtggtcgaatggaccaccaaaaagtcagcatttgtgggatcttttctgttttcaaaatatataaattaaattaacagaggcgtataattagtgcttaattatgataatttgtcaaaactcaaggcatcaaacagggaataaatggtacctattaattaattgtctatgtaacaactaatttattgtctataagtaattgtaatttaaaagtccctactgaaatatttccttggatgtcaaatttgctgaacattcgccctcatttcgcagatgtaacggaatttggatagatgccgccaaactgttccgtggtgaactgttgcgcgagaacatgctcagtgggccccttttgctgttgttggacgccgccgcttttgaagagaccgcgccgtcggcacagtccgtgccaattggcaacgcacggagcactccaaagtctttgatttctaagggggagcggggggggggaggggtaattaacaacaattatgggggtcatttggcaaagaattttggtaattcacttaatagagtaatagaaatgaatttagtcgagaccgaccagggctgactaattcatagtttttgattaatttttgtttcggatagatagagagagttttgcacagctggtcaaggctaaaaattacgcttttcaaattaaaaaatatggctattagttgcgcttgtaatttccaaaactaaattgtttttattaacccatttttcaatatttagatattaattttc

SEQ ID NO: 12457 - DNA, 1258 bp, Heterodera glycines
ctcttcccaaaatcatttcgtcccccaaattggcagtgtccactggcggcggaaacggtgccattatttgctcagtttcatcaatgggcggcgccgggcaaacattcggtgccgaattatttgacccatttgtcgccgccaattgtttctgctgctgtttgttgtgttggtgaagtgcggcaacaaaattgtgcagtagaaattgcattctgtaatttgaaaattaaaaaaataataaatttaatttcaaaagcattgaaaataaaaaatcaattgcatacggtaacacaaaggaatatggttggatattacggtaaattatttatttattatttaaaaaattattgaatttatctgtcaacaattgcagtttgttgaaatcggcttactgtttgaagtcggcgcattcgtaaaaaatgctaaaataaaaaaatgaaaaataaaaaaaaatagttaattacttgaacagtttgaattgctgtgacaacaataatgccacgcaaaaatgatcaaatgctgacggatcatccaacaaaatcgtcaccactttttccactttgatcgctgcttgggattcattctgaaaccaaaaacaaaaaactgagaaataaaattaaattcacaattaaaatatttaaagacgcaaacattccagggttttatattataacaaataaataaaataatattaatattttattatctttaattactttaagaagtgatctgaaattcaaagtatcattaaatatttttttgcaaattcaattttcgaaggacaagtcgaagattttatttatatttttctaaatattcggaatattttgaaaattgtttttacactaaaaaaaattaaaaataataattcttaaaaatcctattctcggtttttacaaaatttatgctttaattttatttgaagattttggttgtgctattgtttcaaacttaatttataagtagggcgaggaattacgacattttttaatcgagaatcgagaaacatggtatatttttaaaaaatcttacattattttaaatttaatttaatttttgacaatttttactgaatttccttttcaccttaacactttcccacttttgccagctgatggcgccccatcggtacaaaagcagcgacactttgtccgcttcttccattatcatttttagcgtttcgctgtaaagctgcaggaaatctcttcgcttcttctgtcttaattctctctctgtacaattttatttgaaattaatttta

SEQ ID NO: 12458 - DNA, 3465 bp, Heterodera glycines
aaattattttttgcagatgagtgtgaccgttggccgttctttgttcgcagatgtccggcctccttcgactgtcacaaattttcaattgctgatgagaaaatcattttccattttaaatttaaatgtctatttttttgttaattaatttatttttatatacaatgtctaataaaatcttcgcaacaacaaattacttcatttttcaatgtgaaaaacagcacttgttctactagtgctgcaattgacctaagtgattccgaagatgaaattggggaagaagctatcccgaaagaaagatttttggacaatcccccaaaaattgcaccggaaagggacttaggccatgtactaatgatgcaacaaaacaaaatccatatttctgccgacgaaaagtatagctggctaactgattttttcgtgccacccgcaacatttgattggccctcaaatatgagggcgggcaaaaaaagattcctctcgccaagaatctcgagcgacacccccaaatgtgttattcgccgcttttaaatggccttctgtgccggtagtaatataaaaattttaaatcgcattattgtgatgaataggtgctgtgtgctgtttgccagtgatgcaattggtcactcatcacaaagcaaagaaaacgtggtatttgtgacgcttccatatcgagactggtcgcgtctcgagagtcccgctactctccaaaaaaatcaagaaggcaaaaaaaaatattcgaaaatgtttgtggcattttttaggaatcacgaaacatgcaacaacacaataccagcaatttgtgtgaatttggccgcaacgtttttaaaaaatttcgaagggacaaagggaattgactgtgcttttaatgatttacagcggcagcaaatccaaagaaaccggtggtttataataaaaatatttttaaaaaaattaactgaaattattttataattaaataataataatttcattaaattattaatttaaaataattatttttaaaaaatattgaaaatataagataaattgaataaatatttattttgcagtgaaatgcttcgccccatgattgaaacagtcatttttttggccaaaacagcacaagcatttcgaggcaacaaagattatggaattttgtcggtacctaaacatattggtcaaattaatgctggagaaggttatgaaaattaaaaataatatatatgaataaattaattaagggctttttcgggccagtttgcaatataggtgtctgtgtggggatgaaaaattaaaaatgcacctggaaaaaggtacagggaaaaaaacgtaattaattttttaaaaactccaaggacaccaaaatgctctgtatatttcgtcaaaagtgcaaaatcaaatgatcagagccgttggaaatgtcattacagcaaaaatatctgagcaaatttcgcagtcgggtgtatttggagtgattgcggatgaaacaatggatatttccggttatgagcaattgtcaataagtgctcgaattgtgaacgagtctaatcaaattgaggaaatttttttgggatttgtcgaactcgaagatcaaacggcagttacaatttcaaagaaaataatttttcttttgcgcggtagttttagttaaaatataaaaatttaaaaaaattaattaaaggtaaatatgggcttgatttgtcaaaaattgtgggccaagcctatgatggagccagtgtgatgagcggtggtcataatggcgttcaggctattgtcagacgtgaatcagggtgggtattgtgtttatttcccctttcaaatcaacccaaattcaaaaaggcctgcggcattttatgtccattgcagtgcgcatcttttgaacttaaaactttgcgccgcattgaccgctaatcactatcacaatgtttttgactttcttggaaaattgacaaacttttttcactgctcggcaaaaagaacgaaaattctcgagcggtcaattgacgcaatttcttgttcaaaaaaacatcgcattccgactttttcggacactagttggaccgccaggcacactgtaattgaggcagtgaaagagcttttgccagcagtcattgcagcattgtgtcaaattcgcaatgaagatgcagccatgagatcggaggctgcttatttgctcgatttttttgcgcaaaatgagtttcaattttgttttatcatgattgacaaagtgatgtcagcaatgaaacccttgacacttctgttccaatccaaagaagttgatattgaaaaggtaaaatctctttttggcaaaaaaaaaaattacaaaaaatcatggccaacgcgcaatttgtctgtttaccgattcattaaacaattggattgatggtgttgggttcgggacctttgagaattgcaagaaagatgcattgctgattcggtcccaaattgtggaatcaaattatgaacgaagaaggagcggccgttttcatgtggccgagtcagattttgatgaatttgaggaaccattttttaattttttaaattcactaaggtagcaaaaaagagcttaaaaataaacaaaaaaaattttcagggaatcttttgccgaaatgttcaatgattcaacaatggaaattttaaaaagcctccagactttgcttccctggaaaatcacaaaatcaaattatggtctcttttcagccgctgccaaattttaccatgaagcaaatattttggaatgttcagaatatcaaattcaggtcatgcagtgaattgttcaaaagtgttaaatttatttagtctgaatttgaacaatggaaaaactattgctatggatttaatggaatggaaatgaatgtggccttggaacattgcgactcttcgttttttccgaatgttaaaaaactcttattagttttggctagcattccaattacttctggtaataccaaaaaaaggaaaaattaaaacaaaaactgtttagttactgctgagagatctttttcatcgctacgtcttctaaaaaattatcttcgcaataggatcaaaatagagcgtttgagttccctagcgctcgcttatattaatcgcgacatcgatttttcggttgatgatgttataaatgaatttgcaaaaaagaatcgaaaaattgattttgcacttggcaaagaacattcagcggaagagatggatgaagacgaaaacatttcgttataataaaaaatattatttggcgccatctcatctgatctggccagcgcgacaaagctgcctccgccagagttttgtcccaaattttgtcgtcttcaagaagaccatgcattattgcagcctcagtgaatgaggtacaaagcaatccattaaccaccttcagatggtctgggtcccctggaaagtggcgcataagtgaatatagcgcgaaccgttctgggtccgatgggggtactggaacaattcgaccgattggtggtctctttgttaggttat

SEQ ID NO: 12459 - DNA, 5276 bp, Heterodera glycines
  misc_feature (2913)..(2913): n is a, c, g, or t
tataaattggctaattttcagtgaaaaactgtttataaatgatcaaaatttccaatttttttccccggcggcgcctatcggcaccgccgcgcccccaaaactcctattttttcttagaaaatggcccaaaatcgcaaaatttggtaatttgatgaaaaactgttctcaacggcgcgccaaaactcttatttctccttagaaaaattatataaaaatcacaaaatttgatcattttttagtgaaaatctgtcaacaaattttaatcaaattttcaaaaattttcccggtaggcaatgacggtcgacggaatgccaaggcatcgagtgcaccagggcagatgggacatggttcgtatttccgaattttggaagtgcttattgttaagggaattatgttggttaggtccaaggagccattgatgcacggaaaaaggcgcaatttaaacaattttttaggaaacaccaaattatttgttttaaacatttgccaggttatgggtttgacggccaaagcattgaatcgatcccttcaaatggcttgtcgccgacggcacaattacattttggaccaaaccaacgtgttcagggaggcgcggaagcggaaactcacccaatttcaggtgctttcttaactttttagtttaaaatatcaataatttttctgtaggacttccagcgcaaatgcgtggtgatcattcccaacgaggcggagcacgaacgacggctgatcagacaagcgcgagagacgggcggaggggggcaaatgccggcagaggcaatgctcgaaatgaaaggcaaaacaataaactattgttcaacaattagtcttaaacgttgattattaatgtaaattacaaatgagaagctaatggtctctcgtttcaggccaattctccatcccatgcaccgaaagtgaacccgtcgatgacgtcatttttgttgaaccgccaattgaacgaatcaatgaagccattgaacaggtgctgggacgtatgagtgtgacggataataacagcttaattatctcttcgaattactggcttttgctttctctttatgcagttttttctgaagttccacaaataaatgttaattctgaggagagaggatcaaaaataaaagacggtctcgtttaattgtttcgaaaggcaccatcctcaagggacggacatccgcgtttttcatgcatcattcaatgtgtgtccttttacaggtgacgcgttataaccaagagggtcgtccgtgggtgcgtaatttcggacaccagcggacacgtggaccggagtcgttgatctccgatcactcgggaatgccggcgccgcggtttttgggcgtcacccgaatagggatctgacaccaaatgttatcggatagctttgtgcggggaaacaatgccaatttcgttttctgaatttgacaaatgagcaccacggaatgctaattttggccggttttatttgtttgttcctctctatttttgatttaccgttcatttttctccatgacattaaactgaaaatgcttttctccttttacgttctctctttctcgcttctcctttgtattttcaaaactacttcatcaacagcattacccatcttttatctgaaataccttctaatcaccttttgatttattcatttgttagagacactgctgatacagtgttggacggacatccatcccaatgcataaataaatgaaaacggaaaatcattgattttttagatataaaaaatggccatacatcaggaacaggaaaatgaatgattatgttacacaaacattttgcacaataaaagatcattttcagaagcttgaaataggacagcttcgatcataaatttttttttgtcaaaaacgaaaaatcatacatcccagacagtcgactgacgaccattcgccaggtttcacctccccccattaatcgtcggatctgtccgtcagctgtctctgctgctgctgttgtgacaaagtgtttctcactgccgccatccctccgttctttcggtttttgaatgccttttgctcctgcaaatgctccaagaacaaatccatgtactttctccttccgttctcctgctgctgctgatggtgtggaggatgatggtacggcggaatgtggcggaaaatgtcgcgcaccaccagtgccaattcacaaatctgagaaacaaaagcgtggcaaagggcaaagtaaacagatcagagataggagaggttccaccacccgccacatttgagggggaatgaacgattagggcctaatctattacgaagtttttttttttgaaaatttttttctatttaaaaaaattttaaattcctgcggcgaggtttttgggtgcatctctcaatttgaatagtatttctgccttccttctcactcacatattcctggtcggaagcactgaagtttgggtagctcagtctgaaaatgagattggtcaccccaaagaaaatgcatccggcgttcacttgtgggaggcggcgttgaagcagcagagaatggcgtggagcagcaactcctccacggggccggccatcggatgcaattccatggccgacttcgcctgctgaatgcacgtcttcgcctgtccgctgttggccatttgcgaggccaaaagacaaacgtcgctcgaggcgagcagacgcaaagcaccgggcaaatgttggaaaaactgagaaacggggacaaatattggaaaaaaagaggaggggacggaacggcagactttgaaaacgccgcggagcaattggaggaggacgaagggtgagtacacacaggcgaacaccttctcgagaaacagccgcacgtagtcgggatcgccaatctccagggacacgtcgagcagccaacaaatctcgtcggaagagggcggattctgttaaagaaaaatagaaaattgagggaggnggcatccaaattaacggttcggcagaccttggcgaatttggcggacgcgctttccgtgctgcgcagtccgttcattgccgcaataccgcaccgatgcgcattctttcacagttgcaatgctcgccattcaatccgatgctgtgtttgccgattcccttttgcagtgtccattgttggtttgccgtctgttgttgctgttgtgtgtagttcggaagctgatgttgtgctggtgtcggttgcaaaatgtgcctcggggggaaagcgctggcggctgcatttgccccgggcaatgccatcagcatcagtgggggaggtggcgtggaaagcggtggctggtgagcagtgacatgatgatggtgagggtagccaatggtcgaaccaaattgggcaacagactgctgcaggtgaggctgagatgtttgtttatgatccacaactgttggtggctgtactgcttgtagttgaggagggggaagcgagagaaaacaacaggatgaaaccgatggcgcctgaccgttgtgaagcattggtgccattgagacggcagccgtttggccgtggaacagcgggacggctgtgggcgtaagctgcagatggtggctgtactgtatgaagttgttgccggtgctgaggttgtgctgctgaggatggatgacaacgttgggcccaacaaattgctgcgggggcgtcggcggcgggggaacggaaggggaaaaaacaacggcagcagaagtcgaagcggcggcagaatggacggggaagaagtgctgctgttgctgctgcgactggtgggagtggtgcagcggggagtgcatcatcagacggacgacgcactgctgcggggcaatgcgttgggtcggctggggatgggccgggggcggaagcgccgtcgttgtcgcctgctgctgctgggtgttctccaaatgggccaagtacaggtcgtcgtaccaatggtgggcaactcgaaacaaaacctgcacaacgaagggacgttgaccaataaagactatttaattcataattgaccgcccttcttcattgttagcttcccacactcaaatttgctccctcctcttgcctcggggtaaacgccgccccgctcggccgctttctccaccgccaaacatgcttcttccaacagtttggtgccacgctccttgcactgattgagcgccttttggctttccgttggcaacagcgaattcgcctcgggcagtacgctgagtgccaaaagtgccgcttcctccaccatggcggagtcgctgctttggctggccttgtccgccaatgaggcggtttcggttggggtcaaatggttacgccatgttttgcggatgatctccagcgcctgtcgtcctaattgttaaattaaaatttttttcatgtatttttaaatatttccccaccaatgtcaagcacttgggcttggatccagctgacgtgagtgctgtaagtgcgtgtactccacgatgtcgagcaagtgttgttcagcccgagcgcgtacagtgccaccaaaagcgaggcgatgtgcaaattgcggtggggaccgttgccgccggcgattccggcgccagccacgtcagcgccgttggccagcacagcgctgaagattggatgtggcaacggatttccgccagcttcttgcagcagagatttggcgaattcgaacagatggtgggcatgggactcgctggcttgactgaccagcagggactgaatcggcttgctgctaagcagaacccgactcgacgcgatttcttggtcaattgggggcgagtgattggagccgttagaatcgacaaagccaacggaagacggaaacgaagcggagaaagaacatggagaggaattggagaaggatgaacgaaatagggccgagacggactttgaggttacggaagaaaaagcattggccgagacgggcaggaaaaattcgacgttggacctgtctttgtccctggaaaaaacatcacatccctttgctaaattgccccatagagttcctcactcgtaaagtttgtgcattttcgggtccaaaaccgtctccagcacgcgcgccactcgcgcagggtcatctctgttccgcaacagcaacgacatttgcacgcttttgcgctgccgtcggatagactcgcacaaaaggggatggtccaactcggaaatgaacaaatctgaacgaagcaaaccaatgaacaccacccatcagtcatgggcggtggggacaaaacatatttctcaactttttaagtccaatgcttttatgcattacctttcttgagcatagacagcgcaaaatctatgccaaggtcttcgtccgcttgcgtacgtaaaacgtccgtttgacatggcgggaccaaatgttg

SEQ ID NO: 12460 - DNA, 887 bp, Heterodera glycines
  misc_feature (25)..(25): n is a, c, g, or t
  misc_feature (877)..(877): n is a, c, g, or t
gccggttcagttgctgctccatctncagcagttcgggtaattcgagcagttccaagtcgccaaaaaagggaatgttggagaagggactgtccggcgaggcgcccgccatcgctgcattttcaccacttctaccgcatttctgtaccaacaaaacgggggaggtcattttgcggtgctgtcgattgccatttttgcctgctgaatgtcggcactcagtcgcgtcccatcgatcaatcgctggacaatgggcgccgaccaatcgaattggcaacacgcgtggagagcgtggtaaaacgcggggaaatgttggcgggagaaaggagcgtttttctgggtcagacggtgccctttcgtatcggtgagttggccatatgaattctaacaattaaccggggcaaaacattggtgaaatgcaaattaatcattttaaattattacattttcgcatgttcccaatttgcccaaaatgttgaaaatgcgcgacacggcggccctttgatagagttggagcagcaaacggaggcgcacttgctcctcagggcacagtcgcgggttcagtgccaccaaacgccaaagggctgtcaattcctttgttaatggatgcgcattagtaaatggacataaattaaagtaaaaaacaacgtgacaaaaaaaaacattttacatgagggaacgggaatagaaacaatgaaatcaggcccatatgcagaaaaactttatttttaacgccggggtgaaaaaacaggcatttgtagcggttaaatgatatccaaaaaatatttgggataataaagtccggctgtggcgataggcgccgccgtgaaagtttttgtgatcagaaatgtgaatagttcttttgtcatcccacaaaatacanactagaaagg

SEQ ID NO: 12461 - DNA, 4016 bp, Heterodera glycines
atagtaaacgttaagctttcgattggtaccaagaaaatgggatttgaccaaataagaaaaaagttaaggctactgaaactgacaatgaaattggccattgattggacgcggaaactgaaaaaaagccgctttttcgggaataagtgtcgtacgtctgttttgttcccaaacttttgattgcatatttataattttatccatgcgaatggttgtcgcaaattattatccgtgcatttttagttggttctggcacaaaatttgaattttttgaaaaatttgatttgttttcaaaaatctgggtgcgggttcggaatgagtcgaaatagatgccataatcgaattctacgacgtagaaaactataagcgtgtgaaaaaaaatttttttaagaaagaggggggggatacaatgtacaaattaccccgatttttttaaaataaaatgtcccgataactaaactcccatcaataaaaacccctgaaaatctcaccgacaattcttcgccagtgtttcccgatggttttttcaaattcagaaatttggcgaaccgtccaatgaaaaaaggctcagcacaaaaactgtagaggcaattgtccaacaaattataaaccttacaagcgaaattaaattaaaaaacgaaaataaattcaaaaaatgccaaaaccaatgcggaaaggtcgtggccggaagcggagaagtccatcgtgtaaatgggctcaactcggtcaatttcgatggtcatatacccttgacaatggaatgaaacgcaaaagcaacgaaaagcgatcaccgtaaagcgcaattgtcagttgctccaacgcttcgcccagcgattggccccacgcgtggagctgaacgtcggccgtgtggtccaaatattcatactgacatggcacaagcggaggagggcattcatttgaagacggaggagggggaggagacaccgaacattctgtggagggagggaaaggaaatgaatgagaaaatgcgaggaaggaacccacttaaaagaaaccattaaaaccgaaagccttatttaaacatttatcgtaccattttccgttgtttttttaattttccccgcctatttttcccaccgaccctttcttccctcttcctccgcttctctcccacagttttcatttgctgatgagtgcggcgtttccatactttgcttttcgcatttgcgttcattcaacattctgttggcttaattatttttttcaaatttataatattttttaagcattggccaaaatgaaaaaacgctatttatttttaattgaatcattcacattctaagtgtcaatttgtacattaattaatagcgcgtaaatggtaaacgggacgataaattagcgggaaggaagaagagatgcattcagcttttgtttgttgtgtgtgtaaaaatgtgaagggtgctattaaatgtgtggagggggggggggggggggcggacaaatcgtattaatggatgatgatgaaatatgtaatgggattttgctgtggattaaaaatattggcattcagtacaaaataatataaaggaaagggcacgaattcattttcgatgttttttgaacatttacattcatccatattcacgccaaaaatgggttatagccaaaagtttaaagttcttgccgcagtttcaaagaatgactaatagaatgaagtgggcgataatgatcaaatatattctacaaaagaatctcctcaaaaatgatcaattgacaaagcaaatggcaattattagggaaaagcttcaattgaggacatttgggatcgaataaacaaaggacgaggtataaaatggaggaaaatccgaacggggcacaaatattgtagaacaaaagtgtaagtagaggtcgaaaaagcagagaatcgggcaaaaaaaggaacatcgaattgtgagggaaaaccgatcggaacaaagcgtcatttgattgccaaagttaggttgatcaccaaaagcggaaaagttagaaataaaatcaatttggattttaacaaaaggaaagaattttggtttaaaacgcgatcaatcctaatttagacaacctaaaaagactgaatgactgattatatgttaaaaatatcattttgaatttgcggcattaactttttcgccccaaagtgaagaaaaactgtgcctttctactgacacaactaaaattgtttttcctccccattccaaagttggtcctccaaagcatccgaaaatgtctcctcgaagtctgttccaagttctgaccctttcaattcatttcgcagcgctcgacaggcgaaaaacaaaaatcgtttgaggctcttaatttttaagaaacgaaaagtaaaaatgcgagtttattgcgttttaggtaaatttaaaaatcataaaggccgcgaaaacttatccaaatcaccttattgaagaagagaaagttgaattgccaaatgcatccgtcctcagtgaaagggtcgccgctgtagcgcggaatgtaactgcaaaaacaaaggcttacaattagcagagtgaatagaaagaggcaatcgaaagggcccacctgtaaatactgcactcggacactttgatcgcctcttcaacagtctgccaaagatggtcccggaaacggctgtagttgtgcacggtggccaccaattttccgtcaacgcacgccatgcattccttagagggaggggaatggtggacaacaaatagaatgggaagtgaggaaccctcataacggagaaagtgtctttagtatggtctcaatttgtataaattacacggacctgataagtgacagtggtgaaagcagcacttttggtctgcgaaaagtcatagtcagggtaacactggttgagcaacgccaaaatgttgaaagagcgttttgcggaaaatgaaattgggatgaaaaaagccaatttctaccgtcgagaaacggcgccgaccaaaatgacttgctgaccgccgccatcctccgcatcgttgtcggaacacccggaattgctcatctcggataagtgtctgaaaagaagaaaagcaaacaatgggacagaaagcaaagaaatgggggaaaggggaatttggaaagggaggaaaatgagcaaagtttgcaaataaaacgacctgagtcgcgaatgcggagaaatcgaaaagcaaatgtcctccggcggcgaaagcggctgcaactcgcgaccctccaccggacatttgatgcttttcttccactctttcttgtcattggtgaccattttgcatgaatatgactccaatctgaaccactgatgcgcattttcctgcaattgagttagtcaaaacctgacatccagcatcagatcctgcgcatttcgtgaaatcgccattgcgattccatcaagcttctcattgtccaataacttcatcgcgtcccgtaatttaattttgtttttaaacgggtaccgctcagaacaagtgacaatggctttccatcattttagcgcttatattttgtgaattaaaatatctgaataacatagttttttttctacatacatctgcagctagaatttgttagattgggtgacagcagtcaaacaatgtcgattaattataccgcctgtataaaatttcttcaaggccaataatttttctctgtcaaaaatttggttgtactagtgatgaattggtaaacaaattttttctcgacaatatgacattttattgatgagaaaagggaaatggcagattgtcaacacacacacatacaaatgatgtgtgcatatgctatttaatagcactttctaagaagcatacaatttgctgaagcaaaggtaactcatttcagccgaggaccgaagtatcgatcgagaaatttaaaaacaagcattttctttgtaaaataacaaaatgcggaaacatatgcaatggaaaggggaaaaagctggcaaggacaaaacggagggagagaaatatgatggatgagagtgcgaatgggatgggatgggaagggatgggatgggggatgggatgcgtcgccatactcgcgtttacgac

SEQ ID NO: 12462 - DNA, 1687 bp, Heterodera glycines
ctaaggacaaaacgccaaaaaaccccactaatttaaaaatttgccgagattttcccttgtaaaaactgaagagccgatctcgagttaaaaaagaaactttcaaataacaaaagaaaattcgatagaaaagaccaaaaaattcacttaggcaaaatttcaataaaattggtcaataggaaaaattttttttcaaggacaaagttttttctttttctctcattttgacgcactatttccatgtctctaacatataagataacacatggttcattttcttgctaataaactattttttcaaatttttatttaactttgaaatattcttaagaattttcccatcaaaatgagcacaaaatggttttgtttggtttacccttcaccaagttataagtattagaaatttagttgacacgtagttgtccaataagtccttaagatcgcaaaaaacaacaaatttctttcctaattaatcgaaatgaagcgaaccaacgcatcaaacatcactccacctcgcgccaaacgtgcaatgccacctgcactggacctggaccaaaacactgccacactcgaagagcaagaacgccaacgcaccctggtcttcattggcctcccggaaagcaacgccatccgcccatcggagcgtgttcaggaagacagggaagccgccacaaaaatcctggaccatcttgaagttgaggccgaaccaaccgccgtctttcgactcggccggttcgacccccagcgaacaacacctcgcccgctcaaggtggtcatgccgacgcccacacaccaacatgtggcactcggaggatggaagcacgagcgtgctcggctccgttcccaacagaacctgacccgtctgttcgtccgtccggcgctgtccaaagaacaactcaaagaggaatacgaagcgcgtctccgaaaacgccaacaaaacccagctccgatggcaccggcaactcagctcccacagacaaatgccccgactcccgttgtcgaagatggaccaaaccagaagaagaccagtgatgacattcccaaacaaccggaggtttttgacgaaacaatcctcgtctgttatgaagcactaaactcatttccacccaccgacaaaattgttcaccaaattcaatcgctcaaaaaacaataccctcatcttttcaacaaatagttctaccagacctccaacaatttcttcaaataaaaatatccctcaaaatttctctaaaaattttacccaaaaaaaaaaaaaaaaattttttttttcctcttttacaacccctaaaaaaacaacaacaattttccctttgttggaggtctgacttttctaatttctgcttcttcattcaaaatttcaattatcttttatcactacctttcatttcacctcatttccgccaaaagtgtaagtggcacatgcccttcttttggttatttttatttttgaataaataaataaaaagttaaaatcaatgataaaacatatagtgtctaattccgctgtctgtttttcattggtgttttgttcacttttattttcaataatttttaatgtagtgtctgacttatatagtgtctgctgtttcttcacttttcttgttttttacatttcgtttcaatactcattttttttttataatgataggcatttttattcaaaatgatgatatatgttagaggtgtattt

SEQ ID NO: 12463 - DNA, 3302 bp, Heterodera glycines
taagtttgaataagaaatattatatgatctattctacttatatttccataattttctcttatttttattatcgctaaaatttgtttttatttaagttctttcacaacaaaataaagcattttattttaattttcaatggcattttcctctaaaattttttcaattttttgtctcttccatttttaagcctattccgcttcttccaaaaacaatgtttccattttataaaaaaaatattacaaaaaacggggggtgggaaaattggaaaaagtatcaacacatacataacaacacatcagcagttttattgaattgggcgcttctgttattccatcaatcacctcaaaataattaaaaacatttccgtcgcttactcacaaccgatctgatcacaattttgaactgaaatcccgccaaaaaatttatttttcgtatttaaattatttttattaattttaaatattttaaattttaaaaataattgatcaacgacaaacaacaacacatcgaccacagaaaatgacacaacaacagcaattcctttggttcaaaattgatggtaaggaattcagcattttgtacgatttacgagtgacttgtatcctgataattaatgtattaaaaaatttaattgtttagggggtactaaaattagaggtgctgagattaaattggcggtgtttaggcgcataatttttaaaatttttaatttcttagctttaccccctgcctcgaattaaaatttttaatttctacatttttgcgtccatcccctcctccccccgccttggcgacaaacttaattttaaaattttaagaccagttttttttgttgaattttaattaaattctcggctcttaattcgtcttatttctgtccaaaaaaatttatttaattaattttttaattaatttttttctacgttttatcgccccctttttcccccacttttggcgaccgatcattagggcagattaaacataatttaaaagtgcgctgcagcacaaattcttttcacaattgcgccatcgccggtgagcagtggaaggttactgggttaattaacggaagaagaagacacaacgccacacaaattgcatttttcaaattgttttggcatcgtgttttgtgcgccaccaattccgagtgcaatttttaattaatttacatacaattaaaagtccccccctcccacgcccttctaccattagacatttttgggatggataaacaaaccatgactcgtaaattgatcagggatggtcccccaaggggggctcgctcacacataaaaatttttgagggaaaaataggtgtgattttatagaaaattattggttttttgcggacggtccaagggggctcgctccctccaaaatttttagaaaaaaaaaatgttttttttttgttgaaaaaatttagatccattcatattgttgtgggaaaatgggtttttgaaaattttctttaacggatacaccaaaaaattttcaaaattccctgtggcacctagagtagaaaaagaaaaaagtgtggctattagaagagaaaaaaagaggggtcgtcacccggggggcggtgcccttccaaaccgaacccctgggtccatcgcccctgaatttgatcagacaggaagttaggctcagctcagcgccgagctcgcgcgccgagttggactcacagctatacggtagcaggggttggcattattacagtatagtatagttttgtacgagattttttgatttccgcccagcacacagtactgttgtttcgaaacattttatgactttggcactgccgcgcggcgagtgccatccccaatttgcgctgttcgccccccaccaccaccaccacaacaccaatcatgcgcagaaatcgcttccagatttgacactgcgctttctgctgatcggactcgctgtggtcgccgcactgctcgccgttctcgccctgtgcctggtctgttgttggcgacggcgcaagaagcagcagcggcgtgtacggcccgcgcgactgcagaaaattgtgagcggaaaaaatggcaccgcccctgggggaattgggctgatcaggatccccagagcagggatttggtgatcagaaaatagttcagaatgccgagtgttaaccaaatctaaaaatatcatgttgatcacctaaacaaagggccgagatttcttggggattgaatacaaaaaatatgattttttcaaaaaaaaaagacagaaatttatacctttttagaaaagaaagttttctaaatctccaaattaaaaaaatgaagaaattgtgtgtttttatttgatttactaaaatttttaaaaacaattttttataaattttatatatttctttgttttcaacaatttttgtttttcaattttgtgtcttttccattgcacattttccatgacaactttaggaatcaaattatttgaacattttgcagaaaaatacgttgacattttgcctaccttattgcaaaaatttcaaaaattttgtaccctctatttaaaacaacctaaagactgttgctgaatttttcaaaatttcgctctctcttgaaaattctccccccttttttgaaaattgataaaaaaaatgcaattaaatttcctccaattaaaaagcaaattctttagccaaaaatcactgtggaagaagcattcagtgggctgcctgacccaagtgtcaaagtgaagcaattgttctgcgcaatggacgccacaaaaaacggtggcaccgccgcaggggaggaaaagcatgggaataaggtgccaagctaataaataaattaatcaattaattaatattaaaaaattaataattattgtttaaaagttggctaatgattcgccccttccgccaatgaatggcggcggtgattatttggacattggcacgcccccgtttagtaatgtggtcattttgaatggccaagaaggacagcagaaggcatcatttgcaatggctttatcaattcattttataatataatttttataaatttattagagctagtaattcgaaaattagaattaagtttttggtacaattctaattatactgtaaaaaatcataaaattcaaaaacggaaaattttcgagggggcctagctcgaaaatttctgaaaatttctgaaatctaaaaacatggttggatagagctcgtcgagctctacaaaaaagccgcttacaccgacctcctccggtcaaacgccggcgagttattcggccggcgctgaaatggccaaaaaaaggatgcaatttttgcgcagtttttcggaaaaactggtagg

SEQ ID NO: 12464 - DNA, 2956 bp, Heterodera glycines
  misc_feature (54)..(54): n is a, c, g, or t
  misc_feature (56)..(57): n is a, c, g, or t
  misc_feature (61)..(62): n is a, c, g, or t
  misc_feature (96)..(96): n is a, c, g, or t
  misc_feature (101)..(101): n is a, c, g, or t
  misc_feature (105)..(105): n is a, c, g, or t
  misc_feature (110)..(110): n is a, c, g, or t
  misc_feature (114)..(114): n is a, c, g, or t
  misc_feature (123)..(123): n is a, c, g, or t
  misc_feature (128)..(128): n is a, c, g, or t
  misc_feature (133)..(133): n is a, c, g, or t
  misc_feature (144)..(145): n is a, c, g, or t
  misc_feature (148)..(148): n is a, c, g, or t
atgggattgaaacggagccggtgttgaacttgtcgttcttctattgtcaggagngnnaagnngaacctgaggaatggtctgtggatggaaaaggantggtntaantggangaantcctttganggtgntgaantggtcgatgtnnaanacatctttggcatacaccgagtgggggtcggggtggaagggaggcggcagctgaacaaatggacaatgaaatgccaaccattcaaattatgccatgccaaaactaccattccctgggcttctcccacctttacggcttccattttcctccatgggaccggctctctgcccgtcttttggtccggctgcgtgaagaacgcgtgtgccttcagctcctccgcgccgtcctctggccgtcccacgcggcggcagcccaaccgcaaagtcggctctttgtgcagcaatccccgacacaaagtgcgtgccgcctccgtgaatttgtcgctgtacttttccgtgtcttcgcgcactctccgctccacttcgtcccgcttcactttttctttacgttggcgaaacggcgcctcaaaaggcaaaaacaatcaccaaatgactaatgtcggcactttattaattacatattttataatttccgtttttacctttccttcgatcatttcgtaaatcaaacagcccaatccccaccagtccacgccgtacgaataacgttcattcttcacaatttccggcgctgcaaaaaataaaaattcccattgcattcaaaaactctcccattcctttgctttcaatggcatttttcccttttcccttgcgtgccattactttgtttttcctacccccccccatttggcttattgccactacaaatgccaattttagctccggattagcttcccccctctcctccccctctcacccatatatcccactgtgcccactcgtccctttatgggctcgttgtccttcagttcgacggctaaacccaaatcggatattcgaacatggcctaagaatagtgaagtgtatttgctgtacaatgaatgcaatacagtatccgaatttgggggtaccgtaatcgtccagcagaatattttccggctttaagtctctgtacaggattctctcccggtgcagatgctgcagtccgagagtgatctctgccgcgtagaattgggcccttctctcatcaaagcccccgggggacaaagtgtaaaggtgaaatttgaggtcgcctttaaagcgaattcgatcagaaaaggcgtccatcgtccgcgggactcagttgaccgacctccgttcatcaaagtgagtaccaaacaaagggcgtccttcgtttcgtaggcgtacgccaaactgaccacaaagggcgagttgatccgctgcagaatttgcttttcgttcagtgtcagtgactcggcgtgccttttcttcacccgcttcttctccaactttttcaaggcgtacattttacccgaggcgcgcaccttttaacggaacaattaatgaatgagtcagtcgctccaggccaaagtgccattgttttacttggcacgcgcacacttcgccgaacccgcccttgcccagaattctgtacaatctgaacgtctgtttgtccactgtcctccgttcaagccatttccactgaaagcattgaggaaaagcatcagattgtgtggcagaagggtgagggggggggcgacctgaagataacggtagaagaacactgtgccaaggaaatgtttgaaagggtcgaaggcgaggaaagaacgcacttctctgacaaagggtgatcagaaaggtattggaaagtgatgatcagaatgatcggatgagtcaatcactttgctaacggagtgaacagtccgtccgacgggtcaatggccccgtcggatgcgtcggtggcaatttttgtgcaccgtttcacgaaggaatcgctaagaaatttgccatgttgggtggacgaattgagcggaacgtttgcggcattggaagactgaagtgattgttgttggttttctggtaaatttattcgttgtgggtttgccacccaccgtcgctgtctctccgtttgtcagtccctcgccgtcccccgctgtccttccgacgttttccaatccgtcggtgaacagttcgatcaccgtcttcgccactctcctccgctggtcagggtcattgtctgaataactctcaacaatttccgcatcaatccgctcactttcaactgaccgctcgtctcgtattcttcgactcgttccaaaaacctccagcatttgcccaattcggacggttcctccgcctgctcgcagtactgcttgaaaaggaggcgcccgattggctgtttttccacgacaaacgaaaaactgagagaatttttaaaattaaatattgactgaaagaaaaacctgaggtcgatttcgctttttaagtgcatacattgcgtgtaatgactgaatgggggggggggagggaatgaatgccatgacaaaagaaaacaaaggcaaactgacggaaattggaggtaatgacgccactttttgcttttccctttgcgttgaccgcccgtcctggcctttatgtacacagtgttggccacccaaaaggggaaaagagagggaagaaattggtgagaaaagaaaaagagggagaatagaggagaggggggggagagagcgggagagagagagagagactgagaagacacgtacaatgttttcgatttccatttcccaatccagcgcagcggcaactgcgaaaagcgatcggatggatgcgcaacttcggaaaaggcttttgaagtcgattggtcagacggaaataagcaaaggagcgaaagggaattccatttacaaagggaaaaggacaaaaacagaaaaaaggggaaaatgatctttaataaaaagggaaattgacacaaaaagaaggaagaggaggggaaagaacagaaagaaagaaagagaggaagaaagag

SEQ ID NO: 12465 - DNA, 2721 bp, Heterodera glycines
aaagaacagcatgaggtcgatttcccattctaagtgcatacagtgcgtgtaatgagtgaatgggggggggggaatgaatgacatgacaaaagataacaaaggcaagctgacggaaattggaggtaatgactccactttttgctattccctttgcgttgaccgcccgtcctggccttcacgtacgcagtgttggccacccaaaaggggaaaagagagggaagaaattggtgagaaaagaaaaagagggagaatagaggagagggggggggggggagagcgggagagagagagagagactgagaagacacgtgagagagagactgagaagacacgtacaatgttttcgatttccatttcccaatccagcgcagcggcaactgcgaaaagcgatcggatggatgcgcaacttcggaaaaggcttttgaagtcgattggtcagacggaaataagcaaaggagcgaaagggaattccatttacaaagggaaaaggacaaaaacagaaaaaaggggaaaatgatctttaataaaaagggaaattgacacaaaaagaaggaagaggaggggaaagaacagaaagaaagaaagagaggaaggaagaggaaagtgatcaaattgagataaaaaaggggggagggaaagagagataaatgaagcggagagggagggaggggagagagggggagggaagggttggtgattagtgggcggtgactaattagtcggagggagggcgaggggggagggagggaattggacgaatttgtggacaaaatccaaacaaacaattgataattgcagaataaaaccatatatttttgtaatttttgtggaactttcaatcaaaaaatcaaaatcaaactgtaaaaggagcaattgaaaggaataaaataaaaggagaaaagggaaaaaataaagaaaaaaagttaagggaaaaaggagaaaaaaaggggatgaaggatgagaatgaaagagataaaaagagaagggtgagagagagagagagagagagagagagaggaaaaggagagagagagagagagagagataggagagagagggagagaaacagagggggaaagagaaaaaaaggagaaggggagagagagagagggaaaaaggaagaaaagaagagagaggggagagagagaagacagaggggagtgagaaggagagaaagggagaaaaaagagaaggggaagagagggagagcgaggaaaaagaaacggttgtgagagaaaggatttaaattctttgttagccgtggggcgaaaagccgagaaagtgaaagtgcactaatcctcttcagaagaaagggacaagaacagcagcagaaggtaaaatggcccaacagaaagaaaaacaaaagacgggtgaactgagaaaggtaaaagtgagaataaaacggagggtaattggagacaaaactcgaaaattggacggaaaatgccgaaaaatagaaaatggatatttaaatataaaaatatttgatagttttttaaatggccaatcagagaaattttaacataataatttaaaagggaagagaaaaacgaacggaaaaggaagaaaagagaaaaaaagaacatagacaaacagacagaagaacagacaaagagaaagagagagagcgatagatagggtgagagagtgggagagagaatgagagaatgagagagagagagagagagagagagagagagagagagaggagagaagggccaatcatgtttcccatcattttcttcccatgcgaagagaaatggtgggggtgagggcgctcatttcctcaaagattttatagaaagggacgaaaaagaaaaaagagacaataagaagaaaaaagaggacaaaaagaaaaaaagaattgttgggcagctgatagtgagtgggagggaaaaagagaaaagaaaagagaggaagggacgaggaacgggggacagacggttgggcaggaaaagaatgtggagaattgattggtgggcggagacaaagagagaaagtggaaaacagggggaggggaggagggtggagaaaagacaaagtggcagacaaagaggagagagagagaaggagagagaaagtggaacagagggagagagagagaaagtggaacagagggagagagagagaaagtggaacagagggagagagagagagagatagaaagtggaacagagggagagagagggagagagaaagcggaacagagggagagagagagagagaggaggcagtagaattcggaagcaaaaggacaaagtaataacggaaaagaaatatttacatgtacatattattggtgtttagagaaaaatggcaaaggggggagtgaaaaagaaagaaagagagatagaaagagagacaggggggggagagggagagaaatgccgaggaaaaaaggaggaaaggaaagcggcggcgtttggccaagagccgggattgcctcttggccattgaattggttggctctgccaatttgcctttcccacaatcaatgcctttccccccccccccctttccctttcatttccctttaagccattccgccgttgtcgcttcgatgaggctgaattaatttggttgctttcagtgaaaaagagcgacggacgatgaaaaaacacgaggaagaacgtaaaaaacggacaagcggaaggaaagagaggacaaaacggtggccataaaaagtgaaagaggaaatattggaaagggtggggagagggg

SEQ ID NO: 12466 - DNA, 1393 bp, Heterodera glycines
  misc_feature (1329)..(1329): n is a, c, g, or t
  misc_feature (1349)..(1349): n is a, c, g, or t
aaaggataaataaagtcagggaatatgtttagcattatcaaaataaagcataaatgaccggtgatatccactagaaaatttgacaaaagcatagtctacatttgttaagacaacttccgatattatcgtttgtctcaggtagatatgttcaggtggtttaaaagaaagatttttgagagtttggggtatcttaaaattttaactaaagtgcaattcctattattgatatgtgcgcataaaactcctggaaggttttaccctattccaaaataaaagggacattgcttctgtaatcagaagaattgttgggacgttgttctaactcaaaatgccccgcgaattgggtcacaaataaattcaagcctttttctcaatgctgtggaagcgaagagttaatctcaatgaaaaggataaataaagtcagggaatatggtttagcattatcaaaataaagcataaatgaacggtgatatccactagaaaaatttgacaaaagcatagtctacatttgttaagacaacttccgatattatcgtttgtctcaggtagatatgttcaggtggtttaaaagaaagatttttgagagtttggggtatcttaaaattttaactaaagtgcaattcctattattgatatgtgcgcataaaactcctggaaggttttaccctattccaaaataaaagggacattgcttctgtaatcagaagaattgttgggacgttgttctaactcaaaatgccccgcgaattgggtcacaaataaattcaagcctttttctcaatgctgaggaagcgaagagttaatctcaatgaaaaggataaataaagtcagggaatatggtttagcattatcaaaataaagcataaatgaacggtgatatccactagaaaaatttgacaaaagcatagtctacatttgttaagacaacttccgatattatcgtttgtctcaggtagatatgttcaggtggtttaaaagaaagatttttgagagtttggggtatcttaaaattttaactaaagtgcaattcctattattgatatgtgcgcataaaactcctggaaggttttaccctattccaaaataaaagggacattgcttctgtaatcagaagaattgttgggacgttgttctaactcaaaatgccccgcgaattgggtcacaaataaattcaagcctttttctcaatgctgtggaagcgaagagttaatctcaatgaaaaggataaataaagtcagggaatatggtttagcattatcaaataaagcataaatgaacggtgatatccactagaaaaatttgacaaaagcatagtctacatttgttaangacacttcccgatatatcgnttgtctcaggtagatatgttcaggtggtttaaaagaagattttt

SEQ ID NO: 12467 - DNA, 900 bp, Heterodera glycines
agagagagagagagcgaggacgaacggaagccgatggaggagaagaggaacagagaggcacaaatgtcagacggcaacagggaaagagagagagaaagagggagggagggggaagagggaaagagagaaggggagggagagtgaaggaaagagagagagagagagagagagagaggaagaacggaagccgatggaggagaagaggaagagagaggaacaaatgtgagagggaaaagggaaagagagagagaaagagggagggagggggaagagggaaagagagaagggaagggagagttatggaaagagagagagagagaggaggaacggaagccgatggaggagaggaggaagagagaggaacaaatgtgagagggaaaagggaaagagagagagaaagagggagggagggggaagagggaaagagagaagggaagggagagttatggaaagagagagagagagaggaggaagcggaagccgatggaggagaggaggaagagagaggaacaaatgtgagagggaaaagggaaagagagagagaaagagggagggagggggaagagggaaagagagaaggggagggagagtgaaggaaagagagagagagagagagagagagaggaagaacggaagccgatggaggagacgaggaagagagaggaacaaatgtgagagggaaaagggaaagagagagagaaagaggtagggtggggtacgagggaaatatagcatgggatgtacagtgagctattcagatagagaattcgattttgacagggtttttggaaaaagaaaaggagacgttatttctgtaaatttattttacctaaaattatttcatgaaaaagttttgaatctatttttaacctacgtctttcaagcgacttttgatcataa

SEQ ID NO: 12468 - DNA, 1236 bp, Heterodera glycines
aagaagcggagaaagtggcattctcacgcgattcccccccccccctttcccatttcctcaaatattgccatttggagagcgtggaaatttgcccctccctcggcactttggcaaggcattgagtgtttttggatggtttggaattggagagaaattggatttgatgttttgtgggtataaaaaacaaacaatttgagttgtgaattgctctttcatcgctttcgcctcccttttcagcccctccgtggcaatttgcaaatttttttgggcctcaacgattggggcatttgcatgatcaatgccaccacacacagacaagtggcatcaattgagatggacaaattggaggtcaaattcacgccgaacacaaattatttggaggtggcgaatcggagaaaagaccttatggccacggtgacatcatcacaggtgaacaaaacaaagagagacttatttaccatcgaacttccaaaacaaggacactttttaaaacgcatttactaaaaggcgctgccggagaagaatttggaaaattgttctgattcggatttaaaaagattttatccaaaaataatttttagattttttggccaaacgaaaagaaataagtcggcaccgtcgggaagagagagagagagagagagagagagagagagagagagagagagagagagataggaagaaagagtgagagatggaggagaagaggaagagagagcaacatatgtgagaggaaagagagagagagagagagagagagggagggaggggaaagagagagagagagagggggagagagagagaaagagagagagagagagaggaagaacggaagccgatggaggagaagaggaagagagaggaacaaatgtgagagggaaaagggaaagagagagagaaagagggagggagggggaagagggaaagagagaaggggagggagagtgaaggaaagagagagagagagagagagagaggaagaacggaagccgatggaggagaagaggaagagagaggaacaaatgtgagagggaaaagggaaagagagagagaaagagggagggagggggaagagggaaagagagaagggaagggagagttatggaaagagagagagagagaggaggaacagaagccgatggaggagaggaggaagagagaggaacaaatgtgagagggaagagggaaagagagaaaggaagacggagggagggggaagagggaaagagagaaggg

SEQ ID NO: 12469 - DNA, 2791 bp, Heterodera glycines
tgaccgatggtctccactttgtacgctttgtgttcgccatttgcttggtcgaagtagcggaacattccattcagctgccaattaaccaatcaattaactgttaattgctttttttccacacgaatattgcccaccaattcgaccacttccatcggctgcgattcgctgcacagcgaagtgaacccaacgatatcactgtacattatcgtaacggaggcgtagaattggggctccacccgccgacccattcgaagctcatcgaccacagaccttaaaatgtttagggatttaaaagcaaaaggagggaatagcaaatgcctgcccactttggcaacaactcgagaagaatctgctcaatcttctgctgctccaactccaatttgcccgtctgttctttcaccaaattctccaaattgcctaaaatcccccagaaaatgcgcaataattaaataattcaatcgaatttcgccgcccaaccgacccgtgtactgctccatgtttttgatcatttggtccaccaaacttccggacctataacgaaaatttgtgtattttaaaatgtcttccaaatcacattttcagagttgcgtcagtgattttccgtgccatgttcgcatcgggtctaattggggaaattattcaaaaatgggttgagcaattggtcctccattattccttttggcacctttgctcgggggtgccaaaacatcgccgcatcagtgccaccaaatcggggtgtactcggtcaattgagctgaccatcgaccggggagtgttggcgcccggggcgacagtctcttcgcccggaaattcgggcacaatcggcaggcgctcttcagcttgggcactgaaaatgccgacgtcgtcttccatcggttccaaagggccggcgcctgggcaaataaataattaacggattgacagacatttgccaaatgggctaaccgtcgccggactccgttacatcgttaattctgaaaaacggttgaaaatttgaagaaattccaaaaaccaaaaacgaaacctccgccggtagagaatttcgtagagaatggcgccgaatgcgtacatatcgtgcgattggccttcttcgttggtaaattccttaattgtttttccaaaagtcataaacttttgccctttcactcatttaccatttcttcaggtttattccgcacaacggctgaacgaattgttaagcgcaattcgggggcataataatgcaattctaaaggaaggccgaaaatattttaaattatttattgtttaaaaaaacactcccccaaaatgccctcccgacaatttaaatttgccctcccccctttcgttgtccgaccttcgtttgggatcagtggctgaatgactgtgccattgccattgctcaaaatgccgttgtgtcgccatttgtacaaaagacgagaagttccaaagcctgaaaatgaatatgcgtctggccaatgcttctccgtttgctcagtttgcacctgccaatttcaaaatccaatgactgtcaattagacatcgcgtcgaagtcagcgcgccgtggtaaccgatgggggacgagtggagaaagtcgagaccctggaatatcaaattgggacaaagcggacattaaaccgaatgagaaaccccgccccagtttgccttgacaatgtctctgacgaaggcacttttgaaattgttgtccaaaatgtccctgcgtggcaccgctccgtcgccctccgcccccctctgctgttggtgtgcgctgacaatggatgccacactggcacggatgtcgttcacccgcgactcaatcgaccttaatcactgcgattactttactaatcgcatcattagcactaattgtggggtgggggacggctaaagcaaattttgtcttttgaaaaggtgcgacagaatttgcagggtttggccacttgtgctggcagttgacgaatagcaaatcggccagcgtcccgcggaagcaatgcctccaaatgacccaaacgtcggtcggccgttcgacgcataagccaatgaaagcgtttatgttgtcatggacagcctgcttcatcttaattagtaaaaccgaacaaactaattaattgatctgttaagggaccataaaaagaagctgagtgtcccttttgttgaaggacaatttctcgcgtaagcgaaaactttcgacaatgacaaaactaaaagggaaaacaaaacggtcaattaaataattaattttaattattctcacttctgttcaatggtcgcaattttgcgactgtaaatttcttcaggaacttcgtccgttctctcctcctccttttcgcgtttggccaagtgctggtgaaagctgtggattgaaatgttctaaaatattcatttgatttaaatttaaatgtcaatttttatttttgcactttcaccgtcataaaaccaattaataaatcaaaatgttcgttaaataaatgcccatttggataatgaattaatttgccatgccaccgaccgatgatccaccgtagtccatgtccacaaaagcgatcatttgttccggcacataataaggcatttgcgttgtttcaccgcgtttccttaatttgcactaattcaaaatggcatttaagtaattagcacgctactctaactcacacaacaaatttttaatatttaactaacacttttcgtatgcataagaaaatgatgaaacccatgcaaattgcgaattattcacagcaacgggagcgataattatgctttaattgggtcattaattactttttttaaataattattattttaatttaccccc

SEQ ID NO: 12470 - DNA, 1983 bp, Heterodera glycines
gagtcacaacctcgttgtagcaaagctgtggcactccctctgatgaaaatggcaaaaaaaaaaacaataataataaattctactataatatttttatttaattggaaaataataaattatttcattttaattttatgttttaccaatgtttggcagttggaatttgtcccacttgaacagctcaacgaaatgttcgcaaattggagaagccccggccgcggttgatcagtcgtattggattggaccaaataggcgctgaacggcgccacccgattcagttgggcgtccacactgatcggaccgaagggtcctacaaaaagcaaccgttcatcgattgaccaaacagaaaagcctcgttctttgccaaatttggccattttcttctccttccccctttgcttgccttggatcggtgccgtgtgaatgttcgcccgtagcaaagtgccgttgcgattgccccggacagtgcccgttttttggaaggtccgccacagcaaaagggcataagcccaaaagcattcgtaaagttggacggaaagcatcagaagagactgaaagggaaaaaagaatttatattccaaaatgagttcccttcgcaacactcacttccgtttgtgccatattttctccatttgcgcttatttcaatgccaatttgagtgccaaatgaagccaattggctaatcgggtagaattcgttgaccaacttgagatccatcggatgaattaattaatggatacatttgcaaaacatgccaaaattgtgccatggaacaaattcaacatggccgagtccatagtgccattggaaagccacggaagagccaacggagaaggcgagtaatcactgatgcaaacaatgttcacaaattcagtctgaaacatttatattcagatgcattaaactattaaatcaaaatcttttaccgtacgcattcccagggcaaagagtgcccgaagaaacggtacatagtcacttaaggaattgccgagaatggtgagcaaaactgaaaaacacaaagcttaaaacaaagggggcatcattggtgagcaaattccattccatccggaggggtacggtaatggctcaatttgtcaaaatgccattgtttttgtttgttacttcgcgcttcgtctttgagtgggcccatccgttccatcaccgtcgtcatgttcagcgtcccattggtcagctcaagccgaacaattcccaccaatttgatgcctttgtcacttagcatttggcccaccgtatcagctaagtcttgggtctgatcagtggggttaaagcattgcggacaagtgaccaaagcgacctgagaaaaacgtgatgggtcaaggaaccatttggggtgatcactcactttccgccagttggtcaattggagcaatgccaaaacattggtgaccaaattttcgggtgccattgtggacagatccaaaagattgtccgacactctgttggcccaactttcgcgccaaaagttgcactgaaaaatgtccaatgaagaagtgattcgatcagtcagcaacaaatctatggaataaaaagtgaattattaaaaaatgggaaaattggggggggggaaataccatcagagcaaatgggcccgaaaagggcggaaatgttagaactaaacaccaaatccatgctttgggaagtgcctatgccaatgccaacatcgccgagacagtccgacgagggcatatcgaaggatttgacactaaattggcaaaatggtgaaaaacagtgacaagggggggggatatattatcaggacataatcaaaaaaaattcagcaaattggagaatgctgatcagttcatatctgtccactgatcagtcagtgacccgtgccagcaataattgaaaagggatggacaatgtcatgttgtcatatccacttccgataacttatgacgttttgttcgtttacgacgtgaccaactcacaatcatttgaccatttgaccgattgggtggg

SEQ ID NO: 12471 - DNA, 2532 bp, Heterodera glycines
ttgttcagcaatgtttttgttgggaagaagggaattatttgaagtcgacgcaacttgaggagaaaaggcaaggtcgacctgatgaattgcacctttgactgtgtgacgacgcgtttgggaacgcaaaagaacggagagggcattgcctgaaaaaggggaagacaaatggccatcccatgtaaaaagcggtagttgaaccaactcgagacaaagcgacgtccgcactttggtgtcaacccaaagagagagcacaaatttgagacatcaaatggtccacgaagctgcagcatgtcttcagctccactgctcaacacaacgccggcacggcccatccgagtgatttccaacagacgccgtgcattagtgaaaaactcaaagagtgaggcgatataaacaacggtgccaattatactcgagttcgactggatccaggccaagatttcccccaagttcaaagtccaggtcatttttcggcaacctgggttttagtccataaaacccaggtccaggttcaacctggaatttaggtccaggtctaattctaaattataatttagggaactaaaccatttagaaaatttatccgtctttcaactataaaacaaaaaagatctcaaactaataaacaagtgagtaaaatttttaatctggtcaagagatgaataaatcttttggcagaatatggcattaaaaaggcacctgtcgtcgatgctccgaactgataagtgcgttgccataacaaagctcaaaagtgagaccggcggcgatgcaactttgcacaattttttgtttaaatagccacgacagacggcccttttccatcgccgtggcatccaatgagacgaggtcaacgaagtcaccctttcttaacggaacatggaattagatttggtctaattgtaagcctaggagtacctttgcaatgtcatcaaaatctgttcatcggggacacgaaccgcaataatatcgtaaagctttacttttttattgtgttggagatggtgaatagaatccgcatcaattgaaaccgtcaaacgactgaaaatattaaatacaaaaataaatattgaagaattctgtgaaaaatgcctaaactgacgaaatcgcttcccattaactgcaaaagccgatagatccaacttggactcgtctacaagaaacggatcaggcacaatttcactttcgctggtcctttcgttgccatcgccactctttcgatcgtgcaactttttctgtttcttacgttttctcttcttcgatacgacttcgtcctcttcgtctgacttaattaagtaatttgtcttattggtgtttcagtaattcaacaaaattacccaaattatgtccgattccttgccgaattttcctatgtcaacattaattgcaacagattcgtatcccattcgaactgctcgtcgcactgtggcaagtgttcgctcggaatttcctctgtggcgaatatttaattcggcaaattgattttttcgaagcatcaaaattaaaatagaagaaaataaagcggaagcgaaatctagaaactggtaaaaaaaaaaatttacgggagcgggagtccgaaactttccgggaacggaactggaactcccgtaaaaaatgctataaatttttaacggtagacccggcgggagtaattcaaatttaatgaaacaaaaaaaaattccattctcgagtgtttcaaattagtggaaatcaaattttctaaacttggtattttccggatgacgcttccttcttgctcaaaagatggtgctgccagtctcagtccaatgtcattcaaagaaccaaatgcttgtccaatgttggaacggatgcattaccagcgaatcactggaaggttttcgttttggacaacacagcttcatttgttagttttttagattttgtgatgcatgtattttcgttaaagaccgccagttcagtgctcacagaatggttttggctgcccatagtccgtattttgattcaattttgcgtcacaacaaaattgcgaaagagaaggtaaagagcgtttgttaattggaatcctttgttatttgttattcccttcagattatagtcaattgtcaagatccgactgtgttcgatcgcattctcaattatatgtatagcggctcagtgacaattgacagagccattgttgtggaattgttaaaattggcgaataatttgctagtgggttttgcaaaattagattcccattttaaagtttttttagatgatccgcttgaaaaattactgtgctgattatctgatgcgttacattgatgttgcaaattgcttggcaattcgtgatttggcctcccgttacaatttgccgcgcttgcaaaagcatgccaacgaattcttcgactcaaatataaatgggttgttcggtctattgtgtgttaagagcaaaagccgtttcagatgtcttttggaaaatgctgatgtgcttggctgggaacccatcaaattggtcgaattgcttgaaatgacgcggcatgcgagcaacgtccgtgccgatgtctaccttaa

SEQ ID NO: 12472 - DNA, 1757 bp, Heterodera glycines
agatccatttgaacgcgtcctccaatcccactgattccttacagcaaattaaaacagcgcccctttctcggcaaatccaaggcaaaaaacgacgacttattggtactcatttcttcattattttaaaccattattttccaaaggcatgaaattataccgaaaatcggttgcatcggcttcccgccagggcggactgccaccacgacgacgcggtcgcccaccaaaagaacgtcctcaaccccatttggctgccggaattgacgaggagccaaattccatcttttttgaattcccggacgaagatggggaaccgaatgtgccagcagtggtaatggaaaatttgtaaataatacagcatttctttcaaggtttttgacgaggaggacgaattcgatccggaaaatatcgaatttatcgaagaaggggaggcggagggaatgggcagtgagcagaacgacgctgcaacgaaagacgaggtacgtcttcagtggcatttagggacgcgagagtacggctccattttcacccttcgagaactttccatttcccacagagagccgtttccctcgcggcctctcataatcagttcctcaactgccctcactgttcctttcaaactcgtcgtggtccgcttcatttgaagcgccatgaagcagtcgttcattcgaggaacgttctctacgtttgcaacggtgtacaacacgacctaccgacatttaagtcttcttcaatatttagtttgtcagttcgaatgtcgttggaaccgcgagttctacgagcacatgcgtcggttgcactttcctgggcccccttacagctgcgactcgtgcacttacgacgttgaccgactcactgtgctgctgactcatcgtttaacgcacagttattgcgcaattaccatagcataaaacattcaatttaagcggacgaaaagccattcaaatgttcggagtgcacattccgaacgcggaacagagccaatttggtcgttcaccatcgtctccacacaggcgaaaagcccttccaatgcgaaatttgtggaaagtgaaggcattacacaatttcgatttgttaaaccattctttgacagacgttttgtcttaaaacgaactttggaacaccattcaatcgcacactccgaagaacgcccttttgcatgcgatcagtgcaatttcaccaccaaataccaatcccatctgatctcccatcgccgaatacagtctctttttgtttgttactagtcaccctctctttctctgaatcgattgttctaactttggactgttaacttttcttgttcagctccggggaacttttccgctgtgaggtgcccgactgtgactattcgtctcctaagaagagtcaattggctgctcatctccgcactcacatgggcgtcaaatcgcataaagtctttcttttacaaatcaaaaacgcttattatttgggttttagtgtcgcatttgccatcgctctttcgttgaaaaatcacatttggttcgccacgagcgcattcatttggaggaaaagccatttaaatgccagaactgcgagtacacctcgtcaagacgggacaaactgaaggagcacattctcaaataccacaaccaatcgcagtcgaacacgcgacttctgaagcgacgttatcgaagggcgcggcaacttcagcaattggcagcaaagggaaaggtggtgggaaaatggacattttacttaacacgaaatacattgggaaaaacttaattgagaatctccgt

SEQ ID NO: 12473 - DNA, 2522 bp, Heterodera glycines
  misc_feature (2396)..(2396): n is a, c, g, or t
  misc_feature (2466)..(2466): n is a, c, g, or t
  misc_feature (2500)..(2500): n is a, c, g, or t
  misc_feature (2506)..(2506): n is a, c, g, or t
ggtggaacagtgcgctttccaatgtgggagaggctgataaaacaaagggcgcaatccacacaatatgcagtcgacaacaacgaattcgagttttattgaagaatgatgagtgggagcaaattgaagagctggttggggtattgaaatgtgctgaagaagcaacaaaaaggttcactgccgagccaatttcgtttgtccttcctcaagcaagagcattacatgatgagttgtacgaaatgaaaattgtcaacaggactgtggagacaatcagaacaacactttattttgcggttgagcggcgcttttttgagctagcgaacaagaagtaaaaaaattatacttggttttcattaatgtttggtcttagggaatatgctctggctacttttttggatgtgcggttcaaagacaaagtgctgactgaaaattccgcaacttttcgcgccagagtcactgtctggatcaaaaatgaattgaaagaattggacattgataatgacttcgaggaactacaacaaaatgaatttgtccgtcctgtaatttcaccccagcccgaaaatctgccagccaaacgacgaatgtcattttttgaacgtcttaaaaatattacaggcgcgaacacaagtgaacagggtgatttttcgtctcttaaaattaattttataatgaatttaaggtctccaaacatcgcaagacgatgacattgaaaaagaaattaaagaatttctctcagtggaaattgcgaacccagaagcaaacccgcttgatgaatggaagaaaatagctccccgattttcaatccttgccaaatttgcagaaaaatatctttcagcacccgccaccagtgtcccaagtgaacaaacattcaaagtcgcccgtgatgtttttgattatcgccgttccaaattatcacccgaaacggcagaacaacttatttttttgaacaagtctcttccccagatgaactacaattattgaaactattttttgtgcattttattaaacttgttatataatttctatatagttgatgaaatttgtgggtttttttcccaaattaacatgtaaaaattaaaatttataccaacccggacccgggcccggcaatttgaaaacccgggttgaccgggctaaccgggttgaccgggttttgagaggccgggcccggaacccggttgattctggaaaaatcagcccggcccggcccggcatttttggaaattccggtctctaataaaaacccatcaaaaagggcattataaaaaaaaccaccaaatgaaaattttcaacaaaaaacgactcataactttgttgaagccaaacttacaaaatttttagttacaactttttgtaaaaattttttctagattttttaattacataagattgaagagaatacatagagccatcgaccaataccaagattgattaatttgataaagtttaagctaaattatgagtcattctttagcaaataaatttaaataataatttaatttaaatatttcaatcattgatacttttttaggctcggctcagcacgattttgaccactttttgtacatattttttggcagccctagaaataaataatggaacataaaaaggggaaaaaatatttggcgttttattttatgttccagctttaactgccgaaagatttttaaaaaatatattacaaaatgccagacataaaaaagcaaagcaaaacgtttgaaatttagtggcctaaaatgaaaagctattcgaaaaagtaacaaaatgaattcaaatcattattgagaaaataatttaaaaaaccaaacttgtaatgaaaataaaatatattggagatgattttttgagaaaattttcatttattaaggggtgtattttcagaaattttcgggccgattcttagggaaggtatttttggtttttattgcatttttgttaacaaatttcgacaaaacgccaataggcaaaaataggttctttcaaaaattctttaggcttttaggtctaaaaataaaagcttaggaaatagacactaataactcgaaaggtagctttaggctttatgtcttaaaaatccccaaaaataggctctaagaaatggaaaatgcaattttatctcaataatattttaatcctcatttaattcatctcaaattgtttcttccaggggggaaaaaaaaattgtctctttttcccccccccctccggttttctcgtcgctcttttttggcttttctcctttcgtttgccgctcctttttccttttttcccttttctctttttcggttgttctttttcccttccttcctttgtgtttcttccctttttgccttgttccttgctttcctccctttttcttccctctttcggcgtcgttttggtgcccttcttttctcgcntcttttcttcctttttgcttctcttcctttttccttgcctttttcttttgccctttttcaaagaaaagtncttccgtttttgctttgttctggcttttgtctcntccttnttctttgttccctttg

SEQ ID NO: 12474 - DNA, 3093 bp, Heterodera glycines
  misc_feature (513)..(513): n is a, c, g, or t
cgtcaacgaacgactgtacgagcggatgaatgagcaggcgaacgtgctgaaggacctgcagtttctgatcacattgatcaatccctttctgtacgggtttggacggagcggcggcagcggcgccaaactgcgcggaaaagcggcggttggacagcatcggcaaaagggacggaatgcctgcggcggtgcggacggctaattaccagctgataattactgcaggcagaaagcgttcaaatgaataagcacaactttatttttgcctttatttttttagacggataaatatttaaaaatatgtctttcacagagagacaatttttcacaaattaacacaatgatgactatatgtacaacaccttggttccaaaacatcataacctattgattaattagctaattagcgcacatttccatggtcaaaccagcgcatttacaatcatgtgaatgagtttaaatatgaagacattcacaatgagaaaatgcactagtccaaacaaaggagattattanagaataaaagaggtaaataaatacataaattattcagggagcaaaagagaattttgtgctaattttgatttttgcaaagaatggctttggcatctatcatttgtgcttttatatgccatgatgtctctgcccatctctgctgttgccattttgtttctcttctctcagattaattgccattcatctgtccatttgattttacttgggttaatttgagcggctaaatgccctcctgctagtgaatggggacgggcggcattttctttgctcgcacaatggcactttgggaaaggtaacttaatcttcaaccaaaaaatgaaaaacaaaaatgaatgggtttgatttattttctctttaggccgaaagtgatcatttaaaagtgaatttttataaaaattaagcatatgtctaaataaatgaaccggataaaataattggcaattccttagaataagaatcagctaagcttataaaatctattgagaaatatttttttatattataaaattggtaatttaggcaaaatctgttaataaatctcacaaaatttttctcaattttatttacctttcttcttaatcactttttcacatttaaacgccacttttgttcatattgttctcataaatgcaaagaaagaaattttagtcaagtagacaaaatgaaaacatttaaagttaacctttttattttttcattaaaaatttctttattaaaaactaggtacctacctaaaattatctctttctaacaaattcaattaggtaatccagaaatgtttttatattccataaacaaaatgcataaatgaccttacctaattggttccgcgattgggtggtaattaattcttccatcgtatgtttgtatttgttcgtcttttacttttcttcttttggccatcccttcccttttaatttcgtccttttaaccatttcaattgaaatcccattcgtctttcatatcagctgctgaccgaagaatggagttcaaaacgctcgagaaattttctcattcagggattttgagcagtatttgtttcgggatcatttaatggacaaattgcacattttgaaatggcattcatgccgtcgtccatctgctgctgaatacctctgctgctgagtggcgctgtttcccccccccccccggcgcccaccaaataaatatttgtaatgcaattaaattttccccattaatttctgtcctttttatagcattttccccgccttcggtgaattcaattatcctttatcagtgcatatgccaattttcggactcaattacctcattcagttcactaattgaattcactttcacatttttatttacaatttcacaaaacaaagacaataattgaaatcaaattcattgacacaccaatcgaagtgctaatttaatttttaaatcggctttggccgggtgatagcatacttacttttaacagaggcacattaacacatcgcattaactcattgtccgatcaatttagaaatatgtttatttcaaatatcctgcaatcaaattcactttttacaaccaaaaaatggattaaaacatttgttatttcattagtctttcgaatccatcattataaaaattttttaagacaaattcatataaatacatttgaacaatcacattttaaatatatcacatttaaataaagctaactatttattgttttcgtttttataaattctctactttttagtgtgtgggatgtgccaaaaaggacaatggcatgcgtttggtgccaaatttatccgagcaataattttggaaggccaattttccgaacattgttttaaaatttttgtaaaagcacaaacagtgtaaatggagcagatgagcaaacaaagtctgctgctgctgctcttttgcgtggtcatcggcacaaaaaaaaggaaaatgaaaattttacccatttgaaattttagatttttacggcacaaatgaaattcaaataaaagcattttaagacactgctgcaattttactttttacttcttcccgtctagcaaataaaaactgccgaaccctttcaaacaaatctctttccattttttcaattttctaattttacaactcattaatttttcttagcgctcagaacaaacatcaattttcgcttgtgctttatccatttgactgtgaatggcaataatccatcgcccgtggcaaaatcaaaaaaaaaaaaaagatgccatccgcgcatttccccaggctttagaaagcattccaaatttatgaaaatccaaatagaaggtaaaaacataaaaattttatttgtattagagaaggtcgggaccgggtccgagctgggaattccctaaaatttccggtctcgacctaatttgtaacgatgattttcgcagttagaaataaatcaaaaaaatttttttttcatattttatatgtaaaaagcaaattgcctaatattagcataaatatagaattggcacaaagttaaaagctaaaaaaagctggccaataactcaaacactgcaacatcgagcacacacaaaaacaaatcccctaatgaatcgcaaccataattacatctcataatggcactca

SEQ ID NO: 12475 - DNA, 3718 bp, Heterodera glycines
  misc_feature (79)..(79): n is a, c, g, or t
  misc_feature (84)..(84): n is a, c, g, or t
  misc_feature (3664)..(3664): n is a, c, g, or t
  misc_feature (3684)..(3685): n is a, c, g, or t
  misc_feature (3696)..(3697): n is a, c, g, or t
ataattacatctcataatggcactcattaatatatgcgcatctgtgaatcacttcccatttcctccacctgacgacatntaatnttcagtactatttccatgtgcttatgattcaagcggattatcaggcacttagcgctcattttagagctaatttaggcattggcggaagaaaactcgctaattaataacaaatataaattattatttatttatttttcttttacgttttggatttgaaaaggaattcttatgcttttcaactttcaattaaaacaattttttttcaaattctctctctcactttttcactttttgtttttttatttgagtcttaattggtgataacaacaaatcattttaatcgttccctgttaatggtatgaataatcagtctgaacaagtgcatcatctccttatccgtcgtcccaatgcatctcttcccccttcctttccccctcccttccgttttcatcatccgccattatccgtccccccgggggcgtcttcttccgttagtgctcatcccttccaaagccgtgccaatgtttaccaaatccattagacattatttgcgcaagggcctctccatatcagcaaattcatttgcgttaaatgctccgaaaatccaaagcgaaaaaataagtcaaacaatttgaaggtttaaaattttctttaaaaaatattaaaaatgtataaaaatagttaaaagcatttatggaaatgattgatccttgattgccattttcctctatttatctgctaattagatttattaaaatttttataacaaatattttcccaccatttagagcgagtttttaaattcaaataaaaaaatgaacggcacaattattcggcaccaaattgaaaaggaggacgtggaaagtgagcgcgagttggtcgactttgtggagattgtgtacctttcgttgagcgtttgcattggcactttgctcaattcggtggccgtcgttcgcctcgtccgttactcaaagtcagtgacacggctcattaacgacaaattacacccaaatttaaaatggctaaatctgtttaaaaaaaaacattttttaccgacagaagtccctcgtcccaggccaagcaccattgcctggtccgacccctgcacatgaacccgttcgccatgttcaaattcaacttggccatcaccgactttgccattctgttcattcacgcacttggcaaggcgagtaaatattggaaatgcattttaatgccaaaaataaatgaaataaaacgatctaaccaagtccaaacctaacatttaccgagccatcgcttaaaataatgtttcttgatattctatgtactgtaatacagtaatcctccttcagatggtttggcttctctcataccggtggctgttcggcgacttcggctgtcgtctgtatcagtttctgtccgcatttgcctactattccaattcgaatgtcatcgtcgcaattggactggacaggcttaaggtaggatttatcggagtaaaattccttgctattttcaagaaattcacccattgcttttcctaaatttgccatttttctaactgttaaaaatcattgaaaaattgaattttttaaaccactaggccaatttgtacaaattgcttttcctttccaggttgtctattctgaccaaatgcaatgcgtttcctcctgcactcgccgcgtgcgcatttttctgctcatcgcgtggcttttggccgcactctgtgcactgccccagctgtttttctggaccaattttgagctgggcctcggctggtcccaatgcaccaccatttggcaggtccaaacttcgtcagcccgttcattttcattgctttttctaagcgggcatccgaccactaattcagtcgggactaatgcaacattttggtcctgacttggcttgtcccaacagtgccgtcagtccagtctctaatgttcctccgtttttccacgaacttgtgccttgagacattaattcctgagattaccaaaaggcatgagggataatgccagtctcgaactgatgccaatctcgagtggtcgtccatgtcaattcccagtctttcattttccatgtttggcattccattcttactcaatcattttttacagattgctgagtacactcagacgaccaatttaatttcgagaatgaattcacaacgacaatctcggacattcaacagcagaaggaagaccattcgtggagtgcccatgccaacactcagctcctctacgaattgttgcaccaggtagacggacggacaaatggtaaattaagtgaaaaattaaagcatcgaacagagcgttgaaatgaccatagaaacattggcattggcatttactacaattttgtagtagtcccattttttaatgttaagagattaggctaatctactcctctctcctcattttttatgttcaatttcaattggcggggcggggggggggggaaaatgcggcgaattggaaaaatgcgcagttgtcgattagcaactattcgatgtgggatcaatgcatcgattcgcatactttcctatcggcccgcacttttctgtccggtcgatggaatcaattagtgcggggcattagcagaggcaaatcgatgcatcggattaatggattggctgtgaacggaaaattgagcgtattggaaaattgggaatggacgcggcttaataaatcgaatatcgaacggaggcgacgggggggcggaggggggagagagcaacggaccaaacggtggggggggggaagaggcgagagtcccccctccggggagccctggcctaaaaagaaaattaattagcaaatttaagcgccgaaaagcagtctattaatgggaatcaattcgaatacactagcagaaaaggggttttttatagtcattttaaatggaattgggccaaaattaggcagccgaaacgaaactcccccccccgttctctttcaccttttacctgctgcatttaacaaaggcatctgtgtgcaagaaagaagcggaatgtgagataaagtgggataacggacttggtagaacccctaaaggatttgaaagggccgtgggttcgagtcccactggcggcgggcgagttaccctttatgttctacaaaccagcaaaaggttgtctgtcgcatttatggtgccggccaaattgagcccggttactatagacccctcccctttttcaggtgattgtgttcatcattcctctgatttccttgtccgcctcctatttgctgatcgttgtccgcgtccttcgctattcgcttcgtcctccgcccaactccaacctttgctccttcaacggcttaaaatgcgcggcccaatgggcggccgacgatggccaacagacggactgcgaagggacgggcgaaggcggcggacgatggcacagggccagcaaccggcggggccgaagaagtgccaaaacgaggcaagaaagagtcaaatggcaatgatgcccgagggggaggggagggaaactatgccaatcacactgattcaattaatcgttaaatttgccattagcgggacgggggttggagaaatacgccgcatttcaaagagagcggcggagttcggacttgacgggacagaatggatggaaccactgggaaagaccggaaattccggcacaaggcacaataanattaatttgaattcaatttnnggaaataattnnagaattattgcgacgattgca

SEQ ID NO: 12476 - DNA, 4308 bp, Heterodera glycines
gccaatgctgattttgaaaatttcagttggcagccctggtttttacgctaataaaccattgttttaagtctatttttcatgtttttattgcgtttccttcgcgctactattagttttagaaaaaatcttatttttggtgtcaaaatcttagtttttcatccattttgtcttattttgaaaaaatttaagctctatcagctaagcaaattcataattaaaaaaattaaaattaaatattcaaaaattatgatcttcccgtggtttctagggctggaaatttaaaacaaatgatttttttgctgaccataatgaccttaaactgacttaaaagtgttctacatttagtttgaagcttctacatgcattttttgtgactttttggctatttattcttgacttttttgaatttttcgtgattttttggcgttttttatgacttttttagtcgactttttggagatttttcatgacttaaattcccagctcaatagtttcaaactttatttcaggcgcagttaacccttaccgttgaattgtttaaaaatggattttgattctattatgtaaggctaatttttgaaaactttctttatattttttgtgccttattaacgttcttatgaatttttagtggtctttatggctaggcccgtttttgtgccttattaacgtttttatgaatttttagtggtctttatggctaaatttcatgcttttttaaaattttgtgtttttttacataatgccaaaaaatatgaaaaagttctttttttctgaaaccaaatgaaactgaaattatatatcgaatgtaccagtgttttttgggtgcttctagaaaaattaaaaagccttaaagtctcattatgttattttatggtcgggtagactgcagtagatcttacaccccttttttcttggtgttggctgttctacataaaccaacacgtgaatcagaattttttttctgcttgctgttacttatccccccttccccctttaaagcttaatacccattttaatggctgggattgattttgggaatttgacttgttacatggctgtggcgcggaacaaaggaatcggttggcaaatatacaaaaaacatttttgaaaattattaaatgttttagaaattgttgagaatgattactctttgcatgccacgccgtaagttctgtctcccattttccatttttgcatttgtccgaatgtcttttgttttcagttcgtgcgtttcctttggacaattcgctcggatgatgggtttcggggccaagcagcagctgaacgtcaattacgggaacagtgtcgtgaatttcaagcacatcctcggacgcactttcaatgacaaagtcgtgcagacatttcgtcagcacattccctgcggacttatggggaagttcaccgatgaccaaattgagataaaagtgtgccaaagcgtcacaaatcattttgtaattaggaaatgtgttttcttaggtcactcatttgggcacgacgcgagtgctttccccggaacaggtggtcgcctgtctgttgacacatttgcgggttcagctcagccgttctctcgggacggatgccactgaatgcgtcattaatgtgagatctttcttttcggtaccaaaaaggatgggcggataggaatagttttgggtgttaaaaatgctcttcaataacccaacagtttgttctccttcaggtcccgtttttctacgaggaaaaccaacgccgcgctttgctgaatgcgggtcgaattgctggcctttcacttcgtctgatcactgacccggccgcgttggcctattgttacggcatgtataacggggcaaagtgagtgagggacaggccatcaccaaaaaagttggagtgggacctggcaacttttttatcggcattaattcttttttggctttgataaacataagaaaatgaaatttaaaacttaccttgtattatataaatttgattatttttccaacttttccaattgtaaaaccctctttttaacacgcatttttcattctcctctttcagtcttcctccacctgaacagcccgctcggcttgttgcgtttgtcgatgtcggccattcgtctgttcaagccagtcttattgcattcagcgccggcaaagcggaggtcagcaggcgaatgttttaaactccttaattatttccattttaggtgctcgccgcctctttcgatttgaccgttgggggcgtccatttcgatgcgttgttgcgcgactatttcaatgaggactttggcaaacgcttcaaaatcgacgcgaggaaaaccccgcgggcgtggctccgtttgttggatgaatgcgaaaaggcattgacaatgaaaggcacaaacgaattagaactttcagatcaaaaagcaaatgtcggcaaacagtcagcccattccctttgcaatcgaatgctttgtgaaagacaccgacgtcaacggagtgatgcaaaggtgggtggtgggacagtacctgagttgttttaggatgtatgaaagtccatgggacgcgtaagcgttttccccctctgctgaattttgaaacaaaaattgtcatcaaataattacaaattagggaccaattcgaacaattggcggagaaactcttccaaaaagtgcaggcactgctccaacagctcattagtgacgcgaatgtgaaggtaaacaaaaacagtcaattaaaaataacaagtttttaggtcggcgatattttcgacgtcgaattggtcggggggtcgtcgcgaattccgcgcatcaaacaaattgtggcaggtagtaaatttggaaaatcattaaaaggatgaataaaagtcggctattttaagagtttttcaagaaggtgccaaaaacgacaatgaatcaggacgatgctttggtgagtggccttggactcaaaaaacgaacggaacttctcttaggcccgcggatgtgctcttcgttcggccatgctttacccggcttatcaggtgaagaaattcgttgtgatcgaccgctacgaaatgccaatcgacccatcggcactttcggacgaagagaagttaaaagaggagatcaaagccgaagtgagtccaatttttttttctcgtacatttggctgttcagcaagaaatgcaaacggccgacctacgcgacaaacaacgatcggatgcgaagaacgctttggaggagtattgcttcaaaacccagcacaaaatggaggatgaacagctggccaagggcaaagtgagcgacgaggagcggcacaaatgtatcgaaaagtgcaactccgttttggaatggttggacaacgaatcggagacattgcagaggaaggtgaacttcgagacaaactgaactctgtctttgatgagctcatgtctttaatttagcaaatcgaatgtcgtcacaatgagttggaggagttttgtcggccgatcctcgccaaattatacgctgtcgtcgagcacacaaacaaaaatgggcagaccgacaaaatggacagcagcggtgggacggactcaaaaatcatcaggaaaccgaaaacatttccattctttcagcttcccctcagcagccgccgcctcttgccgaagacaaaaaaagaacgacggaacagaaaaatgctgggggaggagccatttaaaagggtggacaaatgcttttgacttaaatattgttttaatttattttaaatgactcattttgagatgattgtatttgaattaaatattaaatattctactcatagattgccaaaatcacaaacggccaagagttagcgattgggacaatcaattaatcatttacactcaatatcaaaataatcaatttaatcacttggagctgtggtggcaggggaatcaacatctggttcctgtaaaaatctaaattttaatatgaaatatacctaattggtctctctctaaacattcatcgtagaaaatcaaaaaaattaaaattacaaaattaaactgaaaattagtgaaatccctcccatccgtgccgactaatgaatttttagtgtttacaaaaaccattgcgaatggaaggaaagggccgttgccattgcgttgcgttttttccaattcgagtgccccgcgcccctctcgacaatgtttgttcttggtttgaaacagtcccccccccccccccccctccccctttataaatccttttttccgtcctttcgccccatttctttgcttcgtccgttcccttcccaccgatccctttgatttttgggtgccaatggacagcgttgtgagtgtttgtcctcaaattgtgccaatgtctattttttgttaggcaattca

SEQ ID NO: 12477 - DNA, 1113 bp, Heterodera glycines
atcaaaaaaatggccaagaaaaaactgaagacattgaaatggtgggcagtgggcggactcagaaaaaggtattggaagtgagcattcccctggaaaaggtcgacattcattcatcggcatccatggaaagaataatcccaccgggggattccgaaaaaggccgagagaaggcggaagagaccgagcagtcgaaggggtagtcgtcctcacttcactcccaccaatggtcagtgatcagtgagtatttgttgggaccgatcagtcgccagatttttgcatcatttcgcatttccatttggactttttaattatgattacacccccccccccccccaaggcaaaacattgttttttcatcgcttggccaaattggcgtttttgtgtccacaacaaaagtaaaagcaaatgcttttttaaacaaattctgagaaatctgtgaaggtgttttggattgtcgttgtgtacacaatttttggcgcttatttattcatttggttggaagtgccgaaagatttggaggagaagcgaaaggtcagtgaaatgcatcgaaatgagcgataaaaaatgatcaaaaaaggcgtacgaatatcatttggtggtcagagacacacttttgtttaagtgagtcattaatattgtaaaatgggaaaaattgggagaaaaaaatgaaaaataaataaattaatttgtcccattgccaaattaatatttaactatttcatggtagaatagagcaaattcacaagggaagggtcttggagaagacgcagcattggaagagggccattttggagtttgaacggcacttggactttcagccgccccaattggacacttcgtggactctgtggatgtccattttgtattgtgcaacaatttacacaactgttggtcagaaatttgacaataaaaaaacatgccaaagaacagtcgcccgaatacggtcttagggtacggtaacatcgcgtgcgcaacaacgggcggaagggtggcgaccatcgtttacgccatttgtggcattccgctcagtgagttttaaactattaatcggtttggatgaatttaaaaaataaagaaaaccttttcaaaggaattgaaataattttaaattaa

SEQ ID NO: 12478 - DNA, 3154 bp, Heterodera glycines
  misc_feature (3141)..(3141): n is a, c, g, or t
tttaaaataaatatttaaaaggaaagagattatgtcaaaatggcaaattgcgattatgagccaatttttgttaggggctttgaaaaattctgaccccaatttgaggatttttttgcaaccttataaggaggaggccagattaacagtatgtcaatttttatgaaaattttgcgcactcccgaaaattataattcttttatttgtgcacgcgaatttacggcacgccaacaaacagacgaataaactgtgccggaatggctcaagactgaccaattggcgcagcgaggacagtgtgacgcggacacgcttcaacaactccgtgctgtagacgaagaaactgtgccggaatggctcaaggctgaccagttgacgcagcgaggacagtgtgacgcggacacgcttcaacaactccgtgctgtgcaccaattcgtccaacggcggttcatcagtttcagcatcgtcagagtcctgtgccaatcgaaattgttaaaaaatgttcaaatttcaagaaaaaatcttagaaatttcaaactaaaaatttttcaagaaaaaaatcttgtaaaatttttctaaattttttcatcgaaatttctttataaaatatacccctaagaaattaaaaattttctcaaaaattcatcctctaattttaccatcgaatacctggtcaatttagaacttttaagtcaagtccaataaagatcgacaaagacagggagggaaagacagagatagagagagagggtgtgagagacagagagacaaaaagagagagagacaaacagacaaagagagagagagcgagagtgagaaagaaggagagagagagagagagaaaaagagagacataaaaagatacagagagagagacaaagagagaggaacagatagggagagggggagatagagagtgggaggagataacagagagagattgagtgaaaagtgattagagcactatgggtcatgtcgctgacagcagcgacagatcttatcgatcgccagctgtttttgttttttcccacgctttttgctagtgatagtccaattaagttttttcctctgtgccccgccagtagtatatagtcccaaaaggttgcgggttggttgcgggtgtttcccgcacgagcccgtgcctatgggaaggcgcagccctttgaatttgccgccccataaaaaatccacgatgggggggtgtttcaaaaccaaaacctatggaccactttgaagttgccgcctgaccaaatccgatttcccaaattgttgcgggtgtttttttcccgcgccgcgcagcgccgcgggaaggtcatcaatcatccacctgtcaccaaagtgacaggtgaaggaaattcttttgccaattaattcctttttgattccaaacctttttggggtattttctcaaatcctgagattttttatatgatttttatcctgaattttgaaaatttgccaatgtgtgtttttttatttttacatttcctccacgccctccctccccgcgccacgatgcgccgcgcaaattaatcaataatggaattgtagaagtgcaaatttaattaataattgcagcaaattaatgaattttacagtaaaattaattattaaattcaatttaaatataaaattgaaaaatgaataataaattaggattgaaaaaaaaactttttcaaaagtaggtcatctgcaagaatttcgggaccgtctcaataaataaacatttttatcgtctcattaaattcttttgagccattttcaaataggggagaatatgatgatacatttcctcaatttcagaattgtttttagttcccgtaattacgactttaccggtccagaaaattaacgctgtcatgcttttaccccgcttgaaatttaaaccgcaaaatatttccggttcataaaatgcacgacgattttttcgaaactcgttcagttcaatttcacgtccgaatttaaaggtcgaaacaatattttcaaccgtgtgtccggtgtaagaagcccccggacaccccgagcccttaattatttctataaaatttttaatagcattttcacagtctatcagacttttcgtccccagacatatcattttcccggattcccataataatgccgtggctttgatgggagctgtgcattttataactgcggcattgaattttctagggttatacttaaattcgcattcggtgatcgtcagagagtttagtttaattccggtaccgagattagcgagagcaattatatttacgattatcggtttttgcattttttgatacaatgtaccaatcaaatggtcctttcacttctttatataccccttctataaatagcaaccaaaaaataaaattaaattgaaaaaatgaactgtccacataaaattaagtgttgtcattactgcccctgtcattacgagatttgtaagagatgtaaaagccacagtcttttgcatttcggtacatcattttttgataatttctggctatgccccaaatgcgcgaaacatgttctctatgaaaatataaataggtcaaataaataagaggaattaaaaatgtttcgcggtccgttcacactaattctctcgggggctaccgggagtggtaagacccgttggttattacggtttttaaaacatcataagaatttaattgaaccaccgcctaagaaaattctttattgttacggtgagatgaatgatagcattttaggattaatcggggagggtgttgagacttttaatgggattccggacatgaataagattaaagaacaggaaaaacccctcttactgatacttgacgatttaatgcttaacatgcagaatactttcctcgatttactctttaccaggggctcccataattggaacgtaagcgtaatttttgtaacccagagtctctacggtcgggacattaaaacggcaagagcgaacgcccattatctggttttaatgcgcaacccttcaggacaattacaagtgaggactctagggtcacaactgttcccaaaaagactgaattatttcatggatgcatatcatgatgcgaccaataatcaatttagctatctcatgattaacatgcacccaaattctgatgaggaattcaaaagatgtagcaaaatttttccagatgnagactctggaaat

SEQ ID NO: 12479 - DNA, 4412 bp, Heterodera glycines
ccattggccatcccgtgtacggtcgcggtcgtcattttcagaaccgttcggcttatcaccgacgagttggacgacggcacggtcactttgctggcggaacgacccgcgcgccggcactacgcgcatacattgggtcaacgaccaacaaaaccatgcagtggcagtgaacaggatctgacggttttttatttatcttggggcgggggtctcttcggaaatgattcaccataatttactggtttaacatacattttttttattcaaaaaaaaggtaaagtctctatcataaaaatttattatttagtcataaaagccatgctctttttccaaacaatttgaattcatattgtatgttagggttttttaatcgacgaccattttttcgcggtggcaaaaacttttatctttgttttttacgtttttttgtgaaatttttctaaacagatttgccatattaaattttatgatgtcaattatgctttcagaattccgaaaaattttgtgtaaaaatcttttgttttgatcgtcgtttttgcgtcaggttgagcatcatctattccgttcgtctacggtggcgcccgtccaaactgttgctgtctgttgttgaccgattcgctggtggcggtggacagtgccaacggcattcatctgttcgatgtgcgcaccggaaaccactgttgtgtgagcaattccggaaacattcaaaagcactgttattttttgtcttttttatgaaattaatctccttagagtaggggtttttttactaacagaagccgtccagtccgtatggaaaaaatctgaaaatttgattcaaatttgttgacccattttgttcaaaaacgagcacattttagggtcaaattttatttggttaaactttttgaagctggtggggaaaattctgcaaatttaacaaattttctattgcaaaaaattgacaaattccctcttttatgcatcaccactcctttctttcaaccctttacggagaacgttacatcatgtttttgagaccgtctctgtgcgtggtctggggggggggggggggagagcaggggaggataaaaaaaatttgcaaaaatttttcagcgattttttgggaaaatttttacaaaaattaaataatttcatcataaatcatccctcctgaatgacaagttggacttcaacacagcattagaattgtgacccccatttgctatagacaaatgtggtgaccaatttcatcgctggcggcgtcggtggctcatgcgccgtcatcaccggccatccgttcgacacggtcaaagtgcgactgcagacaatgccaaagccggcgcccggacagccgccactgttcaccggtgcgctcgactgtgtgcgccaaaccgtggcacgggagggattttttgtgaggttttttcaaaattaaaaaatttgattttcatgtccgcttcatgcgcaaatggacagtgattcggagtgggttttttcactatatcatatcaaacccttaaaatcaagcccttttaatctggaaacaggcgcaatttggtcaaaaagtccactcttcaaattgttgtgaggtttaaacaactgacgggctgtgaaaattcggatttggtggaaatttcacgaaaaaaaatcaggaaaaattcggagagcatagttttaatggttttagggatccaaattacgaatttgacacctcattttcagcaattcatagctcaaaacgccaattaaaggcttaatataaagaatttcctttttttttggcatttcattagtgaagtttgcacaccctttaatttgccaaaaaatttatccaaatttcaaaatcatgtccctttcctcaggcactttacaaaggcatggccgccccgctcgtcggcgtttcaccactctttgccgttttctttggcggcactgcactgggcaaatggctgctgcagaacgagccgggccagcagttggacttcaagcagaatttcacggccggtgccattgccgtcgtggtcaccactgctgtgatggtgccaggttgatcattgccatttttggatcaaattttcaaaaaattaatggtaaaaatgatgatccggcggtgcagataggcgccgctggcgctgttgaaattttcatgaagcataataaaaatatgcaaaattgacaagaatttttccgcttttttctttggcgtttttcgggttataaaataaaattttataataaaattaataccggcttaaggcccagagccctgggaaatttatggttctttatcagtacatttttggaaaaaatgccattaatttccattccaaaattaatgccaattcatcatttttaggcgagcgaatcaaatgcattctccaagtgcagtccatggacggcagtgccggcacaacgcccaaatacaccgggccggtggacgtggtgcgcaagctgtacagagagggtggcattcgcagcatttaccggggcacggccgccacactgctcaggggttggtgtggggtaaagggagtaaaattcacacccaaaattggtcaaaattcattttttggcggatttggcattgctttatggcccataaatttacggaaatttcaaaaaaaaattttttgcatatattccggccagcggcgcctacattgctgtgtacgaattgcttaaagacaaattttcgggcggaaaacggcacgagctgacgcccatggcaacgttagtccgggaaattggggagggggtgtttgtaattcaatttcaatttgcccggaggcatttttgcaaatccaaagcaaaaaatacatgaacacaccgagtcaaaaaacgagacatgtgtcaataaagagagagtgcagagaaaaaaacatctctctttttggcgtactatttctttatctgtgttaatagagaaaaactgaatttacttcatgctgtttaaaattttttctacttgttaaatctgcttcaaattttgcatagagacagagaaaaaaattctgcatcgttttctctgtttgtttatagcttaaatgttgttctaaaaagttattaaaaaaataaaatttcgaagccatatatcttttttcgaactcttctaattgtttagcatttgcttacaaaaagcttctcctcatcaagggctttcgaatgatatcaagtttttccaatttggttgggaaaaaccttcaaaaataattcccaaaattcgtcattttaaaaaaaaaacaaaaaaaaaaaactcatgttgcacaacggactcgaaccaccaccctttgtccctttactatcttacaaaaaccacttcgccacacatgcaaatctttttagaactgagaggccaaaattgaaacggtgtgtgaaaaaaggggaggaaaccaactcgtacaccgtcccgacttacactgtgtcagcctaacttttatcaaagttgacctttcacaatttttttgatgaggggcacgatgatgatgacgacatccaaatttgttgcccttttcagtctgctggcggacggttttgccggcatcgccaattggtccgtgtgcattccggccgacgtgatgaagtccagcaggttggagacggcgcccgagggcaaatacccaagaaagtttttaattttttttcttttttctggcacggcattaattttcatttaaaattttttaaaaattgatcaaattgtcataattaaagtcacgccagggtaaaaactgtaggacacgtcgtcgcaaaatgcccgccgcgagagggcccctcctccctcacattttcctggccgggctttaatcatagcgaaggacatcgcaaaagtgcaacgaggaaaagaaaaatttaaagccgatctataagggcttgcttccttggcattctgtttcaattttccacctctctcacagaagtcatccgtgatgtgtgttccgcgaaatgttgcgcgaggaggggcaccgtgcgctgttccgcggcttcgtgcccgtcatgttgtgcgtgttccacgccaacgcggcctgcttctccgggcttgagcagacgctgtgggcgtttcgccaagcgggcgtttgaaaaaaacaaacaatctctttgtgtttactgtatttttcgatattaatttcattgttttgtcgctgggtgtgtctgtctctccgcctttcgtccgtctctctctctcccattttatttgccttaccacacaacaacaataaatcaataattaaatgtaattaacttgcgaaaatgtattttgattaaacccgtttaagtttcttctggtctcgttgaatcgcttctttagccctcagcaagtgacggtcaatgtaaccatcgcgcaattcgttcaggcggcccctcgtgcgtcttccgagtggcagcgctctccactcgtcactcgttttggcaatctggtaaaattctattagttt

SEQ ID NO: 12480 - DNA, 4226 bp, Heterodera glycines
ttaatcgcatttggacacacaaaagcggcaccaaattaatggcatttcccttccgttcgaattttcctgtgcaatttatttattattttattttttgttccgtctttcacagttttgacactttctcattttctatcgcctattttgccttttccattgactgccccaattttaaaaatctcgcaaaatattcgcttattttcacttctcttgccttcaattttattaatttatttttgtgatcttcaaaaggtgattggattataatgcatgatattatttattattattattattgttattatattaattgactttgtggtaatattgtgtttactatacctaataaaaataatcacttaattatgctaaacgcgtgttgtatatgtattcatttaatgacggataaaatgaccgttattattttcatttaattaacaaatattttcaactccatcgaccatgcgaattggggggaaggacatcaaaaacagctttcgcccagataaaaaacaaataattaagaaaacaataaaatctttccccaaatttttctatactggtcatgataagttctgttgtcccgcactttcagactcaatcatacggaatatattgaatttttggagaagcaaaaattggtctcgtccagtcagggtcatattgacccatgtgaccagtgatcggcgccgatgctgcgtgccatgttccgtcgcgtgcggcgacagtgcgctcgccgttggcactcgatgatcccactctcgtggctgtgccggctcccggcgaatggcgaccacaacaaaatgccgccgctgctttacccctgtattgatggtgttattagaaaaaaaaaattgaatatctaaaaaactgaggtttagggttaatagtatggatttacatatcgattttacgccgcaaaagggccgattaaatatatgctaattcggactccaactaattaatttgctaattccctccggcaaaatttgaaaaaaatttaacagctgacataagcagcagaagttgcaccaccaccactaccatttttggcctctttgtggtgtccgcactgctcgcgttgccctcctttgtgctggcgttgttcctcaccggactcgccgaccatttcttcgagacgccctttgcacagttccgttggtcggaagcggacgtgcgggcacaggtagcaaaggaagagtgtacggtagcgagtgtaatatacggtagaaaggcaaggaacggtaggggtaaatggactcaaaaagtgccaaatttaccggaataaatgggctacaaattttttttatggcatttgcaccaattttttctttgttgttttgggtcgtccgtgaactcttgggctcgtcccattcgtccgtcgcaaatttgttggccactgatctgcaaccgctggtgccgatcaatccctggccaacactattcccccgtccgttaattgagccaaactgtcggcacaacattctcagccggcacaactctgtgctgatcattgtcaaaagtgcgcccgatcggcggaaggtgagacaattaatgctaattaattatatcattagtggaaatgcgggctcaccaaggctgatttgtgtcataaaggacaatgcttatccattttacttactttcaagcatcgtgacgcggtccgagctacgtacggtgcgctgaaacggtaccctccggcgtcggaggcgccgccagcagtgcccgctcctgcggttggcaccggcggtgacacttttttccgcttgcgtaccatttttgtgctcggccgtccggcggcggacgacgcagcgcaaatgaacgcgttggaaagcgaggcggccgcgcatggtgacttattggtcggcgactttatggacacctatttcaacaacacgttgaaggtggttttagactggcgcgaaagaccggcgaatgcgacgccaatttaggcgctaaattcaaattgtctctctttctcatcccacctctctattcggcccactatctctttttactaatccaatctcaaaagcacttttaaatattttttctaaatttataaaaaattcctccctaaaaagtttgtccattctgtgcgctttgctcgtcactattgtgcgctgcccaattcggtgccttttgtgcttttgttggacgacgactttctgttgttcccgtggaatttaatcaccgaattgcaaaagtgccacaaaaataaataaacaattattttggcatttttatttttttaaattgtttttggcatgtcccaaatgaacgcctttacatgggctggcgctttgacacttcgccattccgttcacgactgttcaaatggagggtcggagtcaataatcaactaacttattaaaataatttgaatacagtataccaaaaaattgaaccctaaaaaacgtttgaaatttcaatttaattacaaagataaaataaagcaggctcgtcaccagtagaagccggaatcttgaaaaatacagaaaaaggatttgaaaaagctggattgaaaagcagcggaaaaaagtcctaaatttctgagaaaaactgaaatttaaataaattcgggctctaattaattaattaatcttcaattaaggtgtcgctggacgagtttccattcgccgcctttcccccgtacatcgccgctggcgcagtgctcttaacgggccaaacaattgccgaattttacgcagccattccgcacgtgcgactgtttcgcctcgacgacatttttgcgggtgggaaatttttcgtcaatagtttttgaaaacaattttttaaaattttacccattttattccgtttttatttttttgatttattatttcgacatcccatacaattgttctattgctgatttccctttccttttaggcattctctcccatttgttggccattacgcctcaacacaatgccaattttgccttctatcgccaatcatttgccgacgattcattggcattggcatcttcagaaacactcaccacattgatcgctgtgcatgactatttgcccgaagaaatgcgcgagacgtacggaaaggcagtgaaacagcaaaatcagcagaaattgaagctgctctgaccatttatttaggtgttagggcaactcgtacaatttttaatggatttggccataacttttttaggtaaacaaaattattcaaacttgatatcattcgaatgctctccaagtttagaagcgatcattaagtagaagctgagagatttcctttgtacgagtttccattgacccatttattatgattattacatacaataataaatgattagcacgaatttgccaattcgcctccaagtcgttgggagtgccgcttaagtcaaagcaattttgacctaaaccattgtcaatatggcttcataacacttaaaatcgcatcagtaagaaatttagagaaataaataaaatgctggaacattgattgatgagattaaaattttctttgaaccaactttgagttgttctcacaaatatttgaagaaaaaataatggaaaaagattaaaagtaaaatgccgttctgtgcgtacaaatagcgcagtcggttaagcgattgtcccagtgctaagacaaaaggagttcgaacccatcaaaccgcacgctaatataataattattatattttttgccgaattttatgccgcgattcaaggaacggtaggggtaaatggactcaaaaagtgccaaatttaccggactaattagacaaaaaaattttattgcttttgcactaatttttttattgtttttgtaatttttcattttcatcaatttaaaaaaaatgaaaaaaatattttacaaactcagaaaatgccaaaattggcggggtaatgggcttaaatttctatgacatttgagcaattgactgaccgattggttacactttgacatttttaaaaaatttgtttggcagccgttgttgtggcttccaatgctttttggtgactattttttaattcgatattaggtttgcgtcgtcgtccatttgtccgttttatctattttttggatggacaatctcgcggagtaattaaaattcgggtcttttcccgagtgggtatgtccgagatttcttatacttaattaataacattgggacactcaaaagcgggaccaaaattaatggcatttcccttccgttcgaattttcctgtgcaatttatttattattttattttttcttccgt

SEQ ID NO: 12481 - DNA, 3390 bp, Heterodera glycines
  misc_feature (52)..(53): n is a, c, g, or t
  misc_feature (64)..(64): n is a, c, g, or t
  misc_feature (73)..(73): n is a, c, g, or t
  misc_feature (81)..(81): n is a, c, g, or t
  misc_feature (174)..(174): n is a, c, g, or t
ttttataaatttattattttaatgattctgaaaaaatataataaagtccacnntaataaggatntgctgtgcnaagaatancctcgaagtaaaatatttattcatttttgtaaattgtaaatattataattaaaaaatgttcaataactgatgaatataataattatatgaatntagagaatcgaataattaaatttaattattttatcgatcactgagttttttgttcgactcagcacggttcaaagtacgtaaatggcatccaaatacatatgtcaacactgtcgaaaattcaaataaagtgccaatgaacaaatttaagggacaaaaaatgcccccgtcccaaaaattggcatttcgccttttcattttacaaatttttcggcgactttttgtcatccaaaattagagaagcgcttcaattcattagtatgaaatattgtcatacgctgcaaaaacagcaaataaacgaagcttttggcgacaattcatcaacacggcacggcactcggagatattgaaaaggataaacggcaatgtttaaaacagcaaatagatgaagcaaagttaaaggggaggcgcgaacgccgtcccccgcactcaaaaatttagctgtgggcctatcccagttcgggaccgccctgcgggtcagccccgaccgaaagtgcaatggtggagcctcgccacaggagccctgccttggtgatcgcaggaactccccagccaggtaagtttaaagagcggcagcaagtccaaggaaaggaacgatgcaaggatgagggggagatggggtggaaaaagggcgagagatggacagaaaaagggatgaatgggtactctctcccaatgactactcgtctcttttcccaatgatacgtgtgctatttccttcccatgctcgtctgtcacttggctaaaatattatgcactcttttgcaggctgtctttttcttttccttagaaagaacaacagcagcagttagagatgatgatgcacaggatggcaaaaagagggaagagaccatgagagaaagaaagcaaagaaatgagagatgcaaagagagagtattggacaaagaaaaagagtaacgaaaagagcgcagcagaggaccgttgtgcctttcctcttttagatttctattttttaatttaattgaatcaaaactttaaaattcaattttttctttttgctccacaaaagcttatcggatatttaaaattctataaattgtactgcagaccaataccgacctatcagaagccccgggttaatcttttcgttacagaaaaaagaattttgagtaattttgagcccagattctccagtatctatataaaaaaattctcttatataacaatttcaatttttaatcacgattaaccaacaaaaatgaacaaaataaatacacaaaaaatcgcaaaattcataaaaaaattccggaagagttccgtccgggctgttgttgtggctgcggcaccctttttggcctccatttgcttcagctgtcccatcagtgccgtgttcagtgccatcgccgcctccgtcgccactgcgaccatttcgcccacagagtcaatctccagcgagccgcccctggcctttttgagcagtgagaccatgccaatttgtgccgacgctttgtcattgtcatccgaggtggcattctgacgaaagagggaaaatgaaattactagtgaaatatatgaacgagcggggaagcctttgagggaaaaactatggggcgggccggctttgaaccggcatctctggctttccggaccagtgttctgccagctgaactaccgaccctgccctctccagctccccactttgctcgatcatataggatcaattgttgcctcaattgatccattaatcttcctctcggggaagcttcttcttctctatctcactagcatttaaaaagatagtttaaccaaagaagaaagatatttttagaattcgagccactttacaaaaaaaaaattagaaatcaatcataaaacttgaaaacattgctatcaaaatttcgatgattttaatgaataaataaaaggaaaagtgaccaaaatgattttaaaattgtttacaaatttttaaacatttttatttgtcatgtgtaatgaaaaataaccatcaatcctcgatcagtcaacgatatcgacgtcggcatcttgatcactttcttcattcgttttgtcttcctccgcttgctcccgttgttcctcctcccgcttaattagttggattaaaattttaaatccccttccatcaactcaccagcttcaattcgtcgagtctgccggtgtccagcagccaattcaagacgaaatgatgctccagctgttgtcgcatttgttcagagtccggcatcgtcttccaaagttgctcaagtcgcccccacacggaatgcagtgcctcatctcctgaaaaatcacaagttttaaaattgaacccccaaaaatgatatggtcccaccctgctcatccaaaaggcccaaaaatccgtgttggtgcgcaaacggaacaaagtggtgaagcagcaaatgggcttttgtcttttttgaaagaagcgttcgcaccattggttgttcgtcgagaaatgccttgaactggtaaactgccgtctccagtccatccaaatcacctggagacaatggctgggccttaaattaaaaaaattatttccacaaaaaaataaaaccaattactttggtgaaaatttggattttccccaaatgtaccattgtttggcaaattgttttcgcccattccgtttcgaaaagggcctccatttgatcggcatggacgaggattttgcggatgctgttccccgtcaagtcgcgctttctgaacgcttccctccttgtccctattcgtctgaagaattgctgagctatttcggcattttctcccgcttccaactccttgatcagagcatttccgaggccttggaagacgtggaatggggccaacagcatctgctcaaaattgatggacggcagaagaggtgcacaaacaatgcccatcgtcagagcccgagcctctgccgttgctttgtcgccgccttgggtcagctgttcgaattgaccggcctgtctctccagttcttgcacagagcgaagttggcattttgctgaactgatcagacgttctctgcggcagtcacacactggggatgggaatgctgtcattgccgaaccgcaatggccaatgatcgcccacagaaaacacaggtcaccgccaagaaacctggaaatttttcacaaaataaaaaaaacaaattttttttcaccatttcactttgcgcccgtcaattgcatcgatttgtccaatttgtttccacaacgatccgcagaaattcttcaaattttttcgagaatcttttgc

SEQ ID NO: 12482 - DNA, 1299 bp, Heterodera glycines
cgcgatccgcgatcgcggcaaattgaatccgcgatgcgcgatccgcgaccgcgggatttttctgtccgcgctccagccctgatgcatgcctaatttgaggctttttgcattcatcacatctctaacgataaaattttgagaaacaaaaacgattacctaatatgaaatttcaggaaaaatattacctacctatcttattttttgtttgtttgcttttttgaactaatgcgccgttcgattgaggacaaagagaacgacatgccaatgactgcgagcagtgccagcaacagaagcgcggccggattttcgcatggtgccattgttcgcattcagctcaccaattttctgtgtaaaattttaaattaaattaaatttatttttgcaaaattatttaatatatattgtttattgacaattattaagtccagtaaatttaaataaacaaataaattttattttgacgtatgattaaatggattatcatatgcagataaaaactgaactgatcagcgattgtttttaatacataattaaaaatgttatttatttattttccatgtttttcattagttatttagtcagtttaatttaaactttgaataaatgtttgggttttaagttctttaaattaaagttatttattttaattaattttaaataaggaattgcttaattctattttaattctttttaaaattaaaatcatttattttaattaattttaaattaggtaatttattaattctattttatttttttatttaattcattttaattttgaatgtttactttccgtagagataaaagtcctgcgcccacgcggccataaccaccagaaaaaacacagcagtaaagaagttgaacagcaccacatgttggccatcattcaagtcaaaatattgcctaaaattcgaaattggcgcagaaattacccatttttggctgtttggacgtcaaaatcattacaactcgtgtaactcttacattgtttttagattttttgaaaaaatttttgcataaaatttcgtttggaaaataaaaaattcgtgttgctattgagccaaagacctaggggataaaatagagttcactaatcatgaatttgatctcagattttcacttttttatgctttcatctattatataatttttgcatcaattttttagttctgccgaatttaggtttagcgttagaatttcatcaaaataaacttttaattcggaatatacgcacctaaaaaacacttgttcataacgaaaaattttttgcattttctgaaattgacaattcagcagacg

SEQ ID NO: 12483 - DNA, 1077 bp, Heterodera glycines
cttcagatccgccatcagtacatccgtttcgatccttctttccgtcagctgccgcagaacaaaatgcgaatcgaaccttccggcgtaatgtgcaaaagcgaccgtctcaaattgtttggaggccataatccagtcgataaatcctccaatggggtcctccatatttgctgccgaccaagtcagcatcctcggttcctcacaaatttgacattttccttcccctccgacgcatttgctgcacgtcaatgctgcgctgacgagatttggccggtgctctcctccctccaaggtcgtctcaaggtcataagccacaattctgtacgctttctgttgtcgaactttcaattttctgatgtaacatccccgctttgggtggtaaactttgcaacgccaacagaatttctccccacatgtgtgtttgttccttgtgttgtgtgtctctccacatttttcgcactttttgaactctttgcatgccatccttttgtgtccttcgaagcatgactcgttgtagaattttcggttacataccgcgcaataaatttccgcacattcatccacacaagggaacccaaaccccatcctacaacatttcttgcagcgttccttacattcgattcgatgtctttcctggcgattgtaggtcacttcgcagctgacgcaaaagtatcgaatacagaagaattgggtcacagatttaatcccatcccagtggtctccctctcttataacacacacttcgtttttgcagatttgttcccctttgtaaattattttaagacccgatttctaaaaaagaacaatataaataattttgtgggatttaataccgtttcaaaagcaacaatgcgaaacatttccgggaattccttgtcccaaaatttctggatgatatcaaggtgttgtagcccgaaagttttttcctccctgtttatccctgccttttccatcaattcgaatgccatttctcgttgcttcttcacagttttcactagatagcggaatttgtcttccgttatcccctttccaatcaaccggtaattgcgagagaattcaagggcgtaaaaaaggcctaaa

SEQ ID NO: 12484 - DNA, 3226 bp, Heterodera glycines
  misc_feature (22)..(22): n is a, c, g, or t
  misc_feature (36)..(36): n is a, c, g, or t
  misc_feature (81)..(81): n is a, c, g, or t
aaaacgaagcgcatagagtccngaaagatgaaaatntgattgacaggtgagagggataacggtacgctagagtcaaattgnaatttggtcggcgacgaaatggaaaaggaagccgtcacattatttcactgctgcgtatttttttggctggcaccaatttttttggttggcacaaatttttttgactgggactgagtttatgatatgcttatatttttaaatttaattcgaagaaataattaatcatctcacgaaatccatatacaatatttattctaaaccgtatatttatttcttagcaaatatcttttcctttacgctagacatacgcccaatgactgtcaatcccgctgggtttacactaaatgattgtcctttccaataggctcacacccaacgacttcccttcccattgggcatacgcccaatggctgtcctttccaacgggcttacgcccaacgacttcagaattgacttactttgctttaacgatttattgaaataaatgtatcatttacaaaataattagaaatgtttcttcgctttgtagtaccgttaaaaaataagatgttgattgttataaagatcattttgcagaatttaaaaaaaatttcatttccattcggtatattttttcgaattatttttctaataataatttctcgttgtctccttttggcaaacaaaatttttcgcgcctttttgaggttgttctttcgggcaaggttcgcatttgttggtctggacatttctaaaacaaaaaaaaaggcaactcaaattgtaaaaaaaattaatttgggagcgttggtgacctcctttttatgggggcgagaacgattgcgtcggcttttcgatcagacacttgtcttgactaattcttgatcgtaaaatatacctttaatctgatcaccctccatgtctacaatgcgataagatggcggatttgatgatagtacgtttgaaattgcaaaaagttcttccgtgaaatttggataatacccttttccaaactttcctttgtcttttgtgatccgtacaatattcccgattttaaatttaggttttattattttctcttttttattgccatatatgttgttcaaaatttcactagcatttgtaaaattaacaaatgatggcttgacccctagtgtcctattcacactattgtttatatttgttattattttgtctattacatcgacccatcggagagtgttcttttgtgtaaaatatttataaagtcgttcttttattgtacgattcgccctctctactacccctgcatgtaaatctggactatacattacatgcttaagtatttgtttttcttcaaaatattttttcatttttcccgcttgaaactctaagccgctgtcgctatatatttttacgttatgctttttcaactggtcaaatatgcacaaatcacattgccaatctgtatgaagcccgctgggtatcgtcttgagtcttggaaatattttcttgattggtttatgaattgtataggttctttgtttttcaagaaacgtattaacgtcctctaatgttatattttggtctacttttcttgcttcttctaaaaccttcaaaattcccgcatagctagctagggattttagattgaaataaacttttgataatatttgatccattattttggttgtaagaaattgtttattggtatttataatcaactttcagactcttcacctttcatatgttttcttcccaaaccatcattgttcgaccatatgatgtcacaaaattttcacggtttcctcatttttcttattttttcacttttttaactttattatgacatttttttcacctgtttaacacatgttatgacattttttcacctgttctgatgccttttttcacctgctatgacaatgtttttcacacaattttgacttatttttgaacttcttatggctcttttcccgggtatgacctttttttcttatgatttttccctattttgccgattccccttgccactaaattttacctgttattatttttgatcatatgtggtcataattttttcactcatttcaatcattttacaattagtttattagtaaaaaacaattatgattccctccttttcaatcaatttaaacatcacaaatatacggctagaagggaaaaatgaagggaaatggttagtgccacggggtctaaagaggaaggaaaggggttatcgcagataaatttacaccgagatttgcggccatatactactcacgtctctcagctgccgcggtcgttgcattggttgaattgcctgaaaaagcatccggaaatatgagaaacgcacgaaaaacaagacccaacattaccggaacgttttctggtggatgatacggcacgtttggcggcggatcggcaaattgtggtacggcgtattcacgttgaatttgccgaacatgaattccttgaagaaacacccagagactgagaaaaagcaaccacaatttgatccaaattgatgtcacatttcgcggtggatggtgaatttgcggcatgtctctcagcggcaacggttgaggcatcggttggacacgaattacctgaaaaaatacattcggaatcaaattaccggaaaatttagtggccaattactgagcggaatttgggggagggggcagcaactaacgccgttttcaactgcatagaagaaaggatgaaaagtggtagcgtaggggaattgaaattgaatatgaaaaatctgaaataacggatgcggaagggggaggagaggggatgaggggtgtggggatttggggcgcccaatttggtgcggaatttttcagggacattcgaactgctcacgggtgccacgcatgcccattcgccaagccctcgtgttccaactgagcacgggtgtcgcttttctttgttttttcgtgcatatttttttactctttttctctaattctctcctctctcctatgtgaatgcgcatctctctgcccaggggggtcggaattaataaattttagctttatcgtattttttgttccaaaataatttttaataccatatttagacagttttgaaagttattctttacaatagagaatacgaagaaattttgaaaacttacaccctcaatttggaaaatttatgtccatattttggccattttttgtccatatttcgcgatttttggtccatattttgcgattttatatttcattacatggaccgt

SEQ ID NO: 12485 - DNA, 2134 bp, Heterodera glycines
tgttgaagcagtcgccgcttcgtcttctgctgttgtcgctgctgctccttcagttgctcatcagcgtcgcggcgagcgcgacgctcgcgtcgccattggtcatgatgcaacgcctgctgttgcagttgtacctgtacaaaaaaaaatccgcttaaaatttttaatgatttttgccccattttacctcagcatccatatttatgtattttgcgtcgcccatttgattggcgcccaattttttaagtgcccatttgattggcacccaattttaagtgcccatttgattggcttttaagtgcccatttgattggcacccaattttttaagtgcccatttgattggcacccaattttttaagtgcccatttgattggcacccaattttttaagtgcccatttgattggcacccaattttttaagtgcccatttgattggcacccaattttaagtgcccatttgattggcttttaagtgcccatttgattggcatcatgaaaaagctgatcaattctaaacagagtttcaaattgtgctcttatttctctgaatttttctcattataacaaatctcttttaaaaggtttaaatattttgaccgagtttttatgtcgaagttttgatttcttatgcgattattttgagaacaaaaaacctggcaactctatttagtgatcgattttttattataatttcaatatcattttatcacaatttaacgctgtttttcagcattggataaagttttttgtatcaagaaaaactcggatggaattatgcttaaattgaccgaaaaaagtcaattaatattatttgtgaaaatttttgagtagacaatttttctgatcaatttaggaatgtgatgaaaagtcctgaattttccggggtaaaaaatcgtcttttgcgaaatttttctaattcaatttttaaaatatattttcgcatttccaacaataaattttcgacaaaggcaccaatttacattagtttattattttttcacataactttgatgcttttggtctgtgttttgcacattttttgcgccaaaacatcgccatttagccgtccctaatggcgctcataagctgaataatttgcaaaattgcgtaaaattacttctataccaaaaaaagtgcgaaaattacttctataccaattgggcgtttttcagcctattaggaaatttcaaaaaaatttttttgccttctgtgggattcgagacttctcgagtggagactctagaactctcgagcataactcgtcgccattagagttttgacgggcccggtggggcgccggcaggcttttttaccgggcgccaggtcccgttttttgcaccaaaacccggtcccggtcattttgaccgggataaaatgggcttacattttgcattactgatcagaccactaaacaaaatttgctgattggaacagaaaaatttatgagggaggtctaagtacaaattctatcatgcttattgttagcattctttattgatgaaatactaattttcggttgttctttttaatttaactgttaacttctaaaatatgctctaagtgatccgtgattgtaaaaaaaatttttgaatgttgtgaggacggcgccggcggcggttcaatgggcggtggatgaaaatttatatgcgaatgtcgacattgtgctttttggcgataataatggcattgggtgggtaaaacaaacatttgaatattatttttgaatcattaatgatggattggaattcatttgatttgatgctctgttatctatttgaaataaattacttacacttgccgatttttatttaaattttatagatttttacttgaatttttccttaaatttcaaagtttttttgctataatggttaaacagtaattttctgttgctctatatttcgatatggtttaatttggcttacttttatataattttaagcgaatttaattgaattttcaatggcatcgcccgtcggaaaaaagaaaaaaattttcctccgcgcagataattgcttaattacatctgccacaattggtgaaaatcagcagaaatcgttgggttcatcatttgagacagcatttggaaaacatcaaatgaaaatggaaaagcgaaatttgcggaaaatgtgaga

SEQ ID NO: 12486 - DNA, 1472 bp, Heterodera glycines
gaattttatcatcctgatcacatgacagcgtcaaagagagattcctttatgagttggtgagagatcgagaaccgttctgcacacttccaattgcgtgaacaactcatcatgtactgtatgaatgatgtggcaattctgctcgaaagtgtgcgttcaatttcaccaaatcattgctgaaaatacgagaggagctggacccgtttaaaatatcatccacggcagctggtcttgcgttggccaccctccgccgctgctttgttgcaatgaacaagcttgttaatgcgccagaaggtggctacataagggggcggcgagcatctgctgaatcggcacgatacattcgttattatgaaatgacacattcgggagtacatgttcggtctacccaatggtcaattggtgaggctaacgtcgaagacactgaaaaaaaatccccccccccccccgacgaaatttctttgtcgggctctcggggagggagtgggtttctttttgctcttaactcaaaattcttaacagattttcacctaaatctgcgtatttttgggaaaatttagcgtaaattaaaaaaaaaatttgagtggggaaggtcttggacggcggggtacccaccaattaggaaaatcgaaaatttaaacaaatttgcaccctttcagctggctttgcaacgacattttgatggacattctcccattttttcgccatcctcaactctggctcaaattggcactgatttcgtcacgtttcggtgctttggtggacgcgcatttcaatggcaaaacgacgcaatttaaatttatgagtcgtattacaatttgcaaggaggacaaaggaccaaaagcaaaacttattgtacatggtttcaccaaatatttggaatttccgttgcctttgccatttggaaaaaacattttgtttatgcaaattttttacgcttttatttgtctgattttgtgctctatttataaatcaaaaataattaatttcaatggataatattttaaaagatgcaaacaaaatgactcatccacagattttatcggtatttaaaaatgttcaatacccaaattaatatgaatttcttggctttctgcatattttataaagttttcgtaattttttcagcctttttttacaattttttttaaattgttaattaaatttttaaggtgaaataatatattttttaatataattatttaatgggaccacctgttgaaaaaaagaaaaaaatttcttcttccgccgacgaccagcagcagcaaaagtgccaaatgcgaagtgttcggttggccatggcaataaataataataataattactagaaagcgaaccggaccgtatccgttaccggatttttctggatcgggaatccggtccggcgacattttgggaaaatagggattgaccggattacctaaattgaccggattttgagagaccgggtccggaatccggtcatttttgaaaat

SEQ ID NO: 12487 - DNA, 1715 bp, Heterodera glycines
cttccgttttgtaacttttcctattttttctgtttcctttcgtttatctctttttattcaatgatcagatcctgcctgttctctatcattaaaataattttctttaaatttattgaagacagttgtcagaggctttttcaggagatatagtatttatcgcaggatcttacttttttatattcatttgtagtttttaataataataatagcacattaattctttatctaatttttttttcacgtcttcctaattaaacccaaaataactgcaaaattcattatctaatactgtatatgtatctaaaattccttctcatttttttattgtttcgttcttccggttccgattcatctcaattcttcctttcactatcattcgaccataattgaaaaagaattttatttcactttttacaacaaatgaataaaagacacaattcacacgtcatgcgaaaaggagaatcatcaaattggaaaaatcgtggttcattggtagaatttatccttttcaacacaatggggaatcggaaatgtcgtcgattgcactccaaatcggatgagtgtctgtaaatgacaatatatgaaaaaggcaaaaactatgtacccataaaattttgtattttcgttttggaggtcgaattcgaggaaatttttaaaaattttcatttcaagggggattcttggaattttctgagtcccaaaattctgtattttaaattttttgcttttaaatcgctgtttttatggcaatgttttttcaaaaaacttttttgaaacattgggagagggcgggtccccgcggtgccgataggcgccgccggaaaaaattttgagtgagatttgctaacagaatttgtcaaaaaatgtttacatttacagcaataatcaatttattttaaaatttaaaacacacctcttttgccgtcggctgcagccaatagtctttggatggtcggcgactcagcagcgaataaaaaatggctgcagcgatggccagagccagcttgaacagcgacgtcgaatccgcatcgcctccaatcggtgttcttcgtttggctttgccgttgtcgtcgtcgtcggtgccggtgtagttgatgttgaggatgccgtcgatgttgtggacgtgcatcctttacaccgcactgtgccgaacggtgtcgggtccagcacatcaagcgggctcttgctggtttctttttcagcagaagcagtgaccagcagcgcgatggcgagcgcaaccccgatgatcagcagcagcacaacgatgatcagcacaagcgtgctctttttaaacataaatggcttcattctggaaatcgaaaacagttaggaaagttgtgaggaggcgaagataggcgccgccagggaaaatttgagttttggcaaatactctgtcttaaaatgaaaattttttatggaaacggataggtgaatttgtaatttttgttagcatgcataagaagggggtctgtgtgaaaaatttgttatggaaaattagaataagaaaaaattcttgaaaaacttaacttaaatattcttttaaagtttaaattttatgttcttcatattgacagttaattattttttgctcttcatacattattcaatatgtattttcatcaatatagtattttggcgtctcattatttatttcaaattttcggaaataacacaaaatcgcaccaaaataatgccagaacggtctacctcagttg

SEQ ID NO: 12488 - DNA, 2587 bp, Heterodera glycines
  misc_feature (48)..(48): n is a, c, g, or t
  misc_feature (57)..(57): n is a, c, g, or t
  misc_feature (100)..(100): n is a, c, g, or t
  misc_feature (118)..(118): n is a, c, g, or t
  misc_feature (151)..(151): n is a, c, g, or t
  misc_feature (188)..(188): n is a, c, g, or t
ttgcagatctcaaaaaaatataaatctgcttaaatatgagaatataantacatatantcagagaagagcgattttacatttcaaattaaatatttctgcntcaaagttaacattgaanttcggtgttgtgtatttacccttcacggcacanctacattggcagggttgaatggcgggccgagtatttntaaaaaaagttttcattgtttacacgagggcttactggaaaatgtcattgtaagataaagttcttcttctttcaagttcttccgcaaacgtaatcaaaataaattaaataatttaaaattttatcgtgtttatatgaactactgtaccccttccaatcaataattctctcaaaatactgcaccaaaatgagttaagataaaattaatgttaattagcaattttaccattcttaatcactgacgcatttcctctgtgtcaaaattctcccgaaatgtccttcgtgcctttgcaattagttgggatatcaccaattgtacattgggtgttgttctgtagagaacagtgacaaaaatgctgctaaggcatgggaattaacatcaattgatgttactaaattatattacttactattttaaaattttcttattgaactacccatgcttgagccatgttgttcatttcgtctcggtcggttttaaggtcctcaggaggagtgccttgaccgaaaaacattatctcggcctcctcaccagctgttttaaaaaataaattacttccatcactattttacttataaaaaaagaatcttctcactatggatgtcaaaaatatgtacaaaaaggttcaaaatatatacatatatgtacaaaaaaccaaaatatttttactaaataagtaaaatattttttaaattgttattttcttttgttaatatgcttataatcaatcattttttagtattttaaaaattatttgtgcaaaaaaatgaaaatatgtcagaaaaaagtccataatatacaccaaatatgcaaaaaatcacgaaatatataaaagtcccggtttttgttcacaagccaaaataagaaagtgtttttcctactatttagagcatggagaagccagaaaaaatatgtatttatataaatttagattccaacttctcaccaattgacgcgatgtgacgcgaactttagatcaccaaatgaacagaataaaagaaaatgatgttcaataccaattatttttattcaaaatttttcttaatgagggtgggctttatatttttacattaaattgttttacaatttaattaatataaatttttattttcacctcctatgatcagttttaacaatttgaggaaaattagcaaatcgttaagtgcatcggagccaaaaatcagacttttatgatttttttgatgtgattttttcaaaaactttatggaacaatgtggaggccggcggtgccgataggcgccgccgggaaaaattttggatgcgaattgttaacagattttgtccaaaaaaaccaaaattttttaaaatttaaagtgacttacgcaggcacaatgggagtgaaaatggtcaatgccaattgggaatcgtttgaaattacgcaaaaagcgcggccaaagagagtcgtcggattcgaacccattacaatacggagaatgaagctaatgattttttgctggttgtaactcatccacagtcaactcatccacatttctctcggataaacattagttaaatgggttcaaattggcgatgaaaaataaaataaattgataaaatccggtatatcttgagtctctaatgaatttgctgagttttataaatagtcaatgctttagcaatatacgcaacaaaaaaaaatttatttttctaaaacgttctaatctgggacaggtttcgaaattgagccaaagcgacccggatgacccttaaaataatttactcaaaatttaaaaaaaaaatttcgggaccaatgttctttagcttttccaccgtttgcgacatttcgtgccgtcatttctcaacgactgtccatcgcttcggcttatcaatgtctatgactatggtttcttcaccgaatttccatgcgatgacagtgccgccgcatcggatggacaagcgttggccaaatggcttttcactccgcttaaaaaaatgtgccaaaggtgttcaaatgctggttgcattgggatggcgggcatttcgcttcaaggattgaagacttcaaagcggtgcttattgtttgactgatttggcacttttacgggctttgggattttctgacaaaaatattttggaaggcattcaaattgtgaagttttaatgttttttttgatcatttcaattcgggaatgcttttcacattttttccttcattttaggcatttaccaatgcttcatctcctgtcaatttcatcgccatcattcgctttccgacgccttttgctgactccgtcatgccctttgatctaaccaacgaattcactcatgaacaattgaccttgaaaagaatgatggtcgatataggccgttttcttctgattcgttgtccaattgagcgaaatgaaagcagatggacaaaatgggaagaagaagcgatt

SEQ ID NO: 12489 - DNA, 1991 bp, Heterodera glycines
aaatttaaaataataatgtaaatttttagtttaaaacatttagtttatttattttttattgtcagcttttcctcctctttttcttctggtggcatttctccccaaataattcccaaatcgccgctttatcatctttgctcagtttgaactcttccgtttgttcatccaaaagtgccaaattttgtctgtataaatggtaatgttagctaatccctaatgagactctctctctccctctctctctctctctctttgtctctggtctctctctctttttctcttttctctctctctatctttctcactctatctcttgcccccccccttttctgcttacctgtaataactgttcatcaccgagtgccggtaggtcgaatgccgaaggccaagtgcatggccaatctcgtgcagtgccacataccgcaggtccaatgccatcggtgccatttgtcccctcggctgatgcttttgtcgtcctccaccaatgccattgctcctcccccgttctcctgtttttccgatcacaaatgatgattcatccgcttgttccttttgcctttggcccatttacctgtctccgccccttggccaatttgccatcgttcgctggcgtcgaaatggacaatgcccagcggtgggtaggccgaatgggccaccagtccgccagtgccatcgaaactttcgctgtcgccgtgcccaaattcggcaaagaaaatatcaatgtcggcaactcggcgcgagtttagcggcaaatcgcgcgaagccggcgacgcatcgatcagacggagggacggcgactgcgcggagaaagcggcggcaacttcccattttctgatcgcttctccgatcactattcttgatgagttagaaattacacagcagcagaaacaagaaaaatacacaaatgcattggctttttatgaccggaatttcctcctctttaacactaatgagtcaaaacccttttttagcgggggcccaaggggttgtgccacatttgcgccccaatgaaaaagaaaaaaaaattttctgctttggccattgtttaaatgcctcacttaaatgataggaaattaattctgtttccagactcaaccacgtgaaggtagcagacattgagtccacacaaatacatcacaaattctaatgaaaaatctatttatataaaataatttaaatactcaaaaatatttgctataatacatttagttggacaaacacaatactttattttttgtgttttcattttatttttttatattttctttgtttttgtattattttcttgttttttattatttcttgtttttttaaaagatgctcaatcgagccaatgatcaattccttttgtggtaagtcgaaatgacagaaccccccccccccccctatcaacgtaaattaataattacttgacaatttttaaaattcaaatttaagtttcatattaaaaattaaagatgaagaggaataccaaagaaataaaatgagaccacatgaaattgaccagacacgtccagtagctgaagtaccccgcaccaaaaaatatttggaaaatgatcgagccatcaaaaatctgattgaacaatttgatcagtttggtcctgatcagcgtgatgatcaaagatggattacacatttacacgcactgtcatttcgacttaccacaaaaggaattgatcattggctcgattgagcatctttttaaaaaaacaagaaataataaaaaacaagaaaataaaaaaaacaagaaaataatacaaaaacaaagaaaatataaaaaataaatgtattgtggtttgtccaactaaatatattatagcaaatatttttgagtatttaaattattttatataaatatggaggcgcaaatgtggaggcgcaaatgtggaggcgcaaatgtggcacaacccaatcatttacatttacatatttttaaacccacaaatttaaaaaatttatatccataaattaaaatataaatagtcaattat

SEQ ID NO: 12490 - DNA, 2016 bp, Heterodera glycines
  misc_feature (1985)..(1985): n is a, c, g, or t
ccgacatttgataccccccgtttttttaaatgttcggggatatccttagaattaaaacaattagactcacgccgccatatccgccccctgtatcaatcccccccgtatcgtccccccccctcccccaaaattttttaaaacaacgaaatttttaaaaagaatttttaaattttaataaaaatttttgaaaattaaaaaaaaatttagtggggggggagaacagcggtggaatggtaaacgaactgttcgcttcggcacacacaaatcaatttgtcatagaaagattaattttgatggaattgcattcgaataaaaaatttttttgtttggaacttttacgttttaattttggatcatcgacgtggctatccgcgacgcgcaccgccttcacttggctcaatggacagctgatccggattggcttcaaatacacacggcacccattctgcactgccatgatcagggacgtgctgcttgggcagcgttggaagctgtccaatggaccaatggcactggggtaggaaaatttttataaagctaagctttcaaaataatttttgctcaaattttttggaatttttttctatctttcctaagcatgccaaattttacaggaggtcattctgagaaaatgactattacactcatccaaaaaagtcttattccaaacattaaaaatttattcgtttgtttgacgattttcgcaaaaaataaaaaataaacaaacagcttttccttattattagcttaattaagccatatttcttcaaaagtgaacattatttctcattttgtgttttattgcattttctaaattctcattgataaatcaaaaatgtaattatacaaattaaagtaattaaaattatttaaaaatgaatgataacatatcaaaagttgtaataaaatatttggattggtaattaattggttcatttttggccaattaagttggacgttgcttttgggcccgcctgcgattatgtgttggccactgtcacgcgcattctcagtttctatcgagtgccaattttcactaatgccggcttcaggtcgcttcttcttttatttttgactttaatgaaccaccgttttttcagtgaatttttcattgaacagaagagtacagtactgctgaccagggttggaccacttcaggtgcaatcaaaatgtgattactgtatgaaaatcataaactttaattatatcacctaaatcacctactgctaaagtatgtatatgcaaaaagatgacgataaatttaaataataataataagaaaataaccctgctttttgtcatgttgttaggctggcattcatgaaaaatcacctgccaagaatattttttcgacaaatgcataaatataattggtaacacttgtaattcaaaaattttttgtttttttaccatttttcaattttaacacttttttattcaatccatatattttatacaatacatatttttaatatgtaaatttgtcatggttatttatttttttaatttttataatttttatgggaaaacctttttatttattttgtaaaataaaataaaattcaatatgtttaatttttcttccaggatcacatcagcgaattgttggaacggttgttccgtcagtttggttggctccgttcgcgcatgttctacgaaaaacagttttgggagacggaactgcacgaggccggtttctgcaaactgttgatgaatgtaagagaggaaaaatttaatttttaaaaatttgaaaaaattatttttaatgtttgaaaaaaacaacgaaaaacaacgaaaatcgtttcaataacaacaacaacaacaaaaaaattggtgtaaaaatttcataaattaaatttaaaaaaggggaaccaaacaccacgtagggcttattttttgaagaaaattcttaaacttggttagacttatgatttaattgatagtgctggaaatatgtattccagtaatgagcaaaaaaggcaaangtattagcagaaacatttcaaaaatcatttt

SEQ ID NO: 12491 - DNA, 1303 bp, Heterodera glycines
tttttatcgaaagaataacacatgaattaattaaattcattcgcaaaaaaagtggtcaatttaatttttattttatcgaatcatcaaatcaattttaacggctacgtgtgtccattctcgaatggccggatgtggaatttgttacaatgcctaaagaatattaatattgattaaacattattttaaataaaaaaaatttttgggatataacagacaaaatctggatttgcaaaatccgcaatttctaggcctaagccaaggcccaggtttgtctggatttgtcaagaatatccaggtcaaggtcaaatgaaaaaatccagctttagtttaggaaagataggaaagaaaatctggatttctgtatgagaatttgtttattctataaaatgattatttattaattggttggaaacccttcaactaattaattaatcaattaaattaataattcacaaataatacttcaataatcaccgtttgcgcccgcagcagccgcctgcgcagcagcgagttgcgcttgcgctgctaattgtgccgcataattttgtgcattcgttacagtcgtcggcgcaacagacgaagtgtttggttgatgtaacactaaaaatatttaatttttttaagttaataaattttggaataatttctagttcataaatctcgaaaatttactggagacaatttcaaaataatgtgtttgaaaaataatcaaatttcaaattatttcaaataaaagtgtttttaaattataaaataattaaattaaattcgattggggcgtctcaaaattgttacatttatcagggatttgaagaaatttttttgctgtttccttggtactgagtcggcaaattaattgtaaatcaaaaaaattccggtctacctcagttgggcgcgcacggtttggcgctcacggtttggcgctcacgtttgggctacaaatattattgtcagctctgaattaccttggtcagatgttcactttgttcgtcctcctcctcaatttcgtctccaaatgacaaaagcgaagtgttccgtttggtcgctgccattgcgacatttgttgcgtttttctcccttttggacctttttctctcatcgtcctttgtcgctttcctcggattaatgtcatcaaatggattcaccaaaactttggcgctcgtaattttatgtgggtaaattggacgctcatttttgtcaacttcgtattccttaagcttcaaaaaattaaaaattgtgtttccgaccccctaaaataaaagccagttggtttaccttgtaattttggaattggccactttcc

SEQ ID NO: 12492 - DNA, 4023 bp, Heterodera glycines
tttattcattttaaatcaaataataaaaattgatgtctttgttccacttgttgtgccgcaactgcagccagcgtgttcggctgagcctgggacacgacggccgcaagctgtacagcagccaatgggttcattgttgcagcggctgcaaactgtggtccaagtgggctgttctgcaggtacagatgagacccaagccttaaaaattcggcaatcgattttttcgaattttgaaatttggcatttttttttgtgccacaaaagcgcttcagccctcaaaaaagggtgcacacaattaggcacacacccagcaaagtttcgcgcactaggcaaatgcgggagaaaaaatttcgaactcttggtatttcgacccttggcattttcgatcgcggaataggacaaaacgtcgacggacaaaatgccgccgaacgaatttttggaccaaaaccctttttaattttcaacaaaattaaatattcttggtattgttcgtacataagctcatgaaaaaatctctattaacatggaaaaatttaaaaaaaaatggtcttgtacaaaaagagtgaaggccaacaagtataaactgtttggccataggatgtaaaaatttccaagaattttttttaattctttaaattttcaattcttggtatttattgttcggtaaccccgaatttgctgtttttagcctgcagaagttcacaaacaattttttttttaccaattttatagaatttatgaaagaaaaaatccaatttaaatgtgttttccaaaagacacacaaaaatttctgaactgaagttgaaaattcgaacattcacttttagcccaatgcgttacaatatcaatttgatcagtaattgtaatactacagtagcagaaaccatcaccattcacaaccacttttgtttgaacaatagaaaacgacatgacacgcgcctttgggtgtaagtgtcaaaaaacaacaactaattttatggtctaatgaattcaataaaaatatttaaaataaattactaaaaattgaaaaaagcgcataaaaatgaattcagtcagtgagtggcacacggcaaatgatttttcagctcataacaacatcctcataattttcaaatttcaacatatattgtgataaatattctagaccaggccatgcacagaaatgcgtgggattgctggcatttcggggccaaataaagaaaaaaaaagtctaaaaattaaaaaaaaatactagaaattgaatttaaaaattgaatttaaaaataattttaaacaaaaaaagtgctcataaatactagagctctctctacctcgccctggatccaagactaggttttaattatttaaatttgtggtttaagaagatcttgaacataaaataagtgacgaattcatgattatgaaattgaacaaaaaaacttttagtgttatatatgtagctaaaaattttaagagaaagaaaaagtttaaaaattttttggcaattaaaatcgtgatcagcctccgaggaaaatcttatgaaagattgtggatttgatgagcctcgagaaaaattttatgaaagatttgtggatttgatgagcctcgagaaaaattttgtgcatttaaaatttctctaggccagcaagcccaacgccactcaaacattcatgccaaaaaattcattcacgccactttaaactacctccatcaatagcattttttgatttgatagcccatcaaattctgaagaaaatatattttttaaaattttccaaaaaatttttttatcacaacaaatcaaccaaaaatgcgcgacaacctacccaaaacgtccactaagctgttgctgttgttgttgttgctgctgaagttgaatgatcgcttggatttgggcggcctaaaatttacaaagaaaaattaattaattaattaattgatcaattaaaattaaatcggattttaaagggatatggacggccaaggacgtccgaattaatacttatataaatttcgagaaagaaaataaaaaatttcttaacactttttagagtccgacatttgaaaaaacttgtaacaaggacatgggttccattttgatcagagccaggattttctgtgcacaaaaattcaggaaaattgcaggcaggtccaggaaaaatccaggttgtccaaatggattgggcctgacccagaaaaaactcaggttgccaaaaaattgtctagacctcttgacctggactcaggaaaaatccaggttgccaaaaaaatagcctggatgtgtccaataaaaaaaatcctgaaactttaataatttctatggaaatttaaatataaaaataaaataggaaaataaaaaaatttttaaaaaattattgaatttaaaattatcaaagtgtgacctgcagttgtgggagttggtttatcgtggtggacaaggcggccaggtgcgcattgtttcgcggctttgctcccaaatatgccaaattcacatttgctttacgtccatcgatgatcgggtttgggtctctaaaaaaaattaaaaaaaaaattttaataaataaaaactctttaaaaaataaaaaaattaaataaaaattttttttaataattaaaaaaatattttttggctctgacctgcatgctttttccgcgtcacaacgatccttcatcgtcacaaagccataaccgcgacttttctgcgtttgtcgatccgtaatgacaacagccttttggaaatttaattttattattcaaaaaattttttttaaataaaaatttggctgttccaaaaacgacgccaaaaaaaataatgagaatttagttttagattttgaaatttattaaaaatcagaagttttttttaaccaaaatagataaattgaataaaaattgtcgtctgatttaattagaacaacattttttttttaatttgtacggctgtgtcgaaaagcgacggcaagaaaaaactgaaaatttttctatcagattttgaaatttagtaaaattagaaactttttgaaatttaattacttaaattcaataaatattttcgatagaatacttcttcgatttcgccaaattgcttaaaatattcatgcaatgtctcgtcagtcgtatggtatggcaatccgccgacaaaaatttttgtttgggttgtatcacggcttccttaaatggtaaatgatttttgtataaataaattataagttttccaaattcatgtaaaaatgccaaaatatttagagaaaaactttcttagggatgaattttagaaaaacttccattttagtttttacggctgcaaattatatcgaaaaaaattcgcaaaatttataagatatgtaaaataattcccaaatatataaactatttaataaattttttttacaaaattactataaattatcagaacctcaaaacatgaaaagatgtcaaaaaaattgcgaattttggattttctgggacaaattactttaaaaaatcttcaaaaatagcaaaatatgtacatatttaatatgtattaaaaagcgaaaatatttatatttgttctcaaatatcaattaaaatattaattttttatttaaaaaatatttgccgaaatttcgcccataaaacaactatattttagcataaaatgttttaattttatttaaaataaaataaattgtttaatcgcacaaatgccacttttttccgttgccgccgtttcagtgcccgtcgccatgggcgtggtaagcgattgatgggccgccaattctgccaaaatgttggggtcatccaatgcggctaattggtggttcagcggctcagcgggcagcatttcctaggcaattatcacaattatcgttaaagtcaatcgtttaaatatcctatgcatttttctatcgaatttttgccatattttaaatgcttggaatgtgacattgggaattgcaaaatgaaatataaggaaaagaatgttggaattcggggaataaatttaaggtcaaaaaatgtagaaaatccacggatgtaaatttaaggagaaaaaggacacaaaaacga

SEQ ID NO: 12493 - DNA, 1786 bp, Heterodera glycines
ccacaactcttttttaaagaatttttttatgaatataaatttaaaacagattttcatttattcattttttgaaaataatttttttttattaaaaaaaccttttcaaggagtcgaaaattaaatgcagttggctgtataaaaatgacaaaatatttatgtggttttaataaaattaataatataaatattttaagggtatttaaactattaaaatcaattaaattatttttagatttatacactccaaccttttcatctgctcgactgactcctgaagcatttaaaaagtccacaagttgctcaagtgcaaaaggaatttgcaatggatttaatgcgtaaaattttataaatttttcttaatttaacgcatttttattatgaatttgtaatttatatatttatttgcatacgagaagttatgtttttttattcaaaaaaaaaaaaattaaaacaaaattgaaaaattgaaaaaacaaaaggttgtcaaaatttaatatttttaaatacaaagcttttattttattaaaaaaggcataaaaattaattttcaaaaaataaaataaatttcttcaatttcacagggaatcagctgttttgttggaaatttattatgaacaaatgtcgcatgaagtgttgacggaaagtgagtcgtacatggtgagaaaattaattaggtaaattaatttaaacaaaaaataatttgcatataattaatttaattaattaaatttaatattttatatgtcttcagcttgtcaattttgtgtctgatgttggtggacaggctggactttggctgggcgcaagcattttaactctttttgaggtcttttaaggataattatttgctattaaataaaataattttccttattcattacttatttattcatttaaattattctttattttattaatttaattgattctattttttatagtaattaaatttaatgattggccaaataacataattattatgcgaccttaatgagtctaaattaatttttctttttatacttaatttaggtcatttaattgcttttttagtgagaaacaattcataattattcacaatatggttaattactcaattaaataataaaccaattaatcaaaggtggtcgtttttgtgctacgaattttgaccattttttgtcgccgccgttttcgtcgtgacgtcaccgtggctgattcatcgtcaggccaagaaagcagtgaaattgtccataaaaagggtccctcaatagtggaatcacgccgtaaagcttttaaaaaaatataattaataataattattattattttatttaattcaattaaactatgcacttatcatttagagtgattttttaaattttaatttcgtttaaaagtctaattaacgaacttttaaaaaattaagacattttacaggttcaaagacactcagtcagcgtttgaagaaagcggcaaaacaacgtttgcgcaaagtttcctcaattccatcggttggcgcggttactgtaggttcacctccgacaatgaaggatatggtaaaaaccaaaaattattatataattagtagagcgagctttttcgaaagttatattattggattatggggaatttcgatgattttctgaaattttcaaatttttcttctatttttaaatttgaaaatatgggaataaaaaatatatatatttttgaaagcttttaatttaatttaccttaggcatacatatttcagagaaaggcctccaaattgtgccaccattcgaccaccgaatttttcatcggaagt

SEQ ID NO: 12494 - DNA, 993 bp, Heterodera glycines
ttggctgtgtgtggttgaactttttctgctgttggaaaggcaaaaaaaaaagcgaatatgaaatggatgtgacgatgatatgacaaccatatgatgacaaataaatacaaaaatgtggcggtggtgcgcaaagggaagagaaaagcgcatcaaatgaaggcaaaagtaaatttaaatgacgacgacgacgacgataatgatgatgatgatgaaaattaaaataggattttgtgtattttgtgttgcatagatggaagccaatgcgaaaaacaaacaaaaaaattttttcaggggaattggaatttctgggcatcaaagcgcggaattccgacatttttgggttcggaccgcccaaattttttcgggtctctgaacttccatccctgctggtatgtgtgtgtatgtcatcaatgtttactccctagacatacaatataacagatcagatatactgtacatccattacacacagtatataaataaatacaatcaataacaattttaaaaaaacatattttgaacaacaatgtaattaagcattattgtaaatgatcaattgatcaaattatggtgcaattggaatcggggacggtgtactgttgctgttgtttgaggatgggtttactgtaggtgtcgatgttggcgcggtggtgccaaagttaactgctcctcctccgcctccatttgccaatgccctcgttgttgtttctccgccgcgcgttggctcagcgattcggcttttcgggtccgcaccacggacgggccagcaaggctaaatgggggaaagagagggatttttagacaaaattttttttttttaattcaattcaaaaagagagcagttaagatagagcatttattttattcataattggagatggattattatattttttgaaataattcttgatggatttggttttgactatgaaaatgtgccaaaaataattttttgtccaagcaatgtgtcagtagtcaaaaaaccgactattt

SEQ ID NO: 12495 - DNA, 1886 bp, Heterodera glycines
gataatgatgatgatgatgaaaattaaaataggattttgtgtattttgtgttgcatagatgggagccaatgcgaaaaacaaacaaaaaatttttttcaggggaaatggatttctgggcatcaagcgcgggaattccgacatttttgggttcggaccgcccaaatttttccgggtctctgaacttccatccctgctggtatgtgtgtgtatgtcatcaatgtttactccctagacatacaatataacagatcagatatactgtacatccattacacacagtatataaataaatacaatcaataacaattaaaaaaaaacatattttgaacaacaatgtaattaagcattattgtaaatgatcaattgatcaaattatggtgcaattggaatcggggacggtgtactgttgctgttgtttgaggatgggtttactgtaggtgtcgatgttggcgcggtggtgccaaagttcactgctcctcctccgcctccatttgccaatgccctcgttgttgttgttgttgcggcactttcggtgccattgtttctccgccgcgcgttggctcagcgattcggcttttcgggtccgcaccacggacgggccagcaaggctaaatgcggggaaagagagggatttttagacaaaattttttttattttaattcaattcaaaaagagagcagttaagatagagcatttattttattcataattggagatggattattatattttttgaaataattcttgatggatttggttttgactatgaaaatgtgccaaaaataattttttgtccaagcaatgtgtcagtagtcaaaaaaccgactatttttgcctttttggggtcaaattttcaaaaaaaaaaaaagataaacagagggtccgatgatgccattaagctcccatggaaattttaaaaaataataattttaatgcaatttgttaagaaaattgtttgtttaaatttccaaaaaagtttccttacagagtttgggtttttcagagattcatcatgacaccattttatgagtgaatatttttagggcgaaaaaatttaattaaattttttgtgtcaattgaaaattaaaaacaaaatcacctcaccatctgaatgttgttgttgttgtgccaaatagcacgtgagcacctgaaattttgccaatttattgcaaaaaattttacacggaaactcatcaaattattagggaccaaaaaaaaatgttttcaatttaaatttaaattttgccaatgctggaaggaatttcctaaaaaaataaatataattttataaagtaaaactcaaatgtataaataaaataagtagggctgctaattttatgtaaatacatgtttttttcctggattcttcatagcctaattagtaagaaaaacactttcttttttgtgtttgcgaacaaaagttgggacttttatttacatatttttacatatttcgggatttttctacatattacatatgtacatatttttatacatattttggacttgttcgtacatatttcgcaatttttcgtacatattttcatttttaaacatattttgaggatttttgagaatttatagaaattttttgtgaataattttttttaaatgtatccctaaaaaatcgaataaaagatatatcaaaaattaattttttaaatactaaaatgtgattctaagcttattttggtcatttttatggcattttgtgcctattttactttttacgaagaatttttttccaaaaaataaccattaaattttttttttacatattttcgtacatatttgaggatttttgtacatatttcatacagattttaacattttttatacatattttatttacataattcgcaaatattcttacataaaattagcag

SEQ ID NO: 12496 - DNA, 1987 bp, Heterodera glycines
  misc_feature (6)..(7): n is a, c, g, or t
tgcatnntttttgtggccccaatcaacttaaatgaaaaaatgttaattaatatttaaaaaaactgtcgaataaaatttaaaaagttttaagaattttcttcattttaaatgaaaaaattgtcgaatttaaaaatggtttaagaaataaatacaaattaaaaattttaaatcaaaaaattgccgattaaaattaaaaagaaatttgagaatttcctttaatataaaatttaaatacgaattaaaattttaaaatggaaaaaaagtgtcggttaaaataaaaaacaattttttttttaaattttctttattttcaaatttaaatacaccttcatttgaaaaattgcccaatttttgggactcatttccaacaatttggtcctcataaatcaaattcgcaaggccaacatttatccgatcttctccagtgctgaaatttcccataaatcggtcaaatgattcgaaaattattcgaaaaaaattgtgcgttggattttgttgagaaacaattaacaaatcatatcgttcacccggatgaattagcactgaatcaaactaaaataaatgttaaatttttaaaggaatttaattttaaaaaaataaaaaaataaaaatgcacgtaaattttataaaatatttaatttttaaaattttaaataaattacaataaatttaaatcttatttgttatttttataataatttacccgttttggcttgacatacgaaccatcaactgcaacaacccaaaattcatgttcttcaatccacacataaaatgctataaaattgtttttatttttttattttacataataatttttcaaaaatacattgctcaaagcctccgtttatgagtcgtaaaagcaaattttcatctaataaaaaaataaaattaaaattttcatagtattagggataatttttccgtttttctcctcctttacctaaatatttttttttttaataagcttcgttttggttttctgtaatgaactcaagccagcaagaatgcaaaattcataggaatatataatgaaaaacccggaatttttcaggagttgggaaaacggaaatttaagatttatttatttcatttttacccctttttatggcaaagtttggcaatggtaaacgagacgggatcagtttcaaatcgtcttggctatgccaacctttttgattgactaacacagaaaattggcgcagaaatcccaaataagggccatgtgcctgaggtgggcccgcctaaaaactaaaaatttgattatgattttttgtttttgttttggatatataggagtttatatttaaaattctctcctttaacagggcaaaaaaaaaatttatgaaaaaaatactctttggttaaaaaattatgtcagcttaatttgtaaaagaattttagttcaaaaaactataaattttcgagaaaaaagtccagattcttttatggttaaaaattataagttttcgagaaaataggccttttatggttactgcgcaaacatgccgcgcttaaattaaatctaatttcaaatcatatttaatgtttttaatacaggaataaatttttaaaaagtaaaaatttataaaaaaaaactttccggttgaagaatttgtctacttattttttttaaagaatacaagctcaaaaatcgaaaaaactttcaagaaagtaggcatttacgtttgccgctaaaaacatgacatttttaattaaatcgaacatatttttaatataattttattttagtaatatttttaaaaataagtattacagtttctggctgaatacattcacccgaatcaatgcgatgaccaagccatttaattcgttcatgaacaaaatcttgccaaacatcttccacagatttggggagaccaatcataaaatttatttccaaattttttttattaaattttgtttattttttatttttccacctgcaaaaattgccaaattttgtcgcccaaatttttattttgtc

SEQ ID NO: 12497 - DNA, 933 bp, Heterodera glycines
taaaaaaaaaaaaatttgggttgattttttaaaaaaatggaaaatcaaaattaaaattttcagaaaattgggtccactcaaattcatgaaaatatttaaatagggggttagtcgtaaaaaaacagaagaggatattgttgtcgggggctttattaatgttgttgcactgcccacggcaaaagacaacagcccaaagcaaacacaaaacaatacagcccaatgccgaagatgattatcgtttaattccaaataaaattagggcgaggacaatcaataggaaaactgcgacagcataaactaacaaccaacactccacaaaaatcacaaacaaaaatgaaacaaattaaataacaaaacgccaaatatattttaaaatcacaatattagcacatcctcgccctctaagaagcgatgtcctcagcgctttgggctcatcggtagtgcattcgggcgttgaaaggggcggcaagggtgtcagcagtggaccggttcggcataaagtcgcgttgcagggtcagacctgtaaaaacaacggacaaaacggaattccgacttttcatctggccttataaattcatcagcggtagcttcttgcgcacacctgcgatggccatttggaaaattcaggcttttaccgattttcaacaaattttcaagattggcggctgcgacatccgccaattcctccccggccttcggcgaaaaaattgtccccaattttccgaatgctttccgtcctttcaattcgtcggtgcgactcattgagcctttacttttccaaatttgtccacactttgacttttccttcgaaaatacgccggcgaacacaaccaacgcagcgaaaatagcattcaaaaaccattttggaatttccgccgatttttcctccattttccctctttttacactgcataacgacgacgaatttcgctg

SEQ ID NO: 12498 - DNA, 1062 bp, Heterodera glycines
  misc_feature (45)..(47): n is a, c, g, or t
  misc_feature (60)..(61): n is a, c, g, or t
aatctaatttcaaatcatatttaatgtttttaacatctgaggaannntaaaaagaaaaannataaaaaaacctttcagggtgaagaatttgtatagttattttttttaaagaatacaagctcaaaaatcgaaaaaatttttcaaagaaagtagggatttacgtttgccgctaaaaacatgacatttttaattaaatcgaacatatttttaatataattttattttagtaatatttttaaaaataagtattacagtttctggctgaatacattcacccggaatcaattgcgatgaccaagccatttaattcgttcatgaacaaaatcttgccaaacatcttccacagattggggagaccaatcataaaattatttccaaatttttttaataaatttttttaatttttaattttccacctgcaaaattgccaaattttgtcgcccaatttttattttgtcaccaaattcggttgtgaattcaattctctcgtctggtctgatcacaacaaaacctcccagcagtcccattgagcgatcacccatcatatggcctattttttgaatttaaatttaatcgcattatggtaattgctcatccgatcagcaggttggtatagggaatcatttcagttagaagcaattttcgggccataaatttttcaaatttggcattatttgaaagctctatgttttagttattgattaatatagtgataagtgataaataaataactcaaaatctaacttagtgaccttaaaaaagtaattaagaattgcagttatttttttgacagtttagaaaaaaatttttttttggtattttttaaaatttagaaacgtcgaattgtcagtctttaaagtgggggccgcattggcgtcagaaaactctaaaattcaaacatctcaaaactacattcgttactaattagacatttaatgaattgattgccgccaattaatgaggccgacaacagtgtaacgatgcaagtattaatccaaaaatcttaccatgataaaaatggatgccagggttgtcggcaataaaattgtatgtataactaaa

SEQ ID NO: 12499 - DNA, 2900 bp, Heterodera glycines
  misc_feature (160)..(160): n is a, c, g, or t
gaggcttggaattttttttttttttagaaaacctttcaatttaccccctcacagcagacattttttgatttgggttttagaaaaaaatttacgggcccccaattgcacgaaaaaatgagaaatccgtcccctgggactcagtcgtccgcgctgaattttnttctatagttttcccagatgcgcctcaaaaagttgtaagacccttccaccactttcagggcgctcccggccttcggccgggagaaaatggttttagcaacgaaactccttgtcaatataacatatatagtaactagcgggtgcgtgaaccgtcggatctgggcctgggataaagcgcttcgcgcttcttgagcttcgctacctaggctgtgaagcgattcaaattgatagaagatgttagggataatttatcggaattttaaaaaattatcagcgatttttaggccgcttcgcggccttaaagggcggattcgagcccgttgtaagaggtaaaacagtgattagaagaggtacaacagagattaggagaggtacaacagagattataagagacctttctcgaagtaggactcgaaaattgaaagaatggaaaaatttaaaatgttattctaaataaaattttcaaaatttaattaatttttggcttggaaattcagatttaaacagagggttcggaattagattatgagacgcatccgaacaattttttagtttcaaaaatacgtgcaaaaaaaactcaaaaataaatttgggcaaaattcataattttgccaaaataatgaaaaccttttccaaatataatttttttcattaaaaactaaacttaaaaaagaaattaaaagtaaacttttttgataattttagggcaaaaattgccaaaaagcctttaaccggcagcatatcatcaactcccaccaaatatcgcaacaatttaacaaaaatgcaacaattcaaaaaaaattgattgtcacagatctgcccgcaccaccgcaatcattgccccctcctcgccctccaccgcctctaagtcctccctgtttctgctcatcccttccacgtccatttgcggccttcttccagcccttttttgcacccgctgaggcttttcttttgccactgtggtcggcgtgaccaccgccaccacggcctccaccacgtacagcacttccaccaccgcgaccgcgaccgccaccaccgcggccgccatcgccgtggccgccaccgccaccaccgcggccaccaccgcggccgccaccgccaccaccgcggccaccaccgccaccaccgcggccgccaccgccagcaccgcggccgccaccaccgcagccgccaccgccaccaccgcggccgccaccaccaccaccgcgtcctccaccgcgtccaccagcatcaccacctaacaatcaccagtcatatttaaataaaaactttcattcggggtataaaaacgcacttttaaattttttaattatgcagtcacatcctaagattaagggattattaacatgccttttaatgttaatacctgcaaatttctctattttaaatatgtagagtatttttccaaaaacagtataaatcggcaaaatttttcaaaaaagctgcctaaatcacctaatcagtagggattacattttaggctctaaaactgcaaaaataggtagtctctaggctctaaaaaaaccccaaaaataggtaccaaaaaacctcatttttaggggtgtaaaatgacaaaatgtattcaaaaaggtaaaaaaatcagatttgattaaaaatcaatatgtttaatcagaaaatttgaccaccccgattaaatgctaatttaaaattagtaaattaaaaatttctccacctccaccggctccagcattggcaccatcagcaacagcaccgcctccagcatttgcaccatcagcaacagcaccgcctccagcattggcaccatcagcaacagcaccgtctccagcattggcaacatcagcaacagcaccgtctccagcattggcaacatcagcaacagcaccgccgccaacaatggcaacagcaccgccgccaacagcaccgccgccagcattggcttcaacaccgccttcaccatcattaacattattattattgttcatttttggcttaaaaaaattaaaattaaattttaatatgcgaggctgaaagtgcgccagtggaaaatctatcaatttaaaatgttaaataagaaaaatcgttagtgtagtacttaaattacgattcatcgaattactaccaatccccataaatgctggaaaattataaaaatgtttaaatttttttaacttttaataggttcaattatacattaaaattatacggtgagaaaccaacaatatttattttcgcataatgcttaataaaaatatttatttctttttacaaaaacccaattttaaaatacgatcacttaaaaatattttctaccgacgcattttgtaacaaaccatgccgtaggtatggtttaagcactgaagaattttgtcgaataagtccataatgaattaaataaaaatctcaagtgaaaaaccaatcaatgcaaaaaaatattgcacttttgtttttctaaccgtgaaaacaaatatgtattctgtctaaggaagaggtctaagtaaaaaagattgtggatgtaaatatttgaatcagaaagggatttaaataatcaataaaataattttttatccaaaattctttatttaaaaaagaattgaacaaaaaatgataaataatatttttttcaaaattattatatgtataaaaattttaatataaagtaaaaaaaaagcacataattcaaatttattatttaaaagctagaaaaaaatttatcctatgtaggaaataaaatcagaacacagcaaataaaccattttgca

SEQ ID NO: 12500 - DNA, 3368 bp, Heterodera glycines
  misc_feature (3357)..(3357): n is a, c, g, or t
atcctcagcggagaacggaagaacggaattgctgctgcgcttgaggacttattttcccacagtgcagcggggcacatcaaattgggaagagtttggggaggcgccgggggcgtgtcgaagtgatgggaagcgatgagttctcaccacccccccccccccatttgctaatggcaatgattcaaattagtctattgcctgtgctccccctccctccgtttgggtcttcgcttttggcacattcattgacaaaacattcacaatttcaatcattgttaattttaattttggccacttttccgtccttccatcaaatgaatccgaaattctctctttaagtgacttcaaaatgtgcaaatgtgccaataaattaactcagtgaaagaaaaagtcagatgaacgaaagagtgccggtgccaatctttcgttaattaatattaattattcattcattggcatctgatatttccttttcatttcatctgttgtccgctttaacaatttctaaacatcaatttatcactccataaaaccttttacaactaattatttatggggattaattcccattagtagataatattcccaatcaaattatcgattgattttcgatcgataatttgagtgtgtctactttttttctctgacatccccttccacaaacccaaacctattggatggtctcctcgagagagagagagagagagagagtacattctatgatttctctgactaatgaaatcgactttaatttaatttgtttttttaaatttattaatcgataattttatttgacccccccatacctattggatgatctttgatcccttcaaccgaaacctattggatggacttgtgcgcgagaatttaattaatttaaattttaattaattaatttaaacgagcgagagctgcgcgactatttccgataaattgtggaaaatcaaaaacatggtcgcggtctcgaaccgttgagagtggaagcgaggagcttaaccacttggccacaggggcagttgaaaggtacgggataattgttgactttatgatgaaaattccgttaaaatttattaatcgataattttatttgagccccccccccccaaaaaaaaaggcaaaacctattgtaaggactgtacacaaataatcaataaacccaagcctattgcctatatcatatccgaagctttaagtaaattagcaaaaaacccttttcttccggctgggctcgaacccataccaacttactgtgctaaccaattggccattttatgccactgggaaagcaaaatccaattcattaaattgtaaaaaaatgacgtcatcatggaaagtaaaaaatactccgccccttttcttgttggtcacgcccattggtttttgttttgctttgctaagaatacgactccgccttttggctttttagtttctttttttccgcctccatttttttttgctatttaaccacagtttttctaaataaaaatcattcgtgttccattttttaaaaaattccatcctccttcgttttttccgatcttcctgcaatgaattctcttaaacgctttcaactcccggagcaaggaacacgccagcaagaagagttggattccgttgaaccgaaaaacatcagcgatgtggtcaacttcaattcggccggcgttttttatgttttgggaaaagtgacaaatatgcagtaccgtgtttacaaagtccaaattaattaattaattaaattattaatttttctgtttttaggcatgcccattccgttccaaggggctcatttgtcgccgaaaattgtccgatgataacatgtgtgaggcttgcggccaaaaagcgattgcccccatccacacggtgtttgtccgtcttctgctacaggatgttgaacaagcagacattgctcaacgtgtcaccatgttttcgagtgttgccgaagagtttttgggaatgaaagctgctgaattgctcgccaaggagaaggagccggagagccttgcgaaacatttggacgatttgattgctgtgaagataattgcgaaagtcaacattaaggttgtttttttttgcaatttattacatatttgacaaaccacaacataggcgaacagtcagacttacactggatttgattggattgtcaatttgttcaagaagtgccctggaaaaaatgacagtgatgtgccaaaagaaaaagatgatgatgatggtgacgttgatgagattgctaccaaaaaaacaaagaaaaattgagagagagagagagagagagagagagataacggattcattttgttgtgagcttcaaaaaaaggatttaatgtgtcctttactttttaaaaaatccattaaaaatgcattttaccacgaatgggggtatatgatcacacctaagcccacatcccattccgaattaaattgaagttttcttggtagtcgaactcgaaaagagtttgtgcgatttccttcaacatttgtgttggaaggaacgatcacatagaatgagtttgatgaaggcattctcatttgaaatttaaaaaaaaaagagcccctttatatatttttccatgtcatggagcttgcaggaatccagctgttgtgccgttgactgtagcctttccatttcaccaaaacgtattcaacaccttgctttttcctctttcggacgaccttttcaatgtcatatagggtatcatcatcatcatcatcatttttgcgcactagcacacgacagagatcgttggcatagaaacggcccttgatcagggaaccgtcgtcatcacgtattcggtacgtgacgggaaagcggtcagtgtgcacttcggcaacagtgaacacttcgttggtgaagcgtccggtgtagcccttttggaacacgtgtttgtacttctcaatgcgcacacggtcacccacctggaaacgtggtagtggttgtttccgctttaattccgctgtcccaccaacagcgttctgcttgagtttttttctgagcttttctgcattctcaaaattcacatcaactgggcgcatttttatgcttgagttgtacgagtggtttattccatgcacaatttgctgtatcacatcaacccatttttgggtaccccgttccgtgaaatagcgataacggcgttctttgatggttcggttggcccgctctgccatccctgcgtgaattcgcggcgaggtgtacataaaaaagtttttcacgttcttatttttgaaatattcctgaacctcttttgccttaaattcgagcccttggtcggtcaacaatgtccatggtatgtatttggagcgtttaaacaagcgttcaaaagcagcaaccatgtcggagctctttttgcttttcaccgngctcaacaaag

SEQ ID NO: 12501 - DNA, 5075 bp, Heterodera glycines
  misc_feature (41)..(41): n is a, c, g, or t
  misc_feature (70)..(70): n is a, c, g, or t
  misc_feature (84)..(84): n is a, c, g, or t
  misc_feature (102)..(102): n is a, c, g, or t
  misc_feature (1596)..(1596): n is a, c, g, or t
ttaggtcttttttaatacattttgtgcctattttacccttnatgaagaatttttccgaaaaataatcatntaaaaaatttattngcttatttggtaaatctntgggtttttctacatatttcgggatttttttttacatattttgaccactttttgtatatattttttgacatcctccctatgcatcagaaataatgaattttgaactggtaatttttttattgcctgaatttgatgctaccaatgcgctgaccattagaaattcttcttcctaaaattggaacctaaataaaaaattaaaattatttaaattttatcaccggacatacaacggattattattttgataataaatgaataaaggactaaatgaattgttttgaatgtttgtgacgatttgtgagttgatatttgatgcgccaaaactgacagggaactcactcaataggacagcagtaaaatttgcctaaaatataaataaaattttattaaatttaattaaaaattgtaaacttttttttctaaaaaaatcatttacctaataaaatttgctaaaactagctttttcttgctaacattatgatttttcttgctaacattatgctttttctatttcggttactcctcgccgcccaaaaaattctgaaaaatttgtagtttcttgaaattttttaatagttcggtccaaatcttgtaaatttcgcccggctgcgaaaaaggaaaatcaggcaagcaaaaatgtgttaggcaaaagcccctaaaaattggttttttattattacaactatcagagctcggtgctcaaaattgtaggaataagcatcagcctttaaatattctcaaagtcttcattagcataaaaaacctcattttttaaattcttgaagccgaatcaattgtcttttaatgattttataaaccacaaaaatcccaaaaacccgccaattctttttagaacaaaaattccacttttatccctccaaaaaagcccaaaatgagaacaaatcccgaatcccgagccctgacataaagcaaatttttaattatttctttacaaaccaatactatgtataaaattacttgatccgttggctctaacattacaaattgcggcattgtatgctgcaacagtccggtcactggtacagtttctgatcgacaaaaatgggttttaatttgccaagataaaagcggatactccgataaaattcccgaattccggctcaaaaactttcgggattaattttcatttgtgggtgttgttaacctggtttcagtgagtcaattgtttgatgaaacaacacaattccttgctcaaatttgcttgaattggatccgatgtttgacagaatgtttgattttcttacgaaatggaaagtttttgaaaatttaaaatttatttaaaaaaagctctaatttatattttaaagttaaacaaacgaagattatataataaatagagatggaatttttaggcatgaaaaagacacaaaaatcttttttttattattattattattgttaaaactttttagttaacaaaaatacataaaaacttaatattttggacattttatatttaaacgaaattgcttnaaagaacttttaaaaaaagtataatttttaaaactaaaaattttttgtcaaaataaattaaaggtacgcacagaaattattcgttcatttacctaaaataccatccctaataataaatcgtttaacaactgaactgaccttcatttaaaactcatcgaatgtgccattttcttggttatttttttcattttttatttcctaagaatcaaataaatgattttcaaaaatgacactttttattgttttaccgtttctttttcatttttcttctgcagctgctgctgaagaaattcacagcgtttataaagcgattgaatgaattgtctttgtgccggactttgttcggcttccaccatttgagtgagggagaggacattatcacccgtctcgaccgacttgaaaagttgctagaagggtcagggaaccccactctggtcacaatcatcgaacgactagaaaagttagaaaagctggtagaacggctaatcgcgggcgagaatcgatatggaaatcgatttgctgaccctcaacacacctcccacacttcggcctccaccaacaacaacggcaatgttcaatggggtcaaccgccgccttttgctggcactggcgccgtttcgcagatgattaccgaggcaatcatcaactccgaacaactgaaagagaagtccactcgtgcggtcatcaaaaaattgccggaggcgatggaccaacaggcagtggtggagcaaattgcagaacaatgcggtgtcaaagacaaattgtcgcccgacattcaccgccacccaaggacacggcctgaaggaggggtaaaaagggatcggattttaaaagtgccgtttttggacaaattttcacgtgacaaatttctctttaatttccgtaatgctgtgaaaaaattgcccaatgtgccccaacatatcaaagtccgaagggatatgacccaaagtgagctcaaaatcttatactcccttcggcaacaagcctatcaggccaatattgccgcaggtgagtataagtattttgtggttgacttggagatcagatctctgaaagacccccgcccgctcagaactcgctagggatacgcgagcaaatcaaacaaaaatattgggaatacgggaaagaaaaatccttggatttcttgcctattaataaacgcccgatcgataacaaataaaatagctgacttagaacatataacccaaaaatacgatccttttataattataataaatgagacctggttaaactccagaaacacattagaatcagaacttaaagtaaatggtcaatatcaaataatccttgcaagccgaaatgataaaaagggcggaggatcggcaattttattaaaatcaaacatcccttatcagacacttttctctgaaattccaaagcgaaattattcacataaaattactttttaaaaaacctatttaaattataaatatatatcgtccaccaaattgtacagttcagaatactaaaaactactcaaattcatttctgaccagagcgattctgaaaataccatattctgtggtgattttaatatcccaaatatattgtgggatgaaaataaggtaaaaaaaataaatgatccggcgtctaattctctaattgagtttatgcaccaaagacaattgatacagcatgttaaggaaccaaccagagaaaaaacaattttagatttagtaattactagtgaattagaattaattaatgaattgacagttctagaaaatttttcaacttccgatccgaaaatggttggatttaaaataaaagtaaaattcagtcataaaaatcctaaaatttacagaagagattttaaaaatatcaatttttcgaaattaagtcaggcgatacttgaaaatcgaattgatttatcaataaactcagtgttcaccgttgaacagaaatataaagaatttttaaataaagttctgaaattatatgatatttttatacccaataggcctctaaaatcgataataaaacaatcgtatcctcaaaaaataagagacttattttcagagaaattacgtttgcataagcttgtaaaaaaattccctgaaaaaagtgatctcattttaaattacaaaattatttctagggaaatgaaaaaacaattgtacaaattaagaaatgaaaaagagtcaaaaattatttcccaagggcaaaactcagttaacaaatttattcgaaataaattatcaaaagttaatgaaattcctacgttaattgataatgctggaaatatgttttccagcaatgttcaaaaatgtaagatattagcagaaatatttcaaaagtcttttttaagaaaatcaattgttaatggtccacaaactcaatcgacacagaataagactaaactttctgacattgaattgaatgcgggaataatttggaatatattaagaagacttccccggcgtaattccacttcaccggataatgttccttacattttattaaaaaattgtgcagaaccaattacaaaaatattagcagatatatttaggctaattttggattccggtcaaattccggaaatatggcgaacatcattggtggtaccaattttcaaaaaaggcgaaaaaactgatccattaaattacaggccggtgtcattaaccagcactgtctgtagagtttttgaacgaattttgagtagcaaaattttagaatttctgaacagtacaagattctttgataaagaacaatttgggtttttaaaaaatagatcgactacaacccaaatattaaaaatgatggacgatatatataattctatacaaaagaatcaacaaattgacataatctatattgattttgtcaaggcgtttgattctgttccaattgatttattacttcaaaaaatcaaaaagattggaattgaaggaaaaattcataattttttaactaactttttaaaaaatcggagttttaaggttaaaattggcgaagaattgtcagaaagtttcagaatattttcaggagtgccccagggaagtgtcttagggccattactctttttaatttttataaatgatctgccgtcctttattgcaaatgaagcggcatcagttggcataaaaatgtatgccgatgatgttaaattatattatacacatgaaaacgatgaccattcgaatcagttggataaagcaattgaggctttggaaaaatggtcaaaaataaatgggttagaaatttcaactgaaaaatgttttgttttatatttggggaaaaataatatgaaaaaagaatattttattaactcacaaaggatttcagaatcggataatgttcgtgacttgggaattataattgactcgaaactgaatttttcagaacacataagcaaaattatacgaaacgcatatcttagaagctttcagattttgagagtgttgaaaagcagggaaataaagactctaacagcagcttataaaacttttgtacgacct

SEQ ID NO: 12502 - DNA, 4318 bp, Heterodera glycines
aaaattagcagcaaaccgccgcattaatttacaccatttatagcttacttaaattacaatactgttcccgttgcccccctatactgtaagaccctttttaggggagtcaaaaaataatacgcatttcctaaatctgatctaattttcggcgctagttaaaaaagtgcttgttttccgggcttttaggggttgctgaccacgaaaatcttacgccatttttgaccaatttcgagtccctaactagaactccaactaaaaccagaaaaattattttttcaatttttcgatttttgtttccaattccgttaaggaactcggaattggtcgaaatacaggtcagattcgcgctcaacgactcctaaaaccctgcaggaaaagtttaaatagcgcctaattttctctaaatttttttagtccataaatttttttatttgcacaatgaattttttgttggaaatagtacaaaaagttaggttttgatttattccattattccatccgccctcccataaattttctctttttactttgaatttcctgaggaagcggcagcattaaagtcacattttgtggccgcattaaagccacattttgccacggcattaaagccacattttgcggcggcatcaaagcaacattttgcggcggcatcaaagcaacattttgcggtggcatcaatgcaacattttgcggcggcatcaaagcaacattttgcggtggcatcaatgcaacattttgcggcggcatcaaagcaacattttgcggtggcatcaatgcaacattttgcggcggcatcaaagcaacatttttgcgacggcatcaaagcaacattttgcgacggcattgaagccaaattttgcggcggcatcaaagccataacatttggacgtggtaagcctgggactacggatggacgagaacaacgacagttgaagttgagaaaaatcacaacaacgatgaacagcacacctaaaaagatccataaaaacagatcagatgaattgtggttggaatttgttgaagcaggcgcattcattcgtttgcgacgcctccgacggcgacgaccaattgcatcacaaaatgatttatgtatttaaaatgaataagtaatgcaggaaaatcaatatttgcttatatttctcacaaaaaagtgaggtcttccgatttacggcctcaaaaagatgaaaaaatggattctcagctgttttcaaaatgaaaaatcttttcgttataaatttatgaaatattttttaagccaaaaatggtcattttccaccttaaaatgacaatttggtcttttctatataccaaaacaaaagattaaataaaaaaactcaaattctcaaaaaatctgaaaatatgggaatatgaaaatatgtactaaaattgtgattgttgactaaaacagggagtgagtgccattcgtactttttttcaatgggatgtaggtcaaatttagactaagaataatcgctttctaggcaattttagacctaataatttaccaaatatcaatttttaaatttataaattaatttaaaatactgaatttttgtatatattttggtattaaaagcacttattttaaaatagctaatgctttttccaattaccatcaatcgtcatcttcattttgtccatccgtagcagaaaatatatttacgtcccatttcgtttccaatgaccgctcaaaaaattgcaaaaatcgccgttcttttgtccattttttcctttcttttttctccattttttcctattcttttttctccattttttcctttcttttttctccatttttccttttcctttcttgttctttttgcccattcttttcttcttcattttcccattttcttctttcccctttttgccacattttcggcaacttttttttccccaattccatcgtccaattgcaactcattataaatgtcaattagctcaattaaaattgcttttggctcattttgctgcttccctcgggagcttttcagcggaatttggccacgttttgccaagaaaaactaacttttctgcaattgttttttttattaatttaataatgtaaacaaggattcaattattaatttaatttagacgaattgcttaacaaggttttattggttttatgtttatacattcatgatttaaatagtgtaatcctttttatttccgagagttcttcaattcatccatctgtttgtttttggcctgcaaaaaaagaatttttttttatttcaaaattttgacaaaattatttctatttgggtggatgttttgagtccaaccaactgaccatccttagtttatagtacctaccgtaactgtttttttgttgttgcaacagaccgtacaatttttgtattattgaaaaatgcaatttgtaagtctgaagaagcttttaatacgagaaaacaaaggaatataatatgttaaaaagatacaaaaaagcaaacgcagatgaagtttccttaattttcgaaatttttgctaattgccgaaacgccgagaaattattcattttagcttcttcacatttattgccttttttaataaaaaaataaaaatttcaattctgttggaacatgaaaaaaaaattacagttcatgacacccaaaattagttaattgaactcaaacaaaaaaacattttacccaaaatttcttgctaaggtttaacttttcgaattttttataattaaaaaaatttgcattttttttaaattttcaccattttgcaaaaaaaacacagttgcttgttgttcattttgtggctgttcctgcaattcaaaaaaaacaatatttataagaaaattttaaaaaactcatttaaattttaatgataattaactttaattattttttataataattaaggaaatatttaaaataataaacaactattagttcaccatccgcacgtctgttgacatcagcaggttgttgctcattttgatcatattgtaaattatctaaaaacaaataattaaaaaaaaattaaatccgaaattcattataaccattttctgacaaagcggaacgttgttcattaaaatcttcgggcaactcattagtcaagtctaaatacaatgtaatttttaaataaacataaataagatttatttttaacgatcattgggaatggaaaaagagcgttgctcattttgttgataatccggcaaattctctaaataagttattaataatattaaaaatttcaaaaataatattatgttaaaaatatttaaatattcaaaacaaatatcaccattttgtatgagagcagtggaccgttgttcattgaaattttcggtcatttctttaaaacataaatattttattaagaaataaaatataattaataattaaactaattcgccgccattaggattgaaaaaagattgatcattttgttcagtgtcaacaactaatttttacaaaattaaatttaaattaaaaattcattagcataatttggtgctcgagaggcagcaaaaaattctagatctttttgttcaactctcttcttcttgtaatctgatcaaatataattttaaaaatatggaaattatttattccttttaaataaatttaaaaattttaattttttgaaaaaattaattaaaaaaagttattaataaattcttaataatattcatcattttgagagagaacagcagatcgctgttgttcgtgttcatttcctgagaaaaaagcaaaataaataaatttttacaaatatttttttgattaaaagtaggaaatgtcatcaatgaaaaaagcatgatgtataaattaattttgatctcaatgcgacagtttgaagattttacgtttttaaacaccaaattgttttttgtgctataggccatgtgacaaaaacagctttttcaattatgtatcaaaaaaaaattttaaaaaattatttatgccaatttttcttattaataacagtaaattggaccgatgatttgaaaaattatttttattttcaatattcagcatttttgtgcacaaatgtaagttaccaagagctgctgatctcggacccgattctaatcccggaagcgactgtttcggcttttttgttcgccaaatcggcctcggtcccggaaacaaaaacggccgctgcgttgaggacttaatcggtcccggatattgacgataaaatgcttcatccggtatctaaagtttccaaattttatgctggaacgctgggagatctgatcaccggaggtgacagattcggattttttgttggcaaatcggcctcggtcccggaacaaaaatggccgctgcgttgagggcttaatcggtct

SEQ ID NO: 12503 - DNA, 1035 bp, Heterodera glycines
tttgaaaaaaaaactaggattagaagcagtattagtcaatatgctgggaattagaccagtttttgggtttttaatgaaacttctcacatatttagccttttttccaaatttttagttttattgaatttcgccaatcttcttcaaagccgtgttttgaaaatgtttttaaaacaaagattaactggatcaaaataccatgaaatcccagtttaccatttagggattcaaacggaatcctgtatttatacatactatttatattgtaccttttggttcgaaaaattgttgacattcacttcggtttcgtgacgcttggctgggtcggttttcagaagaatattcaatcgaatgattttaggttggccggcgccgcccagatcaaactcaattgctaaaattgcctaaaagcaatgaacaaaattgtgatctggactgatcaaaaattgaaaatggcaccggaaggagaaaagcgatccaagtgatcgtgaccatttttgagaaagacggcattccaattgagtgatctgaaaaatgaaaaatataaatttggaaatggtcaagtctacgaaaaattttaaaagccgaacaaatgaatttaatcgccatgagattaattttttaaaaattatattaccaaatcttcctcaaacaaacaaaaattgtgccttaaatttaacaatcgaaaatcatccgtaaaaaagaacagtaaattttatttttttttactaaaatttgaattttatctaaggttcggaaattaagagataaagattagcaatcatttagaatttaaatcggcttttctattggatttacagaattttattaaaaaaacgtaaaattttatgaatttcttatgaattttttctaaatttataggcagtccaattcacgatggttttaaagcattaataaaattaggatgatgaaaagttaattttatagcacattttacgaccccaaaaaatccaatcgctcatttggtgggctgaataatttaataataaaaaattttattgttttttaagacctgca

SEQ ID NO: 12504 - DNA, 1941 bp, Heterodera glycines
ttttttaatttccaacacatttattcagggtcgaatttgccaaatggtggccaattcgctgccgttggaatggtgccgaacgaggcatttcagtcgcgaagctgcgcaaacactgctcgacaagatgaaagtatcggtttttttttttattcaattaaatgcttatcccactattttaaattttggcggggggggggggagacggactaaattaccccacatttgcgcctatgtccaaattcgggttcaacttaaattttttcaatcgctgatagcctaagcagttttatataagtgatagaaagttttgtgtctgctaatttgatgaaatttaaaaaataaacctttaaacagcagaattaatgctcctaatagactagaagattgggttttcttaatccccaggcgcaaatgtctaaacacggacggacgacgccccaataaaattagggaaaaaatgggttttagccctatctcgatttttttgttgcaatttaactgcttcacattcatttgcagaagtgcaccgctgccactctgtcatacgttttggccaatttgcacaacgtgaaaaagccggaggcattgcgcaccgtcgaaatgctcaaaatggcgtccattcggttgggcatgtccccggcgaggacaatggccgtggccgagaaattgtacacccggggaaacaccaggtttgggttgatagttttttttttgaaattgcccttcgaaaataggagcaataaaagcagtttttttaaattttgccaatccggcggaacccacgccgccgccaccgattatcccacactttgcgccgatgctcaaaatcgttttaaaaattttagttttttcgaaccagaatagcacaaataacactaaaaaattttttaaactcatttgttagtaattcatcatagaaattttcgaaattatttttttttgaaaaatttataaatttgtaaattttaaaaaaaaattcttgagggggtgggggaaacgtgctgccccttaaaaataaacagtttccctctcaacttgtgtaccgcaacaatttccccagttacccccgcacggagacgtccgcctaccatgacgagtttgagtttgagcgtgttttgtccgcgttggaacggtcgccaacatttgcccgcattgttcggcagattcgctccgatggcaaattgctgcccgaaaatgggacaaacaaaggcgaccatccgccaatcactccgctacgttcattttgtctagatggaggtgcgaaaaatcaagtcaagtcggccgttaaccgaaaaaatggtaaaaaacagttttcacattataataggaagcgaaaaaaaaaattttttttaagtaaattaaattctcgagtcagtccaaaaatgggcgaatagggaaaaaagggcgggtgtaaaaaaagggggggggtccgccggcgaagaggggaaagaggtaaaaaattttgaaattgtacaaattttcttacaaattagaaaattcattaaaaattccaacattttcttgacctcgcaaaatttgccgctgacccccccccccccctccttttcatgcgttttttgcatattattgttaataaatgaatgcttcgtagaagtggacaaatgcttgtacgaagatgcgcatgcgctttacgaacaaattgcgtaccattttctcgccacgcttatgcgcccgtgcaaatacatgctcaaaagtgtgatgtaagatcatttaatatgcataattttaaataacaaaaaatgggtggataatgaataaaccccaaaatctcgctgctgaaatctcgccgaaacaaaagttttttttccgaaaatccaaaaaattatcaattgttggtgaaaatttgttaaaaatatggccaaaattctcgggttttcttgcggcggcacccatcggcaccgccggacccgaaaactttaa

SEQ ID NO: 12505 - DNA, 3006 bp, Heterodera glycines
  misc_feature (2950)..(2950): n is a, c, g, or t
ttcctaatttcactcatttttcttggtaaattgactctatattttctaaactttccccggcggtgcctaaagactccgccggatcccaattttcccatgatttttccaaaagtatgtctcaaaattacctaaatattctgcttttttctacggcgccgaaaatttaagtcaatttttctaacttccaaattttagaaaatattagtgtaattcagaataaaattttgaaaaatcaaaaattttaccgtttaattgcaatataatccataattttgtttgttttgctatgctttgatttttatatgttaattttgaaacacaattcagctgaaagaagaaacgctcgcgttctacctgaacaaattttgcaatttcgaacaacgaattgacgacgttgaggaacaagtcagagcaggtgtccagcccatcacattagtgaactaatgagctcttaattaggacccggggtagtaggcaatttcgggttcatacatgaaaaagggggtgagatcgacagaatgtttttttggatgggagggggtccagctgccggggagaattttgtgaaattttatgctcggcttttttttggtcttgattctcggaacttttggttttcttttcatcataattatgaaactgaaaaaagctcaaaagattttctgacatccttttttgcggcgtgatttttcgaattttttttttaaatagcggtgctatttgtaaccaatttttgtccaaaaaacgaccgatttttacgatttcatgaatttttattaacaattttcactaaaacaatgtaaaaaatcgaaaaacgaatttcgattttggccaaaattttacgaaattgcctcgcaattccgtacgatttacgaaattgacccgccctcgctttgcccacctaaggagacttcccctttttgaataatattttaaaaattattttgcagaaatttttgacccggccaatccgcgccgtcaatgtttcaaatgtcgtcgtgttatgctaacggttcgagcggtgtttaatcaacagatgcagcaacacatttgtccgagctgtcaggtgtggtgaacgatagccaaaaaacaaacaaataattaaaaaaaaaattgtaattatttataaaatttgaattttttcgagaattacacaggaaattcctttaataatattaaattgaaatatacaccattcgatagcccttttaaagctctacaatttcgctcacagtgactgtttttcgctaaaaataaaccccaaatgaattaaaggcccgcgagactctttctaaatctcaaatttagtattttttggatagaatctgttatcaaacttcactcaaataagctcgccgcaaaaaaatgagaagcaaaaaagagcgtcgattgggtaaaaattgaaaattccgtccaaaaatttcttattttttagtttttcagtgggaaagaaagactttcttgttttttcagattgcccacgagttttcccgaatctcccgccattgaacagatgcaacgatttctcggcgtaaatccagcaaattgcctgatctgatcatttttcgttttactttcattggccctttcactcaatcaaataatttgtccaacaaattccacaattctttcttctttttctgttcgcttgccttcaattacttttttttactcaaattttacgatcacttattatttcactgatcactttctcagttctttttgttcaacaaaatcccaatttttgaaatcattcgcaaatcccagaagaatacacacaaaatattattaatatgtataacttttttctttgttcaccaactttatcaaatatggtatcattcgaaagctttaaatgtttagaagatatttctaagctattcgaagtgattaagcagctcaacaaaaagttgtcgcttgaaaacataaaaaggcagaattttcgaagttttttatctctatctttttttcagttcgatattctctgtaattatttataggcgaatagagcctgtgaagagctttcgaataataccaagattattggattatatcaacaatttaaaaggttatattgatttaaagttggctcagacggagttggcccgttccccccccccccccccccccgctggacgtccttcgtatggaatcgggtcgaccccgcctttgattgcatgtatctgccgacattctgacattttatggggggtggcggcataacggaaaataccgcaaatagacttatattatcttatcattacgtgatgcgacttttagttacaaaaaatcacgaaatagttaattaaaatagtgaggaaaaatacaaaaataatgacaaaatagtaaccaaaagttcgaaataatagtgatataattctcagcctttaggacacgtaaaataagaaaattttattcaaaaagcaacaaaattaagccaaaccaatgaaataaatgaataaattttggagatgaattttaagaaaatttttcgtttcttagggggtttatttttaaaattttagggtcgattcttaagggtatatttttgttcaatttttggggacgattcttaggtgtgtattttaaattttgggcaaaaggccaaaatagtgatttctaatggcgaaaattgtttttcaaacgaaaaagaaattcaacacagaatgagtttttgctcctctcttcaaaataaatgaacaaaaaaaatattaaatcgctggaaatcgcatccgtatgctaatttattaatacaaaaaactaaaaaggaaagtgttttggtctctcgaaatgtcgaattaaattcccaaacaaaaatgccatcatctttcgttctttggtcggcacaattcactgattcatcgtccgccggtaggagtgccggtattttcccacccgtttctgttgacaacatcggcgagccaagtggcatcattccactgactctttncccaatcactaaaaaagaggacaattaaattcaaataaatattttaattttctaaa

SEQ ID NO: 12506 - DNA, 3533 bp, Heterodera glycines
  misc_feature (2034)..(2034): n is a, c, g, or t
  misc_feature (2047)..(2047): n is a, c, g, or t
  misc_feature (3507)..(3507): n is a, c, g, or t
attaatcgataattaatcgcctgctcaaaacacgcaatcgtttagatcttacatggataatcatccaattcaccacttgcgtgtttcttggagatgaaacgattttcgagcatttaatcactcttgaatttccaaaactccaaatatttaaatgccatctctcagagaagccctaatcaattgcgatcagcatttcatttgttgtttcttaccccggcacccctgagctttccatgtggttggccagcgtgacgtcattgctcattatgtcgaattgccacttcttcagccccaacaccccgcagtgcgctttgccactgtgaatgccgacgcgcatgttcacgttgacgccgtacagctcgcggaccaacctaaaagcacgggtgagtagtacatggttcttcaaaattagacccggcgcggggacgagatcctgcacggaatcgcagtccgcaatttcgcatcttttggaaattgctgggattttgcaggattaatctagcaggatctcgtcccgcaaaaattgagttccaatcccgtagcggaattcgcaaatttgattttttgtgttgaattccgcggacaggcattgatttttttgaaaattttaaaagacagaatgcaaatatttctgaaaattttacaataaattcttatgaacgttaagtgattttcatcgcaaatttcatccaaaatttgtgaaaattcccggcgctgctttcggcccgtcggaatagcctccatcttattaattctataaaaattttgctgaaaaattccgcattaagtcattttttggacacaatctgttaagaaagtgactaaaatctattgaattattttttaatttaaattagcaatattaaaaatggtttacttgatggtgtgaatcatgtccaatcccatggcaactgcacagaccgcgtggtcaggacgcgcctcaggaaagccttaaacaaaaaataaaattaaacatacattttaaagaaaatatttaattatttaaaatttgttattaattaaaattcttatccaactaaccgctgacgcaatagtagcaatcgccgagaattttgatgcgcatgcaatggttttcatgcgccaatttgtcaaaacgcgcgaacagttcattaagcgttagcaccttagaatttgattttaaaaaaatttatcaatttattacattgcccatttgtttgttatttcaaatttaaaattgcttatcaatggcattttgtatgatttttgaaggaaatggcaccgcttttcctttgtgataagtagggatgggatttttagttttttaactattttttctgcggacgaaaaatacacccctaacaaataagaatcgacctaaaaaattttcaaaaataaacccctaagaattggaaaaatttcacaaaaattcttccccaaattttttttttcttgttcaatatttgctaaaaaatattttgtaactggaatcagtgaataaaattgtttgccttaattttaaattattttcaaattaaaaaacagctatttaaaaaattacacccctaaatttggaactttttcgccactatttttgccactattttggcatttttttctcactatttagttaattattttgggattttttatcactaaaaatcccatccctagtgataagtgccgcccacttttggcacacccaccaaatcctcggccgtgcaatgcgatgccaaattggtgaagccgcaaatgtcggcgaacagaatggagatctcgctgtacttctggatgtaaatttttcggaattgcaacgccggctccgtccggtcgatgtttttgcgcacgtccaacgcaatgaatttgggcagcacggacagcaaaatgttctcctgcttttggttgtcccggtgcaaatggagccgattctccacgcttttgcgcgtctcgcggaatgtccgtcgttgaaccaattcggtgggaatgtactgaaatggacgacggggcattcattggccaaaattaatgaaggaagaaataaaaatttatcattanataaataaattanaataaattatacagaatcccttggaatttctcaagccaaacatcccaatcccttattaagagagaccggattttgaagtatatgatcttttttttttgcactttccagttaagaagcatggaaatcgcatttctaattaacaataagtttgaggatatttttcatgattaatttcacttttgataccaaagcaacccaaaatttttcaattttaataaattaaaaatttggatatcaactaattatttttttaacaaaatagcacttaaataaaaatctgataggaaaaccggataataaaaatcgtttcccagaaatcaaaaaactaattcactagaattcgaaagaaattaatttagattacaatttttttaacaaaattctatattttggacaatattttggcaatttttaacacctatttaagtatatattttgcgcaattttaagtatcaaaaagaaccgttcttaataatcagatcaactgtctaagattaatttactcatttccattttttttttttttttggtaattcgcatttcgtaaattcacttaaacccacaatgaaaatgccgttgatattcatggcaagcaccaaaatggcttggattgccaaatgcctcaggtcgtcgcttcgcatcacatagattagccaaagtgcccggacggctaaagacacggcactgatggcaaaggcagccaacagcgacgccgtcaattgcagtggcatctgaatgaatttgggaccccataaaacacattttgagaaacgattaaattattaatacaaaattaataaaattattccattacttcaatttgcctaatttttccaagtgaaaagccaattaaaaagtgaattaaccaggccatattatgagagtacagatggcaccaccgataaatttgttcttttacattcttaaaaatgttactaaaaatggcattttttgtcgaaaagtgcgcctccaattaactgtgtgccaatttaaaatattgcctttctgtaaaatatgccaattaaattaattcttaatgagttaagggcgtcacgttcgttgggagttaagtatcttccataaattccgtcactatggaagttgtggtcggaaaatgtgaaccaaatcataacttttggtaaaaaacaaccgaatttttaatttcaaattttccagtataaaatttgtttgtataaatcagtgattgttaattaagcaacagattataccgctgtgtagcagaggagcagcagcaaaatggtgagcaatgagatcaaatgttgggggctgagcagcagcaaacacagcgagacgatcaccaccgcccaagtgaaaagggcggaacgccaacgccacgtggtcagcaaaagaagcaccagcaaattgatggagagcgcgaaacggagccaattgtgcaggttggcatggacaccgatttggagcaggcacaggaacaccangcaaagcagcgaaatctgtgcgggaa

SEQ ID NO: 12507 - DNA, 1394 bp, Heterodera glycines
tcatcgtccaccttcagtctgcctctgttcatgtgttcaaagtagcgcgtgtacaggtgatcagactggaacagctgtgccaacacgtgcggcggtgccgcccttttcggtgtccgtctcgcgcccgtgccgcgctcctcgtcctcctccgtcgttgttgaggtgccgtacccagcgccgccacttccaccaccagtggacgaaacggcacgaggtccgccaaagcgctgccgtcgttcctcctcctcctcgcgcgacaacagcgacagcacgtcctcctccgcaacgcccagcgaactcatcccctgctgcactatcgtgcgtgaactgctcgagtcaccggcaccaatgccgccgcccgcgctggacgccaacggctcaatgacggaggagccgtccactgacttgctggcacccatctctgagctctgttgatggataaaaatgatgttattagtaccgaactgatgatgatcagcagttttgtcagtattgatttggactgatgtgagatggcaataattggaaggagtgatcggaatggaataatctgaggaggatgttcgatcaataatgggccggcactgaacagtgctcttctgaccattcttattggttgccgatttacaacattcatgatcagaaattatagagattggaatgttgtttgcactccgattggcgggaataaatgccacgcgattggaattggaatcaaaaatagcatagtgatcaggacatttacttgttgcttttgctggtgatgccggtgctttagtcgtttttgcatttgttgtgggagaggaggaaaaattaaatggcatttctttgaaatttaaattttccgcgtgcaatttacagttttggcattatgtcggactgttcagcgcttaagccatcaagggattaaaaaaatttgaattcctcaattgcctactggggtcaattaagaagaaagtagagattggaaaaacaaattttagaacctaattacacagaactaatcctgtaaaatcatgcacagattccagccctattccgaactaaaaagagaagctttccttttacagatagccaaagaatggggctaaaaaagttgaaacaaatatgttttttaaagtttagaatgttttggctaattggataatattttccttcagccattgtttgtttgctgtgtgctaatttgttaatttgtgagtgttggcttactgtgttagctccattttcaccatttaacaaatttttttctttccaaaaatggaacccaacaaatgacaaaaaagtatgtggtgccccttgcaaaatatcacttggctgacaaatgaatgagcagcaaaaggccccgctgctccctcatcggccgattttgttgcttaatttagcaaccccct

SEQ ID NO: 12508 - DNA, 2016 bp, Heterodera glycines
  misc_feature (1949)..(1949): n is a, c, g, or t
tcgacttttagtggttttttgtgatttaaagtccattctctagtcatcacagttcatcatataccatgttgagctcgttcatcagtgtgttaacgttgtagcaaaacaccttgaagtcgggcaactgttcatgagttcgatgtgcgtaagctaaggaggcagcccgccatttgttctcatcgtatttccaagactcagccttcaaaaagattttttttttgtatgccattttctcgccccgtcaacttcaagcagtaaggcacgtgattgtgcccgaaagtcgtcgctctgattggccgcaaattgttcaactgttgctgcgcacaatggacccaacaacaacgcatggaccaaatggtgaacgttgaaatgcattttatcagcgaaatgctggaggcaaaagttgagtaaatcgaaactgaaatcaaaaaaaaaaaactacaaattgcccaattaattgtattttatgccaatgtacacgtgcaaatgaataaaaactgacaaaatctcacccaatttgcccttggtgaaccatctctttgacaatggtgacaaaagtggtcaagtattttgcgtgcttcagctccaacacgctgaccaccgtcttccaaatgtttgagtgggtccgtggcggaaaactgagtggggcgagcagtgtcacaagctgatcgcgatggaaagaggtgatcagaacgcgattcagacagggaagttgaggggaaagggtggtgatggaattgccagcagcggcagcagtgtgaacagtgccctgtggattacatgaattttacaggatgaagaaacagtgtaattcatagattaaagaggaggggtggggaaggtcaccaattgagaaaacaaaggtcgacaaactccaatttggcccacacaattttttgttggaccgaaccggccctagcgtttttattcgtaagctgtcaggcgatcgggccaccctctctctcccccttttttcaattatacaccaaatttttgttttcaatttaaaactaagctgaaatggatcaacagtttcaggcgataccattcgattcgcgacgactcgctatgcagtaaaatatgtcaggttttcccctaacttgaaaccagaagctccatcagtactgctgattagttccttctcgttacctcctccccattcccagcatcgttcgccccagtgtcgtcctcaatctgcttctgtaattgcgtttgttcatctccctgtttttgtccgtcttcgtcgtgctgctgttcattctcgcacaaaatcttccgaagtttgtcgctcatcgcttccaaatgggtggactgttgttgctcgttcctcttgtgctgtttcccgtcttcatcattattagcaaattcggtttgctgttgctgatccaccatcgtccccttctcccaccgcaactgtgtttggtgttgttgctcttcagttacggctcggtgtcgttgttgcttcgctcgtccgccacctttccgtggtggcgtcggtgttcgctgcgacggtctgaacccgtcacaatcgctggtcgctagtcgcaccttcgctgctgcagcagtactgctcggactcgctgccgttgtcgctggggcatttggtgtcgccgtcgttgacgatggcaaccccttgcggtttcgcttctccgtattttctaaccatacaaagaaactctgcaaaataaaagatgatttcgctttcgctcattttatgaccaacttgaacaagcacgtgttccgcaccgagtccatccccaaaatacgccgtcgttggctcgtcttcccgagaatcagcaatccgcgcatggcgcaacaatgcaataaaaaagtccaccactttggaggccggcaccgtgctgaacaggcgaatgcccgtctcgaatcgggtgggtgcacgaggactgacctgggactaatttgggacttaagcgactgtcattattttncagggaatcgtgcacaatttatgcttgcttacccggtgtcccggcttccgtgcggatttggtgctgc

SEQ ID NO: 12509 - DNA, 1313 bp, Heterodera glycines
taatcagccacgatggtggccatttttcactccgttttaaacttgtcggtaagccaattatagaaatagggcataaatttagaatgtgtgaaaaaccaaataaattttaaagataacggaaatgcatcaaatggatttttaaaaaggtaattgatgaaatgaacatgaagaagtaaaaagaaagagctgtatttaaacttttttatgatatgaaaaatggaaacgaaaaaacaaatataacgaaacattcaaatttcgggcccttctccgcccggcacgagcattgtgatgtgattgccattcagcaaaattgtgtccaattttgtcacccgttttccctcgggagttcgttcgtactaaaagaataaattaacagcaattaaatcgattttcatgaattattctacgcctctcacttcgacaacatcctccatcaccatattcacgtagtcatcaaagcccaccaaagtgccaactgaaaaagcatcattttcattaattttaatttgcaatggattaaactaatatttggcaaaaaatcccctggcttttttgccactgaatacgaagcggacaccaacttcaaccaattctaagcctagccaaaattcgaaaaaatttgaccactgaccaatttctttctcgttcttcatgatcacccatattttcgaaccaacacatttgtcgatcagttccaacggcaaaagggtcgacggattcactgcggtagaagcggtcattttttttttgaattagaaatttattaacctgcttttgtcagttaattataagtcttataaaaaacaaacgaaataaatatatattgaatataatttgacaaaaaaaagattaaaaaattgaatagacaatgatttaaatttaaaataaaatgaataacggatacaaattcagaaaaacaagttttagtttccgaaaaattgcattccagaaattgtggttccgacaagaaaaaaaatcattatcggccgaatttaatattattgtccgttaaaatcaataaaaaataagctttctgtttgtcggaatcacccaatttaaaattcgatagggaaaatgaccaagttcacatcactgcttccgccttcctcggctctttatagaacaggttcagattttcctcgacctccttcaactcgccgatcaaattcggcgcgtattttccctccacgtggccgtcaaccgttttgccctcgaacacatccaatgctttgagttcgtcaaagattcgccgttcctcctcctctagactcgccaactcggcgtccatttgtgtcactcgctcttccctcccc

SEQ ID NO: 12510 - DNA, 1090 bp, Heterodera glycines
tgtcattattttgtcttgcggcttctccacatggtaggcgatgttcagtgtacggatcactttctcaaattcttcttcgctttgttcgcgcaataatcgcaactttaaaaaaattcaattcaattatataaaataataaaaagaaatgaaaaagcattcatttttcggacgggttattctctttcttttttaccattttccgacgtccgtggatcaagttgtgtaacttggcgctcagccattttggccgtttgcgcattttatgccacggcctttgcggggcacgtctctgcatcagatcctcgtacagcgcggtccaatgccgaatggtggcggtggcccaggcaactgatcagaaaaggtaaagatgactgaacagtgacaagacaatttcggaaagattagaaacccgggaagagttcccggacatgttcggagaaagatttattttttgacactgacaaaaaaggcttttaaaagacagcgactgaatatgtcgggcagcaaatgttcaggcaaagatcaactataatacaataaaaataaactttttgctggcagcgaatgattgtccaattgatcgtagcgcactctgtccgtcatttccctaaaataagtaaatgcaaatgaaaaacagaattatgaatgatttcaaatgaagatttttaaattttattattaaaaaggtgaattgttgaaaaatgtccgactttttacacgccgctgtgaagtcactgcgctcgccatggtccaaactgaagatgcgctgcacactttcaggtgcctcctgaaaagagcaaaactggtacatttttagaggacaaacaagaaaaaaactatgaattcttgggattatcgtccgaattgagagattcgaagggatgtcataaaaagtaatagccaagggaaatcgacaattaattctcaaatacgaaatcaattaccactaattttatcagaatccattactgcaaaaagcttacagccaacactttgagcccgcggtactcaagccgtggctgtgacatgtccaaggagggaagtccaaagtctgtaaagaaaactgagaaaaaacaaacaaaacgcatta

SEQ ID NO: 12511 - DNA, 3611 bp, Heterodera glycines
  misc_feature (20)..(20): n is a, c, g, or t
cggaacactcgcccatcctntttcgacaaagccaaggactatctgatgcgctacccggacacgggagatgaggaggcagaaaacgcagcgcaaggtgaaaaaaccaaaatgaaaatgaaatttaaatttgaaaaatggaaaattatttaaaaatctaatcaaattttgcgtagaagatttgctgatcagcaagaaaaagaagagcaaggaggatcaggaacaacagcaacagcagaagggcggaaatgcctggctaaagagtcatgacccggacttgcccgcctcgctgtcggaggtggaaaacagttcatcgtcagtgatcggagcgagacgaaaagcggaagacgacacggcagagagtggggagatgggagagagtggacagcaggaggagaagaagcagagcagcagaggggaagagagtgggaaaaagcgagagggcggcaggaggaaaaagacaaaatcgaccaccacggaggaggaggaaagtgaggaagaggaggaggaggaagagagtgccacgccgttccggccacgcccttcgaccatcatcgggttccgcaccattcagccgatgggcaccggtcagtgccccgagcaaacggtgttggcgccaacatactagtgttgttcgagaccgaaaatttctcgagactcaacccagagattcgataccagcgagactgacaaatgagaccatacccggactttctcgagtcgagaccgaggctcttgaacgccgctacatataataagtccgtcgagattctcgactccattgcctcccgtcccggagtctcagttgggtctctaatttcctggaaaacactatcatccctaagctttcgggataattctcgacattgggggtcaaccctcgggtcataactggtctgactgatcagctgatttaagtgatcagaatgatgccacctttcccgcttcttcagatggcgtgtgtaaagaagcgcccattgtgcaggtgaagccccaaacttcgcagccccaatcgcccgcggcgcacagtccgccggcacagccgacgacgcaacaacgcgccaaactgttgaccaccagaaagtaagaaaatgccaaaaaacaaaccaaaatttgaatcggaaaaaccaactcacaattcatagccaaggggagggattaaacaattaaaaaaggcaattatgttaattagcagactgacaaaaatgccataatttattttaaaaattctttaatttacgtctgttttgctaatcccaatttgaatagatttaactacgctttttgaggacattcaataacattgcttaaatgttctatttgtatgccaaaacgccaaactttttttttcgtttaaccgctgcccctttaccgtatttacacaccatttcttggccagctccgcttcgccgtccccaatgcatggtacggtagtcgcttcgccgccgtccccgctgtttggtacagtaggcgccgcgcccgtcagtccatcgtcggttggcggagcggcgaccgcccgtggcggcgctatggcgccccacgcgacgacgacgccgcacgctgacgcgccatcgcccgccccaccgccggaccccgccgcgtcgccaccgcaaccgcagcgcttcgagacggcagccgcgtacatccggcgcaaaaaccgcgagcgacgaacgcggaacctcacagtggcggtgacggagttgtgcccggtgcggcaggacgagtggacgacgaggtgcacaagcaaaacgactggcagagaacagcatttggcacccaattaagggctaatgtgccacgttttagagctttctatagcgaattgcaatccccggcattaactgtaaaaggaattcgttgtgaaaatttattttcgtttggcatttttttaattttggtgtgccattttttctcagtttttgtgccattttctgttttccttttttttcttatgtgagaattaaaactggaggaatggggaaaacattttcaattttgaagcataaatttttcattttgattactcagatttccatctgttgaccagcccgactatcagccgacttcgccgggcggcggcggattggccaaccgacggaagggaagcgtaggaggacaaagtgaggaagggaggtaattagggacagacagattcaagacagattcattatagagcaattcattagggagggaggggaggggagtgattaattaaggaggtgtaattaggaggtggtcaattaattattaataatgtaggggataattaggaggtagtcggtcaattaattagctttatttcgtcatttaaagaattggatgctcagacatcgcccggcttgggctatcagcgtccgggttatttggacgaacgcaaatacggcggcggcgagtcgaactttccacgacaggcaaagccgacactttatcttaattgcctcaattaatgatattaaaatcatttcagaattacgtcgatcgacgaaagtctttccacgaaatgtcgccgccctcgggcgacgagccgccgtacgaccggtacgcaattgccggcggttatttcaactcattggtcggcaacacgcacgtgccaaacaacatcaggcaattaattctatttgaaaattaaaatatgagaggattttttctcccttagccgcttcgaggacgaagtgtacaacgcgttcaagcagttcggcggtggtcatggcgcatggaaccgagggcaggagaaagagcgattcgaagtgtacaaaacgatggcggaacgatcggccgaatttggacgcagcgagtaagccaatcacagcattatattccactaatagcattgcagggtcaccaataaaatgccaaaacaataggtctctaattagtttaattagtgccacgcatcgctggggggggggggaatttgatgggcagttttcataggaacctttttaatacctttttttgtttgtttagcattcaaaatcgaatgtccgctggcggcagctgttattaccccggtgaacgtccgttgagcacttacgccggcggcacaacaaatttggcacagttacgacagccgcgcattgttgacgatgggtacggtaacggcgctggcggcgccggagcgctaccgtacgatcggagacggtccgtatacgaaacggacaggaacggttgtacaaaaacttaattatgagaaatattttttgttgactgatttttaatttaatttaatttttaaaattattaaatttaaacttatgattaaaatcaatttatttaatttttttaaatttaaccgattctaataattttaattttgaaatgcttttcctccccaggcaataatgacttttctggcggcgctttcttctcgcagcaccacgcgccgttgccggagcccgactcaccgccgggcggtgccggcggccgataccggcgccgaattggcgccacactgcgcgacgcggacggacgccgcgcggcgtacgcctcgcgctcgcagtccaacgaccatttgtgcatgttgccaaggacatacgacgaatatgacagcagcggagcaccggcatactacggtaaagcgaaatacagtactgctgggtttgtttaatcgtcat

SEQ ID NO: 12512 - DNA, 2037 bp, Heterodera glycines
atctaaatggagaaaagataataaaatttataaaatgttccatgaaatgataatgaacgcattaaacacgcaccccgacacatgacgggtcaagcgagctcaattgcgattcgccctgcgatgccaacaaacgacgggtctgttgcggcatgggagctacgtacgggaagaacaaatggttggttagaaaaacatgatcatatagaatttcaattaattcttttgagaaaataatgtaacacataccaggatggttgacatcgtagccgatctgtaaaggggaaaaattagtaactaattaattaggatttatagaataattatcatgaaaatttatcaaattaaccgcaaattcaaagtgtgtgtggagtctttttaatgttaaacccattttagtaattgcgtatatttgttctgtcttttatcttaccacaagcacatttccgctttcgagcgaaaagcgacggcacgccgacggctccatcaccggcacgtagttgaggccaaagttcttcatgttcagcttgttcaggatgttctccagcgtttggcgctggttcttccgcacaacgtccttaaaaagggagtgccattttgtcgtcggtcagtttttgcgaaatccatcgtttttttaaaccgccgtacattcgctttctccagcgtcacatgctgcgtggtgactttgtgcattgcctccgacagcttgagcagtccgtgggtgtccttgcgcttttcatccaccagcatgatgaattggatgtgcttgttgacgcatcgctcgaacatcgtcatccattctcggtccgagttcttgacaaggaaaacaaacattaaaacatgtcatgcaaattaatggttgccttttttcaatcaccagacagacaaatatttgagttgaaattgctaaattcgaaaagcggttttttctttttttatgtcagaattacagcagcatcaatgtagttggtgaaaagacaaaattacaattgtattagcgttttgtaatgaattgtaaaaatctgctgatgatccagaaaaggcttgaaaaaattgaaatctttgcttgtaagattcaaataaaccactcctgggatcgagttctatatcccatcccaagttaaaagatatactgggcaacagtatgccatttttagtagttttgttcccaatttgttactcacatccgggctgttgaaagccacaatctccggctccgcaatcggaatgcccttttcgttgcccatgcgacccaaacgttccacaaactgttgggcagtgtcaaaacggttgcgtgcacaaagcaccagccagttggccaattcttccgtcttcaaatattccgcacggcccgcgtcacggcgccagtcaccctttaaaagcgcaatttaaacgattatagctaattgtaagattaattttttttaaataatccgactaactttttgcgcgtcgggacgcaacacacggttacgactaaaacgaagctctggcaatgcgcgaacaccaatcataatcttaaagtgtaagatatcaaataaaaaaaattaattaaatttataacagggtattaagacagtgagccgtagacaaaaaaggctttgcaaagtagttgaaaattaaaacaaaggtttacaattagaataattaaaactgggtaaatgcattagttttactgacccggttcgacttttgatccacagagatcccaaatgctttaagcacagggttctggtcgttgaacaatccgagcgcacgagcacggtcccaaatgcgtcgcatgcgctcatccggtttcatagagttgaatttgagcaactggtccatcaaaactgggtcagttttctcacgagggacacgctcaaatgggaaatttgtattgaattttttttaataaatgtgtgtatttgttatcttggatgaatgcgtgtattggaccctaataataccaatttcctagaaatgtctgatggtcaatttcaattcgggttttccaaacgaaaaattagtctgggtaaaaaatacgtaaataaatttttg

SEQ ID NO: 12513 - DNA, 1551 bp, Heterodera glycines
  misc_feature (109)..(109): n is a, c, g, or t
gccagctgaaatttgtcagaattggagtgtgactataatggcaaataaaattaattggctgattgctaattgtaagaaaattttgaaagaatatagcaaaagccatatntcaataaaaattcaaatttgaaaacgctggtgctacttacagtaagcagctcgaagcagagattgcggttcagagcacgttggccactaaaaaagacggtacaaagtattgcaactagcaatttcataaatggggtcggcagaaagagtcacaaacgttgcagtaacgaaaacattgattttttgcaattcggtacaaaaccattttaactttcgcactaagattagtgtcctttatctttaggcatgtttttgttttgttttaattgtaatcgaaatcagcatacaatgccacttactcgtccctgcccctcacgaggcttttgcctttgtccatttctccgttgcgcttcttcaccggcatgcgctcaatatcgacgtcgtagaagtacgccttggaaccctttgccacattgatggtccaaatggagcaaacgccctgacgcttgcgcacctgcgtcgccggaggtgcgggcggaggagcgaactcaaatgggaagcaacgaaaatggattgtcttgtcttcaattcggtaactccaatgcacagcagggtgcttttacttttgacaagcccaagagttgaggctctattgcactttaggctcccaatcaatggccattttgattgttagttcctaggccataactttttctttttcataatcaaggctcacattcttggtatcaaacgaaagtttgaggtctattgaacattctggtctaaaagcaacaacagattttttgaataactcgaaaaaaaagaatttgattaagtatttgctcttttcttgtatttattaattcttgactttacgctttagtttgatgccaagaatgtaagctcttaccaagtatgaacaaagttatgtcaaaaaaactgaggatggtccattgattggacgcctaaagtacaataacttaacaattgtatcagtcggtttttaatttgtttaaaacgacgcaatttgattgtaagcaactcattgtcggtgtgtaatttttgactgacaatgaatcccgtcttttaacgggaataccaaaacggaattaaaaattagttatttcgccactatagcgccaactccagtttgtagctaatggatctccgaaacccaaaagtgatgtcaaacctcgccaatattgccccgttcagcccgcatcggcggtggtccgccgcgctgctgctgctccggcgggtaataatcaccgccaccgctgtcgggcgacgaccgttcacggcgagctgagtcctggaactgtggacgaccgccaccgcctcctccacctaggcagaaaataaaagtaagtccaaaatgggaaaatttgacgtttttgggggcttgctcttaagctagacttttccagttcaagactgaacccccccccccccccccaaaggcaagcctaacactttttttgtgcaaggttttttgatattttt

SEQ ID NO: 12514 - DNA, 1608 bp, Heterodera glycines
aatgaattaaaaatacaaaaaaaaatgggggtgcccacaatttttattttctccatttttttgaaattattctcatttggctttctctttgtttttgttcgatgcctatcgaatagcagcagaatgggccatttctaattttgccattaataattttgtttaaaaaaaaattaaattttcaacataaatgaattaagtaatttattcggggttaattaaatcattttcaaattattaaaaaagtattgaataaattctaaaaatcaaatgacaattagatatttcttttcacatcagctctaatttaatgaattcatcatgtcattttgctcacttcttccgccaaaatttgaagggcgggcaaaatcttaaaaatttataattttaattgttaattagttcgtccttaattacttgtttggccaatttgtttatgcccttttccgggtacacaaagccaacataatcaccattgaaatggccagatgtcagttccattgtataaacatatcttattttaaaaaataaattgtttttttatttaacatattttcataatctgtcttaaataattcgagtcccggatttgctttttatttattgttttatggccttttagcgtgaaaaatagattttgaagttgcttggaagctttaaaatttatttcatgataaatttcgctgaattcggggtttttaaccaaaaaatgtcaacttttgaaaaatatcaaaagaaaaaatgtaggaaacacaaaagaataaaaattttcaaaattctacgcctaaggataatgattctttcaaaaaattaccgctaaataaatacaattaaattaattaattatttaaatactttatgttcacactttgcgcataatcacggctactcccggtcgcggcatctgaagaaaaacccaaaaaatatatccaattattaattaaattaattaattacgcacataaaatttcatcaccacagccaactttaaagtgttcaccgcccgctttttcgatggcaatggccatttcatttccaactctttgctaattgtaaaaaatattatatttttaaataagaatatttaatgcaaatattaatagtaaattttcaaataggatttttgggaaacttttttaagttatttttattttttcaattcaaattattgggcttcaattagaaataaattgccaaaatctttcaaattaatacaataacaaattaattttttttttaaatttcaaacgaacccattccgttatcaaactgtggttacagccatgcatcagcacattactgtacgaatgcagcgtcaaataggcatcaatttgtggcaaatgctgatgcataaagccggctaaatttgcacattccggctccgaaagcggattatccccgtgaaaaacttcgcttaaaagaaaattataaataaatttaattttaattttaataattacacaaaaataaataacccaaccatttaaagaacgcggaataagatttaaaagaaacactcaaattttacaaagtaaaagcaataaaaatttatatcccttttaatttcccaaaaattttaggaaattgcatttttataataacattgattta

SEQ ID NO: 12515 - DNA, 1907 bp, Heterodera glycines
attttgcagaatttttttaatataaattaaaatagggttcactaattgctttaaaaatttctaaattggaggtaaaattcaagaaagtttaactaataaataatcactatattttagtcagtcacacaatcacacacattttcgtatagtgccaaaaatacttttggcttttttatgacgtatgccagagttctatttttttgaatttttatgattttttacaatcaccgttttatattttatataactttcagtgacggacttcaaaaatttatggagatgcgagttttttgggagcaacgaaaaatgcaaatgtttgcaaaatgggaaagtcaccaataattttctaagcttaaattacatgggcgtttgcaaataaatgtcaaagattttaaaagttaaatttaaaggatcctccaaataatctgcataaatgcaaaaacaaaaggggaaaaataaatgattgatggctttttgcttcgctgcgcggcgcgagaggatgcaaaaaaaacatatccacggattagggaaaatgcccatccgaagggattttaattagggcggcaacttcataagggagtcgaataggtttggttcaaaggactcccttcctatcggcttgggcttttgcggtaaaaccaggtttggggttggggcggctacttcaaagactgtactccttcataggcacgggatgggcgagcgatacccgcaaccttttgacagtctgtgcaattttatatagggcatatatttcactgataattaggtatttcatttcacatcagcactaatttaatgaattcatcatgtcattttgctaacttcttccgccaaaatttgaagggcaggcaaaatcttaaaaatttataattttaattgttaattagttcgtccttaattacttgtttggccaatttgtttatgcccttttccgggtacacaaactactcccggtcgcggcatctgaagaaaaaacaaaaaaatatattcaattattaattaaattaattaattacgcacataaaatttcatcaccgtgtgctcatagtcgtcagggtttacagatggaatctcataaatatcaagttggtcgagaattgaatgtaatattgtcggttgcgagctaaaaaaaaatataattacttgattaaactaattaattaaacagaatcaaaatcataggctttttccaacttttctggacttcttgcgatcagttcactcgcggatgaaaaaattcaaaaaaatatcattattatcagtgaaatggcgtcaaatttgaaaaacttaataatatttttgtcgaaatgtcatagttcaaagtggacttggtcgttttggcgccagcctattgtgctatgactttttggtatcattcgaacgcccttcacattttaatttggcgcatgctttaaataaaattgtaattttcttatgagcaaaaatttttgatcaaaattccgatttgtaaagctacaaattttccggtggctcctaaaacaacccttgtttcccaatttttttttgaaaaaacgcgctgtaaaaaaaatgtaaaaaaaaatcaaaaaagagtcattattatagatgtcaaaattatgtacaaatatgtatgtaacagggatgggccaaattgaaaaataaaaagtgaaatgcgaaaagcgaaatttgcgaaactggaaaatgcgaaatgacaaaaaaagcgaaatgcgaaaagccaaaatatgcgaaaatgcgaaaagcgaaacgcgaaaagcgaaatttttttcaaaaattttaccaatagtaaaatcatagattttgtggtagtgatgcaaaaaaaatcaaaaatctctgcattttccggttcaatctttttctcacatcacaaaaaaggaaaattttacccctttaaaaccaagttaaaa

SEQ ID NO: 12516 - DNA, 3906 bp, Heterodera glycines
aatgtgccttctttctccattgtcaacttttcttgggttcgttcgttcaccaattcaaatggcacaattggcaatgacgcggacatatacaaatgaattgtgtagcaggcagaagaagtgatggcacagagaaatgcctaaacaattgaaaacgaaaataaaaattgtacattttttaacaatatggccagtaagggcgtaattttcagcaaattttttggaattttaagcaattttttttaacaaattgcattaaagttttcgaattttcccggcggcgcctaacgcaatttacctttgaaaaatagatgctaaaatgacaaaaaatagtcattttttgcgaaaaatcgctataaaatcctctcccccgaagccaagagttcgtagggatccttcccgatcgcttttccaaaacctttggaattggtcgtgatcccttcaacccctgttgtgtccggttcactgatcatcccatcagggtacaaaaaatgggaattaattgaattaaggttcagatcggtgagaattgttggtgaaatgagccgacgcaaattgtccaaatgctcagcatttgaaatggtcaaatggccaatgtttggcgcaaaaatgggccaaatttcacggacaaaaacattccaaagcggctggacagagtcgttgtcagttgaggatatgtacaaatccaatttggtgcctttgtcccaaatttgcttgttggcacggagaaatgcgacgacggaatggtcgatgtaactacaaaaatgcggttttactgttcaaaatgcctattaattgaatatggctaatatctttaggtttttgccttttaggtttttataaattaaaaaaaactattttcaactatttagccgttttgcccaaaatttgttacaaaaatgttataaaaatgaaaaatatacccctaagaaatgaaaaatgttcccaaaaaattcatttccaaatttattacatatcttttgacaagatttttatttacctaagcctacctatttttggcaatttttagggcctaaaaatacacataagccctattaatgaattacttaatctgaaggttgctaaagtgaattttgctgggcaacggacggtcgggcaatggaaatggcacagaattggcataacttttaaacacaaatagtttcgcttttgttcccattttgtcaattttgatccgcttccaaattgtcaattcgtttttgccatcaaaatgtttgtccaccaacacatcgaaacgtggcgaaagaagtgccaatttgaggccgagttgagcatggtcaaaacagggcaaaatgtccatccaaacgtcgttacaaatccaactgataataaaataatcgaccaattacgaaataattaggtaatttttatttgtgtgatccccccccccccccccttgacattttcaagtcatttctagggtaatttgtggcgctgatcagtgatcacgaatgcgaacttttcgaacaaaaaatcgaaactatattttccttgtaatttatgaatttcgaatttttgttcgggtcaagggttttgaaaaataaaggtcatttatttgaaatttcaaggggggggggggtcataaaaccgaaaagtaccaataattgaacggaattaaaatttaaattaaatttttcaaaaatttttctcacatttttcttaaacgacgacgttccattttgcttccaaaggatgatgtcacaaatgaacccggcgaattgctgctgattttcaccaattgctgcatattacttttatttggttgtaaaatatatttttacgtcaaaaaatatatacggttttaattttgaacgctgaattttgaataggtaaatcatggaatttagaaaattaaagatgaaatgcgaaagcgctgacaatccttttaattggtctggattttaatcactagggatacgatttatagttgctaaaaagtgccaaaatagttagtttttagtttctaaaaaacccccaaaatgctcagggaaaaaatagtgaaaaaactataaatcatatccctatagtgaaggtgctgatgtccagcccagaatatgacgaagggacgagggaaattagggattggatttgggggaaaaaggaataagccaaaatccgggccctggataaatgacctccccaaattggtaatcccatgggcgcctactagatctaatacgcgtgcggggatgggcgaggagtaaaataataatataaatattggccaattacattaataataattccgccgcgttctgctctcggctctcgctcgccgattaactgcccgctcaactgacccttatcgagagaatgctcccgattaaatagttggacttatggaacggaaaatggaatggaatagagcggagatatgtgcttgggaaagagattaaacggatgtgattcacaaaatgtccccgtcacttaataatgggagagggaaaagtgtttttttataaatcaaatttaaaaaaaaaactcactgaagcagttttttgtacttgtagaatttgttgtcggcctgccccatttccaccacgtctttcaccgcgtcaatgcgaaacttcaacgcgcccaaggagtgaacatgaacagttcctggtacttatgtcgtttacagaccataaaaaatagtttttataaaatcatacatataaacatttttagggggttttcggggtcgctgatcacgaatctaaatctatttcggtcaatttcgaatccccgacccgaattcgaactaaaaaccgaaaattcaatttgcgaatttcgcatttttcgtctaaaacggctttgtaaaactatattttgtatggcctgtaaacaatatacctaagtaccattctctcatgccaaatgttcctatcgccaaaaaaggaacgttcaggttaaaggttaaacaaactcagattaggacacccagttttttttcaaaattctgcagacccctaaaagctcggattaaaagttatattcattttcgcttttattttttattcattttaatacatacaataagtacagaggcatacaaaactatacatataaatatattcattcggcaatgagaacaaatgagcataaaacattacataaacaggtcaaacatcattatgaaaaagccacaatatattggcatatttaaacagaacaacaaccatttgtgggataaatacattcagcaagacaagcaagacaatgcaataggatatggccaaaatcgtgaacgctaaatgaaatgggtgacacaattagaagacaaattgatggttaaaaattaaaatgagaaaaaaactgggaatgatttttgactcgaaatgcggccatatttatacactttttgagtgcggatgttcattatggcccgcgcagtgcgcccatttccatcacagtacgtttggtacagtcctggcagagattcgaagctgggcggcacatgcgcactggtcgatccctcaagaaccacattacgggtacgcaagcgcagcggacggagatctgtgattgccttgctgagaacggtgagcagtttctatttaaaataagaatgagttcgcgtaaattgtcagagcaaaacaccccaaaacgcccaagttaatgtcaaaaattgttgggtcgttgggtgttggctatttattttgcttttgggttatttattaatggaggtctccagcgccagcctggcgccaattccgataaaaaatgccgattattaatgactcagtgttaaggaagcacttttgattggaaatgtcggatgtcttctcaacttccccaaatttacctttaaaagtgccgcccctctcccatcggttggactccctttgtcggctaatcaccttctcttttggctacccatgcaatgcttatgtgataatcccttgg

SEQ ID NO: 12517 - DNA, 3878 bp, Heterodera glycines
tcgttcgctgatcggctgacttttgctggtcctggccataggtttggccgaccggctgagtgatcgggaaggctgggaacatgaaaggggcgatgcccttgcacgcctgcacccgcgggtatttggcattcggacgccgtccccgtggcactctgtgggaggattttgatagatatgattcattgcattaaaatggtttaaaacaaattcccatgggatgaggcgggagggggggagactcagagtttgacggcacaatgatatcattgtgccgttgccatctgttggtcgctcttctgacagtgccaagggattgtgccacattgctcgctcgcccacctcgaagctgccagcaatgcttcaactgagaatggcatcgtttttcctttgcctccgtccgccgctctctccgtccccgttgaactgcttcttctcgtcgtcccgtccatctgctgcgtttggtcatctccgcctccctccgccactctttcctgctgctgtttctgttcgtctgctgccaatccgtgcccacagtgttctttcttgcgccattttgccctaattaatcggcttttcgtcctaatttatgaaatggataaaatcactcaccttcggttctggaaccacacctgaaatatttaaacaattttttaactttgcaaaatgataaaaaaagtccccccccgccgcttttccctttcattttgcaattgcatttcccttttttttgtttttcctcaattactgtgcctaattgcttcatttcgctttccaattttcaaattataacccttgcttctgctgatttatgataaattatccccccccccccctctggcgttttgcgccaccatcttttgccctttttccgccgattgtttcgccccgggggtccaattggcttattattcgattatttgtggctaaatttggcccatttgtgctgccttatctcttcggcgcatcttcgccactcataactctttgccggtcgaaatccattaatggcccatcaaattgaatgaatttgtcatccatcgcttccccccccccccaacaaatctcactcattcgcttaaaagagtgaaggaaatgcaagaaatgagatgggagaaacaatggaaagaaatgaagagaatgacgaatttggaaaatgatttgcataaaaagtggtgattcattccccccaatttagcagatttaaattggaatttaaattttaaaacaataaattggccacctgcactcgcgactccagcaggtcaagccgaatggcaagtgcttcgcgcacgtaaaccttaaaaaggcattttgaagaccaataaataaattgaataatttattctttttgcattttaattggcttttcgtacgtccgggtaatggctacattcgaatgcgctttccaactcgttcagctgccaattggtgaaatttgttcgcgttcgacgcctttttgtcgttgtgtcggacgctgaacaattataaattacatatccatttgaagagaataatcattttgagggtatttagccatggccaatgtccgtcggattggccatagcagtgaaaacatttgcctcttcaataattttgcattacatgccaaggccaatgagttgaatcgttcgtttctcttctaatttaacattcgatttccctgatgctaactcacccggccttccgccctctctgccattgtccgcgttattcgtttgtttcggtggccaattttccgtcgcattcgccgccggaggagtttcagtaccgttcttttgctgctcactttcgcccttttgctgctgctgttccgtcagcagaatgtttggcaatgttcgattttggagcagcacaaagcgttcgagaaaagcggccaacgacggatgggccaaagtatggtcaaattggtcgacggaagtgccaaaatgggcgaacggatgggcggggaaaagggcggcgttttcggaggacgaagaggggccaacgacagtgcaattgctgatcagctaattggtaaggaaaaaaatggagaacggacggactgatcaacaacaatgagaaaagtgtattaacagaaaaagaggcaaaagggcttataaagtgtttaaactttaaagtccctgagaacgaaaagaaattcgaaagtaagatagtattgtaagtaaaagtatactgtatgaagtgtttttttctcaaatgcggacatacattctgatcagaagcaattattttttaatcagaacagaagaggtgattatttgactgtctgatcaactgatttgatctgcccccggccatttaccatttgctgctgcgtgtcctcgtcaaagcgcggcagttgcggcggcggtgacaaagccgtgcccccgtccgccgtgccgttggactcggacattgacgccgacgatgtgttgggcccattcacaatactttcgtcagaactgaggctcggacttgcattcggatctgatccaggaagaaagaaaattaaatgcaatactcttaaaccattcattacgcgttgaagcgaatgaattcgccgtttggcatgcgccggtgccattgaaaagtgtcgccgcagaaaatgcgggcaaaatttgctgatcaaattgttccaattgatccttcgcgatgccattctgttgtatttgttgttgttgctgctggaggttcaacaacagaagcaacgggttcagctgcagaaggggcggcgacgacggcgaaaggccgtcgttggcaattgccgaaaaatccattggaattgtgaaaaatataaaaataataattataaaattaagaaatattttaaaaggcattaggtaaatggagaattttttatgcaattattcgaagacaaaaaagtggcaaatggccttaaaaaagaaatgggcaaagtgtccatttgaatggtcaatgatcagtgacaaaagttgccactccactccaatcacttctcccattttggtgggatttgtcagagggcaaaatgaagaagaaaaaaagatcaaagcaaatttaccgccaaagagttaattactccgtttgatgggaatggcggattattagcaaaaggaacaatttttccatttgcttttacacccaaaacaaagtgaattttcatgttaagaataaatttttatgcaaaaagaagtgacattttacagcaaaaaatataaaatgataaccattttattatatatttaattttgctgattttatttttattttcttaatttttcaaattaaaatacatttttataaaatggagtcaaatccctgctctcatctcaccaatatattaagaagataaattaagaatttgaacacatcggtcgaatataaaagaacgaatgattggattatacaaaataaaacaaaacataccgtatgaccaccgaacaacttttaaaaggggttaagatgggaattgagctgaagtttggttggcggggggtgccgtcacggcaaatgatgcggtgggacattggcacttttggggagatttggcactctttctgcttctgatggggtgggcgagggcaagggtaagcagattatggcctaaaacatttaacggatcaccccgtggggaattggcgcaccctccgcacaaaatgggcggggaatggcaaagaatgggggaaagggagaggaaaagcagccaaacgacaagctaatcgctcaaaaacacattcttgaattgtaagttttaagtttaattataattcagagcggaaataaatttttaaaattaaaaatgattttaaaattctaaatattctttcatttttgagaatttcaataaattaattacttttaattatattatgttaaatgcaatggaaaatgggaaattaccaaacaatggaattaatggg

SEQ ID NO: 12518 - DNA, 2281 bp, Heterodera glycines
actcaattatcaaataaataaaaaaaactataaataataataatttaaaataaaattgaccaaaatattaattgcaagttattacttcgagcagaatattaaaattctatttttaaacaacattaattcaaaaaataagacaacaaaatttggaccaaattttttgtaaaaaaaaaaaaatgaaaatctaacttgccgacgaacgaccaatttggtcttcaagaaccaatcattaatctagcctttctcgaaatctcgcgttccattttctataccagatattcgggagtccaacgcaaaaaatattggatttctctctcccctaaaaggtgcccggtttcaagcagtctctgcgccgatacttcctcttcttttcaccggtcagcaacatcagcatgcagggcacaggtgccggtgccgcgtgcggtgtgccattgcctgggatcaatgtgcatgccgcttggtacaacaatttggccaagaaacagtcatgtggcaatggtggtggtggtcatggaagaaatgttggcatctacgtcaatggcagaaaagtgggcgccggtgctggtggtgccattggcagcagcatagacgccagacggcgccaatcggtggcacagattggcaccactggcacggcaccaacattgaatgatcatctacagcctcatcaacggcatggaggaggacgacgagcaataagcacggtgaaccccccagcaggtagtcaaagctgctgggttttgttcaagactcttgagagcttcatacgtgaaataatttcggctattatggggctttataagaccagtgatttctgggctataaaccagcttaacacaggataaacctggatttggttattttgggcttttttatgataaatgcctgatcatgaagcctgtcctcgggttttttggatgcctgatcaaacttctatttgaccctaacaaaaaaaaaaagtcataatccagaaaatttgggttttcgacttttgttcgagttcggcttagggattagaaatttgttaaaatagatgtcagattaatgatcagggatcccaaaaagacttgggaacgagaatttcataaattattaccataaaaattttttgcaaaccaaaagggtacttccccccccccctttttttttgagggtacactctttataattaccgttagccaaatttattattaaaatccatttttaaattgaatatataaatttgtttttgttttttcagcatttcccatcgcaattgtgcgcgagtcgtcgcgctgtgttggcgttgcgcaatttcgtcgccatcaaaccgagtcgcaaccattgaaacagcaaccacaaatacatcaaaattccacagaaactgatgaaacagtggccgaagaatgtgtggtagacagaatgccaccacagcaacaaatttctaccgaagattcatttgacacaaattcatcatcaaatggtaaatattggattaaaaagtgctttcataaatttatttatattacatattttgataaataatttttattctaacaaaatttatttcaaaaatttcatgctaatatattacaaaatattttatttcaaaattttaattgaatatttataaatgttattttttttatttttaaattcaatatttattaaaactatttaaaaatgaattaatttttatttttaattattaaaaatttaaaatgaatatttataaaaaaatttttaatttttaaattaaaattgttcaaaattaaatttattaatgtttcattatcttttatagaaaattgtcgcatttgtcctgaagaagctgatcgaaaacggtccgggcaaagcattgcaagccgaatgtctgtttggagcttgcgcatcttcagcggacaatggagagtcagctcttttttttatctttaaaaaattttcattaaaatataataaaaaatgtacttcaaaaatttattattttttcaaacttgatgaaaatttcctcccagttcttgacaaaaaaaaattttttgacatttcttcccttttctcttcctgacacgtttttttttggggggggggggggggggggaaattgtcgggtaaaagttgtgcttttgcacgtagcggaaaaagccgcacttttcgaacaggtcgcgcaccggggctgaattactttggcattttgtttcgacaatttattttaataagtaaatgccgcccacctttcgctgctgcaaaatacacagaactctttgctctcgcatttcagcgaaaatccgttgatgttttt

SEQ ID NO: 12519 - DNA, 2322 bp, Heterodera glycines
  misc_feature (2284)..(2284): n is a, c, g, or t
ttaccgtatttattgaattatagccccgcccctgaattagagctcccccccctctgaaataaagcccctttctagggggttgaaaaataaagcccccccctctgaattataaagcccctctctgaaataaagccgccccccttatgaggggggttgaaaaatagagcacccgggggctctattacaataaatgcgataagtcccatcccaacccaatccaaaaacggattttttgattgcctaaccgggccggatatatgaatataaaggcaaaaaacttgtgatgattgttcgttcacccgtccgtccaaacacaaatgacagctaacattcccagcaaaaatatgatcggaaatgggcaaaaaaaaaaaaaatcaaaaacaattttaatatggaaatttatgtgcaaaaaattattatggtaaaaatgatatctaatgagatatattaaataaaagataaaaattttaataaatggatgatttaaatttaatttaattaaggaataaaagcattcactaattttgccaaattctttacaattaaattaaatcagcccaaaaaaattcataaaatattttaacatttttagtgaaataattagaaatttcttgtacaaaattaataatttaattacatgtatctcaaaaataattaataaaaaaagtatgaaccatttaatggaataagtcgacaaattttcaataaaaacttggcaaggttaacccaaaaaatggagactcattaagggaatttgttataaattttaaaaaatttaaaatatatccttaagaattttacgcaataaataaaatcaaaaattcattgtgtgccaaaatgggaattgaacttgaaaaataattataaggcaaaatcgctgacaaattggcaaaaaaaaaaaaaattttttttttcttttcgatttgaaaaacgatcgagaaattctatttttttttaaatacaaaaacatttatctgttgaatcgctttaatgataataatacataataaattcaaatattttttttattttaaaaaattattcaatttttttcgcctccgtcatggcattgctgctgctggtggttgccaaactgcgcttcttcattttgcccgaaatatatgagtcgtagaagaattgagcaaacaaatacaggtatgaaagatacatcagaccgccaagagacaaaacattccaactaaaattaaaaacaaattaaatttcactaattaaataaaattattgtaatttgttgccaattatgacaccaaccaaggacgtccttgttgtcttgtgaaattaatatttttgacaaaaataattcataacttagctcaagagtaaacaaattttaattcttgatatcattcgatagccataaatattctctatttgcctgcaaaatttcaaatttttgttgagtttcgaaaaaaagttatggtcagaagaactcaaaaaatcaggattttcaaacattattggtcataactttttttttttgaaactaaatgaaattttttgaaattttgtagtttaatgaaaaacacttaagggctatcgaatgatgtcaaaaaattctacaaacaaattgcaaacgctagccacacttttttaacctccaatgatcccatttgatttgaccattaaaaattgtttaataatttaacaaataaataaaattattttcgatttaatgtttaattgcatcacctcgcatcacatggtagcacatccgtgaacttaatgtacacaatgtgggtgaagatgtaaacggagatgacaaattggagaatttggatgctggtgatgaatttggcaacaatgcgtgggctccgaattttcattgcttggaggccaaaataactgaaattttcaataaattaaaaaatagttttaaaaatttgaaagggatttattgaaatttcaggttgatcaagcattattatacataaagtattttcggaaaattatttattaaatttttaaatctttagaaatttttcaattttgaatttttttaaaaaacccaggagggaaatttcagaaataaataaattacttcaataattttgattttttaaattcaatataattaattcaacccctaaaaatgcactcacaaatacatgacagtgtgcacgctgaggttcaatgccaaggaccaacggcaccacgcttgtttctccgcataggttatggtggcgtagaggaaggtgagcgcatggtggtaccaatgcagaaagatgacgggacgcttgcggagaatctggaaacaaaaaattanattttaaattcagaattagaaatttttttaatccctta

SEQ ID NO: 12520 - DNA, 1225 bp, Heterodera glycines
tcttcggggcggaactgaaattttttatccctttaggactcaaaagacggggactgaaaaatacaaaataaaaataaaattggggcggggtaacaattttgaatatttttttgcattaaaattagtcgtttttaaattactttcttcgaagaatgtttaaaaacggcttttgggtttaattactttgggctaatttttcaggactttttcggatttatttcgtgcttttttggcatttttatgtgactttttggttattttttcatgacttttttgtattttttgtgactttggcattttttatgactttttcgtgactttttggcgatttttcatgactttttaagtcgactttttgagatttttcgtgacttaaattcccatccctagttatgaagaaaggggttcaaaaatagcatttctacgttaaaaatttttgatctggtgaagctttttagtccacataaatccatattttgggggtttcgggaatattttgcgtttttagtccatattttgaccattttttggaaaatttcacaaaaaaatgcaaaaaaagcgaaaaatatacccctaaagatagaatttttagaaattttttaaaaatacacccccctaaaaagagaaatttttcggtattttggcaaattttcagatattttgtccgcttccaaaaattgagtgtttaaaattaaatctttttcagtttttagtccatgttttggtccgtatttggccatttttgagctttttaatccatatttcgagcatttttagtccatagtttatgtaaatagttgacgctttttagtccatataatttcgagccataaaaattacgaaaaaatcaaaaaacttaaaaacgtaaatactttaataatttaaaaataataatgaatggaaaacacccagaattaatgggactttggatcgcttgtttcaaaactcaaaaaaattaatttttttataaattctttagatttgtataattattgttttattttttattttttgatttgattaatatttaaacttattttaaaatttaattaaaataaattattttttattaattttaaataaacgattattttattttataaatttaattaattgacaaaaacaaaaaaataaattaaaaaagcaaaataaaggtgaattattttcactcaacaatgagtagaaaacacacaaaattaatgggactcgaacccatgacagcata

SEQ ID NO: 12521 - DNA, 1953 bp, Heterodera glycines
ctttatttttattgaagcattgttgacttttagttgttttccttgttcttaagccggttttgaaccaaaaatgcaagattcgaaaaatttgaagtttcgtgccggtaggcgccgccaggaaaatttttgaaaatttgagtgcgatttgttatcagattttcaccaaaaaactgcctaatttcttgcgattttaagccgtgtggcgaattttttttttaatggttttttacgaaaattttattgtctatttttagtctatcgtcaaacttctttgcctccacacattgctgtgtttgaacaatggactgcacaaattctccattctgaagggcaataatgaacaataacaacaacaatcaatcatcgcatctttgatatttttgaacactttttaactgtttaagaaataatcgtttgattttgccaacttttatcatttttactgagatttgttgggtcggacaatggaccatttttttcaattttacggtggtaatttgaaaatgttttttaaaggcaaatgtctgttccaaaatcgcgtccctttacttgttttgagcggctgaagtctacttttaatgtcgcccagggtgacaaggtaacagactcctctttttacaaccttccaatttcgcatttatgggcggctatttattattggataattcaattaaaatccttggaccattcgaagtacatacgccaaaatttttaattgcttggccatttttgggactggggcacggcggtgccgaagtaaaaatacaaattttgacaattattgtccaattagtagcccatgtgatctattagcgttttgtttgaaccctttgtcttttactcgatggcgtttggatgccaaatgcaacccatcattagcatcccccgccttattctcttatccatcgccaaagattagtttggtctctcacctcccctttcgtccgtccctaatcaatggacgatgaatgaccccttccccaccgtccatttgccttcgtcccccgctgttccttccccgcacattgcccaccacaaaaagggcgcactttcccccaggggagtgtttgctgaccctccggtttggtcacttttcggatcggttcgctcactgagtaagtgagtgacctttcccaaaaccgacatttcttatcgccgtcgttccgtcggatgaatgcctttcggtcattgcagaagttttactttagctttgatttgccattctttccccatttttctttcgaaattattcctttttattttaaattttcgcttctaggaggacagtgacgagttgcgcagtgcccagtcgagcagagcgtccacctcccgccaacagtcgcaacggaaagagacggcggaaaaacattcgcaggaaaagcagccccggggacacaacgagcgggaggagcaccaattccctgcgcctcctccccattttgcgcacccttttcaattcgttttcacgaatcgacaaagcgccaacacattcagtctcagttcgggcgcaaaagtcgacgagttgagcacgccggaggaagagagtgtggtcgatgaggagggcataaaagagggagagacgacggggccgccaaaagtgccgccactgaaattggaggaattgtcgccggagggcaaatcgccgtcggaagtgaaaacattttggaaaatgtgcattatgaaaagcaatgaaacgttcagaccgatacgtataacagctcattgaacatggacactgtgctgatacgagaggaagaggaggaattaaaaaaggtaagcaaaacaaaaaagacggtagaagcatactttaggaaaagcatgtcatactgtaatggcttcggcaatcccaaatattcccttgaagaaatcttctgattttggaccaaagtttatgttcgcaaaaaaaatttacgaggccgaaatgtccgctatgtcccgagtaaattcggtcaa

SEQ ID NO: 12522 - DNA, 1986 bp, Heterodera glycines
  misc_feature (150)..(150): n is a, c, g, or t
attttgaaaaatcacctgaaaattaaaaaaaaattttctcatataatttcaaagaaattttttctaatattttttctagaaaaatttctgtttaattttttttttttaatctactcccgggctgtgttttgtggtgtaccatcccttcangatatcaaaaaattttggatcatcaccatccattttcgtgccattgatggcataactttgaccatcatggcacatagaattttaccaaaaacaacgaagactcgggcctcggcggacagatcagtcccgtcatgctccaagtttcaaatgccactgtacgtgcttcacaattaacccatgacaaaaattttggctttggttcgtaaaaatggggacaaaactgaaaccggctcctctaaacactactttctcgaccgctcggtgctacgtcatttcgcgacaagtgcaaaaagggcacttcgcgacagtgcaaaaattgggcacttcgcgaaaaatgcaaaaattgggcacttcgcgacagtgcaaaaatggtgtaaaaatggggcgtttcgcgacagtgcaaaaatgggcacttcgcgaaacgtgcaaatttaaccgaaagagaccgggcctcatcagtacggtgtctctttgggttaattcccaaataacaacgaaaacatgcaaaaaaaaatattgtatactaactaaattacaaaataatattattaaaaatttgtttttttttgtaaaaataaattaaaaaatgaaaaaatcaatgactttactccctattggggatatacccaatgactccctcccattgggcatatacccaatgactcctcccattggacatatacccaatgactcctccccattgggcatatacccaattctttccttgccgcagggcatataccccaagggtgtaacttgtttctgaaaagacgagagtgagagttaggcgagaggcgagagtccccaaaaagacgagagcgagagtttggcgagaggcgagagtccccaaaaagacgagagcgagagtttggcgagaggcgagagtccccaaaaagacgagagcgagagttcggcgagaggcgagagtttccaattcttctgtggccttattttttactccaaaaaagtttcattcatagctaaatatgtaaaatttaatttttcgttggggttttggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggggggggggaagagggcttttggaggtgatatcatgacttacgctccgagagtagtgtgctgttttgcccgtccttgcgcccccgaaaagcttcagacaaagctgaagcgtcgactccttctggatgttgtagtcggccatggtgcgtgcgtcctcgagctgtttccctaaaaacaaggattacgtgaaacatttaatatcctggcatatcaagcggatgtacccgcgaaaatgatgcgctgttggtccggcggaattccctccttgtcatggatcttcgctttcacattctcgatggggtcgctcgcctcgacttcaagggtgatggtcttcccggtgagagttttgacgaaaatttggaacattatattttgtttcaaaatgatccggtgtgcaaaacgtaataaaattgtaaa

SEQ ID NO: 12523 - DNA, 1485 bp, Heterodera glycines
  misc_feature (1467)..(1467): n is a, c, g, or t
cgaaaacgaaacacgaaacgaaaaaagaaattttgaaatccgaaaacgaaacacgaaacgaaaaaattttgacggacgaaaacgaaacacgaaaacgaaaaaatagccattttcgtacgaaacgaaacgaaaaaaccgaaaattttttaaatatattcaattttaattaataactttaaaattgtatcctctaactgagggaattaagatcctagtaggtggaaaagcggatgtggctctaggacaggggtatgaccgaaaaattttcaaaataagaacatcaaggacaaaaaattattggaaattttacgaaattggaaaaaaaagtttttgtgataaaaactcaaaatttttacgatttgaatagcatttcgttcaattttttatgaaattctatttaatttccaattcgcaaatttcatttgaaatgaatttcgttttaaatttcttaacttttttacgatggatttgtaaattttttcaaaattatagatacctaatttttgtgaaaaatcgttagcaaaattcatataatcggttaaaaagcgcaaatttgttcgataaatctgttaacaatttgcaatcaaattaaaaaaaatttcccgccggcgcctatcggcaccgccggactccaaaaactcttgtttaatgttcgtaataaaatttagaacgaatctatattagtattttagttaaaaaatatggtttttattgattaaaaacttttcaaaaaaccctgatccgtatacgggtccgtatttttcctgcatacggacttatacggagtaagggttttccggggttttagtccgtaagtctgtagtccgtatggatgcctagtccgtagtcctgatcctgatccgtattttcgccaaatgtcgctctctagaaaaaattatcaacatttcaaactttacatacaatttcctgtcagatttaatacaatacttcaagaaatatcttattttttcttaccaaaaaagtcattcttaagggtgtaagtattttcgtctttttcgtccaattttgctctgacgaaaacgaaacacgaaacgaaaaacaaaattttgaaaaccgaaaacgaaacgaaaaaactttggtagacgaaaacgaaacacgaaaacgaaactcaaaaagtgccgaaaatgtaggacgaaacgaaaacgaaacgaaatttcgtccatccctgtttggaaaggaaattacacaaattttaaaaagttaaatgaataaattaaaaaataaaattttaaatactgaaataattctacaatgtgtatgaattgaaaaaaagcaaaaaaaaaaaattcaagaatttgctggtgccgtcggacgaattggacattcgcaatacgccggacggcgcgtgccgcgtacgaattgcgcagttccgcgcagagcatgtgggcgaatatttgtgcgtcgcgaagaacatttacggcgtggcggacacgcgcgcgcattacnacgtggaggcaatgaaaa

SEQ ID NO: 12524 - DNA, 1700 bp, Heterodera glycines
acgggcgactgcactctttttggtgcacgaagcgaacgagtcggacgcgggcgcataccgctgcgtggcgaagaacgcgcatggcagcacgaacagcgcgtgccaagtcagcgtgaaggcattcaaggaggaggtgaagaaccatttgacacgagactcacgagcatggccataataaaatgccgtttaagccgaagaaagagggggccgagccgagcttcacccggggattggtggaccaatacatcgaaagggtaccattgggaggaaattgggataaataatatttaaataaatgatttaaaaataattttaaatgaataaaaatataattagaaaataatgttgcgaatttaatgagtgaaagtgaagaaaagttttttcgttttcttattttattgaaatgaatcaaaatttaaattacttacagaggtttatgggatttacctaatctttttccagggtgacactttggtgtttatttgcgctgtgtcgggtgatccggcgcccgaaattaaatggttttgcaacggcaaactgttgaagccgtcggacaggtgagcagcgaaaggaaagggcactcgaagtcaggacgggccaaggatttcggcttgggggaaaacacccgccccgggcaacgactttttttttttgcttttcccaccactttgcggagctttttccaaaaaacttttcgggatataggggggccgagggggaaaaattgagaattttggctatttagcagattttcttcaaaaattcctgattttgtggattttctgacaaaaaattggtaatttctggattttatgaaaaatttactaaattttttggaaaatttgtgtgaggcaggtcttggagggggtaccaacaagaaaaaccaaaaattttaagcaaaaatactatttttccttaaaaatttcgcatgcggaggggtcttgggcgggggggggggggggggggtgatattcaatcttcgagtcactccgaacctattttactacaagccaaaagaaacgatagtgctgaacgaaacaaacgttggcgtgataaaaagaatgaattggttggaattgaatttgaagaattccaggaaaaacaacgcaaaaaagttgaaaattggcgtaaaagaaaaatcgaagaaggtgggacggaattagaaaaatttagagaaaatgaacacaaaagggtaaaagaataccgtaaagagagaatggtgaattaaaccttgcggctagcgaccaaagaaaagcaagtttttattctctcaaaccttttaacttaaaatgcaaagcaatttattttaatgaagagcttcccggatcaacaaaatcagttggtttgtttaattgttgcaaaaatgggcgtttaagtatacttcaagattttgttgaagaatatcccgaggaattaaggaaattatttttaccagaaaatccaaaaaaaaaatttttttaaataatatacgtcggtagaatagagtttcttcaatctccttataattacgcatttgctttggcttctctaagttgttttcatttttcttttccaacacctggaccaccttgctttaaaatccaagggcaaatatatcacaaatttaatcaaactgcgatgccattcagcgataacgaagttccaactaatggggcattgtattttattgatactaacgaagctttaggaaaccgatgcaa

SEQ ID NO: 12525 - DNA, 1497 bp, Heterodera glycines
cgcacatcagcgtcaagttggccgaccaacgagtgcaagagggtcagccgttgaaattgcactgcaaagtggagggcgtgccaatgcccgagttggtgtggtacaaagacggcgagcaggtcaggccgtccgagcgcgtgcagttggagcgggacgcagacggcaccgcgtatctgatcattcccaagtgcacgatggacgatgatggggtaggagtggcataattcttttgctaattagtcaactgagactaattaacgatataaaaggtgtaccgagtgatcgcaaccaacccgcacggtactgcctacgataagtgtacggtgacagtgaaaaaggcggcagcggaggagggcccgacaaagcatgagggtgccaaggagtttgaagcggccaaagcgccaaaactgttggaaccgctgcaaaatgtgaaatgcccggagggcacggagtttgtgctgcggtgccgtttctcgggcgaaccgacgcccaccgtcaaatggtgggcaaaaagagaaggggaagcggtcaaagggttgctaattatgcttttcccctttcttcaggttcaaggacggcgaccgactgtttccctacgagcgaatgcaaattgcggaaatgtcgccggatggctggtgcgaattgcgtgtgcccgcctccatgcgttccgattcgggcaattaccgatgcattgcggagaatccatacggcactgcgcgtagcgcatgcgaagtgaattatgggagggatattggcatattggtggtgaacagaaaaagccgacaaatatccatttggacaaaaaatagtgattaggaaggcaactgatcaaagtgattgatcaattagaaaaagtttaataataggagaaaacactccgttggcccaatgttgataattgattagaatttggaaaagatttgaaagtgatcaatatttttgcaaattttggttaaatttgtacaaaaaaatgggaaaaattgactggcagctcgaattttaatggaattaattacatttttattgtttgaggtgcaagtgcaacgcgaaaagaagcccaaagaggacctgaaagagttggccaaggaatttggccgtgccccgggctttacaattccattgaccgtaaaacacgccaagccgggcgacactgtggtgggtattctgttaattatgctcatatactcaaaacattgtgctaataaatataattaaattcactcattgtcataccgtatcacaaaaacatacagtaagccgactgatcgaaatttccaggtgtttgaatgtcttccgtacggaaagccgttcccggacataaaatggatgaaagatggcattgaacttgtgccgagcgaatgcataagaattgaggcattgccggacggaacgcaacggctaactctggacactgttgactttccagcggaaggtggccatttgtcgggaattaaatttaaattttcgaaaaataggttactattcgttgtgtggcaa

SEQ ID NO: 12526 - DNA, 4347 bp, Heterodera glycines
ggataaatattttttatttgtttgctacctttttcaacaacaattatatttgcagctggtatttcttcgtttgcattacatacaataattgcggcaacttcatttgtttgttggacattgtaccgatttggatcaaatcctttgcgtaaactcaatagcattttaatttcttgtgtttcgttatttttaatatttgatgattttttttgttcgtctattacatttttcatcattttataggctttgcaaaaggataattttttctgagagatgattctattttttctgttaatgtaacatctaaattatgagaatctaatctaagattttgtgcttcgttactatcgagaaaatataattgcccatttgttggcaaaaaatttttgtctaccggttgtgccactggattatatttatgataaacctgtcctgatattttaaaacaacttggacccggagttgtaaaactaaatttattacaggctaaagaagcgcatgcgaatgaattattataagctcttatatttttcataaaagttttcgaaatttcattatcttctgaaaataaatcttttaattcagttggatattcagcaaataattccaacaaattttttgcttttccaaaattgcaacatgaattaaaaccattctttttttttgaatttgtaggtttttcttctaaaaaatgcattgctttgcaaaaggtacattcaacatttaatcctagcaatgaaaataattttacgtcagtaaactccgctccttttttaaacaaataaccgattggtaaaagtttcacggtctgttcgaattcattgctttcgtttattacatccaaatcaattttatccaaatctatcacattttcaaattcaatatttcttttagttttctttctttcattaatatgttctacctcaaaacaatccaataaccgtcggatttccagaagtagatagattaatattttgtaacgaagatgaggaacattgctccgcaggaggaaaggattgcttagttcgaaccattatgaatttaaaaaataaacaacattaaaagaaaatccgatttaattatgatgttaacatatgctataatcaaaaattcgcaaatggaaagtttaagccttttttattttttaattgatataattaataattatcggaatttaaaggggtaaggctttagcttgattttatgattttttagaaggataattaactaacttaaatttgaaaatttgtctttttgtgattttattaaaaagctaaaaaaggaaaaataaaatacattttaaagtagtaacacaaaaaatcgaattcaatgagataaaaaattaaacttacaacaaactatattatgaataagaaaaaagaacaaaaaacgaaattataaaaataaaaaaacacaaaaaatggattaaaataaataatatttaaattaattaaaataaatataatttaattatgttaatatatgctacaatcaaaaaacgcaaatggaaggtttcgaccttttttaagctttattgataaaagtactaataattggaatttaaaggtgtagggctttagaatgattttgtgatttttttgaagaccaataaacaaatttaacttttgaaaatgagtttttttttaatttaacgaaaaagaaaaaaaaagaaaaaatatacagaatagatatcacgaaaaaatgaaattgaatggaataaaaaacaaggcttacgggcggagcttcgcctcacttaatatatagcaagggattagttttagggaataaaatattccattggaaatccacctcagttaattgtttcttgatccgttcgaataatttttctccgggtacgagtttataatgtctttattcatctcaaaacttatgtcaaaatttcggtctcgactattcatggctgcaatttttaagttgttatgtaatctcttaaaattcttcactaatttgcttttgaacattttttcaattccattttgtttctttctatttaattgttcactttttatttttcaatttacaaattttttttaatgtgaatttttattttaattactttattcaatcatttaaattgaatttcactccattcacccttaaattgaatttcgtatcactcctttatcacaaaaagtcattttttccatccgtttattaaatgccacagaaaaagcagtggtcaatcaacagactttttgttgactgcttaagttaatagaggggccgcggttgtccatcgtccaacactttttgacacaaacggcggtggtagcaaagcaaagttccgcgtggaaattgaattatgtgccgcgagtgacaacgccgccgcccccccccccccccccaaaaaaaagtgggagcaaagggagagagggggcgggggacttattctgctgctcttccatttttgtcgcaaaacgcttattgaatttggcacatcagtgaaagcacagcaaaaacagcttttctggtcaaaagtgccgacactcgttgcgaaattgaatctgttgatgaagctaaacccgagaagaggcggaaggagagactgatgaaacagatggccaaaagtgggatactttagaattttgtacatataaaaaaaaattaaaatgccaaaaagcggctgttaaatttgctttttaaattgtgctttttcatttgaatgttgcctattccatgttgccacacattgtgtgtacagcagcaaaatgcgtagattgaatgtgtcgataaacatctgttcatgcttaatgccgtcttctcgtcataccccgggggtgggattggcggcgcacacaaacagataatttgttgttcgagagcataaacgactactgatggcacacacacacccaaaatgccgccaaaatgtgcgttttgtttgtttgcgctttggctcgtgccgctctcccgatgtcgccctcatccctccccaaaatgccatctatccccttaggcggatatcctccactcctccggggtggtaaggggaagtccttccccaccccctcttcagcttcatccatcatcatctgctgttgatgccgttgtccctaaacccccaagaatgccttcttgtcacaaaaccaacaaaaacggacaatacgccccctccctaaaggcactcgccgcccaataatttttaattacccccttttatgcaaattaaatgacaaattgttttcctcaaaattaggggcggcctattttgagaaaaacaacgcaatgatcattcaaaaaaatcatatttttgtgattaatctttcgcattttccgatttgccaataccaattattaggcttaattgctgaaagttttattttttttaatgcttttggtgtaactgacaaatgaacgattcacttaattatgatgccattttcattattttcgcgcatcattagttttaagatatgcccggaaattgcctcgggcgatataatattaattttaaaaaataattaaaaatttcccatgggatggaaaaacaatgattggaataaatatgcttgaaaggaggaaaaatgtttaattaaatccaagcgaaaaaatatttattcgattttaatgacacacatttaaataataaattttttattttcgtttttccatttttggccttcttccgaaaagcctctcctcaatgcgattcttgcgagcacaaaataatgcgactaattatgcaaaataattacgcctccggcgacattggccattcggcttttcccataaattctcccctctttttcctccgtcccaatgttttcaacgattatctctaagtgtttcgaaattagtcagctaaatttcctaaaaaaaatcgtttaatgcgcctcttagcccattcatccgtatgaaaagatgctgacactctttctgtgatgaacaacagtgtgccaaattgaattttgccctgcggggacgacggcacaaacgaaacgaaatcacaaaatcattagccgctgccttaagggcatgaagacgcaaatgccgaaatccgattttgtgccgggcgggcgcagctgagggggcacggcacaattcttctctgtttttttttgccgcgcacttttgacgagaaaaaaaaacgccgaatggcaaaacgacgacagaattaagcgcaatttgttattttacgttttgtcaacccatgcaaaatgcgctgaacaaaaacagtgacgaaagaattggacaaaatagacacagcagagaaagctaacggttataaaattttgaaaatttgaaaaattttacactcaaacagacggaggaggaggaggagactggccaaactgatcaattcagatgctaagagtgagtggggcgatt

SEQ ID NO: 12527 - DNA, 3813 bp, Heterodera glycines
  misc_feature (3678)..(3678): n is a, c, g, or t
tcaaatcaaatcaaatcacaattcgattcttcacataagtcacatttattatgattctgttatttcttcgactgtgcaattgactttattattggaaaagaataaattctaaaattttatgggaaaatcaaaacgaatttcgcaaccgcgtcaatcaggagaaaatattagaaaattaaattaatttatatttgttaatatttattaaaataaaccaattaaagtgcaataattctattgtacattcaattgcattttgcttttatagttaagcggaccgggcccagtctagaaagccccttttcgggtcggtccgggttcctgatcaggtacttttggtgcctcgaatgggctccggtgggcctctggaaaatgaccgatcgaatttagtttttggatcggttccggatgccgggcaaatcgccaaacaatttctcccggctaaatcgaccccttggcataacccggtctcggattccagaaatcagaatccggaacttttcctggtccaccgggtttttcgtgaaactccaatagtccctcatgcctcctgggctgtactccgtaaatgattaatttggaccgaatattgctgcttccttagaaatttgattttaaatttcatttaaataaaattttgtgattcacatcgaagattcaatttattcacatttagtaacacaaacataatagagtctcaatttgcgttccattctctgttccgtctctcctcctccgcttttccgaattgccatctcacaatttctgtgcctttattcgcttttcggtggcgcaccgcgacggtacaaaatgtcgtagtgaccggggcggtaaaggaagaacagtttcggttggttgtcgccctcgacgaggaaatcgtggtgccaaccgccgctgggagcctggcttcggtccatgtactcaatgcgaatggaaacacctgaaaatggagaggaaacagagaaaaaacagagggagggagggaagatgggggggggggagatggtgaggaaaaaagaaatgatattcttgattttttttagagagaaaggattatattattagatagcatgccataagataattttctgactccttgttttacctttctcgaaaaattgattcacccattcaagctcgttaaggttaacagcatgataaacattgcccatttgttcgtaaatttcttcaattttcagaagcgaaatttgccgttttgccatgctgtgggtcgacctttcttgtaaccacttgccggagctaaattttttttattaataaatgtttattttttgctggtcaacataataaatttcatagaaacaaatactcaaaatgtcattttaaacagtgatcgaaaccatttttacatatttttttaaatcaaagcaaattcaaaaaaaaaattactgaaaatccatttttttgtgttgaattatcaaaaggtttacttttttcattttcctgctgcggttagttcataagtgacaaaagtcggtgcgccgtgacacgggcattttacttcagcggttataacatgccgtgtcgctgtatttttgactttgttaacttcgattttgatcaaagttttgtttgagcatgggcacgggcaaaggtactcttcaaccattctttttggatcactaaatatgaactgaaattattttgcccttccttccgagccgcccagcctggggtcctcttcaaagaggggggggggacagaaatcgaccacccgcccccttaaattaataattaccattatcgaagaaatcgtctgcccatttttgacaattgtaccatattacacaatagcccctcaacggcatgtcagcgtatacgtcattcagagtttggtgacatcgcaattttttggttcgaacgattttgatgaagtttccgtactctcccaacctaaagtgttggattttcatttttggacaaaaaactagccaaaatccctaaaaatttcccgtcacaaaaatccattattttcttaaaaatgagctccaaattaaaaaatggaaattttttctgttagttaacatatgtattgcactcaatttttaaaaaattttccggcggcgcttgttggcaccatcgtctcccactttttccaattgttaaaaatctgatgttttttgacggatcggattccgtaagattttggtgacacccctggtcacctcaaaaaaaaatttaaatgtttacattgcgctctttccttttctgctgaattcgtacgttacgtgagttttttggcgcatgtcttgcacaagaatgtgaccacagcacaatggtgctttggagcaggcgcaatgggaagcatgtcatatgaggtgattcggattttgattgcggtttgatgttcgtagatatgacagaagtggtcattcctccaaccgccagagtgtgccaatgtgtcgggcttcaaagagccaccggagctgctactgctacttgaagagtgggaagacatttttgaacagaataattggcttaaaaagagtaatggttttacgcaaatttttataaaagcaatgagcaaaagaaaacccaattctcaagtaattttagatttaaaacgacctttttttaaatagccacctaaaagagacacgaaaaaaggcatctaaaatgcatgaaaaggacaaaaagtagggatgtgcgagaagtgatttttactgggaaccgagaaataaccccggaaacgataagagatccaaaaaccgagaaatttctcgactcggaaatcgagaaatttaaatgaaaagaatccaaataaatcaaaaacacattaaaaatggggtaaatcaaagggaatttttgcgtagaagtctcagaagtctcaacattaaagtgtcgccgttttttgctgttaaaaacgctttttgcacactttttacacaaaaaaacttgggaaacatgagggtccgacggtgccggtaggcgaggattctgatcgaaatttggggaacaaatgaataagcaaatcgtaattttcagtgcattcgtgattcaaacggctttttttgcggcatttttcaaaaaactttttttaggcttggggagtcagggtggcaacatgaagtttgggcaccagagggagggatttaaaaaaataaaacaaaataaatatataaaatgttatataaatcattaaaatttagtaaattttaacaacccttgtgctcaaaaatttctatgttattgaaaattaaaaaatttatctatggaaacctgttcaatcttattatttagtcaattcttacggttgtttaaacgcatagttaaacatgtatttagtttctgtttggacttagacctgaatacccagattagttggccccgaaataacaagaacccgtctaattttgtttaaactcataaaattttagaacccgtctaattttgtttaaactcataaaattttaagtcttgaacagaccgagccttgcaatgttataattataagttataaaatacatatgttggcattgatatagaatgaatggtaatgaactaatgagtttagcaaaataagcatgcttaatcgagtgaatattcgttaaaaaattttctattcctaacttgattcgacttgataacagattttcaccaaaaaggccaatttttgcatgacaaattttaggtcaacttttgaaatctggggaattntgtggcacggcgcgctgaagacgccgaccggaaaatttttaaaaatgtgtgtccagggctattctgggtcgctgatcaagaatacgacatcccatttcgatcaatttcgaaccaatgaaccgaattttaaaaaaa

SEQ ID NO: 12528 - DNA, 752 bp, Heterodera glycines
aattaattctatgctagtgagaatttgatgcatttccatctttactcttctccgccccttcagcgaaacaaattttggagtctaaacaattttgtgtaaattaagtgggaatgttttgacacataaagaaattgaaatttaattccacaataaatcaataattcatggattaaattatcgattaattgcctccaaagcatttcaacctaacaaatccataattaattcattaattagttaattgagcacagattattttttgccaatttttgtcccttttccttgtctatttctttctatgcgtggttttattttttgcaaatttcacaaaacatttttgctctttccgtcgaatgttctcccatttcgcattcatttgacggagacggccgacattttgtggggtgtcaaattgggggggggggaaagattcccactcggaccccacccaaccacgagttcgagcagatcaatttatgtgtttatgtgaccaaaaacgagcgacccccaaattggttgaacctttttgatctgaaaatgcaaatttaaattaattttccgacaattcggagaattatttcaaatatgtatcagttaaacaatgatcagagcaaatcagcaaaaccccataaacatgcttttcttgccattcaacttaaaatttttgcaaaatgaaggatatggctatgcctttgccattaatttccccattttcccaggctgaccaatggccaagcaatctctgaccttaa

SEQ ID NO: 12529 - DNA, 2456 bp, Heterodera glycines
tccttccgcctctcatcaatgttttacaaatagtgcgtactctcttcgcttccccttcatattccaaagggaggaacactttcgaatcaatgggcccatggattattttgatttaaaatattattaaattgtctatttttgagattatattactttccagcaccgttagtcagtcaaccctaaacgaattggccatggacatggaaagtgacccgggctggcgatacttacgccgcacgcgcgagcaaattttggaggtgagcaataaaattaaatagtccaaataattaattaaagccattttaggaccaatcgcgtccctatgacagcaaaaagaactgttggattccggacccggaggagggatatttggcgggagagatcgtatctggaaaaggggaaaaggttaccgtaaaattcggcggtgggaacgaggtacggtacatgccggattgatttaaatttgattaaaaagaacggcacttgcagaaaacggtgaagcaggaggaaatccaggagatgaacccgcccaaattcgaaaaaacggcaattttattattaatttttaaatatttttaaatttatttttaggaagacatgtccaatctgacctttctgaacgatgcctccgtgctgcacaatcttcgcgcgcgttatggggcaatgctcatttatgtgggctaattttttattaaaaaagctcaagcacctgcttttagacctattccggcctgttttgtgtggtgattaacccgtacaaaagactgccaatttacacggactcagtcgcccgattttacatgggcaaacggaagaccgaaatgccgccacatttggcaagcatttaaaaaaataataaaaccaattaattcatttgttttgtaatttaatttttttgccatgagttagagcatattatgaacaaaatatagaaatgtttttctcttttattcatttaaatattaattttaagtttgctgtttcggacgaagcctaccgtaatatgttgcaaaacgctgaaaaccaatcgatgctaattactggcgagtcgggagccggcaaaacggagaacaccaaaaaggtgggcgaatttgaaaatcagccattacaatttcatcaatcggtctcatctttctctgtttctccactaatacagttctgctgatcacttgcaggtgatcgcttattttgcagcggtcggtgcgtcgcaacagcagacagccgatggcgggagcacgggtccgacgttggaggaccaaattgtgcagaccaacccggtgctggaggcattcggcaacgccaaaacggtgcgcaacaacaactcgtcacggttcggcaagttcatccgcatccacttcaacaagcagggcaaattggccagctgcgacattgagcactgtgcgtttggcatttaattgtttgtttctttatgaaaaactgcttcctctcgagaattaacaagaggcattctcgaatatcacttactaaccaatcaagttctactttaataaaataaataaatgccaaattttcttctgtacgtgtagatctgcttgagaaatcgcgtgtcattcgccaggcacccggcgagcgatgctatcacattttctaccaagtaaaaacctcaaattaataaagggtttttatcaaataacagctcccaattttgttcagattcaatccggctttttgcccgatctgaagaagcaattgttgttggatttgccggcaaaagattattggttcatcgcccaggctgaattgaccatcgacggcgtaaatgatacggaggagcaccaattgacccacgaagtgagtgaagtttaacattaattcataaaatattttttattttaatattcaacaatcactttgaatcctcacactttttattgtgaattttttaggcattcaaagtgctgaatttcacggactctgaaactcaagacgtttaccgtttggtggccggcataatgcacatgggtaagttttaaagtgatcagcaaatcatgttttgaattgcgagtattattctcatatttaaaggctaatgaaaaaaagagtaaggcttgaacgatttaggcaatatgaagttcaaacaacggccccgggaagaacaagccgaggcggacggaaccgaaggttggcattttgaagcgaatgttgcaactttaaaagaaaattttagaggccgagaaaaccgccagaatgtacggggcgaacccggaggaatttatgaaggctttgctgaagccgcgtgtgaaagtcggcacagaatgggtgagcaaaggacagaaccaagaacaggcaaggcaacccaatggcattggcatttaaaatggcaacaattgatttggacaggttgcctggtcagtcggggccatggccaagggactgtacacgcgcattttcaattggttggtcgtaaaatgcaatgtgacactggtaaacaaaaa

SEQ ID NO: 12530 - DNA, 3063 bp, Heterodera glycines
  misc_feature (2879)..(2879): n is a, c, g, or t
  misc_feature (3053)..(3053): n is a, c, g, or t
tttttttaatggtatatggtaagaaaatgttcaaatttttcattgaaaattttttaatttttcatttgggggggggggacgtggtccctccccctctcttccccccccgggtcgggcctgttcaagagcaaacgtttttcgagttctctcggttggtagtaaagctccaaaattaaagaaaaaaaggagagtatctttcacatagctaattaaattcccacaaatttttcaattaattaaatacaatttttttttttttgcatgtttatgaaataaaatttaaaaccgaaataaaatttgccacaacattaaattcactaaatagccatctatttttttaatttgcattttcaaaattcattcattggcatcagtatagaaatggcgtgtccaacactccgttgcccgatgaaacgccgccctcattgttgtgcatgttcttggtacggaccatgttaccaggctgttcatactccagcacttccccggtgttcatgttgccaatgaggtatccgtaaatgccaagctcattgataacttcggcaaactcggcccttttaaagggccagaccataaaattctgtaaaaaatgtgtgacaataaataataaaaaagagaaatcggaaacaaaaatatttgaactcattaatgaagaagtcaaattactttgtaaaattttaaaaattttattaatgttttaagtctgtctacctgctgttcataattattaaagacattttttttttgcaatttataataatattcaaaattagaaagaaatgttatgaaaaattaaatttatttaattagatgaagaatatttctcctaaaataaggaaaaaaatttgttactggatttttcagggtctctgatcaatcactatagcatctatttctacaaactctaaattccttaaaccgagaattcgaaacaattcgatatttcaaaaatttaatccaaaagggtccctcacttttttaattgacgccttgataaacactcttttaaatttttctttaaaattccaattttatcaaaattacctttactgtcaccggattaatgcgctccatcaaaatatgtgccgcaagttcacttcgagaaaatttgcgtaatttttgagaaatttcttcgccccaaatattccctccaccgccctccttgtttggctttagcacataacgctcgggatgggcaattgcatccttaattatacttaattaccaaataaatcgaaaatgcaaataaaaatgaatttgaataatttaaaaatataaaagtaaaaaagaattgcataggattaggaatttagaaaaataaaattctattgtttaatcgatgcgaaattttaaagaattatttgcaacgataatagtaaaatagattaactaaaatagattaattttatgttttattaattttcttttaactgttaattatcgttaatgcgttaattgcataattacctgaataattttttgcgtttcctcgtccttattctccaatccccacagtttagcaaatgttgcacgaattgcgtcaaccatttgttgttcgctgggatctgtgaaaaatcgttcaaccatcccgggcttggcaagcaactgaaatttttaattgaacaaaattaatttaaattaaaaaaaattaattaaaaaaatacttgttgaatttttttcgatgtgctcaattcaaagaacaacgaagtcgctttctgaaaatataccaaataaattacgaattaattaatttaataattacaattgctgttgagcgttcaatcattcgcaatgctgcccaagatttaggcccaaatgcgtcgctgccaagtcgcacgagattccaatatgcaacgccaattggacgaccgtccaatcgaagcgttaaatcatcgtcaagctttaaactgaaaaaaaaaatttatttatttatttaaataaattctgtgcttaatagtgaatggcaaatgcgattattggcttttaagcaaatgatttcgaaagaaaagcccgaaaagattagcataattcgtaaagcgataatttacaaaatttgttgggttttaaaattgttattttttctgattattatgtttattttttaatatactcatcgattttttgcatgtgaatagaccaaaatttgtgcatcattttgtaaaattaagaaattgtctaaaaaaataattttttttttgcatgataaatttatgaataaatatttccattaatatatttgtaaatttattcattcggtacgatgatttaatttttacagaaatatgtaacatcaatgtctcgatcgagacctttattaaatttaatattaatattttaatttttttttttgaaattttcgcccttgccccacttttcaaagcattccacagttgttaggtgaacaattttggcacgtccaccggacaatctttccaactcatattcatcatatcgtttggagaaatgccaagtgcttaagtctttgacgaccacaaataaaataattgcacgcggatcattcaacaatttcctggttattaaaaaagaatgaaaaattaattaaataataattaatggagcgccagaggcggcagggaaaaatttcatatttttcaatagaaatgtcaaaggttaatccaacaaaatagacaacttgagagtaaggttggtcgggaccgggaatctttggcaaaaccgtgaccgggacttttttggttaaaaaaccgagaccttttggctggaaaaaccgggaaaaacccaggaatttcccggtcccggtcaaaactggtcaaaaccgggacctagatactcagttgtactcaggtgtccgtgtctaggtcccggtcccgtacaactctactcgggagtgaaaagattanagaaaaaacattagaatatacataaaatattatttttatgcaaatgtttttttaatcaaagaaaattttaacggattttcgaatttattaataaataaatcaaaaaccattgctggttcaaattttcattttagcctcatcttgtttttgtggctaatataaaaaatatataanttttattttt

SEQ ID NO: 12531 - DNA, 1750 bp, Heterodera glycines
aaaaaatatcttttttttgcatgataattttatgaataaatatttccattaatatttttgtaaatttattcattcggtacgatgatgtaattttacagaaatatgtaacatcaatgtctcgatcgagacctttattaaatttaatattaatattttaatttttttttttgaaattttcgcccttgccccacttttcaaagcattccacagttgttaggtgaacaattttggcacgtccaccggacaatctttccaactcatattcatcatatcgtttggagaaatgccaagtgcttaagtctttgacgaccacaaataaaataattgcacgcggatcattcaacaatttcctggttattaaaaaagaatgaaaaattaattaaataataattaatggagcgccagaggcggcagggaaaaatttcatatttttcaatagaaatgtcaaaggttaatccaacaaaatagacaacttgagagtaaggttggtcgggaccgggaatctttggcaaaaccgtgaccgggacttttttggttaaaaaaccgggaccttttggctgaaaaacccgggaatttcccggtcccggtcaaaaccgggacctagatactcagttgtactcagttgtccgtgtctaggtcccggtcccgtacaactctactcgggagtgaaaagattaaagaaaaaacattagaatatacataaaatattatttttatgcaaatgttttttaaatcaaagaaaattttaacggattttcgaatttattaataaataaatcaaaaaccattgctggttcaaattttcattttagcctcatcttgttttgtggctaatataaaaaacatataattttatttttagaaaaattttcattattcaattggacttcttcgaccatcgctaaaatacaaattattcatttttctgcataatcatgactaattaaaagcaataaaaaaaatcaaaaaatatattttaataaaatgactgaccaagccttgtaaattattttggcaattgccgcgcccgaacgattttcgggcaatgcattgctgatcatttggtcggaacaacctgtgtgtttgagcattcgctgatgaatgctcaaaagccgatcttggcatcccgcactgccaattgagccaccattaacttcaatctgaaaaaatttggcaaaaatatttataatatttttaaatttgtttcgtgaaataataaattatcgtttggtcgacctgctttagttggtagtttggttgattggactttgaattagtttcagctgttatcatataatcctaaaatagagaaataaaataaattatataattattattatataaatattacttaaacttaaaaaaaatttaaaaaaaaaatattaaaatagcttagttatcactgatctgatcagtcagtgacaaaagtaattacaaaactcggaatacctcatttaaattgtatatttaaaatccatttgggtgtgtctgttttgatgaacaattttagtactttatttataaaattttgttgaaactcaaattatgtgaatttaaatttgaactgaccgatcgttgcaaaaagatggaaattggctgtttgatcccttcctttttaatatcttccaaaatacccagcagcgtccgaacagacgtatctgattcaatcacatctttataggccatttttaaaaactcgaaatcggatgcaaatcgaaaatacagcagactcatggcctaaaatatatga

SEQ ID NO: 12532 - DNA, 1083 bp, Heterodera glycines
aaattattttcgagaattttttgccaaatatcttttttatattatttattaaaaatttccagggcggcgcctaccacgacaccgttgtgggctcaatgtttctaaatagacttaaaaaacatataaaattattattttgtattaaaaacagggacctcgaaagtccaaaactctgttttttaatgggggcataaggagccaaatttttaaaatttcaaaaaatggcgcaaaatgtagccaagactctcgtatattcgcgatggcgctttgggtcagagtacagtacaactcgccgacgccaacatgccgatggccgactcgctgacgctaagctcgccgataaattaagcaagaaaaaatgatgaaaaattaaaatttcttgatttcaaaaaaaaatcgaaaggcaatataataaaaaaaatttaagtcataatttaacttttcttggtattcgctcaacggcactgatcttatctttgcgtatagagaaagaagatatccattaagagtttgttcgccgcgttaacttttgaatttgtagcggattatacttagttgttactaaattttgtcgcaatttttttttttcaaaggtgtgtaaaaaaaacctaaaaacgctgatggattctactagttttttttttaaatttgttcgttcgtttgttttttcccattcaaagtaaattgcttagttagtgatcagaagcaaaatgcgcgcatgtgagcgaaatttttcgatttatgaccaatgtttctggcatttatttttttatttataatcctttttacaggaaaatttggttttaatttataaaatttgaattttttccacaatttttcttgaataattatcggcgagtaaactatcggtgcgtcgatgtccaccagctttcggcaccatctgaactctcttctttttttttaaaaacgcggcgaaagattattgactttgaactagagtgccactggaccgggaattttgggcaaaaccgggaccgggacttgtaaaaaaatttttaaaaaattcaaattttaattatttttttttaaagtgaaaataatataaacttatttttttatttt

SEQ ID NO: 12533 - DNA, 1332 bp, Heterodera glycines
agacactaatgtgtgtcatgctttgaaaaacattagtggttgttctgtgactttggtgtgagacactaatgtgtgtcatgcttttgaaaaacattagtggtttgttctgtgactttagtgtgagacactaatgtgtgtcatgcttttgaaaacattagtggtttgttctgtgactttagtgtgagacactaatgtgtgtcatgcttttgaaaaacattagtggtttgttctgtgactttcgtgtgagacactaatgtgtgtcatgcttttgataaaacattagtggtttgttctgtgactttcgtgtgagacactaatgtgtgtcatgtttttgataaacattagtgtttgttatttgagtttagtgtgacacaattatgtgtgtcatgtttttgataaacattagtgttcgttatttgagtttagtgtgacacaattatgtgtgtcatgtctttgataaaacattagtgtttattctgtgactttagtgtgacacaaaagtgtgtgtcatgcttttgaaaaacattagtggtttgttctgtgactttcgtgtgagacactaatgtgtgtcatgcttttgaaaaacattagtggtttgttctgtgactttagtgtgagacactaatgtgtgtcatgcttttgaaaaacattagtggtttgttctgtgactttagtgtgagacactaatgtgtgtcatgcttttgataaacattagtggtttgttctgtgactttagtgtgagacactaatgtgtgtcatgcttttgaaaaacattagtggtttgttctgtgactttagtgtgagacactaatgtgtgtcatgcttttgataaaacattagtggtttgttctgtgactttagtgtgagacactaatgtgtgtcatgtttttgataaacattagtgtttgttatgtgagtttagtgtgacacactaatgtgtgtcatgcttttgataaaacattagtggtttgttctgtgactttagtgtgagacactaatgtgtgtcatgcttttgataaaacattagtggtttgttctgtgactttagtgtgagacactattgtgtgtcatgcttttgaaaaaacattagtggtttgttctgtgactttagtgtgagacactaatgtgtgtcatgcttttgaaaaacattagtggtttgttctgtgactttagtgtgagacactattgtgtgtcatgcttttgaaaaacattagtggtttgttctgtgactttagtgtgagacactattgtgtgtcatgcttttgaaaaaacattagtggtttgttctgtgactttagtgtgagacactactgtgtgtcatgcttttgataa

SEQ ID NO: 12534 - DNA, 1279 bp, Heterodera glycines
  misc_feature (1242)..(1242): n is a, c, g, or t
atatttaattaataaatacgaatattttaatttaatgctagcatgaaaattcatataaaactttttgtccgaataaatacgacagaatttgttaccaatgcaataaataataaatgcatcaactaaaaagaaaaaaaaaaaaattctttcggacgtttttttgtatcatcaaattttcttcagcaacaaaaagcacaaattctttttggcacttttcgcttttaattttcttttgcttttgttggcacaacgacggggtcaggaagaaggaacagaaggagcagaaaggcaagtgtgcttatttgaccggtgatggccagaaaaaagatcagtttgatgtaagtgtcgtatccgaattctttctttgcttttcctctgttttttcgctttcgccgtcgatgtacaaaatttttttgttttccgccgttaaaactttcggcgaatttttggaaaatttcgtgctcaaaaatcgcctcgtcgagcagcatttggaccaggtcgctgggcttcagctgctggttggccttggcctccagcagtttgtcaatgccactttttgccttttgctcgggtgccaatgccttcgcacactctttgaacgatgcgtcaaattccgcaagtttcgccatgccctcggcattttgttcctcttgaatttgctcctcctccgtttgcatttgtgccaaaacgcattgtccggtggcaattagcgccgatttcccccaattttgtgcaatttccttcgcttttgatgttccacccgcgcacatttccatcattttttgccccatttcttctcctacacattcattggcggtctttgtccccaatttggccttttcccacaatttttctgccatttcgcaccctttggccaatgcccaatccatcgtctgctctgagaaacttgcgatcatttctaaattgcattttatttattaatatatatttaatatttatttttactttttcctccattgttttctatcgcatttattccataattttttaaaccttctgttgaagtgcattttgcagatgcattgtttattataaatgtgaagagaatgtaaaggactggaaaaagcattgaatcttttgttaaaaaatatcaaagtaaatttattttaccaaatttaatgggttcaaaataagttacaaatattttaaactttattttttttatctttttttgagatgaatagaaattcttagtcttgcccatgctaattagggaactanaataataattttaaaattatgcaattttagagcatcg

SEQ ID NO: 12535 - DNA, 771 bp, Heterodera glycines
  misc_feature (696)..(696): n is a, c, g, or t
tgctcgtgaatttcgccttcttcggaagatgaggaatacattttttgagggaataaatgaaaattttcgaaggaaaaggaagtgttaatttgtgcagtgcacgagaatggtcatttttacttgcaagtaatttggcaaacatttttatcatcgcattttcacatcatttacattttctaggtcattcgcaaaaaataattaatttatttgcctattttccttttttttcttgatatggcaaaatcggtccctttcggcgaccggcattttcttatctatttgtatatttgactgtcggattgtccactgtccgattgtccacctctgtccgattgtcctcactgtccgattgtccactgtccgattgtccactgtccgattgtccactgtccgattgtccgggagccaccacgaaaccccggcggatgatgcatttttaaattgggcaaaggacggcaagccaacaacggtttcgtcaggctcagcaggggaattaatggattttgaccagaaaatgccctcgtatttcgtctaaataattacaaaaaccggccatgcttaagatttgtgttccctgctggtctgacttgggtttgttgctctttttattgctaacaaaacactataaaaatttggtggccgaaagagaatttatcctttgagtcggacttacgtaatcccctcccccgcctcccnacattcacaattttccactagcaaaacaattcgacctcaaaattacttaagtttttactagtaaatccaaaaatg

SEQ ID NO: 12536 - DNA, 2077 bp, Heterodera glycines
  misc_feature (2060)..(2060): n is a, c, g, or t
atagagacatttcgatttggtcgatacagtgaaaacaacgaaattgatgaatgtgtggacattttagtggcagaaaaataaaaaaaaaatttcttgcaaactgcctttgttcatttatgcatcccctcgcaatctcgccttaaagcaatgtgaaatctgatggcccattcatgcaaaaaaaagagagaaagttgtaccatcccacattctaccttatccgagcacatacccaagctgttctattttattatggattgaatctggtcttaataacgcccacccccccccccgaaatgaaaatttttaaaaattttccagcaaataatggaaatttttttcgaattcccccccccccaaacgaaaattaaaaagtttaataggcaaatttcgtaacaagtagcactcaaatttccaaaaattttttccggcggcgcctatcggcaccgccggacctacatttccactatttttacaagttttttgccttaaaacggccaaaatttggtcatttttagtgaaaaagtgcagttgttacccagcagtggaaaaaaagttattggttaaatagcaaaaaaaaaaaaaggtcttcaggtcgggtcccccccccccgaaaaatgtttctagatacgcccctggttcatcgtgacattaatttcccgagactcaccacgaaaccccggcggatgatgcatttttaaattgggcaaaggacggcaagccaacaacggtttcgtcaggctcagcaggggaattaatggattttgaccagaaaatgccctcgtatttcgtctaaataattacaaaaaccggcaatgcttaagatttgtgttccctgctggtctgacttgggtttgttgctctttttattgctaacaaaacactataaaaatttggtggccgaaagagaatttatcctttgagtcggacttacgtaatcccctcccccgccttccaacattcacaattttccactagcaaaacaattcgacctcaaaattacttaagtttttactagtaaatccaaaaatgataacaaaataaaataagtcgcagagtttaacaaactcaaagtgaaaaatatttgaaaacaattaacgcatcataaaacctttctccaaattgcaattagctgaatttcgctttggagaagtccatctccggatgctgctccataaacctgaagtgtcaaaacaatcggtcatttccatggccttcttttcccgggccactcacttcttcagaatgtcctgcttcttcttctcctcggaagtgggcaagccgagctccttctggcgctggtcgtacatcattttctcgaccattgagcgcgtttcgccgtccaaatccttaaaaagagcgcatatttacaaataacaccaatggaaagggacacaaaccgaaagtttagagttttccggctgaacctgaaaaaattatcgaaatttatttgacaaaaagcaaacgaattccctggggaattgtggaaaaattgcagggaatgagaggcatttgcgtttttaaagggtttgtcccttccagtttttccgttctgcgtttctcttcccctccccaccttttgagtgtcaatttctgggtcgccttcgatcagtttgttccaccagtgcatttggttgatctgacaaaagaaaagccatgtaaaattaaattaaaagatttgtatgttttttctaatttttaaacggtggattcgttttgccaattttggctgttgagtaaaaccatataaaagataatttgcccactcgcacaaaatgtgaatgtattcaaaccttttcgagtgttaagtaaacgcagcgtttgtcttcgatcacccaagtcatggactccacctttttattgggaaaaaacaaatatcttactacaaatgaacgatcatttggcattagtttttctttttttgtgtgcgaaaaatctgctaaaaatttaattagcacggcacttaaattttagaaaattaaactaacaataaatagttttctggacttacaagcaaaaaaaaaagaagataaaagatcttcgaattcggatgcttttacatngtgcatattttttaaaa

SEQ ID NO: 12537 - DNA, 3260 bp, Heterodera glycines
ttttcgctatcggcccgtaaaattaaaaattcacaatagaagtctaccctcctctatccatccaatggtatataatacatatgcattttccgactaacagttcgcgaggttcccttgtaaggattaaacgcaccaattccaagtcgggattttccttcagaagcttaagagtcgcctttcccattttcgaatccaacggctctttgattccttcgagtgcttcgatgaattcgtctctgttccgctgaattccattggatcaaaatgcaaaaattcgtaatttgcttcccaccggtctggagaaggatttaaaaaatgatttaatgaggaaataaaaatgtaaaatattaactgaacagccgaattgttcttcaggtgaaccccgcgaacataaccgtaaagagaaaccgaacgcgacactttggggtccgaacgaataagcttaataaaggaaaagcattcgtataaaaaatgaatgtgagttccacctcggggtcagtgatatcctcaaatcggtcacaaaacacgtagggatgggaattgcgccacaaaattggccttaacttggccacagaaatgaaacggccaaggtttttgatttcgtgttgaaggtaacgctgcttttgcatcccggtgaggtaaaacaatttggcaccctaaaagtgattaacaatcggttacattcgcatggtagacatttcgcacttggtaaagttcggaccaaaagcgatttttcaattgcttctttatggacttcaattgactccgtttcggcacattgtccatgtgagtgagtactccaatcacttttggcatgccgtgcacttggcaaatgttgatgaactcgaacacttccatttcaaagccgaaagaggcgtcgatgagaatgagggcctagaaaatcgaaagaattctttatccaaatatccacaaaaaccgaccaaatcggcaatttttgctgcgtcgaccatggcatttatgtcatttggcacttcaaaaaaggtcacccgtctctttttgctggtcaccacagtcactgggcctttttttaaattccttcgatttttcctactcgaatttcactttttattacacaacaaagttgaaatatcaactttaaactgtccttttggcctttatccgattgctttccgttggcggggggacaaatgcctaaaatagggaatgccaattttgtttaattctgtccgaaatttcattttgcatttgcctttcagctccaaattcgcgagtgccggattggccgcattgacgagggtgccctcggggactgttcacggtcggctctgtccaacttcagtccaaccaaattgtgcgactgtcgcccggttggtcttccggcatggacaatgttggcaaattggtgttcacttacaacaccgtgcgtgagccgatggtgtcgccagaatgccttcggcacgacggcgcacagcgattcgaatttgcggacaatacgctgcactgctcatgcgcactccaatggatgatcaacgcaccggaggaggagcaggtgaatcggacgcaggagacggccaaaaatacaaattaattgccaattttggattattttgacaatcgctaaatggcacaattcagtggttggccgagaattactgcggtgccgaggagaacttcaaggcgctgctgtacttttcgcccgccggcgtcggctgtgccccgtgggttccgacggcgtttgtccctccggtcgctccttttccatcgtcgtcttcgactcgtcctttgcttccgagcagtccccaggatggattggcccagtcggctgaggtcgacgaatggtccgaccccgaggacgaacccttccccaatccgtcgccgcaccggcggcactcttcgcacccccttttctctgcctgccctcctcgtcatcacttggctcgtttcttttccctctgtttgtctgtctttctgccactctcctcctcctttcctatctatcttccctcttttttgctgttgtaaattttcattgacagtgcttttcattttgaccgggaacagagccaattttgaacgcatttgtcaaagcgataaaatcagtcacttctttcaaatgaattctgtgctatttccttattcaaacagaataaatattattatttttataataaaatcagaaacatggaagttatggcaaattggaaggtatcgactagagaccggcgcgggacgggatttttcactatttcgacattttttggaaaattccttaacaaaaatgcaataaaaccaaaaaatacacccctaagaatcgagcaaaaatttttcaaaatatactcctatgaaatgaaaaaaaattttctcaaaaatttactttcttggcaaaaatttttaattttaaaattttttttaggtaactattttgggttttttggtcttaaaaatcccagtcctactcatttgcaactgcaatcagtgaataaaaattatttttgctcaatttttggctgaaaattatgtcactattcgtcactatttcggactttttgacactattttgtcactattttggcatttttactcactattttagttaactatttcgggatttttcgtcactaaaagttgcgaccctacttattaatcttgttgaaattagtcaaaaaatgtaaaatctggtcaatttttgaccaagaatggttttgaaaagcaaaaaatagttaaatttatggtccattaacagatttgattctagatcctctttttaccgtctgatacattcggaaaatcttagtcgccaatgcatcccgctatcccctaaaaatttctttttcaaaatatcattattttctcttttttggaaattttttgaaatttaattgaaattttttcaaaatcccgcaatcccgcgcgggatcccgcaaattttaaatgcgggatttgcgggattaatcccgcgggatcccgtcccccaaaaaattttggattccaatcccgcagcgggatccgcataattagtgctttgagggaatgcaaataaaaatatgccattcctggccgtggtgcgacttttggggatttgcaacttggggacccgacatttggggatcgaacgtcttttggggatctgacatttggggacccgacatttggggatcgaacgtcttttggggatctgacatttggggaacttggaatgaactgatcagtttgctcgccgagtcgggcttcgtcggtcgtgcgcaggcgaacattttaaagtgtcacggggtactctt

SEQ ID NO: 12538 - DNA, 2171 bp, Heterodera glycines
gggtaaatgatggcaaatcaaaaaaatggcaattcgactgatgataaaaatggtggtcaatgtgtccacgattcgtgatcaaatgaactgaccgatcaccccgaccgcccaaaggtccacgcgatttgagtaagggacgcgcagcagaatctctggcgcaatgtattccggcgtgccacaagtgtccgtcattttctcgtccggagaacgcgattggtgctgaaagaggggaaaagcactttaaaaaatggaaaatgctcggaggaattgtcaaaatgtttgtttgtttttctgtcaacactcaccgccaatccgaagtcggtgatcagcagccgcgcctcctgcctcgtgtcgctgtacagcaaattctccggcttcaggtcacggtgggttatgtgcatactgtgggaaatgggacacggattacggtatttaattaattgattgattatgccgatgatggcattctctctgggcttacctgtgcagatattcgagcccggtcagcaacattttgatggccatccgagcttcgctttccgagtaccgccccttggccaccacgcggtcgtacatttcacccccggaagccatttccatgacgatgaacagctgaaaatgaggggggacgatgatcgcactgatcagtctgatcaaattggcgccaataaaactgagaatggcacaaactatggtccaatacaaagcataaaattcataaaaggcgtttcgaccgagggaattcgaacccacggccttccaaaccacaaaatgctcaaccgactgaacttcggtgcccttttttgaggtcctttcgcccttttcctttctcttcccctcggccttacttttgtggcacttcgaaacacttcctcaagtcgaatgacaaacggatgctgaacacggctgagaatgctcagctcgttgttcacagcgccaaagtcttgctcggtactgaccaacttgacggcgtagaagcgtttactgactgacaaatcaaaaaatgccgtttttggaacaaactgtgccaatcattgacattttgagactatgagaccatttttgggagatggatcatttttagaggacggacatattcatttttagtccttttttttctggcattttccactcattttcccattttcctttacattattttatcattttggaattttcaactcattttccccattttccattaaatttgttggcactccattttcctatatattatttgtcatttggcatttccactaattttcccaattttcctttatatatttttatcattttggcattttcctctcatttgcccattttcggcattttcgctgtctctccctccgcccgcgtctcctccaactcacttctgtcctgcactcgcagcacttgggagaatgagccctttccgaccacggacagcacttcgtatttgcacactaatcgcgagtccaaccgaatggccggtcggtcaggaagcaaaacgaagggctgctgctgttgttggtgctcaatttggggggccatcgtcggctgtactgaattggacgggggcggtggcgcggcgaacgctccgttcggcgattgttggagatgctgaacggaggaaaaacgacgagtttggcatttagttaacagcccgatttgatcagcagagccttgactggcaatatattctgatcacaccaaaagtgatcgggaaaccttttttgatcggcatttgataatcaacagattctgattggattgtgataaaaagggcttcccaattgcaagagggggggggggcagaaaggtaaacaacgtttgatactctaattagcagtaaaatataaaataaaatcggaatttatggtcagatcgaaacattggcactctgaccaagaacataaacaaattgtgatctaaacaatgatcaatgatacgcaaatgcaaatgccaatttaagagaaagcattttcggcttgtggcttctctcctccatttgaccccccccccctccgatcggaattaattcgtcccaaatttacgacgcattgcaaaaggaaataaatgacagatggatggatggaaatgactgctgaattttgtcgcatttgcaaaaaaacagcccaaaaaagaatgaacgaaaaaaaaaagtggggggaaagtccttaaaaggaaaaagg

SEQ ID NO: 12539 - DNA, 1509 bp, Heterodera glycines
ccccccccccctagggggaacactgtccaaatttggaactttggggaggggggggggggtaaagaaaatagagcaaaagttctttaggggttcgttgaatttcaaaaatgaattctttcaaagttaaaattatgcagatttctcgaactcagaagagaccaagtcacagggcttctcctttctgtcgctgttaatattcccaaatgaatttgtcctccaattcccattggattatccccccccccctccaaattcgttttgatcacttttaatgtctctgatcagtcaataccatttcatttctcatattatgtttatgtcactatcattaagttaaggatatcctttcagtgaattttgcccactttttccaacttttttagctgtttttttgactgatttttccttttccaccttttcaatggtttttctgatcagtatttccccccccccaccttttctgcttcgattgccttcttttgttgtcgccctgttgaatggttaaataattgtgccaaaaatccgccgcctccgccgttttttcgccccgtcggtgtcgcgtcggccgaagcggcgaattgttcggccatttttggcgaaacggacggcggcgcaggtgcggcggcgccgtcaccgctgtgcatggaattgcgcgaggagggcgaaagagggctaaacatttggggaggaaaggcactgatcggaaatgaaaaagactaatcgaaatgatcatttatatgacaaatttaaaacaatcatttaatgaccttttcctatcaacgtccctttctataagctctgatcactttctcagatcagtccctttctttctctgttcattgcctccttttctgatcacttttccctttatcagtctctccttattaatcactttctctatcactttccctttttgctgctggtcattgcttgcttttccaaccacttttcccacctgttgctgctgttttcatttttctgcgtcgccatttcagtcccgctgttcctcttttgcttttgctgttgccttcggcgcttctgctgttgcccatttcgccacatttccgacggcatcgttccgttacattccgtgcccactttcccatttcggcacgtgccattcgccagcggtgggccaacatcgcccgagggtgccgccgcccattgttggagataaaaagccccacggggagaggccggaggttgctggtggtgcgggtactgcttgaactcatcaacggtagacgaaccgttcaatgagtgtttattgcccatttgggcaaaaaatgaaaaaaactaaacaaaaattgtaaaaaattttgaaaatttaaaatctttttagaagaagagtaacattcagacaaagaaacgaatggaaaaacatttaaaattgcttcactatttcaatttttcaaaataaaatataaatacctcctaaaaataaaaatattctaaaatattcaaattacttcataataaaaatcaaaaaatttaatattttacaaaaaa

SEQ ID NO: 12540 - DNA, 1306 bp, Heterodera glycines
aattcattaaaatgacacttcaaaaagtagtgagaattaaatgggtggtgaaaaggaaaagcggcggaagagaagggaaaaacaaaaagaaaatgggaggagggggtaattaagtaattaattggttgatggacggatgacgaaaaacagagattatccccctcgggggacgtcacgaacaaacaaaaggcaatggcaaaagtggcttcaaaccaacaaaaacaaataggcaaaatggcagacggaaatttgggggaaatattattaaattagcataattaaataaataattattaaattagcataattaaataaataattattaaattagcataattagtaaataattattattaaattattcgttagttgtcactaataaaataaagagaatgcgtgcgtttaaagtcagtatcaattaccaaataattaatgaattaattaatcggatgaatgaacgaattttgtcgcgcgtcgccgaaaggcgacaaaatttgagcccgaaaatttccggcgaggaatgagtacatttatttgaattgattacgtaaggcgcgagacagaaaattgggggcaattgggagagtgatcagagcagccaatgggaaaagaattgaaattatattccgatcaaagaaacggggggggggggggaaagaacggaaattatgggacagaaaataatgggacacaaaagggaataaaaataaaaatgatttatttaatttccttttgcaaaaaattattatttatttttttgggaattgcgccaattcgatggaatgaatctctctctccttcaaattcgccatcgtttgttttttctgttctcaaatttataaatggcggccactttttgtgagagtgcccaaaagtgtcgggagagcccccggggggcaataaatggcgaagaaattggcggcggaatgaataaatgggtggggcacggaaggacaagggagggatgccattcattgggcacacaattcgcgggcatataaatagccaaaataagcgagaaattggtagaggggacaaagggggggggagaaagtgtagcaaaagtgatgggcgagactgaaaaggggggagggagtcgagactgacaaaccgagaaaaataataatcccaaggttcgaaatcaaaaccgagaaacagtgaatggaatgatcgaagtggtaaagcaaagagatggaggaaaaggaaaagctaaaaaaagagggaaaaaaggaaggaaaagcaaccaaccttttgctctaatgtattttgtgatgaaaaaacaaaaaaagatgctttgcagttttga

SEQ ID NO: 12541 - DNA, 3830 bp, Heterodera glycines
tctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatcagtagtatatggcgtcaaaagcgcacggttgcgcacgggtgtttaccgcacaaacccgtgcctatgggaggggcgcagccctttgatgttgccgcccggggacattttcccgcacaatcccaagcctataggaggggtgcagtcctttgaagtctgccgccttgtagattttatttcctcaaatccgcactggcgattttttttcactccccctctccgcgccgcgcagcgccgcggaaggtcatcaatcatccacctgtcaccaaaagtgacaggtgaaggaaattcaattttttcttttgcaaatttaaatctttttgatcccaaaccttttgggccggttttattttctcaatcctgaatttttttatgatgatttttcggatcctgaaattaaaaattctttttgaaaattagccaaaaccgtgcggtttttatcacctctcccctccctccccgcccgtccggcgacgcgatgccgccgccgcgaaaaaaaaatcgataacggaatttggaagaagtgaaaatttaattggtaatgcagcaaataatgccatgaataattattgaattgcacaataaaattgattatttaaaaacgaaatcgaaaatgaataaataaattaaaaaacttttccaaaagtaggtcacctgtcaaccaaaattgattgatgggtttttatttctcttccattatttcgaaatctgcacgtgactttttgttccattatttcgcaatctgcacgtgactttttgttcaaattatttcgcaatatcttccctaaattaggtcaactgtcaataaaatgtgattgattggtttcttatttaaatgtctccattatttttagttttctgttccaactatttcgcaatatggcccgtaattttgcaaacctgtcaagaaaaatgattgatgacattcgaaataaagaatatccagacgatttttttttgcagttttgaataaaatgtgacagttgtctacggaaatgattgattaccctcaaaattaaggcaaacccagacagtcacgtgactagacccctcccccctttttgcctatttcgcacacccggcccaaatcgcaaatcattcaactaaatagttggatttcattaaactctcttcacgctctaattttatttctctccgctctatttttatttgcattaattaaatctattactatttacctacgtctttttcttttcaaatctgctctctttaattcttctgtttcaatttcttgttttaaaatgtcttttaaacgcgtgaactccttccaacccgccgtgccaatggccaaaaaatgggatttccgatcaatcgggtaagtgatttttaataaattaaataaaaaaataatttcttaaacaattataaatacaattataagataataccctttaagaattatttcaaaaaatttttttgttcagaaataattttgctgaaaaaatggaaaattataaattgatggattaccaatcgacaacttgcgaaaaatttggatttacgaaaaatattacggaatttcgtgtcaacccggatgtggagcgccccgatgaagcgatgaaggatgcaatcgacaacatgataaaggtggctttaaaaaactacggaagaaaaaatgaagcgaaaagtgcggatgtttggagtggcaattacgggtgctgggcttgcttccccggtttgggtgccgtatcgggcgtacccgcagaacaatgcggatgttatcatgcaggagattaataagttggggcagagcgggaacggagatgaaaataagaaaatgcttttattatctgagccagttacgatgaaaattacttgcgtgaccatgcccagtggagaggggccgaggaatgtccataaatttgactttggattcaaggaacaccagcggatagggtaagtgtttttaataaaataaaattaaaatagaaaaaaactaaaataaaaaaacaataaataaatttaaaataaatacattaaatttatttaatgaagcaaaaattctttaaagaaaaaatgaaaaaaagcaacaaaaaacctaaaaataaattaaaaatattaaaaaataataatttaatgagccaaaataaataaaaattaaattttaaaaatcaaaaaaatatatattaaaaaatattaaataaataaaaaataaaatttaaaaaatcaaaaaaaattaaataataattaaagtaaagaaaaaaaagaaataattatttttaattaagcaaagcagcaaaaaaaaacagaaaaaaaaatttaaaaaataaattaaataataaagaaaaaataaatggaaataataataattttattaaggattacaaatgcggataaattttgtttgttttatgctttggtggcgtctaaattttatttggaagtgcatcgaaacatttttaatcgatttatgaacaatattatgagacagagggacgcagctattgagcttttacataattgtggaattgatattaacgaatatagctatggtgtggagcaattgccgaatgttcagaaatattgggtgggtttaaatgaaaaaatgcaaaattaataaatttttcaggatgagatttaccccggaaagtaccgggttgtggcgtttgaaaaatctgcggatccgaggaaatcgatacgtgttttgtggaaaggtcctatggggcgtgaaaatgtcgtgccgttattcttggagaatggccattgggatggtctgaagaatttcgtctgcttttttaatcgagggaggaaattctgcattgattgcgaatgtttttacgacaaggatgttaagcatgcgatggagtgccgggcgagatgttattattgcaataaagtgtgcggagtgccgtgtcaaaaggagagtggagtgaagattgaatgcccgaagtgtcgacgttacttttacaattgggaatgctataattatcatcagggacatcagacttgcaacttatggaagcg

SEQ ID NO: 12542 - DNA, 959 bp, Heterodera glycines
cttcatcccccacagcttttctctttcaacaaatacctatgtcactttacacatttcaatcgatttccattctatttataatttatttttgattttatattaattctttaattgtgtaaattaatttgccgttcggcccttctctccttactaaatttgtgattctcttcaattcaaagggtgctttggtcattcttcgttccttggtcatcatcataagcaagcagtccctcttcctcaacaatccctctttgacgtgctttctctctcccccagagaaacgcggcttgactcacctccccccccccaatcattgcccctaatagcccttgcttgtcctgtttgtttgctttttctcccccactaaaggccggccgataaacgattgagaagcaaacaagctggtcagcgaaagaggggcaccttctctccccccccccccccccccctaatacattgtgcttatttgccgttgctttccaatttccccctttcccttccgctccttccatcacattccttccaccttcttaatcatttcattcttgccaagcaatttattctgaaataaagaagatcaaacttttggtcgtcaaattttgatttttggaataaatgcattatgcaatttataaatgtaactgatctgaaatattgacttaaaaatagtttccattccatttaaattatgcaattctccgaatttggcttatatggtcaacagccctttgaatgttttttaagtaaaagcaataatagatattaatttaaactgttcgtttttctttacgctatcatttaaatttatgaagtcgatcactttctgaaaaagaaaatgccgggccgctcaacgggtaaagcggacaaaagcaccgacgaacgaatgatatttgttgatattaccctattcataggcgcatagggcgttgaaacaagttgaagcataccacgcgttgctg

SEQ ID NO: 12543 - DNA, 2266 bp, Heterodera glycines
ttaagacatccaagaattttacgacaacactttgctgaacgaaagagttccgttggatatgaaaacaaccgaaactcgcaaattggccgagagatgggagcaggtgggcgccgaagtccttccatttgcctaatgagtcgctttcctccaaagagtccccccttcggcgccgtctcccgggcattcactccgtcctccttcgaccgtcctgtctttcccgccacaacaactgcaacacctcacacaaatggcttcaatggcgaaatggaaacagccataacacactcttctcattcatattcgtaccaggagcagagcaaacaattggtgaggcggagagacaattcggccgagaaagccaattcgaacctggcattccatttggcaaccattggcggcatacctgtgctaggggggggctcagccaagaggtcttactatcgactttgccccccccccatgggggggtcagagcccatttccattacgatcgaccattattccaattttttgcctgctgaagaccttttttttaaaccacttttttttgcggcgtgcttttcaaaaattttttggggaacatgggggtccggcggagaagataggcgcggccaggaaaattttaaaatttgagtgcaatttgttaacagattttcacgagaaagtgctgcatttttgcgtttttaagccaactattttaagaaaaattaaggatttttattgacgaaaggggaaaaatcgaggttagtcgatcgtagaaaaattgcaatttaatggaattttttttaaaccggcaaaatttttggggttttctacccactctcctcttacgatcgacaatttttctcacaaatcggtattagtcgatcgtaaaaatctggaatttttaatgaaatttattaagaaataaggcaattttccgaattgccaatgagaaaattttataaagtttctgtttcatgttaacgatcgacttgttcgctgactttttttctctcatcccttttcttcttccctcttcctcccttcacccccccccacctcttacgatcgactaagagaccctcctgtgcacaggtatgattggcggtaattgtccatttcttagaccaaggatggatggcatacgcaagagtaccggactcaaacggtggacgggccgagtgggtttcagacggagacagtgaccaacaacggactgattgacgaccagggaaaggcgtgggaggtagaggacgtggtgctggagaagaaccaactcggactggtcagcctgcatttgtccacaatgtccaccgttttggcctctttctgcagggtttctccatttctggcggcaatgaccacagttccggcccttatatccgtgtcactgacattgcgcctggggtactttccatttccaattgcttctgccaattcggcttacgcccttaagggtggtgtggcgagggacggacgaattcgaattggcgatgtgattctgaaggtgaacaacacggacaccgtcgacgtgccgcaccaagtgccttctcaaccgactctctctcctttctgttaatgccctttctgtgcttaggtggctgtgaatgcgttgaaagttgcgggcagtgtggtccgattagtgagttaattatcccccccccccctcgggcataagtgaacctctccaattttagctcatcaaacgaccaaagacttcccaagcgagtgcgtttcgtccctcctcggccgaaccgctctcgcgcggcagtcccccggagggtttcggtttcggtcccccaccgcccgtccccacccatcagcagtcatttggagaaagtgaggccgtgaaagagttggagcaaatgccgggagtaaggcgaatggatttgatcaaagtggagtcggacggaatacacaagggattgggcttcagcatcgccggaggaaccggaaaccagcactatccgggttagaccgtgtcggacccacactctctccctctctcttaccattgttacttaccctcaggcgatgacggaatttttgtgacgcgaataatcaaaggaacgccagcttattacggtaggatgctgctaccgtaacaccgtcaaaaggcttttatttcattttcattcagacggccgactccaaaaaggggaccaaattttggcagtggacaataccatctttaaaaatgtttctcatcagtttgccgtggacactctgacgaacactggggaccgagtgaagattctgttcttgaaaaaccctcacccggaca

SEQ ID NO: 12544 - DNA, 3031 bp, Heterodera glycines
taaaatattttaaatttgattctttgaatttaaattgcaataaaagttttttaaattattgaatttagaatttatatttgaataatttgatttttttaaatttaataaaaattaattcattaattattcaaaaatgaatttactttcatcaaatgacccatttattttgttaattaatgtgtacatctttctcaacatatatccaagtgtttgatccgcttgttcaattgattttaaaattccaattttttcctttaaatgtttcttttcgtcgtccttttcggccttcgattttgtttttgttgaaaatttaaaacaacctaggagaagcaattggcaattcatttaatttatcgcaaaaaaaaatatttttagatttttatcatataaaatttttgtgctcatatagttccaagaaatctgctaaaatgcgtttctgctttaaatttttttaagctttaactaggttgttcacggttatttaaccgaaccaaaaccaaaaccacttttttgggcaaaaacagaaaccgaaaaccgggagtcctaaaaccagtctaaccgaaaacctgggggtaccggcttccggttttttcggttttaaaaatacgcccatgacacctcattctgggaattattgatcgcaaaagaaatgttggtattctccaaagttttgttcactaacagggatgggatttatatgtatgtaccaaacactctgaagatttttctaaaaatatttccacaagtatatttttaattatttattttgtaatttgacaaaatttgttaagaaatcacactcaaattttcaaaaaattttcccagcggcgcctaccggctccgccagcagaccattttctttccctttcccataagttttttaaaatgcgcctttttgtatcactattttccatttcgccccttttccactaataaagtatgtcctttttcagcaaatcttttctttcttgttcatattttcttcgcttttattaataagaaacaaaaagaaatttatgataatgccccaatttaattttacatgatttttttgattttttagcatgtgccgttgtggtgcccactgccttgcctttagagtgtgtctgattgtttgtgtggtggtccagttccatgccgaacaaaatgtgccatcggcttagatcgcagataaattgcttcagctaaaaatgcaataaaaattttttgttgaccaaattcaacaaacttggtatcattcgaaagcgcttaacagcctctattggatttccaaaatcacaaatatatactgacatgtaaaaagttataaataaaaaatatgtaaaaattctaagtcatacataaaaaatatgtaaaaattctgacttttttttgcgattttcatgtttcagctttttattagttttttaattgcttagttaaagcttatcagtagcttatagacatgtggagctttcgaataatgtaaaatttttgaaatttggttaatcaaaaaaaagttatgatgctttaaacggctcagacggaactggccagacagaactgtgactcctacctaaatgtaaatatatttaaatgttaataaattaaactatatttttctaattttgtataattgagtctgaaatttccctattttcttggcactttgtttctgcaccacctcattgtcaccgccgttttcttttgtcgcaagaagaccaccgttagtgtatagcttcaccatcaaattgttgtcaggtacatcaaattcttcgtcctccagcacatcgtagcatttgaaatcggcaaaaacgccgaaaatccaagccacaaaaatatttaatatcaaaagttttatcatttgttgtctgtttttattatttttttcattaatataagattttagtaattgcaaaaagcgaaagattaaaataatatgaacaatttgtaaaaataaaaatattacgcaaataaacacgtatattcgttggcaaatcaataaacaattttatgttgccattatttttcaaaatctagtttatacttaaatgaatttttttgtttttaataatatattaaatgaaatatagccaaattatgctgaaaaatgataaaaaaaaattatgagtctaaatatctttatcatttagcattcttggaccatttaaagaaattttgtataagttttgaagtttttaaattaatttcttttcgatttatttgacaatagcaaagataaaagttaataatgcatttttatttatgaataaagctactatttttgagtgttttctgtttgtgtatacatgtttttttcttgcttattttttcatgcttaaatagaaaaaaatttttgtgtttcagaacaaaagtagtgattttaattatcgtacttttacacagttcctgaattttgcgtattaaataagtaaatatttttatacacatttcaaactcacaaagaaaggataaaatgcaactttggctttctgcaaggcattttgcctcggtaaaaatcccattccaaaagttagaaaatagacaattaaaaggtttgttctgtgggtttgtttaacaaatttggcaggttgattcattgagaatggtggtatatattattttttttattacttttgtcaggaatttaaaatcaatagtctgttattaattattaaagctcgttaagtagcaaaaaatacctggacctggattccaaaaattaattaatcttttgtatttgcttgaatgaatttgatttggtcatgaaaatatagaaatattgagggacgcccattctggcacttttacgaatcgattcacaattagcacaaaaattttggcgctagttaaaaacttcttctcaaaaaaatttatttattaattctgaaaaaaattgttgaagtaaaaaattttctattagttacccattttaagatagaatttgattgttatttgtttgccaaaaatcattctgtcctcaaatgaataattttgctgaattcggcactgatcgtttttaacaatacaatttgttttatcagtgcgcgca

SEQ ID NO: 12545 - DNA, 3822 bp, Heterodera glycines
  misc_feature (3800)..(3800): n is a, c, g, or t
tgtatcatcatcttcaatttcatcatcgcatcctcttcctcctatttaccaacaccttttttccgtcactgaaaagcacatggaacccccgaacatgagcatggtcgtcggcgatgaggaaaaagactcccgcatttgtggcaacagagcggcgccggcattggcacaccgccacaacaacggtgccgactcggccgctacaacggcacacatggcggaagatgatgctgaagaggatgaggagcaggatgaagatgaggatgatgccgactcatttccgggcgagttggagccccgcgggcgctgctacacatggccagtcccacagtttggagccgtatcaacagcacaacaatcgccgctttcctctctgcatcctccgccaccgaatcatcatcacctccaccaccaccatttgttttcgggtgctcctaattctgcaacaacatccgccacttcgtccaaatttccgtcattgagcagcatcattggctgtggaggtgcgggtactgcttgctcttcctcctcctgttctttgctgaccggtgtcgaacaacaacaaccatgcacttcctcatcacatcactcaccattttccgctctgtccatcgacggtcaacaacaacggcatcagcatcattctcaagcagtacaacagtcgttgttgctgtcctcctccggtggtccttgcggtgtcaccgcgtcatcgtcattctccaccgctcaactcggcacatcctctatggcactaatcaggccgaagccgaagcgagtccgtcgacgtaccgctgacggcggaacggcgcccaccggtgtcacagatgatggtgctgttggtagtggtggtcaagcagcgcagcagcattcacacaaaaagccgaatccctggggcgaggagtcctactcggacttgatcgcgcgcgcgctcggctgtgccattgacggacggctgaagctcagcgagatttaccagtggttctcggacaacatcccgtactttgcgcaccggtccagccaggaagacgcgcaggggtggaaggtaaaggcgcagctaagcgcggcgcgttcgaccccttaatctcatgccaattgcgctccctctctccctccctactgcggtgtcatgacaactcgtacaaaaacaacgcctacaatggtttagatttaagcctaagctttaggctttggcttaagctttaggctaggcttaagatttattttataaaaatgttgttattgtacgaattgccttttggtacgagttgccattgactccctgcttccctgtcttgcatttattttccgtcgatttgcagttgccaaacagtgattggttgcttatctcagaaccaaatcctttacaaccctttaagctctctatccactcacccatggtcattaagtataggatttcgttacttccacttaaaagatttagttggatggttttcaatttctttgtatttaaagaaattgaggaattttttaacactattgtttaaatgaggtctcactcaatggggtgtccttattttctcgggaatggaatgagagttcggtttataaaaattttttttttctaatattggtagggggaccaggaatttaaggaaagcctgggattcgggaccggaaacatgtcataaaatgggtcaagaattcccggtgaaaaaatcggtacttctaaaactatttggtcccggtcccgaggccttccaacttaagttgtttgtgttttgcatcatttaaaaaaaatttcactgctttcagaactccattcggcacaacctttcgctgcacagtcgcttcatgcgcattcagaacgagggggctgggaagagctcgtggtgggtgatcaacccggacgcaaagccgggccgaaacccgcgccgaagggccaacacaatggaggcggccacgaaggtggacatcagagctactgaaaatatttaataagagtcgggcggtggtcccaataagccaattttcttttttttaaatttgaaatcgttagttttgggtttctcgaataaaaaagggtcgtcggttcgtctcgccattgtgaaggagttctttcgaattcgcaacatttaaataagcattcactaattgcccccgtccggtcgcttaattgacttccttccacacttgttaattggttttaattacccataatttgatttgccatttacacctcctcctctcctcctccgcaggctgtcattgacaagaagcggcgtggtgcgcgcaaacgtgtcgaaaccctcgtccaacagaagggcagcaacggcggctgttccgcctccatggcctccattctcagcgctcagtcggccgccatgttcccctcgggcaacgacgagctcaacgagcaaccgcaacagcaacaacaacaacagcagcacatggtgctgaatgctgctgcaccgaccggggggcccaacttcgacacgttcaggtgtggtttggctggctggtggccacgaaaacattgctaaattttcaaagattaaaataatcaaattaaaaattatgatattttcgagaccgaaaatttctcgagactctaaaccaaacaccagaaaaatccgagacttttctcgagacgaaattccgaactgagaaccttggtcagcaaaaagggacttttttttattccttttagtttcctaacctaaaaaatgaagggggaaagtgctgcgccgtacggcgcctgctgagaatcaacggattccctgctccacattttcttttttcattgctaaaactacatttccaaattgcatttttcgtcatataaaatttttcaataaaaaatgcccgtttttataaacgttttgataataaggcatgctattgtgaatataggccccgtgctgagtcgacactgtccgtggtcggtgggccggcgtcctgctcgcgcctgtcgccccccaacgagtcgtccatggaatttcctctgtggatggatcaactgcagcaacagcaacaaaacggtgccgacacggcggcaacggtgccgagctgttcagctgttgtgcttccaacaacgacggcgacgacgacgacaggagcggccacggcaccgccgccggtgatgaacccgcaggtcagcgaactgctcgaccggacggaccaaatgcgactggaggcgacgacgacgacggtggagcagtgcagcagcaacggaaggatgatgagcagttgcaacggtcggttgtgtgggagttatgacgtcacaaacaaaaaccattaaaataaattttgttggcttataactttgctaaaaagcacttcgaaaacatggttttatgatatgagttcatctgaccgtaattttttttgaaagtttgcgaaattttttgaaattttccagactaatagagaacacttagagctatcgaatgatatcaagaaataaaaatttgattatttttaactaaacttatgaaaaaattttgtcaaaaagtttccatttgaatggattttgagtaacgccctttttttatatgggtttgagtaatcgacgtttttccttcaactccaaaaatttggcatttaattatatatttactggaaaatggaatgttttacaaaatgtatggttttgtcccacttccaggcggactgctcaaaatggagatgggctgctccaccgcgtcgtcctccaccgcctcgtgctcctccacaacgtcgtcggttctgctgatgccaaagtgtgaaattggcgccggaggcgacccgtcgttgtcccttgtcaaggtggacacataatcaagggatgggatcgatgccttgtngaatttcatataaaaaattttt

SEQ ID NO: 12546 - DNA, 2054 bp, Heterodera glycines
  misc_feature (7)..(7): n is a, c, g, or t
  misc_feature (2015)..(2016): n is a, c, g, or t
ttaattntgctgttaaaatattgctccatgaaagtgtaaagttcgggcggctgttctccattattgtcagcagatgatttctccgtgtttgaccatcgcattaaaattgcttccaacactttgtacacctcgtaatatgacaatgtgaattcactgagtttgagcaaaaagttgaaattttctgaaatatttatggaaaggcaattgttagggctgtcaaaaatatgtacataaaatatataagaaaaataccaaaattgtacgaaatatgtaaattaaatgttaaaatcgttatttttggaaaaaaaattctataaacattgaaataggcacaaaatgccataaaaatgatataaatagggcttaggattatgtagggtttccagtagggtgttgacgggtccgagtccaacttgacgctttggcaccctgtcaaggacccgcggtccccggtcttcttaacacaggatttctcgaggcttacaaaaaaacagattttatggtaattttaaagttattaagaaaaaacttaaaaatcccgatttttggcaattttgatgttagaacttttttttaataattgccaaatcaccaagggacagcttagaattcgaatgatattaaaattgttgaattttgtcgacaaagaaaaataaaataattaaaacgattaaaaatctttttttgtacaaaaattaaattattgaaagcagcttcataatcctttgtaatttaattgtaattaaattttatttaatcgctttgttcacccaccaataaattgcggttctctcgcgctgttcgctttaatttcatcccaaaaatgttctttggtttgcgcgtcaatgcgaatgatttgaaaaggaaatattctgtaaattaaattaaattctttaaaaaagtcattaatagcaaatcacaaaattaaaaacggaagaaaaatattttacccattttcgttggtgccgcctctttgtgccgataaaatttgaaaagcggacaaaagttgttccaattgccacccgccgacatcataaaaacgcgagaaataattctcataactaaggatggtatttgtaatgtgaaaaaaatatatttaaattgccaaatattattgataagatattcaattaattaaggattatttgcaatggaaaaagtgccaacaaaatttgtgccaaaagcccaaaatttaataaggataaaaattaggaattgttctttttgattatttcaatttcaaaactcacatcacacaaagcattatccgaatggccaatgagaaggtcagttgcaaaatttggtcgacaacccttttggcaatttgatttttggcggcacaaaacactgtttcgttgtacgctttggcaatgtgatggcccaatttttgatcgtagtgcaaaaagccaaggaattcgttcaccgggtcatcttctctaatcacattcaaatttggcacttcttcgccctctccgattttgttgtccaacacctgaaagggatcgaccgggggacaatttagcaaagcagcaatttggcacagggacaattgggcacagggacaattgggcacagcagggacaatttagcacagggacaatttggcaaagcggcaatttggcacagggacaattgggcacagcagggacaatttagcacagggacaatttggcaaagcggcaatttggcacagggacaattgggcacagtctttggctccatgacaatccgtcagtaaattttttatatattaaaacaccataaattctaacaaagatattttcattttataaaagttttactgaagtttctaaactgacgattatatcaacaaaatgatgcttaccattgaattcattagtccaaattaaagtcaactaccgtttttccatccaaaatttaaaaaatgtcgattgccaaaagcgataaaaacaatatttagcatttttgtttttgccatgtgaataaaataaaatttaaacagaaacttttcaactgcactcccatccctttgnntttcttgtctctcctaattttgttttctttattattta

SEQ ID NO: 12547 - DNA, 1306 bp, Heterodera glycines
attagtgtaaatatcatcgatgatttcggcgaatgttttcacatttttggacgggtcggccgagtcccattgataagacgacgaaacgccaatggtttatcagcaaaaaatgaaggaaaatttgaataaaaagcaatggtaaaattggattttgcattttctaaacggatgaatgaaataacagaaaaataagtttaatagtctcggcttttgatctcggcaattcctggtcaagatttttccaaaatcccggtccctttccaacgtcttttgaaaataatttaaatacaaatgacagttgatttaatataggtaaatataaaaattggaattaataataaatttatttaaaatgacgttacattaccactagggatgccatttttaggtttttacctatttttttcctgagctccccgtggcctgaaacgcacgaaaaccatgtttttttgggctgttgttaagctacttttcgagttattagcacctattttctaggtttttatttttagcacctaaaaaacctaaaattttttgaccaaacttatttaaatgaaaaattttctcaaaaattcatctccaaaatttatttgtttatttcttgacgagaatttttgattttgaaaattatatgtatccttccttaatgatatggcataatatttttgttttttgaagaaaattttcgattttacacccctaaattcttaactttttggcacctattttgggagttttttagaacttaaaacctacctattttggcaatttttagcacctataaatgtaatccctaattaccacccactaaaattcaataattgattaatttttattgtcatattgcgcacatcaaaacatatttttaggtacctaatttataaacaggggaaagaaagccgttaaacaattgagtgcctttttttcttcataaaattgaattttttatgtacatttttttaaaaaaagcttaagtaagagggggcttcgtttgtgctaataggcgccgtctaggaaaaaattagaatttttaccaatttgtcaaagattttgcccaagaaatgcacatttttggggggattttgaatgaatgcaaaattctcaaaaagttacattaagtttaaaaaatgttatgaccaaaaatttttaagaaaacttgcttttttgaatttctcaggtcacataagttttttgaatttttattttagattatataaaatgtgcttaattttgggcgaagttatgaatagggctgggatttttagacacaaaaaatcgcgaaataggcacctaaaataggcagaaa

SEQ ID NO: 12548 - DNA, 5557 bp, Heterodera glycines
ggggggggggacgttcaaggcagcgaaacgggcgaccaaaacgccgctgtttttgccacctgaggcggaaataggaaaacttttgacgccatgggcaattggtgccctaaacaatgggaaaagcggaaaaagtgaaaagcattgaacaaaaaggcatcaatcttcagctgaaagaacaaaaagaaagaacctttcagcaggtcgaagtcttctcaaagaaccaatcaaataaaattcatttacttttttcgtttatttatttatttatcctaccgaatctttcatccgttaacatttgtgttcatttgttttctttgccgccctttgcccatcaaatccgaccttttgtcttgcttttgtttagtcatccattcttttattgatgccaaatatctgagacccctttcattgagaatgggattaggccttataaagtgagagaaatttggcaaattgattgactaaaggcattgttgatcgatcagagataatttggctgatcaaattcccaaaaattcctcaattcattgcattatctcattttgttgatcattttttggttgtttttctatgcaaaagccgcgatcactgaggagaatttttggaggagagaaagggtttaaaaagaaggcaatgagaaaaaagagaagcgaaaaattgactgaataaagagaaacgaaccaattgggtttggttttgtttgatgagtgggaaggagaaaaactcatcaaaagagggaggaaaagcatcggacaaaaagcataaacaaaattagggaagcaaagccgaaaatgctcttcaaaagtcaactaatgaatgaaaggaaaatgctatcaactgaaaaacaatcagtggcaaacgaaagattgatcagtgaatgaaatgataggggaaaaggaagtgatcaagggggggggcaatttaattggcaagggaatttgaaaagaaaaagcaaattaatttgaaaacaaaaatgccaataaaggcaaaaacagactcagaaggatggcagcattgactggatatatgtttttgtccgcacaattctcgctagggtccagtctctcatcacagtctgtttttactagacaaaaatggagtaacgccaatgagaattgaacaaaggagagcaggaaaggaaaactagagggacaaccaactgaaccatccccaagcaatcgtgaacgacggaatatttttaaaatatttttatatttttaaggtggataatattgggagaaaacatttgggccaaatgagtgaactgatccattcattctcacttaaatattctgtccaatagcagtgctaatttgtaagtcagcatttgttcgtttctctcatctctaattagttttgtgagatgaatgattagggcaattaataatttttttttatggtcccttaattaccggataaatgttaattagtaaatgaatctgatacagtcactgaatcaaatgctaataaagaagttgcgtctttatgttaattaaaattgctttaaaaaacatcgtcaaaatttcacaccttttgcaattgaaacgtgcaaaagcaacggccgtgggaggggaaaggacaattgtcggatcggattttcggtttgaaatgcaaagggccaattaatcgctcaaaattggagacggtgaagtattaaaagcttagcagaaaacagagacagttgcccattcccattcattctttgtcttcaagggttttgatcagaaaaacggaaacaaattaaagcgaaaagaaaatttagctaaattttattggctttttttctcgagacggaaatgccgaacggcggagagaaagaaaagctgtcataacaaatcatacaaaaggcaactcgtacaattgcttatgttaggcctaagctttaggttaggccaaggcttaggcttgctttggtctaggcttaggcttattattttcaaaaatatgagttgacattgacccaaaagaaaagcgaaaaatgcaatttgaacgaatctcaaatgttaccaaatataccaatcaaaaacgaagtcattctgatcaaatcggagtgatcagaaagtgccgaaagggctcaatcctacttttacactttgcaattaatttattttggcttaattatatagtttttgttccattttttgcttcactcacctgtccatgcaaattctccgcaatgattgtgtactctccgctgtcctcgggcgtcatcatcgacactttgagcagtgccatcgttccgctgtaatgcgtttgccagcgatgagaagtcaccaatggacggccatttttaaaccagccgatctgaaataagcaaaaaggatttattggcatgccattggtaatgccaattcgtaattcatgctgtattgtgtccagcaggcccattttcttctgtcccaaccaggagtttttgaatctgttcctctcgccacatcccccaactcactctcggctttggaacaccgaccacggaacattgcaataccgcgtcagtgccttccgttaagcgcaatccgcgcagtttgttccggaagagcggtgccatcgctgctggtggttgatcgcccacaaacggatcagacatatcggaggcgggcgacataaagcctagcaaatgctgcgccggttgtacttggtcaagttgtcgttggatgaaggagggcgtggcacgcggggaaaagccaatttgctggggggtcctacttgcaaaagcaacagatttaaattaatttaacttgaaaaatcattggtttatatgtaattattaatatttattttcccagcaggtttcagttcctctattgtagctatttatctgaacacgctgattagcctgttaatcagcagttcctcctctccttaatccttttcttttatccttgatcactctcaactaataattttggtcattttctgatcatcttcatctctctgattagtttgtttgttcttttgattagtttggtgtttgacttaatcaacccgatcatttgatcaaccccccccctctctgttttccacctgtactgctgctgctgcggttggtattgcgactgttgctgctgcggctgcgttttcgctcgctgcgcggccaccagtcgctgcttgcgttcgcgcgtcaccattcgcttttcatccgcaaaccatcggtcgtactgctcctgcggcatgatatgtgcacgggattcagccttgcccgttgcgttggtggcacggcaagtgtactcgcccaaatcctccgtgaacagttgcggcaccgtcagcacgcaaattcccgagcgggcgtcgtactccgtcttaattctgctcaggaaagagtgggtattgcttttaaaaaattaattaaaagcttttaatgacctataattatttatcggttttccgtcctttagccactcaatttgtggcaacggaacgcctgaaaatcaaattcattaaaattaaattaaataaaaaagataatttaaaaattacacaccgacgactcgtgcctccaacaccgcagcttcactgggcttcattggctgatgcttaagctctttgaggaacaaaggcgcggaagggcccaccggcgtttgtgggggcgcgggtgagctactgtaagtgcgtggcgggttgtcatacgataacatgtaccaatatttttgaatgtaattaaagtgaaattggtagataaaaatataaatccgagcaatgcccctggccccattcattggcttcaaaaatgccagcctgatcgacggtttttttggcttttctctaaggttaaaacacaatatgccgtgcttacgttatgctcgtcatgcccccgggcactggggttggtgcctgtgccacgattagcatgcacgtggactgtttgatgcccgccgcattcatcgcctgcaccgtaaaccgaccgcagtccgcagcctgtgccttacggatcagcagccggtacgtcttgccctcctcttccatctgaacggcaccaaaagcatgagatttaaaattttaatagcatttaatataatgaaaaaaaaattatatttaaaaatagccttttttaattgaccttataatccgggcattggctgacattgtgcccgtcctttagccacttaaccaccgggtcaggatgagcttcaatttggcactccagcacaatgttctgcccgatcaaagcccttttgtcccggagaggcttaaaaagagatgaatgtatggattaattaattttttgatgctttgaatttatagcatttttagaatatttaacaattggataaagcatacgcgaataaaattgggcggtgtctgattcgggtcctctttcactccgcgtggcttttggaatggcatttttatgaccgacaaaaaatgctaatgcaataaatgctaaaataattttaaaaataaaaattatttatttattttagtttttgtaatcaaacgaggaaaacaaaaataaaatgaggcgaatctgttcattgtccgcagcagcaaagtgtgaaatgggagaagaagaatgaccgatgggaaccgatggacggacggaggaaaaacgaatcgaatcggacggaaggaaaaatgaccgacggaaaaagcggacaaaacaacaaaacaacagctgcaaaagtgagcacaatgccaacacagtggcgaaatttgatcttttggaaagaaaacaaaacacacaaaaagaaaggaagcaaatggaaaatgaaagaggcgacaaataaaaaataaataatacaaaaagttgagggttctcttaatgagtgcgaattttaattccatttttgaacagtcagttgaaatatgaaaagcaatacgaagcatagcaaaatacgttaagccatgctaaacactcattgggaaaaggtttgtcgcgtccaaatcgctaaagttcagcgagtgccaaatccgccgaccgtctcgcctctcaaaaagcaatgccctcttgaaaaaatgaaacgagtcgcaagagaggccgctgatttgcaggaaaaacaaaacaacatggtctaaagcagcgggagggaaatctcgagaagaaacattgggccaaatgctcgggatcacctcgagaaatgcgaaggatcgatcgatcgactgacttttgatgggtgacgatgagaagggataaagcgaaggcggcggaagccaaaagcctttggatatattacagttcaacaaaatgctttattaaattggatgaaaaacaagatttctgatttcttagaaagtaatttaaataaacaaatccaaggctttgaaaatgtttcaaaaacacaaaactgtttttatattttaattctcataatattacttttatttatttacatatcatctttccctttttaataataatattttctctgatttataaataatatttaacaaataaatttataaataatttaattaatttacaaaataaataataatcaaacattggaaaagggattgattgaacattccgaagaaattcctgttcattgggggggcctgggtttctcgaaaaaaaccaaaatcagttaatgctttcaaaaaccaagtcactaacttccca

SEQ ID NO: 12549 - DNA, 3618 bp, Heterodera glycines
tttaagaaatacactccaaagaattaaaaaaattttcttaataatagatcgccaaaatttcatttttttatgataaaaaattttaggtttaaaaattttcattattcgaaaaacattataaaagattgaataatcatttaaatgaccaaaattaagttatttgattaaattttacgtgttttgctccctaaaaaccttaaaaaaattttttaatgccctttttgatgcctttttcgggatttttgtgcctttttttcaattttttcgtgcctattatagtgcctttttagtcggtctctattgattattaacaaaaaatgtggtgaaaccgaataaatcgatatttttggccaaatttactcatagaagaatgtatggggtaaagcccattcaaaattcaatttatacgaaaatgcaaaaaaaaaatttcaacttagatacctatagtaattaatatatgataaaaaatagccaaaaaattttgtatttttttttaatgataaaatgatttagaagagaaatatatgactgaaaaaatgtaataaaatgggcgggaaatcgttcaaatgaatggcattggctaaataaacgtagccgcgagaatggcattttgtttgcgttaatttttacctctttttttgcggtgttgtcaaggtgattttgtgctttttcaattttttttatgtattcaaccgcttgcaattaactgtaaattattatcactaaatttaaaatatcataattaataaacaacaaagttaataaaatttcataacattcagcaaaaaaaaatcagttgttttcgtttgttttcgttttaaatatttgataatttgcgacaaaatgatataaaaaacacatggacccctctagggatgtgcgagagtttcggtactcgattctcgactgaggaaatttctctggtttttcgcttctcggtatagattcccggtctcggctttttagtctcgtaaatcgagaattttttataggcgcctgcaggcaccgccggactcccctcccaagtctaaaaaaagttttttgaaaaaaatgcgccgcaaaaaaagctttttaatgagctgttttccgggtaagtttgtactttatcgaacctatggaccatttaatatctcaaaagtttactaattatttgaaaaagagaaaattaaaccgcaattttgaccactttgttttggactgatataaaagagaaattgtcaaaaacaaactggatctcttcaactcgggttcgcaatttctgaaattagtttttcagaatcaaattgaaactgtaaattttactggtcgatattgaaaagggtggcaaatttttgatactcataaaagttcaaaaaattatactcacttattcgacaagaaatgggacaggtttttgaaaaaatttgccatgctagttagtgttttctttaggtctaccttttgaaattctttagtacattacaaaatgatttttaaaaacgaatttatatccacaagcatttaataggggcttgcatttataacttctgagaatctcataaatttgatgaattttcaattttatcattggcaacactgcgaattgtgcatttaattagttgccatgattctatgagctatttattacagcaatgggtgaattttaaatagatctgaaatttttaattaacgccaaatatgggcaaagtttgtacggtttaaaggcagatttgcggaacatatagggcccctcatcgtcttatcaagggctttcgagcagtttatcatattgtgttcattgtttgagtgtttttattattgtctagccattcaagaaaattggctctttaggtttgcagattcttaatatttttctgatgtggtattttggcagtaattcctttttccatcttctcataattcccaatttcttggcaattatttcgtcacccatttttgggtttctttcttttatttcaaaatattgcttcatcatttttaatttgtactcatttgtatatttatttgctgcttaaaaatattttttatttaaaaatcctactccttttataatatttggcaccaattcttttttccatctcataaaattttctctggcaataccctaattcattaaaaattttcaaaatttataaaattaattacgaaaatcttttttgattcgttgtgctttgatttgctgctcgtctaatgcatcgtttcccatttgtgagtccaatttctgcagattttctctttgggttttataatcattgtttttctcaatcgtaacaattggctaattggattttaaaattcccaatactttttcaattttattttcacgggcctctccaatcaaacatctggggcctctgatgatgatgacggaaaatgtttataattggggatcaattaattttgtttcaaattttgcgatgggttcaaaaatggcaaattctctctgtgttgatataacttataaaatgaattaaaacgaaattaaaattaaaaagccacaaaaatcatttacattagcatgttaattgcccattcattggggatcaacattagcatgctatcatcggattgatcattcaagttgcagcaatttaagtagtaatttccattataaattctaatttttgcttaatttgatagaattagctataatatactcataaaaaatctgaaagcaatattgattaaattttgatgcaaaatttttttttctttcatatttccaattctaatctaattttaaaattatttgagggttcctatcggataaactcactttccaagtacagggatgccaatttccaagtacataatgggaaaaattcgtgaaatccaagtacattttttgaaagttgttgacttctaattcagggcataggtatctgaaaaatcaggacaccttcgattttacattgatgccaacaaaatgaaaaaaataagctttataatattattggaagtctttatacaaattttcaaattgaaaatgtttttatggtatttaatatttattataattttctttatttataaaatttattcctgcaaaattcgaccaaattttgatgatatatttggtgacggatgggacaaaaaagaaaataatgaaattgtgataaaaattaaactaaatgatcaaaatgaaaatttggaatttattcattttcttcatcaaaacaatgattaaatgggaactgacccaattgatcaaatggcaaattatggtcagaaaaatattaataatcagaacaaaaaaaaacaaatgatgaacaaaaaagagaatttgttaataaatttgatacaattaaagaaaagttgagagaaaaaggaaaatacaaatggaaagaccaaggcaaaattgagagaaaaattgcaaaattattaggaacaaatcggcaattaatacaaaaatggaaaaatgaattaaatttaaataaaaagaaaatgaaaaaacaattatatgatgagaaaaagagagaattcattgaaagatttgatgaatttaaagaattttatggccaaggcaaacagaaagaatttgtgaaggaattgggcatttctgaagaaacatttcgaatatggaaaaaagaataacgccaaaatatcataaaagtaaaa

SEQ ID NO: 12550 - DNA, 1605 bp, Heterodera glycines
  misc_feature (38)..(38): n is a, c, g, or t
  misc_feature (53)..(53): n is a, c, g, or t
gcgcaagccttgctacctgataagccctcgaagtatancacagaagtcctcanccagttgaagcgtgccgttgaacccatccttcccataaaaggcaaaaaaacagcagattatcttcattaataattattttaagtgatgagcgacttcgagattggaatgctgaaagcgatgcgtcatgtcttcccgtcatgcgaacgctcgggctgcagcttccacatggcgcaagcggtgttccgaaaagccagaagcatgggcatttttaatttgttgaacgaagatgacgacgaagcaccggttcaaaggaaatccgttcacaaaacattcaggtgtctttcattagcttatgtgtatttatttgttttttcaaaatcagatctgttctctctttggcactcattctgccactttacgttcggcgcgctttttcaactattgtcagcgcggcaccgcttggagttcaaggatggctggcgtattttgccaaaacctacattgccaccactcaattcgagattgatcgcggggcggaggcatttgaaccgcatgctgatgtcggacactttcttctgcgtcgcactcgaagcacaactcgtaaatgcacctattctgtcatgaatttatgaaatttttcaattttaccgttcagtatttcccaggcatccataatgacaggcagtggaccaatacaattcggactgcattcgccacaaccttcaactccaaccattccattgtcagaagaaagcagcttgcagcttattccacgctgggaacaagacatcgtctgtcctccacgcttcccaatctcgttttggaatgtgtacaccagggctcaaatggcaattgagcgaacgaacaacggcatggaagccgcgcatggacaatttgcagtaaaaatttgtccgttggaagacacttttttgttaatttagtgtgaactcaatcatcatccgtcactgagtgatttcatcgctgcaatcatcaaggacatcgacaaacaactggacattggacgagcagaacgtctccagaaaagcacaaaacgacgacaacggtacatcatcaaagaacaaaatgtggtgcggatccttgacgaggccgactttgaatcggaagaaggattgacgaacgccttgtatctgatcgggctcgtaatgcaaggctttgtggagggacttcacgtccgtggaaatgaagatagtgagaagaaactgatgataccgatggaaattgaatttatgattttaacaatttttacttttatgatttttaaccttttacttttattttttctttggaatttaataaatatctatttgcttccgtgtatttttaggttaaatttaattattataataaaatagctaaatataaaccaatttagaatatatattttggtgaaactcgttgtcaaaatatatattttaggttagtaggcgaaatgaatgtttttgggttagtaggcgaaatgtcgagtaggcgaaatgaatgtttctggcttagtaggcgaaatgaatgtttttggcttagtaggcgaaatgtcagtaggcgaaatgtcggtaggcgagatgtcgagtaggcgaaatgtccatacaccgataa

SEQ ID NO: 12551 - DNA, 2010 bp, Heterodera glycines
tttttccgtaaaatttcaaaaaaatttcgttgagtttcaaagaagttgtggtcaaaaaggtttaccaaatcaatttttgaaatttacaagccgcaacttctttgaaactcaacgaaatttttttaaattttaaaggcaaaaagaggacacttagggctatcaaaaaataccaagtttgtttaatttggatgcttctacaaaaagttatgacgctgatcaaaaattgatcatttttatggtgatcaaattttcaaccaagcatatcttttcatgtaaaagtcgtagccccattattcaaaagtcaaatcagtagagaattttgtgctctttccagtgggcttgcctatttttccttgaaaagatttcccaaccccctaggcatttcgaaaatttcccgattttcagtgtattttgggtgtcccggtcactaggaaggagtgatctgatcaagttgatgtaagagacttttttgatcagcaccaaaagttgtgcaagcatgaattatttcaagtttttaaatgaactataagatggtttttaggtttgagtaaaaattttttgggactatattttctcataaaaatgtaatttgtttgggaaatattaaaataataaatctaaattataattatggtcagcaaatctaattataaattaaaataattatattattaattaattaaattcatttattccgtactgaaatgacccgccccttctgatcatcactcattcgcacttttgtcacttcgactcaccacgtttcccaatatttccgcatttttaaccggtttaaaaactggtttatatacgttgccgcttttttagaataacttattaatgcatgcatctattatttttcatgaattttcatttttgtgcctatttttaggatttttaaggcctaaatcccacctatttcgatgatttttagagccaaaaaatcgtatcccaataacactaacaaacccattcacgcatttttcgcgtgtgtcaaatgcgatttaatgtgcgcaaaatgatgaataaattattaaaaaataatttctttctttccttcaattgtgtttaaatgggcacttctccggaccaattgtgcatcttaacaagggatggcattttctgttcaaatttcgctctctctctctctctcttacccgtccggatggttttggtggaaaaggcattggaaagtgcgcagtttttctcgtccaatttccttctcaaatcgctgatagtccgagtgccaaaagcgcagcgaaagggtgccatttgagaggacgaacaattggcgttggctgtgcaaaaaggtcaaaaggccacgacggatgccggacagaaaaagactgaaaaaaacatattttttaaatttttaatccgttttattaatacaaaatttgctcaccggtgctcttcattcaacaccgtttttgcaacctctgcaaccgttgctgccccgccacaatgccaattgctgaaatgttgaattaaatagtaataggattttatttcatttgacaattggctaattaatgcctccgtcactaacaaatattaccaaaatttctgatcggaacccttcgaaatcagatgagaaataatgcgacgggaaaggtcgacaaaacattcgttggtggacatggtcttggcattctgtaaaaaaaagcaaaattaaattcttgatacagtattcattcgaatcaaccaattgcttgtctggccgttctttgctttgttttccgccaatgctctccatggaaagcaaatggtcaatgattttgtccaattcatttgcttttggcaatccgttgggcgacacaacgccaattaaacatttcttaaaaaggaattggagaggttccctggtgaggactaggtcgttgtggcgccgacgttttggcgccagcttcagtttacggattatagcttttttctttgtcgactaaatctaacgatcttggtatcattcgaaagcccttcacaagctctattagccttccaaaaacaaaa

SEQ ID NO: 12552 - DNA, 2699 bp, Heterodera glycines
  misc_feature (1668)..(1668): n is a, c, g, or t
ggtttcagtttgggggaaaatgggtgcgtggcgaatggcgacccggcagtgagaaaacacgtccttttacgcagtcactcacgggtcatgcccagtgttagacaaaatcgctcataacgccaaatagagtaatcggcgtaattttttcgcgctaattcaaaattcacaccggtgaacgcctttttcggatcgtttattttcgatcagccataactcgcttcattcccaactaaactcgaacaaaattagtatctaaaaaaagtttttgagcaggagaatttttaatcaagcgaatgctaagcaatttgtcatctcagaaaaaagttgtgggagtttcaaattttattaggttatattttttattagacttcccctatccctaattaattaccgtattcgctaacacaagggaaccacccgaactgtaagtcagaaaatgcatatgtgttatataccattcgatagagcagggtcgacttctagtgtggatttttaatcttacggatgcattttgctttcttcaagagttatagggcctcaaaagtcgaaattttgtgcttgagggctcattttcaagctttttcactttacatcgatttttatccacttcataatgacagattacatttgttctaaacaaagaaataattttaatgcatttttcatatttaaaaatgtattttttaaatctttaatttgttaaaaatttaataaaatttatttatttttatgttggactcgaacccggacccccaaaattaggaatttaaccaactgagccaccaattttaagtgaaaactcagccaaaatttcgattttggaggccctgtaacttttgaactaggcggaatgcaccgctaaaattaaaaattcacactagaagtcgaccctgctctatccaatggtatatcatttatatgcattttcctacttacagctcgggaagtatccgaaatggttaattggataatcacagttcgatttgttcccttgtcagttcgaagtggcatttgcgcctatgcttaaaatcggtttcaatctcagatttaattgcatcttgatgcattataaattatatcaatttacgaaaccgtttctatcataggcgtgaatatctgcacacggttcagttttagtcctgtgaaaattgcattaccatgtggaagttcggcaagttctccgagggcatttcggggaagggcactctcggctgtgccgaaacatacgctgcgcacaccgccgtaatggttcgtagcaaaaattccggaatatggcccattaaaaaattagggataaaatcgaattattggaggaacgagttcgtcccctctcctcccatcattccccctcaaaaaaaagttttttcattttatttcagtttgcatttttttaactttcaccattttctccgtcccattttaggagatgccgcgcacggaaatgtggttcatcaaaatggccgtggatccgtcccgcagagtgagtttaggagaacgttgaatttatgcaaaaacacgagttcgctagctgacttgtcgggcccgcagttgcattattatttattgttccccccaccccatcttttaaatatttctctcatatgccattgtaattgtttgaccagaattggcgtccatttcgaccaatccctcacaaattaatatttncttccgtcagtttctcgtctgcggcagcgaggagggcgaattgcgcatttggcgattggacacagagaaactaccgaaccgaaagaggtgaaacggacggagaggaagaaacacttggggcgtcttttgactttagtgatttttgtttggtcgcgccgaccaaagaattgaggaaatgcattcggcaggtggcgttcagtccggacggaagggtaaatgcatttgttgggatgaaacgttcaaaaagcggacgaatgattcctttgccaggttatgctctctgttggcgatggtggcgttgtgtcgcggtacaatttacaggaaaaggaggagacggattcggacattgagttgatcaactgatgatctcaaccacctttcatatcatcgccactttatacccttactgtttttattgtttctttattattattatttaattgtattaaattaaatactaaaattgcgaatggatttgcatgggttttctttagattattaggtggaccgaattgtaaaagggcggagcagagaaaaagcctctgtgttgtttgcccagctactgacccgctcgctgatgagtgaatgtttgggctgtctcatcggtctctttgcttggccacaaacactcggaggggggggggggggaggaacagacggacggtctgcaggggacgagggatggccaatgggtggtccctttggcaattcacagccaaaagcctcgcttacccctgaaaactccgtttcccaaaaaaatgcctttttcgtttcatttggcgacggattatcgcatttgctaatctaattgagtggtgccagcggggattcgcctccgataactttggcatttccaccctcccctttggccccaatgcttcaaccctttccctcccccatttatttgcaattcttcccaattcattccctcccatttttgcctgggaagggactgtccgttcccctggaaacagtccatcatccggcgggatgcgttgatagaatgacaaccacgaccaatcaccgagatg

SEQ ID NO: 12553 - DNA, 1573 bp, Heterodera glycines
gaggggggttgaacaatagaggccccgggggctctaatcgagtaaactacggtattcaaatcgtatccgaatcaccttcgtgtgacatttgactcagatttccccccgctgcgggttgtcccatgcgacaactgtgcaccacaattctcgttgcagctgctggtctctccattttcttcttctcacgtttgtcatcgatgatgtcatcgtcacccgcaaccgtatgagaagcagactttcgttgtcgacgaaccaccagcacaatcacaattgtcaggacggtagccaaaatgaggagaccacctctgaaagtgggatgggggggggggggggatcaacagtttgtgccattttcaagcaaacagcggaagttggcacgcacccgaggaggccgtagaaaagcaaatccttcaagttcaaaatgccaccgcccttttgccaacattgctcaaccaacaattcaggaccgctttccgccttgtttagaagaaccacgacatcgtccttaaaaaattgtgcaattgccaattaaacaaataaaaaaaattacgatagttccttgttttgctaccccccccctcgaaaaatttaaaaaaatcatagatattttttaaatctatgaccagcaggtgttcagatgtcaaaacaaacgccacattcgtgagattgatgagacgagaccttgacaaatccaaaatatgaatttttaatatttttcggggggcgcgggtagcaaaaacacagaagtactgaaatgacacggacaataaacgctttccatccgcactgaaccaagtcgtcatcatcatccgagatgtttttccacaaagacattgtgaaatgacgcgcattcggcaagccatcgaccggagtcatttgaagaaggttgcacgtgacattcagaaacgcacatttgccttgaccacagttctctccgaagcgatcttgaccctgaaaaacaattaggaattgttcgtacataattaacactgatttgcaacacaaaaacactgactgaccgcacgtccctcgagggcaacagcgcgctcatcaacggcacaaccggttggcatttgaacacgagaaaggaaggatgttttgcaattgatgccgccaccatttgggaacagtactgacatcaccaagcgtttgtccgcagcgtcgtccaaacgaagcgcatcaatttttgcgttgccttcattggttgtcagttgcgatggatcaacacgactgaaaaatgccaaaaaacataaatgaaaaaggaaatttgaattttcaacttttgttcgaattcgggtccggggttcgaaattggtcgaaattaatgtgatattcgtgattagcgactcacagccgcttctctccaacaacagtgaacgtgccgccgtgcactgcggcatctttcttcgcacaggcaaagccgcgcaatgaaaaactgctgctgctggcatccgccgattgggagcagcaacgggcgaagagcaggacgaagacgaacactgacaaaacagaagaagcagaagcagacgaaggccacggttgaagagacaatgaataagccatacgatagaag

SEQ ID NO: 12554 - DNA, 3317 bp, Heterodera glycines
atttgtccttgccctggaaaatcataggcaacgcccatttgttgttgttgttgttgtttttgttgtagtgcagctttatatgatggcatgttgatgtcgtctgattggacacttggtacttgattagcggcgttgaatagattttcccatgtgtcaatcatcccaactttgttgtctgttttcacaatcactattcggttatcatttggctgtgggttgtcttgttttgtggtcggtaacagattgcttctctcacaactagcaatgtcgtagctcttcatagcttgctgcacgcttgtttcactatcatcttcttcactattatcactatcatcttcttcactattatcaacatcgctatctaaccattgtaggattgctaagtacctattcagacataaataatataaaattatttattattagagctcgcatttgaggcatatatatgcctttttgctgcgcgcactaattccgatatactaagcatggcttctttttcttttattatgccttttcttttttgcgttttccggattttcttgccttaaatgccttttttggcattttgccgttttggtgccgtttttggcgtttttttccgaaaaatactattacaacaaaatcgggaaaaaacacccccaagcaaatgacatgaaaatatttcagaaaatacacccctaagaattgaaaaaaaatttaaaaattgatcgccaaaatttcatttttttctagtgcctttttcgcgatttttcgtgcctttttttgcgagctctatttattattgacgtttaactattcagttgctcaaaaggcaaaaataaaatttagctccccaaatgtattttttgccgaaaaaattaaacttaaaaatgaaagatagccaatgacataaccacataacctaaaaattgcatccctgataaaggaattaaaaacaaattaaacaaatacccgcttatcacgaacgcctcatcaattttttttttcttttcaaaaaccattttgatttccataagacgatcaacaagttttacctaaaacatggaattttccctataattgttaaaaccctcttgacgatcatcttacttcagattttttgaatttcttgatggcatcgctgtacactttactaatttcccacagctgaactggagcatgcaatatgaacaggcgtgacgcgtcgttgaacgcatcactcaattcattgactttatcatttggtgtcttctggcctttcggccattgttctgatgcagaccagtacagacgttccaacttttcatgtaacagcagtgccagcagaaatggtcgtccatagagcgcgtcaatgaataccaaacgggccaatctctgaattttacagagttctagaagttttttctgggcttcggtggcaaatgcgaaatggatttttccagattgaaataataatgaaaattttcttgtataatttctgtgaaattccatccatactgggcgggggcggtggtgacccacaaatttggtttttataccgataaaagtgaaaaatatggaaatgaatttttcaaattgatggcaaaattttagaaaattcttcatatttcattaaatttaagctaaaaatatcgaaaatagttaaacatggtaaaaaaacaatttaaaaggaaaaatacaaaagaaagcgataattattgatttccaccaaaagttttcatgcgttttaggccggccttccacagttaaggaaaaaaaatcttcgtgccaaaaattttgaatttggataaaaaatttaaaaatttttagtccatattttttgctttgttttcgatgacggattttagcggatttagaaaaatctcccacttagccttttccattaccagcaatgcgagtgcgtcggctgggatttttttcttttttatttcttctgttatagtccgatccaaatcatcaattacattaccatgctgatgattataatatactaaaacacaacgcagtctctcataattgtcctcggtcagcattcgtacaacccggtctttgccgtccatatcatttataaattcgttgtttcttgtccaaacgtcgtcaaaattattactagcatctttgataaatgctttcaataaatcagcgtcctaaatgagaaatgttttttttgtattaaaaattggtaaatttgcacatgcatctatcggcacgtgtacagagtgcgtaattgcattttttttaatttttaaattcttagaattttttattttattagtcctaaagatcattgtaagcgtaaatttttggtcaatcgtaacaaattccaaattttcttcaagaacctaaaattttgcaccaccaaaaccaaacaaaaaagcatttttttcaatattccattacttttttaattgttgctggcgtatataaagcagcctccttttttccttttttactaaatggcgcaaaggtttgttcacgatttgtttcacaaagatttataatcacaattgcatatttcgaagctcctttgagtttgctttcccgttttctgaaataacaattaacagtttggtaaaagcaacaattttgcccaaaaagccgataatagccatgattttatttttgatagggcccggattcatgactgtaaccagaaaaaaagatgaaagattcttaagagagggacccaaagtcctctttttttacatactgtatatattatatatatatatatatatatatatatatatatatatatatataattttttattatttcttttaaagtttttaacccaacaaaaaatgtttaggtatatatataacccgcccgccaaagaagaaactcaccttaaatcagtgcacaagcctggtgcatcttccttattttttttcccatcaacctgttcatatttttttttgttttttgcaagctcggtatcatatattttatgatttgccttgatttcattacgttcttctttcgttaaagtaaccataatttcatttacgtcatcaaaatcactgtcttgctgcaatttgttatatatgtgattaaatagggactccatttttatgcaaatgcctaaatttctgcgcacttaatacgctcagataagcacgaaaaacgcgttttccgcttgattttgggtgtctacgatgacttttataatgcctatttggtgcctattttagaatttttgtgcctttttaatgcatattttacgattttttctgccttttcctatttcgcaattttttgtgcctaaaaatgaattaccctaatgattaaaaatgattgcatatttggaaaaataataaataatttatatttga

SEQ ID NO: 12555 - DNA, 2225 bp, Heterodera glycines
  misc_feature (2215)..(2215): n is a, c, g, or t
ttttttaaacatttattttaccattttattcatcattattattacatacagatcaaaatttgtcgatttttccaattttctcaataaaattttaattgaatgaccttacaaaataatgcaatgtggttcacaagttgttacgaattgagacggatacgggacgtacattttttcttagacaatcccagtccatttcggtccactgtcgttatggtaatggtgaagggttctctccacagcgtcacatctttcagttgattgttctgtgtcacttttttgtactggtacagaatgctgtcgagtgtgttgtttgtcatttgttgtattggggttgagatgtctccgcctttcaacagaggactgctgatcatacagccgaggtgtgtaggttcgatgttgcgctcacggctgtcagcaaatgcctcctcgatataatgtttgaaagtccaggtccacattgcctcaggcgtgctcggcaagtcggtaatgatgaattttgacttgactttgacatagtggaatttggccatatgctcgatgtttttctccaattttttaacgtagtctttggccactttcgatgctccttcggcttgttgaactgagtcgtggaagtgtactatgccatgttcattgatcaggaagccttgacggggctttttgggctcggagagaatatggtcaatggaaaagttagtgaagcgctttcggcgatgattgtccatatttttaaatctgtgcagggattgaggaggagtgaacaaaatttcggtatttatatgcgcaaagcatggaaatagtgtgaagaataaaaggaggtgaaagacggaagatgaataaacatttaagcatgctcatataattttaataaaatttaattatacggttccctaaattcccaattaaataatacggtgcccataaagcgcagaaaaacagcaatgtgcaaaaaaaaagtgcaaaatttttaaaatgaatcgggaaaatgatcgggtatacgatgtgtgcactttggccacgcccacttgcgcaccaaatcattcccagcaagaaatcgaaatcattctttattcaaattctagaaaatgaaacgccctaatcctttgaaccttccaacgagtgagaaaaagccaaaacttcgtcgactcctgccggctgaattgaacaacgagcagatcagtttcgtgccattagtctgcctatttgccaatgtgaagcggactccaatcggtcctgtttgttaccaattcgagtgtttccgtagtcagcgccaaaagtgctttgaatatttggtattttaccaaatttattattttattacataaattatttatagaagggtgttattgcagtattcgatgtgatgtttgaggagaaaaggacaccgaagaagaagaaagtgtggagactgcatctacaggaagaactgccgcatgagctcagccgaaatgagcttctacactacctcagttacggacgactgggaacgaatttgttcgagacttattttgtgatgagccaagcaacaaatgtaagcgaaaagttttaaatttttaatgacaacacaaaatttttagtcaattgccattgggaatttgtttgggcttctgctcgattttgcaatgagctcaccaactccttggctcatgaaacgaccaatttgctgtggaattttcttccgacaacatttgccatggattctgcaacaaccgatgaacgtaatgctttctcatggcttttttccggaggtccgaagtgatggttttgaatttttttggctgttcaacccacacttgaaaaagtatgctgggtatgtccgaattctccctgagcttagtcagcctgacaatttgcattttttccttagcattttctaagcattttacttgaccaatttattcatcattatcattacatacagatcggaatttgtcgatttttccattttctcaataaattgttgaaatgaatgaccttgtgacatatgatacacaaaaacaatacaatgtggggcacacgttgacactaattgggattgataggaacgaatattttttcttaggcccattggaaacttattcaggaatgatgacacaatgacagatggtattttttgggctaagctgtcataataaatcactggttcttccattcccttcgcataaattgcacaccaatgagaccctcccttgtaatgtgggtccctggttcacanattagcgctg

SEQ ID NO: 12556 - DNA, 1745 bp, Heterodera glycines
  misc_feature (123)..(123): n is a, c, g, or t
  misc_feature (136)..(136): n is a, c, g, or t
gcatgagctcagccgaaatgagcttctacactacctcagttacggacgactgggaacgaatttgttcgagacttattttgtgatgagccaagcaacaaatgtaagcgaaaagttttaaatttntaatgacacacanaaatttttagtcaattgccattgggaatttgtttgggcttctgctcgattttgcaatgagctcaccaactccttggctcatgaagcggccaatttgctgtggaattttcttccgacaacatttgccgtggattctgcaacaaccgatgaacgtaatgctttctcatgacatttttccggaggtccgaggtgatggttttgaatttttttggctgttcaacccacacttgaaaaagtatgctgggtatgtcagaattctgcctgagcttagtcagcctgacaatttgcattttttcttcagcattttctaagcattttaattgatcaatttattcatcattattattacatacagatcaaaatttgtcgatttttccattttctcaataaattgttgaaatgaatgaccttgtgacatatgatacacaaaaacaatacagtgtggggcacatgttgacactaattgggattgatagggacgaatattttttcttagacccatcggaaacttattcaggaatgatgacacaatgactgatggtattttttggttaggctgtcataataaatcactggctcatccattcccttcgcatatatggcgcaccaatgagatccttccttatagtgggggtcccggtttacgattagcgttgcgggatattgtagagtgaccggagacggtaattggtcactggcgaagcagccccgaatttactttcacccctttggcttaaagtttgatcggcctttttatcgcattgaagaaacaatttttcgcattggcaaattaattcaaatttaaatattttgttggccgaatttcagaacacccgattcattgcaatgtcatttttagaatgtggcgacaaaaattgtgcgagattcgttgagcttttatagacaatctatcaaacaaatgcctatttttaatgcctacgcgctagagctgcaaaatttcttctcaaatgtttttctgctgctttcaatgtgcatacatttatgtttgaaaatgctccaaagatgacggacccatttaccattcaagcatcctaaattaaaattttcataattttttttcattacaaaatatttactttcacccctttggcttaaagtttgatcggcctttttatagcattgaagaaacaatttttcgcattggcaaattaattcaattttaaatattttgttggccgaatttcagaacacccgattcattgcaatgtcatttttagaatgtggctacaaaaattgtgcgagattcgttgagcttttatagacaatctatcaaacaaatgcctatttttaaaacacccgtttcattgcaatgtcatttttagaatgtggcgacaaaaattgtgcgagattcgttgagcttttatagacaatctatcaaacaaatgcctatttttaatgcctacgcgctagagctgcaaaatttcttctcaaatgtttttctgctgctttcaatgtgcatacatttatgtttgaaaatgctccaaagatgacagacccatttaccattcaagcatcctaaattaaaattttcataattttttttcattacaaaatatttactttcacccctttggcttaaagtttgatcg

SEQ ID NO: 12557 - DNA, 3255 bp, Heterodera glycines
agctatcgaacaacaccaagattgcttaatttagtttgacaattaacaaagttacgttccaaaaagtcttccgacgacgtctcggccgacgacgttttggggtgcaccggccaacagcaggtgccccagagaatttgtgaaaatattggcatttttcaagaaatttttaccctctgccgcagtttattaaacagtttcattcatttcgtctcgtcccacctttttcggttttgtcacagcagcagctatggcagtgccatggtcagcagaaactgcgtcttttgtcgctgttgttggtgccgccaacgatggttgttcagctgctgccaatgatttggatgatgacgaagccgcttcgtccccgtctccaccaccaccttcaccagcaaaagtgccgtcctcatcgttggcaccggttttgccgtcaatatccgttgtgtgcggcgtcatcgtcgccgtttcgttgatggacagttcggcttgcagacgggcggcaactcgcggttgaccttgggcaatttgcgcgagcgttggcccgccgcgccgccagcgtcgttccgcttcacaaattgcactgagcgctcctgctccaactgatgttgcagctgaacaacaaaagagaaaaggttaaaaaacaataaaatttttggtttcaaacggaatttttcggttaaaaaccgaaaatttgaaaaaaaaagtttggtgaaacaacgggaaaccaattaaaaaatcagtttttccgccccgaaaatatttgaaaaacgattttttaaataaaaatttttccaaaatcgctaatcaatttcttaaaaatactataaatgttttctggttcatccctctgtcatcaccactccctcccacctttttctcccggtacgcttcgaatgcgctcagttggcactgactgcgcgcctttttgtacgtgcccatgtccacgaagaagccgtgcatgtaggcacgcagcgcattggtgccaatcagtttggacaagcccagctcctccaactgcgacttggtcacaaatttgaagtcgtcgtacactgagaaaaatgggggcaaagtgattttttgtgggattaaccatctttttttttgtttaaaacagcgctttcaagggaaggagactcattttcttaattagtcaataattagtcagtcattaattggcttaaagtgccaaaaatcaaccaagaaattgtaaaggttttcaatttattgttttttgaaaaaatttttgattggaggcatattttttattgaatttttttttgtcttgaattttgagttatttccagaaaaaaacacaaaaggaggcaattaaaattttttttttggaatgcttagattggaaggaacattaaaattcaatggcataaatgtgccaagggacgggggtgaacgaaattttttagtgggttctcgtgtgggagacccctatcccataaaattttacgcaaaattttttcagttctccaacttgcactattgttaaatttaaaaaaaaattgtcgcttgaatctggaagccaacatgcacagtgtgcttttgaagcagtacattcgactgtggcggataaaagcgagcgaaacaattttttgcccaatttatccacactcgccagcagcacagttattgtgctggcaaattctacaaattggggcgtgcgcatcggcgcggaattgaaccaacgacaacaaatggggaaagtgacaaacgcacagaccactaagccaaaaaacgatgaatggaagactccaattaaataaggaaataagaaatgtttttttaaatgcataccggaaggtttttcggcctccaattcttcagtgatcgattcctgaaatataataatttttaaaatatttaaattatttaggaggggggggggattttaaaaggagaaaaaattcatttttaatctgccataaaaaaaattgtcgctgaccaaatgggagcaccagcgcggggcgggccccaatgaaggcacaaaaaattgttgtatttttggctcatcatttgcgaacatgatgatgcctgaaaaagaaggggggggggatataattaaaatcaaataaattaaaaatggtttttaaatggaatggatgtggtgccgtcgaacgaacccacccgagttgggataacgggcaaagtcgcgcaggtccatgcccggctcaatgctggtgaacggctggccgttgtgttcgttccaagcctggcagcaaaaaaatgggaaaattttttctcacgaattttcaaaataaaatttgccataaaatttgatttttataccagaaaatatattttaaaaaataaaaaagtgaaaattataatttacaacgacttttctatttttaaaaaattagaaaattatttttgtttgtattttttgtgcaaggctaattgtaagctaatttgtgaaatgtgaagctaaatgagagtgaatttgaattttcacttttttaatttactttcagtgcccgtccgtccatgctgagcaccagttcctgttcaggtgcaaactgtagtcgggtgatgggcaggccgaaattgtgatttttgctcaaatatggcttggacgaacggacatcgtacagcaacacctgaaaatggaaggatgggttggtggacaaaaaaaatttgactccctacaaaatttcaaaaataatttagagcccttacaaattcaaaaaaaaaaaaaaaattttttttggttttgcgcaaaaagtaaaaaaaaaaattataaaaaatattggtaaaagaaaattcaagaggaaaaaagcagtaaaagggcaaatttttaagaaatttaaaaacgtcgaattttttttttttttttttgccactcacataaccgttgctgagcccaaccgccaaatgcaatgcgtccttaaagcaaatgctggacacttcaatctgagaccttaaaaaaagaaaaaatgcaataaaaatttaaaaaatggctaaaactgacccgccgccgctgtccaggtccagctccaactcgatggccttgttcagcacacagtccagcattgccacgcgtcgtcggcaccgctggtcccacgcctccacccgcgcgtcaccggtgccacagacgaacagctgaaatgcaaaaaaaaaaaaaagaaatgcggccaatttgaacaacccgccgtaattcacgaaaattaaatttgaaaaaatggaaaatgttcgggaaaccgttttttaaagtttttggtgcataaattttttgaaactcaaactaaattt

SEQ ID NO: 12558 - DNA, 1855 bp, Heterodera glycines
cggcgggatcccggtcccgtccgggctctagaaattattgcataggactgaattggcgagctcatcttataaatccaataaatccagacaaccaactaggtcaacaggtctctgtttttctttcagcttttgaaatcataaaatcaaatagagaaatattgtctcagtcgcataaccattttttatgcataaaataaaaattaaagaaaaaatgtttatgtaaaacaaatcacagcgaaaaacaattacaaattacaaccaaatttaatgattactcaaaaacaaaataaagtgaaaatagtggttatgatcggggataatccttgaaaattttgtgaccgtccgattatttttgtttggatagattccgtaaaaaatttttttcaatgattactcggtcggcggagcagtaaaaatgtaaaataaattaatggaattattgcgaagaaatggagacaatgaatgatgatgtgggattgatcgtatggtgttgcttttacgacggctcagttgcagtttttcacgacaattttaatgcttcacaaaatttcaataaattcggttaagttacaaaaattatggcaaaaatcctttccaaacgttttaaaaataacataattttttcaaattttgtaggctaaaagaagggattttaaaacaattggaagacacgaggaattttacaaatggttgtttaagcgaaaaattataaagcgctaaaccgctgaaactgagccattttaccggggcaaggaggtacaggagagcgaagcagaggaacagagcattttccaacaaaaaaaaaccgtggagaaattttcaatttgttattttttgaaataatatcgactacatctcggttgggaaatgtttaattttttacattttaattttgttggaaataaaaaaaattcaaacggttactccgtagggcaatgttagttaaattgtaaaataacaaaggataacaagaaaaacaaccaaaaaaaaagggaaaaaaagattgtcatgcccttccaaggcaattcaaattccgtaaaaattggcaaaattcgacaacctttttttcttttttgcgagacaaggcaagaaatactaagaaaatgaatgaaaaacaattgataaataaaaaaatggtggatgataaagtaattaaaactcaattagttaattaattaaataccatttatttgcatcataacaaccatatcatattattatcataatcttcataatgagatgaaaaacaaaaataacatacatacaattacataaaaacaaacacagagatagagagaggcattattacaatataggtatgaaaaataattaaaaaaaccaataaataaataaataataatacaaaattaaataataataaattatgcgcacaattcttaagtgatgattttggtgaaagtacgaaagaaggaatgcgggaaatgaatgaagttaattaggtaattagaacaagaacataaaaaaaggagaaggtggaggggacaaataaaatttataaatacaattaaaggttaattaattattatttttgccatttaaattcaaaggcctccgccatttttgtccgtgccaccgcccctgatcattgcgtactcgcgcgccttggcctcgttgtactccttgaaggtccaatgctggtacacattgtccacgtcacaggcactcatctggcaacaattaaataatttatttaaaaatgaaaaaataatttaaaaaataaattttttgaaatttgtataaaaatattgccacaatattctacatatattgcgatatgatataagcaaacagcagcctcaccttcaatttggtgccatccctggtcatttccatg

SEQ ID NO: 12559 - DNA, 3121 bp, Heterodera glycines
  misc_feature (509)..(509): n is a, c, g, or t
acggaataatttgtttgttgatgggcaattaagccacaagggggtggtgagagtttgtccgtaatcggcgggtgggcacttacaaaagggggtaattagcagggttcccagatcaaaattttcaaaagcctcatttggcaggcaaaaaagcctcattttgactcaaaaagcctcatttctacaaatttattcaaaacacatttaaaattttcaaatgttatattttttattgtgacggaagggctcggagaaatgcgacccaaaagcgaaaaaccgacaattcccttttatctttttcgtcgtcttctaattactgcaccttgccacatccttctaaaattctacgccattatttaatgcctttattaacacttgaaaatggtcatttgtgttttggccactttgacgccctttcactgctcatccccatgattagaagtgggtaaaaataatttgttagttgatgggcaatttgcaactgctgaaaagccattaagtgggaggggggngggggggggtgagtgtttacccaccctcgccgggtgagcacttacaaaagggggtaattagggacggtgggggcgggggggggcagtgatttggagttgcctctccactgctgctgctaatgctgatgacgattattgttcgattcgcttttgttgttcggacggacgggcgaatggacacggaaattgttgcaccaaaatgcatccgtccgccacaatttgcccaaattctgctgccagaccatccatcatcagtaacggacgaatttcctctgatgtatgccgtcaaatgtcgtgccaaacacagaaaaatatggccgcccgtcgtcctaattaactgattaacactacaactgaacgacaccggcggcgcctttgatcagtcaattagcccagcgctgctccaaatgataagaattttccaaattctgctgctgtttgttcttaagtattttcgccctgtcgcttctgtcagcacgcgactgctcttcagtgataatgatgacgcacttctccaggcttggcatgaacttgttgcgcttcaggtgctcctggccaattgcaatttgtacaagaaagaaaaaattgtttgaaattgagtaatccgaatccattccaagtgcaaattccgattttttccgcctgctatgaaattattatttcgggactgtgcccattggttcgacatcccaaaaccgtaccgcaggccaaacaaagtgccattgcgcaccgtgaccatcccgtggatgaacgacttctcagcccactgcgcaagtgtggtggtgctgctgcttcatcgccccggcacggcacaacgccatgggaccccaatgcttatattgacaatagtgatgccaataatgatgatcatgctgataatctgttgccgatttatgccgtttcttcttctgcttcaacattggcaccccagcgagtggaaatttatgccgaaattggacatttgacccaattttgtggggcggaggaaccgttggcaaaacgaacaacagttgacatccaacgattggcagaaggtgggcgagaggattgagtaagacaaactttgaaagcatttagtcactttcaccaaattttgaagcttttgtccatgtgatcgtccggtccattttcaaaatttgttatgatcattatcaacttctaaaaacagtcgaagatttcaaaggacgggataattagatgctcctaattacaaccaaaatcttatggctaattaccagaatttctgtcgacgtcagatcgattgagcccaaattaagtgaccaatcaataatcagtcaatgcttcacacagaatttcgcaacaaatgctctgtccgatcaccgtctccgtcttcattgtcgtcgtctctgtccgtctcgtcaaagtttgttgtgtcgtcgctgtctcttgcacaaattttcactgtaatgggcgcccgagttgagacagtagtgatcagtgccgatgagaacgccaccaatagtgccggtagtgccagtgccaaccgcaaaaacttgcaagaatggacgcgccaaatggtggacaaagtgcgccgcaccgtccgggcccattccgagcggtggaaattggtgctaattgcgcccggacttcacgtaattagtaatcacattcggcttacatgaaaggggtggccattgatcagtttagtgatggtcctgatcaatttatgattgggtcctggcaactgatcactgaccctaacaaaccctaattaatttgatgtaaaaagagttagaaaaggtcatgggcttagcttatgatcagcgtgtgatcagagggaatgaatattaactaattggaaaagccttacaattaatcgaacgtaagaattttgattgtgaaattctgatcagttaatggcaaagcaaatgctacaagtgatcagagaatgtcccaatcaatttaaaggacattccgtacgggcaaagttcggccgtacttgcccaggacgtgctccaaagtgtgcagctgatccgccatggccttccccgccgcacttttcttctcgtccttcgccagtccaacttggtcagtgctgctcattagccatggatgcttcttcaaaatgccaaattactctttgtgttcttagaccttttggcgttctgttgccaaggcagccgccttctgttcaaaaatgttgtccctgtgggagcttggcgaggcggacgatgacgaaagggcctgggacctggtgagagacatttgggtgatctgctgatggtctaactgatcagaagcccgcctaatgcctcgttattttccgatgaaacccttcctaccaaattgctttcatattaggattaattagatggtttaatattctgctggtgattagttaatcatttcttgttgttgcatcttattaatccctgagtgactcctacatttataaaaccttcaatcaaatggcattatggaattactcccggacggctcccggaattttcgacagtaaatacaaaatcaaattttcttattaaaattatttatattgtttgtctgttttactaaatttcttttaaatttacatattaatgtgtgttgctaagtcattattactagggaaacggttttttggtttttaccta

SEQ ID NO: 12560 - DNA, 1119 bp, Heterodera glycines
tatttctgtcgaaaagtccggcgcccctcccgggacaatctatcagtaattttttaaaagccaactgttttttcgagtgtaatattggataggtaattaattaattttcttacatctattaataatttttagttttttccatttttaccaaacctaaacataattcatttattttaaaaaaaaattttgctgattgaaaaaaatttaaaaattaaatttaaatcaacaatataaaaagaagatataaccctaattttttatttgtctccaagctaggtttgcatttttttgtctgtcaattttatcaaacagttggaaacacgtcttcgaacagtgtacggtgatgatgaagagtttcatgtgcaagtggtggatttgatggagcacgcgaggcccataattagcgcaggcaattagtgagctttgcccgtaattagcgcaggcaattagtgagcttttgcattaatgaaacgaataaaactcggcaatagcatttttttattaatttactgaccggcaattaaaaaaacccattatcatgatcatgggaaaatcccccgtctcttcacactaacccatgggaaaatacccgtcagatatgtcaggaaatcccggcagactccgactgattcctcccgatcactaattgcctttttccagcgctgatctgtcaccgttggcctccgattgtgtgcatttgtcaccgcgtggcctctccctgctgcaccttcagctgtggaattggctggttcagccccgtcttcgccactcccaaccgttcgttcattcgttctttgattgatcactgatcagcgttttgcgtattggaacaaaaatgaaatcacttgcgtaagctctaactcaagctgctatcaaatgatcaatgctggtcaaaaaatatatgaattttttatgtaagccctcgtaaatttggctttatccccccgtgcagtttcgtgccacttcttcgtcctccgctttgccctcgtccccattgtccgtttttggcaactccgcgcaacaccatttcatgcccacgggtgccgccagaccgagctaatgttcgttgtccttcatgaaggatgaattggtttcgtcaactttcaaatcttatgatag

SEQ ID NO: 12561 - DNA, 2239 bp, Heterodera glycines
aaaactagggtaggtcgggaccgggaattttaggcaaaaccgggaccgggacttttcgggttgaaaacccgggactttttggctgggaaaaccgggaatttcccggtcccggtcaaaactggttaaaaccgggacttcggtactcagttgtccgtgttttggtccaggtcccgacctaccctaatgaaaagcgattaaattactataatcaacgccaaataggtatgttataaatacaaaaaaaatgtgctaaagatatgaccatgcctatgtattattcatctatctatacattaatataactaaccattatacatcccgtcaacatcaccaaatgacatgaaaccaccaatgagcaaaagcaaagttgaaaatgacacaaagttgttcattttatggaagataaaaatagaataatttgatcactctaaatattatgtattaatgaaaaaataatcctatggtctggcaataaatttggaaaaatgggccctagccaaaattgtctacaaaatcgcttttgaaaagattattaaaattttttggcggtcggtttttcattaaaaagttcgaaaacgccgaaaattgttttcggtttttttaaaaattcttttcaatccattaaatttgagttgtttaaaaaaattaagtaaaaaggggtaaatttttaagaaattctgttaacatatgtggccaaaactccaattttttcccagacggagcctatagacacagccggaccttaactcgttaaaatttccttcgaaaattggccaaattcgcagaatttggacaaattagttaaaaattacactaaattttcataattttggggcggcttttacgcaattttagatcaattttgaaaatcaagtttatttttttgcaaaatctaccagaaaaaactaatttaatgatgaaaaaaatcacattaaaaatcaaaaattctcaaaaatcaacattttttatccaacaattctttgattgttttttcgggtaaaatttgaatagaaaagtcggaaagaccgaaaaaaatgaccgcgccgatctcaggttaacacaaatcgtctaaaaatatttcagttttcaaaatttaggcaattcgggaatcaaaaaatgaatgaaaaaaggcagaaatttaaaatgatatggcaaaagagtgaaagcgcttggcttttaaatgcaaaaattcggtaggaaaagctacttaatcactcgtaatttgcagccaaaaaaggaagattctttctttacatttgcatcataagattgccacttttgcataaatattatttttctcattgtttctacaataagcgcgaaaaattgaaaagcctcattgacctatcaaaaaaccacaaaatgaggctaaagcctcagatctgccagccctgtctaaaaataataacaaaaaattcaaaaattttgctaccagcacttgccatagacaaatagagaatcaaaaaaagtcagaaaattaataatgaaaaatggcattttattgaatggcgccgttggcttttaaatgcaaaaatttggctggaaaagctgcttgttcactcgtgataaccagacaaaaaaggaagggtaacctttctttacattgccatcataaaatcataagaatgcactttttaagataaattttttgcactttttcataaaaaatttttttcattgtttcgaaatggggaaaaaatcaattcatacacgcgtgaattatggctaaatttttttagatttgccctttttaatatacaaaatgattttttaaatattttttctaaaattacgatttcccagcataaatgtttgcttaatttgtgtttcagcgggttctcattcattcaaattaattgaaggagaaaattttggaactcaaaatccaagaaaaactgtggtgcctgtggatagtaaattgaataaaaaatttcggcacgggtaaaaaattatgcccggtacaatctgggaaaaccggggcgacgaggcattttatggaaaacctaccgggaactggaaaacccattaaatttcccccatttgaagttgcggcaaacaatttttgaactgccgccgatcccccataattccggaccctcgaccatacaatttttgctagtcattcggcatcattgaatcctttcaaaatttttatgaaactcctttttcgacttcgcttgaaattttcaaataaaaagtcatttctggggtaatttgtggcgctgatcacgaatatgac

SEQ ID NO: 12562 - DNA, 1177 bp, Heterodera glycines
aaatgccaaatgtggttaaaatttacatatatgtggaaggaaaggccccaatcgttagtttcactttgctttcaattttacctttatttcctaaacccaaaatggattattataattatgaccgattaatgaccgaatgtcccaatgaaattgaggcaatcaaatttttccaaaccaatggcctgctacacgcgcaaatgtccggggcgcaaatgtggggcaaccattgaattgtacgatccaagatggataaagtgttgatgagatggattaatgctaattgtaattcatcaagttcgaaaacttctgatttttattccggaatatgtgtattccgacagttcattctggtgccgatttgtccatatgggcgactcattttggtgataaccgtccgtgggcttggagtttcattggccggcatcatccggcaattccagccggtataaaaaaaaagccaccaaatgaaaattttcaacaaaaaactacccataactttgcttaaacccaactaaaattttaattctttatatcattcgatagccctaagagagtactctattagctctccttatttaaaaaaatttggtcgagtttgaacaaagttatggccaaaagtaaacaagcaccaaaaatttttggccataacttttttgaagtagacataccttttttgaaacttacaaattttaacaattttgcaggctagtaggaaacccagggggtatcgaatgagactcaagattatttaatatgatatttctaagaatgttttgatcagtattttggtgaacaaaattattttatttcgaatgaaaatattttaaatataaattgctatatattttttattttcttgttatacataaaaattttttatgaaaaagtgcaaaaaatttatcttaaaaagtgcattcttatgattagggtcgcgacttttagtgacaaaaaatctcaaatagtaaactaaaatagtgccaaaaaagtgccaaaatagtgaaaaaagtttgaaatagtgacgaatagtgatataattttcagccaaaaattgagcaaaaataattttgttcaatggttgcagttgcaaatgagaagagaacgagccgagcccggtactgggttttcccgggcccggcaacccggcccggcgatttttgggaaaatccgggttgaccgg

SEQ ID NO: 12563 - DNA, 3448 bp, Heterodera glycines
  misc_feature (19)..(19): n is a, c, g, or t
ttgctctaaggcaattttntcgctaaaatcaaaccctgacgagttatgggtccgggactgaaatgtcccgctcaggccaaaaattttttctatttccggaaaaaaatcgaaaattttctaaaaatgtcaccaatcgatagagctcgaaaaacggttgcttgaaagtggtctccgtttttctgggaaaattcgttaaaaaatcataaaattcaaaaaccaaaaaatcgttttttaggcctagctcgaaaatttttgaaaattttcgaaatttttaaacatggttcgatagccctttgaaagctctacaaaaagtccgctggcgactacccgctccgagcaaaccctggcgcggcattcagctggtactgaagtgtccaaaaaaagtagttcttacgttgccatttttccaggccaggcctttggtctgatcaaaaaacttttgctggcaaagttgtagagcacagttggggggtgtgccttttggggtccgctaagctctgaaagcaaaagcaaaaaattttgtaacagtgagactgtcggcaaagttggtttttgagccgctggtactcagttggcccttggaccggaaaacctatatttttcccggattctcctcaaaaagttgtaagacccttccactactttcagggcgctcccggccttcggccgggagattttgtttttgcaaacgaaactccttgtcaatataacatatatagtaactagcgggtgcgtgaaccgtcggctatttagctgggcaaaagcgcttcgcgctttgggagcttcgctacctagactgtgaagcgattcaaattgatcgaattggttggagatttttttttgaatttttaaaaaattattatgggtttttagtccacatcgaggctcaagatgggctcttcgcgcccttcgcgtcctcgaacggcgctttgcgcccgtttctaatttttgttgtgcttttcggccgcttcgcggcctcgaacgggcgcttcgcgcccgttttttaaattttgttgggcttatacgggcgcttcgcgcccgtttctaaatttgtttggctattaaggcagcttcgagacctcagacgggcgcttcgcgcccgtttctaaatttgttgggctattaaggccgcttcgcggcctcagacgggagcttcgcgcccgttttttagcttgttaggccgcttcgcggcctcagtcgggcgcttcgcgccggtttttcaatttttgttggccttgaacgggcgcttcgcgcccgtttctaaatttgttgggctattaaggccgcttcgcggcctcagacgggagcttcgcgcccgttttttagcttgttaggccgcttcgcggcctcagtcgggcgcttcgcgccggtttttcaatttttgttggccttgaacgggcgcttcgcgcccgttttttaaatccgttgaactcatacgggcgcttcgcgcctgttttttagcttgttaggccgcttcacggcctcagtcgagcgcttcgcccggtttttcaatttttgttggccttggacgggcgcttcgcgcccgttttttaaattcgttgaactcatacgggcgcttcgcgcccgttttttaaattttgaggtacaacagcgattagaagagtgattagaagaggtacaacagtgattagaagaggtacaacagcgattagaagaggtacaacagcgattagaagagtgattagaagaggtacaacagtgattagaagagtacaacagcgattagaagaggtacaacagcgattagaagaggtacaacagcgattagaagaggtacaacagcgattagaagagtgattagaagaggtacaacagtgattagaagtggtacaacagtgattagaagaggtacaacagcgattagaagaggtacaacagcgattagaagagtgattagaagaggtacaacagcgattagaagaggtacaacagcgattagaagagtgattagaagaggtacaacagtgattagaagtggtacaacagtgattagaagaggtacaacagcgattagaagaggtacaaaagtgattagaagaggtacaacattggtcagaagaggtacaacggtgattagaagaggtacaacggtgattaaaagaggtacaaaagtaaatggaagaggtacaacagtgataagaacatacaacagtgattaggagaggtacaacagtgattaaaagaggaagaacagtgattagaagaggtacaactgtgattagaagaggtacaactgtgattgattagaagaggcacaacagtgatgagaagaggtacaaaagtgattaaaagaggtacaatagtgattaaaagaggaagaacagtgattaaaagaggtacaatagtgattaaaagaggaagaacagtgattagaagaggtacaaaagtgatgagaagaggtacaacagtgatgagaagaggcacaacagtgatgagaagaggtacaacagtgatgagaagaggtacaacagtgtgagaagaggtacaacagtgattaaaagaggtacaactgtgattaaaagaggtacaactgtgattaaaagaggtacaatagtgattaaaagaggcacaacagtgattaaaagaggaagaacagtgattagaagaggtacaaatgtgatttaaagaggtacaaaagtgataaaagatacaaaagtgattagaagaggtacaatactgattaaaagaggaagaacagtgattagaagaggtacaactgtgattaaaagaggtacaactgtgattaaaagaggaagaacagtgattgaagaggtacaaaagtgatgagaagaggcacaacagtgattaaaagaggaagaacagtgattagaagagatacaaatgtgatttaaagaggtacaaaagtgataaaagatacaaaagtgattagaagaggtacaaaagtgattagaagaggtacaacatggtttaaaattaaataaataatgaaaagtttttataaaaatcgattgcattttaatttaaaatttttttataataaaatactctttttattcattaaatataattttgaaaattaataattgaatatttattttgaaatgaaattcattttttataaattcaaaaaataaataatgaaattaaataaattaattaaatatttataaaaatcttgaaattaattaaacattaaaaataacccaaaaatacaagaaaataatgtacaccgcccggattcgaacttcccccccccctccaaatgatgcctcagaatcccaatcacacagggattctgaggtctgaacgatgtcaaaagtaaaatctgatcccgtatttcgggatcagcgtcataaaatcccctaaagaattgtgttttggaatattttcggtgaaaaaatttttccccccaaaaatcctgttccccccccctttggtcccgaacccaaaaatcccttttattttt

SEQ ID NO: 12564 - DNA, 3710 bp, Heterodera glycines
  misc_feature (218)..(218): n is a, c, g, or t
  misc_feature (243)..(244): n is a, c, g, or t
ttcaagtgaccgatgtttttttcacgttttcaaaaacagattaaataaatttaaaaacacattattattatttattagatatttttagatgcttctaagcaaataattaattttttcaaacatatttttgatttttaaaataaatttcaaaaaatccaggtccatgcctggatccaggtctcgaggagcctgaatttttcctggacctggattttccntggatttttgtcaaggaaatccagnngttccagggtcccaaccaggaatccaggtccaggcatttttcaaaatatcgagctctagtttttggctctggatcatatgacctatattttgcaaaatatcgtcgcaaatcacggcacgatctctgctggtgctaaacatatgtataagaaaaattgtcaatttatttatattatgagatttacaaaattttaattatggaaaagtcaaaaaaggacgaaattcatctggcaaagatggaaaatattaaccgacttttaactttcgtagcacaaaattttgacagaaaattaaaaggtatcaattcgcatcagcaggatgaccagctgaatgactaatttcaatcgaaaagccatcttcggcaaaaattgggtgaacaaaatgagcatcaaataatttaaaaaatttatttcaatttacttaatccgcaaaagtcggcttgtccaatcagcagttgttacccagctgatgctttttcatccgcctgatattgggggaattatcgcaatttcggagttttcttccaattcgatgcgattttctgtccctccgagggcgtctcttccttcaaaacaatagcgatgattcactgccaaaatacacgaatttcgaattggcattaaagcggggaaaatctgcgaaaattttccaattagtcttattttattgcatttttatataaaaaagtatttttgaaattttaaaaatactttatcaaaaatgtggttgtaaagttccgtgctggtcaaacttttcggcaaaatctggcgaatttcctggcattctgccatctcccgagcttttccgaataataaaatttgcacttcaacgcattccatcgaagctcgaaaagcacaataatatttatttaaataatatttgtccaacaaaattgggaataaaaaatcaattaatgctgggaaaatgatctttatcttttcctcaccttattgactacttgcagagaatgaatttatgttgaagcaaagtaaaaactagacaagacaatgaaaatatttaattgattacaatttaattgattaggcaaattaaagggtttaaaataaataattttgaattttgcaatttcttcaaaagaaattttctggaaataaaaatgctgaaaattaaaccataaaaataaaattgagctgatcatttttaatagggcaggtcggttcggttccaacttgacgcttttggctccgtttcaagaaaccggtttccaaccctttcaaaattggcagaaaattggcacaaaaatatttagattggacctctttaagttgcaaaatttaaaaagtcgcttaatttccaaactattttataaaaaaagctcctgcacacaccgaattaattctaggctcccagttcaaaagagatttgcatgtgtgacgaatttgtttttgtaagatagcaaagggataaagggcggcggttagagtccgttgtgaaacatgtatttttatttattttttgaccaaacagttaaaaaatcacggttttcaaaaattatttttgaaagtttttgccaatcaaattggacaacttggtatcagtcgaaaagaagcttttttaagcaaatattaagcttttttacatataaaagtaaattcagttattctctaataatagagataaagaaatagtaccccaaaatgagagatgtatttttctctgcactctctatttattggttcatttctcgttttttgtgcatacactaaaacttaacaggctgcaagacgccaaatttttcagtttatgccaattttagcctattttgaaagtgtttaagaccgcgggttctttatcgggcccaaaagtatcagaatccatgggaaaatatcccccggctaaagttagttttgaaatgtccaaattatgaccaatttattactaagaatttattaataaaaataaatttaaattctgacataattaaaaagaaaatggttatttaaatgccgtttttttgccattttttaattataaatatacttattacttttgttaatttatttttgtccctttttctaccaaattatcgacttaattagaattttccagctggcctattgtgtgtatatgtttttctataaatattaaagcgtaattgacctgaatcactttgttgtgatgccagaaggaacggagtgtgggagaaagtgggataaaggacctgagagaacctctaaaagaggcgcccgtagctcagttggttagagcacggcacggattgctggggtcgtgggttcgagtcccaccgggcgagttaccttttatgttctacatggcgctcctgggtggatcccctccacactgccgggaccactggaccaaggagagtccaagtccgtcggtgaagggccaaggagagcccgagggaccggtcttccgagggaggcggaatgtgatgccagaaggaacggagtgtgggagaaagtgggataaaggacctgagagaacctctaaaggaggcgcccgtagctcagttggttagagcacggcacggattgctggggtcgtgggttcgagtcccaccgggcgagttaccttttatgttctacattgttattaaatgtcaaccatcaaacaaataaattccaatatataataatataatttttattatttttatttcacatttttaattaaaacatagataattcttcgttttgcatgcatttccatttgaaatttcgtctttctttctcggttcatttattatttaattattgtctcttaatttgataatgaaccattaaatgaattttccgtccatttctttaaatttctctttgtcagatggcgtgccaaaaaagaagccgaatttaattgcatttgaagtacaaatgcggattcaattagcagcagcaggtgttctcggcaaattaatttcccgatttccaattaatgcatttcattgacatttgggagaatattatggttaaagcaggcaaaagtcagtcagaattttttttagaatggcttaatttttcgtaagtcgaccaaatgtttgaattaagttgataaaattcgagatgatgcagaaaatattactcaggcaaaaaattctgaaaaaatttctgctaagctagcttttgatgctgatcaaaaaagtcttttacagcaacttgaccagatcactccttcatagtgatcggcacatcacaaaatacagtgaaaatcggggaaatttttgaaaaaaattcctagggggttgtgaaaattttttggaaaatttgaaccagcccattggaaaggggacaaaattctctaccaattgccttttgaatgatgagtctatgacttacatccgctgagatatgggcacttcaatttcagtgtctacaaaaagtactgtatttaaaaaaaatagtgcattttacagtaaaatgatcctgactgaaattgaagtacccatacctaagttggtttaagtcgtagagacttgaggtctttta

SEQ ID NO: 12565 - DNA, 3773 bp, Heterodera glycines
  misc_feature (811)..(811): n is a, c, g, or t
ggggatctctagagcggaaggaacgattgatgagtcacacaatcacctcccttcattggtccctcaattccccccccccctccccccgcgggccctcatttccacaaaatcattgcctaaacaattgcggagacaagggggaagcataacgggaaagaacacataaatgtggaatatcttgaagaggcggcgatgggaaaaaacgagaaattgttttttctgtttttttttgtaattaaaaaaaatttttaaatgttatatcgttagccataaaattggaaaaaactgaataggtaatctcataaaaattcgagcatttcaaaaatgaactttgaataccagggataaggggttttacatataattaagatagagcccttacttccgctttaaaactaccgactaaaatatatttttgagaaaaaattatatttgcttaatttgcatgagagctttttgcaaatgtttttttgttattactctttgtgagatgatcaagaaactgatggtgacaaattaagttttgttttttttaagtcattaattcgcacaatttgtaataaacagcccggcgggtcatattagttgtatattgtcttgcaattgaaaaaataattatttaagtaaaaccatacgaaagctctgactatcagctttaaaataagctattaaattattcattgtcattaaaaaaatacaaatttttaaatagggttggggaaccaagaaaatttgctcactattttacaccaaagggtaccaccactaaagaaaggtgttgaaatgaattgaaacttggtcagtctattanattagatgtgctaaacaaaatagttgaaagaaacttttctggaacggaaaccccaattttagggccaagtcagaggagattggccaaaagttcacccataaaactggacttaaacatagaaacacagcacagcataatcatacttacactgaattttttctggcgacaatggcattgccgtgtaaattggtgaaagtccactgtcattatttggcgttggctttaagcctaaagattttgtattataaaattttatatatttttttaggatttaggatttggatactcaattcatttccatctgaaaacccagttttagtgccttacaattttgtcagaattggtcaaaaactccaaaaactcaaaccatgccgttatgacgttggttaccaaattatcaaaaactttggcggatcaattaggcaaaatcaaatcaccttttaaatcaagcgtcagatgacttctgtcccggcaaccactttcagccatcatgaatttttgaagaaactcgcaaattcgttagttattattttgtaaaatttgcttaattttataaattatttattattattattaataattattgttagaggaataatatgtattgtataatttattctgtaagaaaatttctttgcgaaggaaaagtccaaaaaactgaaggtcaatcagagtcaatttacaatgtattaaaacttccaaaaagcctttctctccgtaaagttttttcctccaaaaatcaatcatcacctcacaacaatcagaggatagtgaagtgatgatgaaaactgtgttccttacaaatgggtctttggcatatgagtccccccaaccatccgttttaattttaaatattttggccaatttaaacaacaaaaaaaaatatgaggccatacactttgtacagctttttaggggccaataatttttgttttaagaatttttgtggattttagaaaattttataagaaatttggtaaaaatttatttaaagcttttgaattaatttcttcataaatttcattcatatcctatataataaagttgagtgtttgtatgtatgtatgtatgtatgtgtccgtgtttgaatttgtgtggcgttttgtttgagttttgcgttaaaaatgaatttgaaaaaaaagaaatatttggtttttgttttctgcgttgcaaaaaagcattctattaaaaatgaaaattcccacttttttgtgctgtcaaattttttatttcttatttatttatgttaaattgatttattttttgatatgaatggttatgttttgattatgtaaatgattttggagaattgtttgattagaaaactgaattagaattggtttgatatgaaaattgtttgtttcttaaaaagctattggtacttttttgattataatacatacgaaaaaaatctgatttgatttttgatatttgtttgaatgaaaaaaatgttttgtatagtaaaaagagaatgaacaagcctttaatggattgaaagaaagcaatgtaaatctacatctcaaattttcctgttcgggtggataattatatgcagttgggatatattacgtgccgcttgctgaatgaccgcttgctgaatgaaatttatatggaatattttaaattaacgtttacaggtcagtttttgttttgaatttgggggtgggtgcaataacgattctcttttatatgtttttttaaaaaaaacccctcccccatctgcaaactattaacttaattactgctttttttgagcgaaaaaagaaaaagttgaaatgcttcttttttttgtttttgtgtacattcttttattctcaaagtttgtttcaaggtttaaaatatctaccgctgatttttgtaatgaatttaagacctagaattggaattcagatttgattgtgtttgtaaatgctaatgaattgtttgtgaaaaaagtcacatttaatttttttaaatatgaatttaattgtttggttatcagcagaaatttttgtttatgttatgattaattgaaaacgaattgttagtaaatgaaagttttgttgtttgatatgtatcatgttgtgctgattcaagttgcaatttttttacaaatggatgttttacgatatcgaagccaatctacaaaatgtgatgtttttgaaaattttaaaaattaacgggataacaggtcagtttgattttttctctttttattgagagataatttgaccttgcattatttttgacccactcatttttatttttaatcattttattaaataaatattcacacttgcttgaatatgttgtttggttcacatttatatatttgttattttgtaaatgattttgttatgtaatgttctttcaggtttaaactttctactgcctcctttgttataatgaatttagaccgagtatttgtgaatgatagaagtaatgataatgaacagaatttggaatatgcatatgtttttgataatgattatgaagtagttgagagcagttatgatatattggaagagcataattatagtaaacggtcaagaatggatgttgttggtggcgaaagccaggtatctctgaattcagatattggtattgctggaccgtcacgtatgagtgatagtcaatttgaagaaaggagaagaactgagtatttgaaaagaaagagagaacgtgagagaatgagaagagaaaacgaatcacaaaaccagagagttttgcgtttagaacagatgcgagatagaaataatagtcaacgaacggaagaaaatgcaaatgaacgtcgtttgcgtttagaacagatgagaaatagaaataatagtcaacgaacggaagaaaatgcaaatgaacgtcgtttgcgtttagaacagatgagaaatagaaataatagtcaaagatcggaagagaatgcaaatgaacgtcgtttgcgtttagaacatatgagaaatagaaataatagtcaaagatcggaaga

SEQ ID NO: 12566 - DNA, 2355 bp, Heterodera glycines
aaaaatgaataatttgtggagttggtaaatttttaccttcttaaaaagtttttaaaaatttaatcttaagttaaaaaaataattactaacgaagtcctaaaattataaggttaaatgaacaaattcaaatttaacgaagataaatattggtttcaaaatattaaataaatcattattttctaaatcaaatataaattaaaaagaaataattaaaaaaaactttgtattataaaaaaaacaaaaataaattacaataaataaaaaagttataatagattcattcaaaacttttgtaaaactaacaaaaaataagtgattttatatcagtcgatagcccttagaaatctctacattaaaattgtaatttataatatcgtgataattaataaaacaaaaatatttatttgaattttttaataaatttttaattttttctctttcgccaattattaaagaaagggcaacttaaccacaaaatttcaaatataaattttaagcctaaatatattttacacattctataaatcataaacaagaataagttttttgatgtatactgataattatgaaaaagcagaataattttttagtaaatattcaattcaattaaaattattattaaaatagatattaatttacagtgtaaacaaacagaatatcaatatattttttataaccattcatattattaaaatgaatataaattaatatgcatgttgtcagttaatttaaattattaatgattatgacatataaaaaacgactagtgaataaaaaagaaaataccgtatttgctctttttatgtgccagtctccattaaactgccggtctccaattatgtacccctttctgaggaggttgaaaaataatctaccagtctccatttatgtgccaggggggataaatagaattttttaataatttatttggcacattttccaaaaaaaatcaattcaacagtaaaaggggctaataaatgaacaattcgttgtcatctccgactccatccagccctgcatcatcattagagtagggtcgctacttttagtgacggaaaatctcgaaatagttaactaaaatagtgagtaaaaattccaaaatagtggcaaaaagtccgaaatagtgacgaatagtgacctaattttcagtcaaaaattaagccaaaataattttattcactaattggagttgcaaatgaggtacttttcctttgaactattcccttatcaaaatactgaacatttttaatcaaaatttgtcaagaaaaaaaaattgtgggaagaatttttaagaacattttccaattcttagtggtatttttgaaaaattttttagaccgattctcaggggtgcattttttgaaaaaatgtttaggtcgtttcttaggggtgtatttttttggttttattgcatttttgttaaggaattttcctaaaaatgtcgaaatagtaaattttcactattttagtacgaagcgccaaaataggtagtgatttctagtgcccgatagtgacatcagaatcgaaaaatttcaacgaaaaaatacgttttttgagctcctttcttcaaaacaattgagcaaaaaaattcgttaaatcactaaaagtagcgacactaatcatcagaaaagccaaaaaaaaactaaaaatttttaaaattaaaattaatattaaaaaaaataaaaaaaggcttcttcgtgatcgtttcgtccatctttcaccattaaaaattccaatttttatgcataccggaagcaagaaaatgatagatttttgtcattttggagtcattttcagaagttgtttaacagaaatgcaataaaaatgttttttttttgacgcgatgacattttttggcgacatgttcaaaaaaatttcaaaaattttccactaaataaatcaacgaaaaataatctcccagtctccattagtctaccaatctccaattatctacccccttctgaggaggttgaaaaataatataccatggcatataaaaagagcaaatacggtatataataaaaatcaacacgtacatcatatttttaaaatctttatttgtgaaaaattgaaagaaaaacaattacttagaggggaactaatctaacgcaaaaatcaggaacggatccaagagcacaaccatcccccgctaggaagtacggatgtgtaaaattatgaatgataaaaccgaaaatggctcggccgcttcgcggcctcgcacccttcgcttggcattttcttatggcacaacatttttaacatatggcacaacatttcttaacatttttaacttcttggtatttcttattgcataacatttcttagcattttcatcgtcctttcctcctttttggc

SEQ ID NO: 12567 - DNA, 1711 bp, Heterodera glycines
  misc_feature (31)..(31): n is a, c, g, or t
  misc_feature (73)..(73): n is a, c, g, or t
  misc_feature (102)..(102): n is a, c, g, or t
  misc_feature (320)..(320): n is a, c, g, or t
  misc_feature (1583)..(1583): n is a, c, g, or t
ttaattttaaaattaagatgatgtaattttnttaccaatttttcccgtcagagcctatcaatagctgatcctnccaaattaatttttcaaaaaaattagttngaaaatctatgaaatagtattttttgcttatctatcagcaaacctgttcaaaaatcggcacccactgaccccctcatacttattttttgaaaaaaaaaagttcgaccaaaaccagccacccaaaagtcatattaggtaagtctcgtgtacattcttgaaaaattttgcctcaaaatttccaaaaaatttttcggcggcttttagcagcaacaaacccnctcatactctaaaattctcaaaaaaaaaaaaagttttctcaccacttggcctgtaactgtaagattttgctgctgttcgcccagttgcgcaattgtttgattttcctgttaagtaaaataatattattaaaaatatgatagttacaaaaaaaaaaattatttttataaaaattataaaaaagtttttcaaaatttattaaacaaataacaaacttggtcagtaaaattccattcctcgaaacctaaaaaattaaagattaataaattttttaaattaaaaataagatttaaaaaattattttgccccttagaagctttaaacagtaagatatctatttttccacctttttggtgacatttgccaccattttttgaagattttgtcatcattattttaaataccaccatctgtcactaatttgtgtttttttattttttagattttttgtaaggagggtgaaaaggaaaatttttgaaccccacccaaaaacaggtggtgcctgtaggtgtcacaggacccaaaaacaaaaaaacctactgaaaattttaattgtgccttttttgcagaaaaaattttcagccccctagtatttttttatttgataattttccgtattttaagccaattttcgggtggtcctatcaacatgaaggagtgatttgatctgattggtgtaaaagactttttattattcagcatcaaagttagctaagatggaatttttttagattttttcatagcttaaaggcgagaaaaattaagattacaaaagtggtgctaaacatgtgcaccacttgaaatagggtgtgatgcatgaattcaaatgtacctaggcaattaatcattctttcacctaatgaaaggtaactttggaatcctattaaaagtgctacaaaaaaaatgtaaatacagtaagtctctatacatcatctaaaataagttattcagagattttcaataaaattcatatgggttagaaagggaggatgactgcgagtgtcaaaaggtgcctccgaaaaattaaaaaattgttttgtactaaagcataacaatttcccgggtactgattttaggcaattcttttctcgataatataatttaccgaaaataatttattattaaagaccggtaaaaatatgtacaaaaaaatggaataaaaaaagacgaaatatgtacaaaaaatgtcctagaagctagaaaaaatatggaaatccatactttgccagtctgtaattataatattttttcattctgcttacaanaatctggtgcaacaaaattatttaacaaaaaaaaataagattaatctttaaaaataaggacattttctatttctaattcttagtctccaaaataaggacatttgccacaatatatctatataattatt

SEQ ID NO: 12568 - DNA, 2374 bp, Heterodera glycines
gcacgccgaccaagtcgcggccacggtttgtcgacgctgcaatttgttccttctctcgaatccatgccaattcgtcgtcgatgtcgcggaacagctggtggccaagcagcgactcggccaacttttgcttccggcgctgcaacggctcgcgcaacgcctcgaagcgggcgcgtaacgcctcgaactttttaccgatcaacggtgcgttgaagtggcccgtgtcatgaaactcgcgcgtctgatgcccgatcgcgtcaatgcgttcctgaaatgtcgaaaaagttcgctctgatagtgataaatgtttaaaaattaaaattattaaatacaattttagactagtaaatcaaagtcgggcctcctgaattgacatttttgatcttattggcaaacaattatttttagaacaaaatattcaatttattcactcaaaatgagaaaagaaaaataggggtctcaacccaaagatttcaccagtttcgataaaactataccaattatttcccagaaaaaacccgagtcgagtctcgaaactttttctatattcctttacttttctcccttccctcccattgatcattttccccgtttctcctattatttttcccatccctcacattgatcatttctcacccattgatcattttccccgttagtcccacctggtgcgcgttgtagtcactttcgacaaggccaagtttcttctgcagattttgcaccgagatcaggtccttgccgaagtcctcgctggccaattggccctccaattcgctgagccacagctccacgtcttcaatgttgcggttgtacaattgctcctggttggcctcctgcagcttggcaccctttagcccgctggcatcagccagctcggtccacaactgttccacctcgttgagacgggtctatatgatcagaaaacaaattttaatttagcgatggcgtaatcgtaattgtaaaaaaagaaataggcccatgatacaaattagaaattctaaaacgattaattgcaatgagcagtcctaattagggagcgggaaatatatattttttcggtctttaacaaattttcaaaaatttaggcattccttttctttaaaaagttttatttttgctttccccacctgaatgtgttcgttggcatagtgcccagattggatcagttcttgccccgtggctttgatctcatccagccggttgcgatttgcgcgcaactcctgctcaaagttgccgtgcttttgtaactttccgcgaatgtttgtcgggtccaaatagctctgtaaaaaaaggaagaataatcattttaggtttaaatggttatgattgcttgatcggttaaagcagttactttctggtttgatctgacaaactcaaaccagaagttaaggtgtgatccaattgattgtgggtttaaagagaatagattagggaccgcttgatcagttcagactaataagtgatcggaaatcaaggacctaattaataataaatatccaaagtaaggacaactcaagaacaacgcaattactttggtcatcatatattcggatcagaaattttggtctttattttttttattgacctggtctttggccgtcttcagcttctcctggatccagcccagcatttcgtcacagtcgcggtcaaagctgtgcaggcggtaggactccttgagacgctcccggcgctgtgccatccgatccatcagatggcgacgacgggcgagcaactgaaaaggcataggggatttaataaaaggataaaatttagaaaaataactttcgatgttattaattaaaatttaatttggccaccttttcacgccgtttggccacatcttccgctgcgtaatgtccgccctcgatcagtttggtggcaaattcgtccaaagcatggattttctcctcctgggcggccaacgatttctcaaagtcctcgtgtttcttcagcagcgactcaaccgcgtccagcgaatcaccgaggtcgtcgttttggagaaaagccttaaaaataattaggaaatattattaaaatcgtaaaattaattaatgcgaatgttctattctgatcaggttgatcaaaaaaagctagaatttgtttcaaaatccctgtccgtccttcaatctaatcaacagacatccaaaaagctagagttccgggtgccaaacggaatctcaaatccgacaaaccattcattttaattagtaatcaacttaatcctacactgcgggggactttttcgcggattttgccaccccctgaaatagctatattttttctagggtaatttaggcgctgaaaacgaatctgacgtttatttgaggctgtcacgtattttatgaggtacatgaaaaaaataaacgtcagattcgtg

SEQ ID NO: 12569 - DNA, 880 bp, Heterodera glycines
tgcctcctgcttggtcatccacgactcggcctgctcagtgtccctgtagaacaactgcaggtccatgcactgttcgtacagtatgcgacgctcctcccacagattgttcaggctcgtctgctccatggccaaattctgtgacaaaaaaaaaattattttaaagacaaaatgaaagccaaaatttcaattttgtaatatgatcatttaagagttaaaaattttaaaaaaaaattcatcaaacggtgaaaaaattcagaaattactttttttaaaagatgttttaggttgtctcataattatgttcgtatttcttatttgctttgagttactttttccgaatatggcatcagatttacagaatgacttcagagatctatgattttgtgaaatttatgatttttgatcaattcatcgaaatcacttgtttttaagaattgaaaggctaaatactcaattataaacattctccaaacctttctctatattcgagatgttaaaaattaaaattaatttaagttttataaaaaacattcaaacatattgtttgcctttaatatttatgccatttaaaatatattaaatatttttccgccacacctgaaggcactgtcgaatttcgtccgactcgtcaatgtcttcgtccaacagacgttgtcccgtttcggccgtctgtttgaatgagtcggttcgggcttcaatctcttaaaatgtttagcatatattgcctatacagtatatttgtggttactgtatcctatttatcacgctactgtgtgcatttttttttactcaccgcccttgtgctcttggtgctgttccaacaacgcttcggcgcccgcaacatctttggccaattccgacgattggatgagtgcctttt

SEQ ID NO: 12570 - DNA, 2616 bp, Heterodera glycines
cggtgcctttgcaaaatgccaaagtttcacctttttatttcttcgacatttggcatttttgtacaaaatcacattaaatgatagtcaaaatcaaaaagtgcgatcagccgaagctcttttttcttctcgacggcctattcattcagtgaaacacccgcgcagtgtttgcacaaccaccgacaatcgccttccaaagtcttcccgcggtgtttcgtcgccccctccgcccgtcgccttcccctcgtacaaattggccaactcgatcgcacgcattcaatgccgaacggaccaagtcacgacggcgttgttggccaatgcccgtcttcagatgcagcaattggttgttgcactcgattgtgagaatggttggggaaggaaaaccgatggcaaaagcaatgtttttgtgcttgctttcaaaactcgaccagaattaggccgtacagggcttgggcacttggcgcgagggcgagcgaccgctcgtaataggcacgtgcaatctcgacattgtcgggtccacccaaagtgtagcgaatttcagccattttgagcaaataagtgggattttggggctaaaatatgagaacagacaaattccaaaacgttttgttggaaatttaggcatcggtccaacatttgaaagaagcaattcctcgaaacaaaacgcagcccggccaaagtcggcctcctgaaggaacagttcgccctgctgcagccacgcctcggagtcgttggcgaaaatctccaaatatttgttcagttcgcggatggccaactggcgatcaccgcgcgcgatcagaatggcaatgcaacgcttgcggaaaagctgagaaaagcaaccaaagggaaaaataaaattgcgatagtcaaatatgattaagtctcgagaactccgtttattatttaccggattcgtgtcgtccccttcgatcaggcgacggtaaagctcttccgcgtcttcgtaattgccaatggcttccaaacgcattgcctaaacatgtaaaggacagggaatggctttcttaagtgccaaacttgaagctttgttacgcgggtactcttcggaaaacggcgatgcaattgctgcaggcattcaatggccaagtcatgtcttgcctggtcgagcgcggcgatggtcacctgaaaagcggcataaaggtgttgttattctgctgtaatttaattgagaatgttaggagatttcaaaaagctttcatcaaatcttttcagtgacctttttgaataaaccttgaaaatcggaatggtagcaaaaaccttgaaaatgctataccccatcgttatcccccccccccctccttccccacctgttccaacaccgcccacaattcgcccttaagcgcagcggcgtaccgactgagcacaaactcccaaatttccacgacttcttccgagcgtcgcgcgtgctcttcccgccactttttgagtgtcgcatttgcctctaaaagttaaattagcgccccatttggtaaaataagttcgaatcattgaccttcgtaggtcaaactccgccagtcgtcctgcatttaatattaaaatttagtaaagcagttcaactcaattgttaaatgggaaaagaattggaaaaagaagtttcgttaaaataatccaacattttaaaataaacagacatttagaaaagtcaaaaaagaaaacaaataaccgttgttaatgaacagaatatttatttattaaattcagaatcaaaaattaattcccattgggaaaagaaaacatatcgaaacaataaaaagaatttgtgcgatgggcgtcagtggtaaaggcgggatgattatgcaatcaaagaaacaaaggacattgcgacaaagaaattaggatgaattcattacatatgtaaagataataattgcctatttattccatttattatgcgacaattcaatagaatagggaaaaacaaaacatcaaaaaaagatggggcgatagggagagaattatgggagaaattcaaaggaaattattggattgaatggagggaaatctcgctacatgaaaaccacgttggtttcaaaagacaataaaggtctcccatctaatccatgtgcgggtagcgccattcggtaagcggcccaaaactctctttgatcacttgggcagaagtccatcggaggacgtaatgggggcctccggccttgtcattagtgccttaattttaagcgattccataagaaaattggcacaaaaagcctactaaccggattgacgcgctccaccaaaaggctgctgaccaacaacggaaccggtacatttgtcattcaaatacaaattgccttaatttgcaagcgattttttttttttttaatttatcctgaccgactgcatcacggagaatgtcttttgcttcataaagaaagtcccttaaaacaagaaaaaattaacattctttaaatgtcggttcacttgtcctggctgaaaactgcgccagtcagtccgaacggagtttggtccttcagggaacgaacgagctgaccagcatccccatcctagaggttaagacgggtgggcgtactttttcggaaataaaacgaacattgtacacgtaaacagcgataaaaggtccaaatatttcctaaaaaatat

SEQ ID NO: 12571 - DNA, 1865 bp, Heterodera glycines
  misc_feature (18)..(18): n is a, c, g, or t
  misc_feature (57)..(57): n is a, c, g, or t
  misc_feature (70)..(70): n is a, c, g, or t
tcctttttggatggatgnccacagactttcgggcacgaccatccgcgagctaaattnggatagtgaagcncaaaaggcgtaagtttatctgaccatgcgctgcatttctgtccttgatattcgaaagccgcgcgatgcgtacaagcgacgactgatggaacatcggcggacggatggacaaaatgaaagtttttgccgccacattctgaataaacccgaattttattagaacaccatgaaaagcacctccgatgagacgagggaaagtggcataagtagtcaaattctcagaaatctgtttccataggtgttggaacgtcggaacagagcctgtaaagattttattttccaatgatcatgcactatccgtgcacaaatggttggagtttttctgggtttgaataacttggtttgggctcccaaccagtttcccggttcttccccaaattgtatcaaaaatatttaatgctaaaggttgttgatttgagtgcttcacaaacccgtgaagttgatgcccgccaaatctttactgttcgtgacggcattaccaaaagtgggcccatcggatggcaaaaaagaaatgacgccggatgaaagtccttaaatttagccacaatgtttgatggttatgtattttgaccaaccagcctcttcgaagactttgtaagccacataattgctcgccactgcggtgtccgacggtttccacatgacgacattcccctaattagtcatcattttgtgtttagaacaatgtttccgtataccataagtgcgggtgcagaagccaaattaccgccaattgcggtgaaattgaacggagcaatcgctgcgacaaaaccctttgaaataatatgaatgattaagggctaattatactgaaacagcacctcaagtcctctgagaagcatgctgttctcgtaacccttgccactgatcggctgatactttgaattttgaagtgcgaaatacgcattgaaacgcagaaaatccgccaattcacaggccgcgtctaaattcaaagcaatggcaaaaaagagacaaattttgagaccaatttcggcttgttgaatgttcttcgcttggccaagcattgtggccgcgtttatcaacatccgatattttcctgccacgaggtcggcggcatgcagaaaaatatcagccctctttctgaattaaaatcgtattgaaaaatcaacatagttgcacaaacataagcggaagtcgctcccattgatgacgcgctgccaacccaattgaaatggcattttgaatgtcttccgttgtcgcatggttaaacaacgcaatgggacggttgtggtcaaagggctgaaaacaaatgaaaaagtctatcctttactgacatctcaaattaaaggttttctgtttttgtgaacctattcaaatgcactcgccatgggctgtctaattgctttttccttgcgaaatgtcttctccccgccaatggccaacggcacttccatgggctctgcccacagtttctgcagttccttctccaaagcgtcgctttccgcgcttcccttgcgatattcgagcaccggctcattggttgggctcttcatgaactgttccgaagtgaggcctctaaagcgaaactcacaagtagtcaatgtttgtaaacatcgatggattgaaagcccacgtgaatgaagaggcactccgtcgcagaagacacgggggaaaggagcggccgaagggaagcgaccgaagcaacatatcgaagagaattaaacaaatttcctatttcctatttaaaattcgcgcgtaataggccatagaaagttaggagaaaaggcacatacaaacaatgacggaagtattttaccaagaattaaaaacttgcc

SEQ ID NO: 12572 - DNA, 1092 bp, Heterodera glycines
tgcaggtcgaaaaagaaattatttaatcagaaaaatggcatagagagcaattcacggcacaaaatttttcggttaaatctctctggattgagtgatccacgaaaaaatacattaaaaacttaaaaattgcccccccactctttcgtgtgatcacctccaaatgctttgactcgatcagtggcgaaatgatcgcgtgtttcagcgccgccgttgccgcactctccgcgttcactttgttcagcctcgtcagcggcgagttttcgctcgccctcagcgcggtggaaagcggcggcggcggaatgccccgcgagggggcgaagcggccgccgtcggacgcgccggtgggacggaatttggtgattctgcaacacaacacgacatgtaaacattggcaaattagttcggcattttcattttgtatttatttcaacaattcatggacgacgatcgatcccatggggacaaagacatttacttttttatcttaaattaaaaaaaaactttttcggtggtaattcgtgtgatttttaaagattttatccagaatattttttagcattgtcaaggacaacccaagaattgagctcggaaaatgtataataaagccgaatatcaagggccataaccaatacacaaaaattgcggctttttaattaaaaaaatgcaaaatttttaacccgcccctgacacgttgcatgtcgcaaagattgtaatagaggaaattcaaaaaaaaaaaaaattgttttcaaattcgtagttcgggtctcttaaaaaattccacagagagctgcgcgttcaactccgtccccaccgtttcccactcccgaaaggtttttaaaaatttaataaagtataagacgtttaatctaaaaaagaaaatttaaatcaaattttcattttttaaagaaggttggcgggtcgcagtgcaaaacacccaaaaaagggcaaccccaaaacagccgaccgaccgtctccgctcgggagtgattgctcgacggtcgtcaatcgctttggcctttttgaccggcgtgctcacaatgttgtagtcctcttgctgcttctgctgctgcggatggtcgtcggaaatgcact

SEQ ID NO: 12573 - DNA, 3807 bp, Heterodera glycines
taccacgaaaatttttgatgtgcgttaattaactgttttgttttctattagccgattagattcagaatatttagttgccttgcaattagcccggtaactgttaaaacaatttttatacctttttggttcgatggatttttgaaaacttatgaaatttacaggcgcataaaaaataaaactttcctttttccgataccgtacctcgcaatacgaccgtatcgatgaccacagcatgggacagctgcgaattgcgtttgccaagtgtagttttgcgtactcgacccggtttgtctcgctggaaattggtaaacccaaaattaatgcaacgcaacaattggggaggaggcggcgacatttgtagccgattagaagatatcgaaaaggatgccatttttgggtgtgccaatcccaacattacagtcagtatacggtttgtgccaatcccgttgtaccgtagatgggtgtgttgtgtgcacataccgtaaaatgttggccagcagcgaatgtgcgtaagggagcgaggcagtgcccacaaagacggggtgcaactccactttgtccgtggccctctcatcccggagcatcgactccgcttcttgtagtctgaacaaaaaagttttacaaatctaaaccaaaaaaggcgctgtgccaagtttttgacgacaaaaattgtccccaccgtccaaaaagccaatggaaattagaaattaaaagattacctaacttagtaaatgcaaaaaatgggactaattataaagggaaattagttattgaaaattcaattacaacagtaagcattttgtaaaacatcggtgtgtgctcgaaattggaatatgttaattacatttccttattattactcgccaaatgctctcaaattttggaggggggggggggggggggaaggtaattattccatttaaaactcgcccaaacccaaaaatggagctaaaaatttttaccggttttgtgcaaaagcacaccgggcaaacatgtaccgcgacttggccatttttatacattggggactggacagcttcaaaaagtggtaagcactttccaaattctgtgtccgcgttaagcagtgggccaacagcagcagggaacgctcggagccaactgaaaatgtttttataaatcacaacaattacaatgaatttgtttgagagacatttatgaaatgattttgaaatagaatggccaatttgagaattttgaacccacttttggaaaaacttaggattttgagttgatttctgacccgaatcttccaaaaaaggaaattgctttaaaaatgttggtaacctaagggctatcgcctgctcacactttactctcttttcagactaggaacctaagccatgaaagtgtgtcaaaataaataaaattcaatttggtcggttgaacattggcagattggcacacctcgactgcagtaagcctcggcgagtgcgacggcgtcgtcaatggcaaaatggtccaaacttgtctcaatcagttcctggcaaaattggcatttgaaatgaatgatcgaggcttgccactctcccgctcacttcaattgttctggaatggacacattcgccgttttcaccggaagaattagaaaacaaattggtcgtcgaatcaattcccttcagcattttgtgtgtctccaaatacaaatatgaaaatggaaagctttatgtaggcctatttgttagatattttgggacaaatggacaaacacataattaaaatttttatattttaggtatttttgatattttattttggtttagataaattaaaataaaaataaattaaatttcagccaaaggtatgtaaaatagaacaaaaaatataaaattttatcaattttttgagaaagctagacgaaacgacggtaaaaagcaagcaaaaaggctatacataaggctaattccgtaaaaaataattctaaaataaaacaccaaaacttcaaattcttagagttgatagtgtcacgggaccggggcgggaattcccggtcctccgaggtcccggttcccggattttgaaaatttatttcccggtagggctcccgggaaaaacaaacacgggtaagaatggggtattagcgaaaaattaatgagcgaaattgggggggaaaggaaaactttttgataaaaatcaattataaaatttattttttaaataatatacaaatggtccagtggttaatcttcctgctggtttcttacttctttcccttgtttcaatcccacttcagtaattaaatgtattttgtttttttctttttgtaatcatttttaatgtaccttcttccatcagcaatactatagtaaattaatttttaattcgaattttcccgaagatgcctatcggtattgcggcactcaaatcaagcaaaattttcatggtttagtcaaattttcaagttaccaaacaagataaggagatttatcaatatgcaacgcgaacaaaagaataaattaaattaaaacagaaataaaagttgattggactcataaagtgaagtagagccagaaattccacaagttttttcagtccgtctgctgcatgttcgctgataagtccgcctcgctcactgtgtcgcccgccctcacctgcgcagctcatgcttcattttctgtgcttgctggcgcagtcgctcgtaccgccgcttccattcctcatgtagcttggcgctcgccgtgaccggggtttttcatagttgaacctatttttgaggtttttaggacctaatcctattttgacagttttaagacctaaagatagccctagttcggaccgctttttaccgggactacccggcccattactcaaactcatattattattattattactattaagacaaaaaaagaaatgactgaactttgccaattgctgaaaagcgaaattcggcgtttggaaacgaaaatggactatggtttcaatgaactcggcaaaaaaatcagtggattggagaccaaaatcggtggattggagacaagaatcgatggattggagacaagaatcgatggattggagaccaaaatcggtggattggagacgaaaatcgatggaatggagacgaaaattggtggaatgcagacgaagatcgatggaatggatatgaaaatgaatcagtttgaggtttgttgtttgtggagtggttatgcttttggttttgctctcattgtcattggatttatttgtaattgttttgtccaacggattttgagtccaaccgactttaatgtgcctatagtgctcggacagaaaaatttccagccccctcattcggggcctcttttttgaataaccatggaggaatatcaaccaggacttactagtccggaatgctctccgggttcatcttgaaatccggcatcttgtcctggtccctcgtcgtttctcaagattcgggctcaactaaaaaaattttttttttcttggccatctctataatgttcagcagaatgtacatttttgatatcatttgaaagcacaatttctgaagaagtcaatagtacaacaaacaaacagaagtatgcttttaaaaatatagaagcgtaaataatcacatttttctgacaaatgcttaaacgcagagaatttgcatatttcgacttcatcagactttgtgctttctttcatataaaaatgaaaggattattctgacattccttcaaaggattgtgctgattttatgttttttattgcttatagacacgcttccgtctcctcgaacaaagcggcagaaaagggacgccaggagcaatcaaggttgccaaaagagaatagggggggggggggggg

SEQ ID NO: 12574 - DNA, 3400 bp, Heterodera glycines
  misc_feature (44)..(44): n is a, c, g, or t
  misc_feature (202)..(202): n is a, c, g, or t
  misc_feature (3362)..(3362): n is a, c, g, or t
gcagttgattttttatattttaatttaaaataaacaattttctnttctgtgctaattcataaataattcagagcgcgactttcgatgatgggaattatcgacggggacggagtcagccgagacaatgacaagggcgagtactttcgatcaaggcgatggtcatcactgtgaagagtgaccaggccatctatcaggtcagacncaacaacaaatagactttgtatggggaaacacattaaattgaatacgatttcgacaaaggcataaatattcggacgcaaaagccaaataaaactcactttaaaccaccaattttgtgttttgccaggcgtgtcctcagcagggctgcaagaagaaagtgtccatggagggcaaccagtaccgttgcgagaagtgcgccaacactttcgacacctacaagaacataatgatgttgcaggttcttcttgttgtgcaatgcgattccccactttcctttcaggtcgaattggccgacttttctggagagacctgggcaaccatttttgaggacaaagcggaggcattgttgggggtgaaagctgaccaaatggcacagtggcagagagaggacgtgagcacaaaatttaatttcatatttatattaaagcacattttaccacggggggggaatgagtcgggtagcaattgcctattttcattgtaatttctgtgtccgaggagatttttcaatacatggacttcccttcatcgtttttcctttttgtccagcccgctcggtttgattctgcatttaatgtcattcgtttccatgagtttttgttccgcgtcggagtcaaatacgaaatgtacaatgtgagtggacaaataaatgttcaataatttttgaaactgttattttctcaagggatgctttcatacttttgcctaaattgccgtcatttatccaacacgtgcctctaattttttttcttctcttccaggacaaatcccgtctcaaatggtctgtgttcaacattcagcccgtcccattggccaagtgcaaagctttctttgagcaatcggtgcaaaaattggaaggaatttgatgccaatttcgaatttgataaaccgcaaatacacaacgtttttgcttctgatcaggcgatactcattttatccaaatatgatttcacttatttttgcaaatattttgacattaatgaatatttaaattcaaaaatgggctaaatgttattaaataaatgtcatttttaattcactctatccaatttagcaatatccctattggacctgttcttatttattcaacttttaatagcttccataaaaagggataaaaatttgttgaacatcgcaagtaaagtgctttttcaatgttagttcgtggtttttccgatttgacatcatcagagaatggattcgggcatcagcgtgtccaacactgtgactaagaaatgcacccccatcggcaagtcctccccttcggcgtgcatttggtccgcgttttgttgatttgtccaccaatcgccgcccgccaattgccatagccccggggcgaaagcggcgtagtgaaaattgtggccaaattccctcagggcgcgccaccaattgaaaaacgtttgctgcagcgtttgcgcggccaaattggcgtgacagctggccaaaacaccgttgaccaaaatgtttccgttggcagtcaatggcgcgtaaatgccatggccacgcacctaattagtgccatttacacctgattaggcccaattaagcctcgttgccttgtcaatgtgcacaattcggctcaatgccatcctggtctgcccccttctttctccttctcctcgtctctccgtttgccgaactctctccgtcccgtctccatcccttccccacactatttcctcgcccattttgccgttttctcctccctccaatgcgtaaacgcattgccccgggcgcaattcattggccctaattagccgcagtcgccccgcgcatccgacccaaatcaaatggagggcggtgagttggagttggtggccaaattcggtgaaaattcgcatgaaaagggccgattctgacggcttccgatggagaaacatcagaacgggagagaaggaaagcttaacggaatttgaaaaaagaaaaacggaaattagaaaaatgaaaaaatgatattgttttgggaaccttctgaatttcagaagaaacggtttcgaaattcggatttaaaccatttgatcaatttttgaattttaagaagtgatcaatctcaataaactgaaattcaaaactgattgccatgttcatcaggacagattggcaaaaagatattattaattgttaatgccgtctaccaatgactcgtccatggacagcaccaaatcgccgattcggagctgatccatgcggacgggtccccgggctgtccggaccaactgatcaccgctgaaacactgcagcgaggcgaaggcggcattaagcgccgtgccgccaccgtaacctccaccgttgacaccgtaaccaaagttcggcgccttagggagtaattatgacaaataaacttaaaataccatatgagagggtcgctgtattttttattaaatgtttaaatttaaaatattttccactgactctaaaataataaaaaaaattttaattaaataatttatgaattaataaaaggacggacggcgtaatagttctgcgatgtgccgatttgctgttgctcattccatgacggaatgtactgctgttgctgcatttcgacggccttaaacaaaaaaacgtgcacataattaacattaattacgacaataattgatatttttaatcacttggctttcccctaattcgatgccattttcgctgttttgaatgccattgaatggaggtaatgatgccatcgagtcgcagccgcattcggtcggacattggcacatcgacgggcaaaagggacaattgggcccattgcaggacgagggaaggctgaggaagaacaaattagggggaaaatgagggcgaaaagcgatggtaaattatcaaattgacacaaaccccgaacatttgcattgggagcacgaacagagaccacaggacaactgaaaatgggtaaattgatggaaagtgaaggaacaaaaataacacaataaaaaacaattaatggcaaaaaaaagaaaatgggcctagtgcacatggtaattgtcgccatttatgaaccaaccaacaaacaaacaaatcgaaatcctacgagttgaatattctccaccaccactcaccacaagtgccgacggtgcggtgccgtcgcatccgtccgatcttccgcttcgaattgtggcgcaattggcagccaattgcggggcgttctcgtccccgctggcggnaccctctccgaccgttgccttttgagctcccgccgctg

SEQ ID NO: 12575 - DNA, 2929 bp, Heterodera glycines
gctgctgctccttcaccgattgcaactcgtcctcttcgcttttgctgctgctttccgccgttctgccgatgtccatctgttgcacatttttcaatgctaaagtgtaagccgcgccggcactgccgaatgtctttggcctttcctcccccattcctcgccctttcttcgcttcatcgtccccttcctttgcttttcgctcgttactcatccaattcattggcccatctatccgatgacgaattgttgtcagtctgaccaaaaattgaacatttatgagccaataaattctgatcgttcttcatttgatcttttatttctctttttctcttctactgtctctttcggtgttccactctctctctctctctctttctctctgtatctctctctctccgctctctcctttcgccctttctctctcaccccgtgtattttatccgatcaccgccttttttgcttctttgtttctgtgccaatgattgcgtttgtgttcgcctgttgtactgttttaggagtgccatttcggtcgtgaacgatgcttcatttgattggctttgatccgttggcggcgttggctctgtccgtgtgggcaatgtcgaaaagctatcaatggaagtgccgtcctcgtgcccattgcggcgaccattcaacgaaattggcggaagtgacggagttacagcttcaatggcgaaaaattgattagtggaatcttaaaagtttttaacgctaataaaagaaattttccaaacaccgcgcccgggaaccctcacagccaatcactcgccgctctttttaagtccccggaatgccactcaggcggatcagtcggccaatcagctacccctatagatccatcaatctcttttcacgagttttatttttttaaattttcgatattttattaaatcccttcggttcacttttccaatcccacttgtgcccctcttcttctgccattgtgccactttttgttctcattgttgctgcagttgttgtcgctgaatcgtggctaatgtcaccaatgctttttccgtctgtctgcgattgtttcgcgttgcgaatgccgtccaaatcgacgacatttttggtccaatttgtcggtgccaataatgaatcattatggagtgaagatggacgtcggcgcctttaatgcatccaatttgccccattttttcctaattgtgccaatgccatccgaccattccttcgctttttgcatcgctttgcgcatcagtgcgaatgacggcctttcgcgtcgtgcaaatgcgctgcgctgagaagcattcgccgcggcgacagagacgcccgcgtcagcgtcgtccggaatcaaacgcacgcccgacaaatgtgagaatattgggcgagcagagaaagaggaatcggcagagagtgggggagcagaggcgcagaggacgcggaagacggagagaacgaagcggacgctgaaagccaaaaggtgggaatggcacaaaatgtgccaatttaaacaaacattaaacaaattactcgttttctgtcgtcacatttttgcggacttctttgatcacatcgtacgccaccttaagagcacaataaaatgtttattttattaattgatgtttaaatttggcaatttccaaaaaaaaagaagatttttcctcacagtttttccgttgtgaatcacttggccaccactgaactgctcgccgggtgcaagcacaacttgtttcagcggggcggcccattcagagagacgcgccacggtacagcagcgcatcagcagggaaatatgggtgccgttgttcacctttcattatggcatttaattcaaattttcccaagtctttaataagtgcccactcgcctcgaccaacgcgacggtccattggtcgggcaaatcgcacaccgcggcacttaacgtcccattgcagtgcttaaaaacggtttgctcattttcatttttgtaattcgaatttggcctttcggccgattgactgaccgtctgccggtctcttcgccctccaccgttcgcttcgtctctctctcctcccctctcgtcctcctcccttttgtcctttccttttcttccacttttctctctcccaatttcgcccctttgccatttctttggttcctccgccatttgcttttcttctgtccttttctcgtccgattctgtggagaggaaaaagtggacgaaaacagcggacaaagcggcaaatggcagaacaattctgagaaagggtgaattgggaagatatgaaccaaagcaaatcaaaaataaagtcgagagtctcgaaattgacatgggaaagtcaagccaaaaggtacgaattaagttgcaagtgaatcgcgagagtctcgaaaaatcgctaaacgtaaactgccatgccgacctggcctctcatccggccacactttcaccaccgttggcactttgtccttctcacagtttccattctgctgctgccttgcgacaattgaggaaagaaataaaaacggaaacagtaaatgcaaaacagtcggaatacggtagtcaacttgcatttgtgccgtacagaatgaaagagacgtacggtatgagcagggtaaaagaaataaaattgtattaaagtgcccttctcgacaaataaacgatttaaagcaacggtaagctaatgcaaaaccttgcgcatattcagcagcccaattacagcagataattgtgcacggacgggggaagggacacccatcgcccgagggattgactcgggcggagggattggtggagagggttttgtgccctttttggattggacgaaagggcgggcggaaaagggtcaacgacttttctttttgaggagcgatcattcgttggttggaaatggtggcaagaggggattatttggaattgatttccaaagcaaatgagaagagaaaatgcaaatggaggaaaagcatgaaagggaaa

SEQ ID NO: 12576 - DNA, 2644 bp, Heterodera glycines
ttgtttagtaaagtgatttatcaaaaaaaaaatacaaaaatatttcatcaatatgatcgaaaatcatgcttttccttctcttcttctcagctcattagcacctaattatcggttttatgcttcttgcacccaaacaataacgattcaagagtgtccacttgagggtactcaaactcaaacagtgagtgatatgatgatgaactggcgaagtcatttgaagaaggattttgcggagcattgaaggaatttgaaggatttaatccggaattgaattgtgatgaattgtctaaagcatttaaagaagcgttctgtggcattttgaaggaatttaaagcatttaatctggcatttaattgtgatgaattggcgaatgcatttgaagaagggttttgtggcactaggaaggtgcctgatgagttaaatctggaattgaactgtgatgaactggtaaaagcatttgacgaagtgctctttggcacaatgaatgatggtttagccacggaagttctcgaaggatttggtctcaaaaaggtgccgctggattgtaatggtctacttgatgaaccagaggccaccaatggttgttggcccaaatatgctttccccaatggcacagtgcctaaaacatcagcaaattaatttgcacgtaatttagctaaatttctccatttcagttaattttcagctaattaagcacagaatctgttcgactgacctgacccaaattggtttgatgggaattggtttgaactttgaaatggctgtggacttcggctagaagaggccgaatttggcccattctttaccaaattatacatttctttttgttggtttggtgggagttgttgaaatgttgaattccaacgcatttcctgggataattgttctctcacaggatcatccttacttgccgtcatagcttggatcgtgccgcgaaagccctcaggcgcgacattaatacggtaaggttcgataccgtaagaatcgtctcggaaataaaattccttatctctttcgtcttcaaatgatccttttgagtaagttctctctactctttttttgccttttctgtccatacatttgtaaggtgtaaatatctgtgccaaaatgttcagtgttatgagaagaaaaagatgagatttcatcgctaaaagtacaatggaaattactgcttttacattattagtttggccattttaccatttggagaatttttgtcaaaataaattcatttatgtctaatttcaataaaaaattcacaaaaagaaaaatgaaaatagagaaaagggaaatatgatgatgaaataagtgttggaatgggaatattgatctttttaattttctcatagagtggatttaagaagcatacagtggcggaaaaaagtcttgactcaagatgataaaatttgtagaattttaaatttcgactggaaatttagctgattatttcttgtttatgtatatttaattcggcagataattttgtgctctttccaatgaacctattcaaaaattcccgggaaattttactaactccctaggaattttttcgaaaattttcccgattttcaatgtattttttggtgtctcgatcaccataaaggagtgatctgatcaagttggcataagagacttttttgatcaatatcaaaagttatataaataggattttttcagatttttgggtaaactattaaatagtttttcaagtttgagtcaagacttttttccgccccttttttgaacaaggtctgattaggagacttattcacgagaatgataaagcggaatgaaatgattttgtggtatatgaaaggcccatatatcggggtaaataaatatacataaacaaaaaataatcagctaaatttccagtcgaaatttaaaattctacaaattttatcatcttgagtcaagacttttttccgccactgtatttgttcaggcaaagaaaatatgtaatttgaaaaagaattcaattttcttagctctctctcactcgcttttcaaggcagcctctttctctccgtttgtttgagaatccaccaactccgaccccgttggaggagaaggttcatcccccattccaattacatcacaatgtcgtgtgttagaaattcgttggtcgattgccggtactaatgcactttaccagacataaaattttttttttgtcttaattcgtgtaaaatggttttcatactttctagagccccacattttgattataaagcatggacctgggtttatgcttatcatgggccagtaaaatttttgtgtaaattccagctaaattttagttttaagaactcctggaacttggcctgagctcaaaagtccttaacccaagtccatttccaaaattactcaataaaaccagtaaaattaaaatttctaaaagtcttggaacttggcctagcctgggctcaagaaaggacccaaatccaggtccaaaattacccaataaaaacccagtaaaaaaaatttaaatttaaaaaaatccttgaattggtctagacttccttgacccatgtcaaggtctaaaataatccaatctttttacccctaaaatattcaaaattctttgcttactctttcaaaaataggttactgaaaattgtgagcacgggattgggatttgatt

SEQ ID NO: 12577 - DNA, 1988 bp, Heterodera glycines
gattacgacagtagttgatttcgacagtgcccactaatttttaaaaatagtgataagttgcaatgaaaaaccgtaattcgacagtagtgagttcgattatttaatatttttaaattattactaattaaatattctaatttttccttccgcattgatataaaaatgaattaaagggtaaaagggcctaattatattgaataacctttgtgaattatttgtttttaccccttgagaacgtttttttgtttgtcttccttatcaatgaacgaatgcagcaaagatggcattctcggaggaaattcgccaaacccatttcccatcacccataataaaccaaaatggctttccatcgttttttggaggcaaaatcaaatagggggaaaatgcttctcactaacaatggctacgaatatgcatttgaggtgtcaaattttttgtagactaggccaatttccgagtttaggccatttccaagacagaggatggttacgagtattggagatgtccacgtcgtccgccgtattgtcctggtcgtgcaattgttttgattcggtgggaagtcgacaatgatggggaccaattcaaagaaggacgagtaacggcagatcacaaccacccccctactttgggatggcatttggtattttataaaaatagacatttgccttaaggtaatcataattataacaatcttaaaaaggtgagagaagcatgtgagaaagttcggcaagaggcacgcaatgattttccaacgacaagccgaaatattgtaagagaagtacgtgggaatttgccggtcgatgtccgagtttcgagtgcgccatcttcttctaatatgcagtggaacttcaattatcaaaagagaaaacagcaagaagaagtggggttttaatatataaatagaatgcggccaaatatggacaaaaaaaaagtaaaaatacggacttaaaaattcacaaaattttttatttatttgaaaaagtaattttttgagatctgtttatatttttggtttaattttccaaaaaatatatttttttaaaatttttggcctcttttttacatttttgctattatccgaaaatagcaaatacgggcaaaaagggcgaaacgccaaaattggcaaatttttcaatattttttcataaatgccataatatggacaaaaaaaagtggacgaaaaacgtaaatgtgaaatatgattgaaaatgtgaaatatggaaaatattcacaaaaaataagctaaaaatgctttttatttgcttattagaccgaaattagtatccaaaaatatgcaaatccatacttgccgcactatttataaaataaacaaaaataatatttgatggttttgggtcggagacgttggaatcgacgcctttcctgccaccctgattgttatgccggggagattggctgactgagttagtttcaacgaaattgttaatggacaacagatgattgttttttgctcgccatttggccgtggaactttggctgcgcacggcgctgacacggcaattgacgggacctttgaagtagaattcggggtcactaatcagaattcttatatccatttcgaaaataccgcttcccggacccgaatttgaacaaaaaatgggaaaatcaaattttgacagtttagataagtaaaattggtttaaattttaaatttattataaactgcatcaactaaattgtttagacgagccctagggggttcgaacaagtgtacacaatgtctgcaatcatccagaattgtgccgtgccgtgtgtgtatggattacttccaggtaaaacacaagcaaattattgccgcttttttcgtgcaatccagcaagcagttggcaacgtttggtcaccagatgcaattaccgtatttcctcgattataagccccggggcttctattgttcaacccccctccaaagggggcttatattcgagggggtcttccaatcgagggggggcttttattgttcaaccccc

SEQ ID NO: 12578 - DNA, 1834 bp, Heterodera glycines
ctcccctcgcacattcatcaagtttcttccttagtgtgccgcaggaaaaaattttttaaagatatgacttttaattttccttgagtaaattatgataatttaatatagttaaaaaacgaaaaattgatcggaaaatcttaatttttggtgagtatctgttagaaataaatttaaaattcacccctatcggcacgccgccccccccctcaaaaaaaaaacgaattttttcttaaaaattaccccaaatccctaactttggttattttttagtcaaaatctgtgcaaattatgtcaaaatagatagaattaaggcgatcaacgaataaaggaatgtggaccaaagaaatcattcataaaaaatattttttttttatgagattttttggagctaattcaaagcaaacccccgcccccgcccccgcgggggcggaattttcgtgcccccgtccccgtccccgcgactctgacccccgcaatcccccgcccccgcgaaaagccacccccgcccgcggggctcgaaccctactagaaatcactattttggcgttttgtcacttaaaataatgaaaattcactattttggcattttgccactattttttcactatgtatttcgacattttttggtaaatttctcaacaaaaatgcaataaaaacgaaaaatacacccctaagaatctacatttaaaaaatttcaaaaaatttggaaaattttctcaaaaatcatctcccaaatttttttttcttggcaaattttttggattaaaaatgtcaatatttgccaataaaatattagaaaggaaacttacttcatttgcaactgcaatcagtgaataaaaattatttttgatcaatttttaaaaattatgtcactattcgtcactatttcgcactttttggagtaatgtatgaaatacaccggattccagaaattttcataagtgaaaaagaaaattatgacgaccaaaacgagttcagaatgagtataaatgtcataagaagtgaaaaaatgaagaaatgggacaatttatgaaaaataatgagcaaaataagcagcttttaggcctaatcgagaacatgaacacgaaaggcagattaaacgagcccaaagaaaagaacgggaaaatttacgaaagccattcatttttcaagatggaattgttatcgaaagaggaggaagaatctctgaagaggttgaagagaaagctcgaacatcaacttctgagggtccagcaaagtctgaccgaaagcgaaaaatgaaaatccggaacgtcggatgatgatccagtgggaccacaggagtgggaagaaaatgaggaagaaacgacgaaaaagggcgaagaaatgaaggaaaaagaggaggaggagaagaaaagaagagagggaaaagaaaaagagacggaaaagaagaaggaagagatgaagcagaaggacgagacggaaaccaaacgaagcctcagcgtcggaacaacgaaagacgatgaaatctcgattgtggattctgaagaaagagaaagagatgccttcgaatacccgccgaaaccgacaaacgagcgaatggcattttgggagtcgactttgaacaatgaggcaaaaaaggatttgcgagaggacaaagagaaagccttaaaaacacaggccaagctattgtcgtaagctccagaaaacgaacgataaacgaagtcgacccgccaactctggcaaatgaagccgccacgaaattcggggaaaaaatgcggcaaagcattgaacaggatcagaacacgaaggaggcgcgaacagtgctctccatgctcctcaaaatcagagaaagggcactgatttgggagatgag

SEQ ID NO: 12579 - DNA, 1760 bp, Heterodera glycines
taaaacaaagttaattttttattttgttttttatttaataaaatccaaaagttaaagctaaattaaattaatgaaaattttcaaaccaaatttatttcaattatttcaggcaataatcatttttgactagtgatcgaatattattagaaattcagatttgcttttcacagcactttttttcggcgcgctttttccaaaaaaattttgcgaaagacgggggtccggcggtgccgataggcgccgccggggaaaattttgaaaatttgagtgaaatttgttaacagattttcaacaaaaaagactggtttttgggattactaggctcaatttgtacggattttctttaaaaaatgataaaatatgtataaataaataaaaaagtatgaggaataatattttgtcgataggaaaccaatgaatatacaaaaagaaaattcaaaatattttaatttctgtagagggattgaaccaggtgaaagaagaagacaaaagtcaaagagactagcgccaataagccatttgaacaattggtagtaacacttttaaagaatatttttatcattttttggcatcggatggacaagcggtgacaaaatggcttcactccccgtccggacaaagtgccaaagttattgaaatgctcattggacaaagatgatttgcatttcgagttgaggattgaagccttcaaagcgctgctttcatttatcatttcgtatttcttattcaattttcacacctttcaggcttttgcttcttcacccgtcaattttattgtcgtcatttcgtttccgttgcattttgctttctccgttgtgccattcgatctgatcaatgaatttactcgtgaacaattggcattgaaaataattgacaataaccgccgttttctgctgatccgttgtccaattgcgcgagacgaaagcaaatggacaaaatgggaagaggaagcgattggctggcgaatttataaccagtggagcagtattgagattcgaatttatgatgaggatgaaatcggagacgggtaactgaagaatgctttttcaaaaatgcgaatgatttgctgcgaagtgatcaacaaatttgaaagatggaattgccaaatgaatttgaggctattttgacgtgcttgtaaaaattgttctccttttttttgttgttggaataatctcataataattaaggcttcgacatttagttaatcgaaataataactaaatagtgtgacaaaaagtcctaattagtagcataattttcagccaaaaactgagcaaaattattattattattactggttacagttgcagggtctccctgttcttaaatgttgtgaaaatccatgccgaaaaaatatcattgatttttttttttttgtgtaaaaaaactttatttttgcggtagaagcatagttttatttctccgggcattgttttcaatatgaaaattttggtccgtcaattttttttgttttgtttttttatagatttctaacccaagtggccaggccagaggtgatcaaattaaaaatggcaaaaattgttatatgaaaaagcagtactcaaattaatagaacacaaaattgattaattacctaactaccagggatggcaagaattccgatttccgacatttttggggtcggaattccgatttccgaaaaatttttgggcctcggaattccgatttccgaaaaattttggacccccggaattccgatttccgaaaatttttggggcctcggaatgccatccctgcta

SEQ ID NO: 12580 - DNA, 4363 bp, Heterodera glycines
  misc_feature (64)..(64): n is a, c, g, or t
  misc_feature (135)..(135): n is a, c, g, or t
aaacgttcgaggtgcgttatgcgcttcggggtggggtgggctgcagcaaaaaaaaaaagaattntattcgacagttacaatcgaataaaaaaaatcccttttcatagggaaatttaattgttgtgccaaagatgntattcggtttagaattaaaaaacaaaccgagttttatctattttttaagaattgaactgcatatgttctgtatcgggtgcattacgatccccacatcgaaaattgaaaaaaaaattcaaacaaaaataatattaaatttaaggctatattattatttattcaaaattgttttttattaaaaaatctaacaatatgaatttttttaaattttttgggcgaagctgctcatttgaaatctctggtgcacattgctctctgtataatctgtcggtgttttaggcgtggaattacagacaaagtggccatttgatcgtcgagtttggctcgttggcttcggtggaattttttgttgagatgatggccgccgatcgcattccgtaccttcacaagcccgtgggcttccaggatctcatcacggtacactttttcaaaaaagaaaaaaatatttttttttcctggcggttggcgattttacacccgttgccatttgtagtatttttcctttttgtgcatgtgggttggtcaaccgaaattttttggtcaatttctttttaaaaaaataaaatttcgggaaggaggggccctgcccttgaattttctcaattttcattttcttttctttgcgctgcacagtttggtcggcgtcagttcttcgagttggtctaccgcgacacgggcgtcgatttgttgggctgcgatggcaatgtgagcaacaccagcacattttggcacatccatgcctaataaatcgattttgttgccacaaaaaaataacatttttagccaccttcctcggaatggaaccggcaaaggccccgtgggatggccgttcggagtgcactcggcggaggtggcaacggtaagcaaaaaaacaatgaaatttttcaaaaattcccttaaaatttttcaaaccattttttcttgaaattttctttgtacaaaaagttttagagggattcaacttaatattttgcatatgatgattgagtctgtttttcacaaaaattttcctaaaatttgctgaaaaaattttcaaaaatattcttgtaaaaaatttattttttttcttgaaaaattctaagtttttttggggggagggaagaattaagaaattccatcatctcaacattttgtacatttgcagcctttccgcgtcgggccggcaagccgtacgagcgcgagcgtgggcgcaccggcgctgccgcgtcatcgtcgtcgagttggcgccgtcggtccgagtcgccgtcgccagtgattgacacgagtccgttcccgagcgccgccaccaccaacggcactcttcgacgggtaaaaaaaattttttttttttgatacgacaaatacacaaacagaggcccgtagaagaccaggatttcggccctggcgatgacttttttctttttttgcagcgatttttataaattggtgtgtaacctatataggcgccgcttgggaaaaatagaaatttttaccattttttaaaaaccatgaaattaattatttgtacagtaccgaatatgcagcgtaaaaatattaatttgtttgaaaataaaaatgacaacaaaattatggttcatttttggctatttccctctctctctctccatctctctcttttccccttctatctttggactctcattccaacacatgcactctttttctccacacacaaacactctctttcttttcccaggcttctctctctctctctctcatcttcccgcttttcttccctcggcttgctattctattctattctatcgcttactatgtttttttataaattcattttcttttggtggtccgtagccgaaaacttttttttctttgttctatatttcttaatgccaattttgtctttgcttttttttcaaatggctacgggcctctgttttattgtttgtttgctgtttttcattttgtattatgccaagtgcgacccagggatgactgaatactgacttttttgaatgatggcattttcatgtcaaaattggtttgaaattctaattgctaattcatccctgtttcgccaattgtttgttttgctgttctattatttgttggatgcatttttccctggagctccgtccacccaaacccggcaaaaatctgaaaattttaaaaatttatttttacggagaggaccgagacaaaaatggcatgggtcagtgccgtaatgcatttattgtaaaaaattttgttataaaaattcaaatttttttaaaattttataaatttcttttaaaaatatttttgaaaaattgcaacaaaaaaatataaaataattttctatttttttatataattttaaagtttttttatgattttttacccaatttgccattgattgttatgccaaagggggacggaactgtccaatttttggaatggcacttctgccaccacccatacacttcatcatcattttgcacaaaataaaaaaacaattattgtcgtgagcagggcggcggtggtcgctcgctgtacggctcgtaccgcctctactgatgtgtgatggatgatctgcggcgctgaatacggattttgtgcacacggatagagaggagggcattggcactgcgtggggaatgaatgatgagcctttgtgtgtgtgtgtagcaccaatgaatggcacacgtgccgagtgcatcgatttcattttacaaaatttgacactttttttttgttgtttttgttttgcatcatttgctttgttcaaacggagtactatttcttcattcccctctcatctctccaccctcccgcaacagacactattattattattattatattattattattatttgattttatgttagggttgtgcgcgagacttccgactttctgaaaaatgaattggttcgagaaaatttttttgtgtttccatttttttaagttttcatggcagtctctctttctctgtcagtctcctttctcttagcttacaattatctctctcgctcgctcggtctatttctcgctgtcttttggcattctctctttctcgatcagtctcttcttttctctctgattttgtaagtgtcttgatcggtctcatttttttggcacgaccgattgatcctcattgttttgtttctcgacatggtcattgtcctctggtccatcctttgatcccatttcaaattgccattatttttttttggaaagcttcgcacagccctaatatttcctccccgtcccctcccctccccccacatttaattactctctccatttcatgttaaaactgcaaaattcgaacgaattccatgttttgtcgtgttagtcgaagccctaataattggacataatattttttcatttgttgggcaagcgactgacataaaagcattttgtttgacatctcttcaagttccactattatgcttttttccttttatgtaatacacaaaaaattcattttttttttgcatttttttctcatctcaataaatgttcttcgttactcataataattttttaataaatttttttttcccattaaaaacattcaaaacaaagttctgtttcaataaaaaaaaggttatcaagtcgggtgccaatacttatattactcttacgccttaaaattacaacaaaaaaaaagttaacaaaagcgcgcaaaaaaaacacgattttttcccattctctatcataaaaagtttggttcgaattgtggcattctccaaatcatggcacgtactgaactgatttttgcgcgccctttgttgatttttttaaattttcgggcatatgagaaaaactgaaaattaccgaatgcgcctaatagtaccaattacttgaaattaggaataaatccgattgcttttaaatgccaaaggtgatacggtgcttttggggtaccctaataccgtccgtgtctattgttgccactaaaccaacgataatctcatgagtacgatgcttttggggtaccataataccgtaatcttcggtcaccattctcacatttcttgcaaattttgcaaacgcaactcataaaaaatctttgattgaattttccccagtttctgtggagcaccgaggccggacgaaagcacattttgaccgtcgacgaactgaacagaggcggcaccgcgacaacaaaagcgaaaacggcgggggcattccaagacaacaaaacgcaacaaaagttgtgtgcacgggtccaagaaatgaacattgaggagggcgaaattgtggaggaccacggcgagga

SEQ ID NO: 12581 - DNA, 2826 bp, Heterodera glycines
aaatcatttggtaatggattcaacagaaacggaacctttacgctttgtggaaaatattttacttacagatttgaacgtttcagacgcggtgtagaatcttaaaaaattaatattatttaaatcttttataagatttacgcgatacaaattaaggaaatagtaaagttcatgtgatcttgatagaaaatggataaagaaaatgtggtttattgaaaaaaatggtgttaattcgcgttcagaatctataaataaattaatattattttaatcatttaaaatattttagttatataaatgataaattgaaatgtattaatgctctgataaaaaaagcatttgataatggattcaacagaaacggaaaaattagcactttgtggaaaatattttacttacagatttgaaggtttcagacgcggtgtagaatcttaaaaaattaatattatttaaaacttttataagatttacgcgatacaaattaaggaaatagtgaagttcatgtgatcttaatagaaaatggataaagaaaatgtggtttattgaaaaaaatggtgttaattcgcgttcagaatctataaataaattaatattattttaatcattaaaaatattttatttatataaatgataaatcgaaatttattaatgctctgataaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataaagaaaatgtggtttattgaaaaaaatggtgttaattcgcgtgcagaatctataaataaattaatattattttaatcatttaaaatattttagttatataaatgataaattgaaatgtaagtagtatatgacccctaaaggttgcgggttggttgcgggtgtttcccgcacgagcccgtgggcgcagccctttgaagtagccgccgtggacatttaccgccaagaaccaaatcctaagggatggatgcgcattcctttgattccaaaacctattggaccactttgatgtagccgcctgaccaaatccgatttcccaaattgttgcgggtgctttttttttcaccgccgcgcagcgccgcgggaaggtcatcaatcatccacctgtcaccaaagtgacaggtggaggaaattcaatttaacttttgcaaattttaatcttttgttttcaaaaccttttagcgttttattttctcaatcctgaaatttttttatgatgattttttgatcctgaaattaaaaattctttttgaaaattagccaaaatcgtgaggttttttcatttccactcactccctgccgatgcgccgcgatgcatcgccgcgcaaattaatcgataaaaataatcgataattacactagcactatcctccctatcgatggcacctgcccgccagcgagctttgaaatgagcactcagacccccccgccccaccaacccccctgccccacgggcacctgcccgccagcgaactttgaaacgagcactcagacccccgccccaccaaccccctgccccacgggcacctgcccgccagcgaaattaataaaaaaatacacaacaggaccacaaattgagggaccgtcccaataaatgaaaaaaattttatcgtctctttaaattcttttgagccattttcagatagggaagaatataatgatacatttcatcaatttcagaattgttttttgttcccgtaattacgactttaccggtccagaaaattaacgctgtcctgcttttaccccgcttgaaatttaaaccgcaaaatatttcgggttcataaaaggcacgacgattttttcgaaactcgttcagttcaatttcatgtccgaatttaaaggtcgaaacaatattttcaaccgtgtgtccggtgtaagaagcccccggacaccccgagcccttaattatttctataaattttttaatagcattttcacagtctatcagacttttcgtccccagacatatcatttttccggattcccataataatgccgtggcgttgataggagttgtacatttgataaccgcggcattgaattttctagggttatacttaaattcgcattcggtgatcgtcagagagtttagtttaattccggtaccgagattagcgagagcaattatatttacgattatcggtttttgcattttgatacaatgtatcaatcaaatggtcctttcactccctttatataccccttctataaatagcaacccaaaataaaattaaattgaaaaatgaactgcccacataaaattaagtgttgtcattactgtccctgtcattacgagatttgtagcaggtgtaaatagcacagtcttttgcatttcggtacatcattatttgataatttctggctatgccccaaatgcgcgaaacatgttcctatgaaaatataaataggtcaaataaataagaggaattaaaaatgtttcgcggtccgttcactctaattctctcgggggctaccgggagtggtaagacccgttggctattacggtttttaaaacaccataagaatctaattgaaccatcgcccaccaaaattctttattgttacggtgagatgaatgatagtattttaggattaatcggggagggtgtcgagagttttaacgggattccggacatgaataagattaaagaacaaggaaaacccctcttactgatacttgacgatttaatgct

SEQ ID NO: 12582 - DNA, 909 bp, Heterodera glycines
tccaagtcaaagcaggcgccctgaatgtttgcattctgctggcccatttgacatcgtctaaatggcaaaaagggaatggctccaggcatagccatgggcccgattaaaacacacacaccgtttcaattttggcatctcagtcccaaaaagatttgaaaatgtggcgaagtggttcttgtaagatagttaagggacaaagggtggaggttcgagtccggtgtgcgacatgagtatttttattcattttcgtccaaaaattaaagaaaatacaaattcgtaaattatttttgatgtttttgccagccaaattggacgcttttggttccattcgaaagatcttaatgacaaatactaaggaatttgatcccttagaaaaaaaatctatgagcgttcgaaaatttgatgcaaaatttggtgcggatttaacgtactgaagtaaattcaattttacaaaaatagtacgtcaaaatgggagatgtttttttctctgcgctctctatttattgttcatctctcgctttttgaaacggtgtgcagaacacagcttttcattttcggtttacctcgccaccattctggggaccattttgttcgcgtgttcctgcagacgataaagtgccatcgatgggtcatggtccaaaatgtgggcacactccgaaagacgctcggcaacttaagagaaggaagatcacagaccaaactgaagatgttttgagccctcaaattcaagacgtacgctgtttggaccggaattgcaagtcgcgactaattggcgaattcggaggatccattgactggagacgaaaactcaatttagcacacaaaaatatgaagaaaaagtcgcacgatgaacaatcaacaaatgaggcaatataaaattttaggttattaccgtagaaaggtaaaaaa

SEQ ID NO: 12583 - DNA, 2560 bp, Heterodera glycines
tctcctctcccttcccttttcttcctctccctcccatttctctccttttcctcctctcccttcccttttcctcctctccctttcacttcccttttcttcctctccctccccgttctctttcctcctcccatttttctctctttcccccgttcaccaccctctccaacttttccacctgactgtgaatgagtcgctttctgcgttcggcccattcccaaaagtgtttcctttgcacttccatcattcgttcctcctccttctgcaaaattggctcaaatcgtactgccaacatctcggaaagtttttcggttgcttttgctttgttaatttcaaattcggcacttttttgctcaaataatttctgaataggcaatcgtgcgaatgataattttttgccattatcactttcagtgccattttctccgattcctccgaattttggtcgtctttttctctttccgtttgcttctccgccgcttcaatctgttcgtcaaaattcaaaaattgctgcatttgttccatggaggaataaatcatttgccgcgcattgtccgatggagcaactgtgataaacatctcttccgccaatgacttcgcttccgtccatttccgctgtatgctcaaccccaaaagtctgatcactctgatcagtgtctcgtcgtaattcgtttcgtcattttttgccaatttcaaatggtatgaaagccattcgagggctttgcctgccattcggtcggagtcattctcatcgaagtgtccatcccaaaaagggttcttcagaaaagggtagcgaaaaaggcgctgaaatgggaagtttgggggaggagggaaatgggacggacggagtgccaaaaacggactgaccacgttctcctcattgaagttagtctcgtcctccagagaaggtgccattttcggatggatttgctcatcgagttttcgttccccttgcgtccactcgagaagggcgcgagtggcgagaaaagtgagcaaagggaagtcgaacatttcctgcagcatcacataaatggcaattttggccgcatctgtggcaaatgggaaggataattaagcaaaaggaaaccggagaaaaatggacacagacattgcaactgagcggagccgagaaaatggtcgaggaacatgcagcaaatgtgctcattgggaaagatgccgtagttgatctgaaaggccatgggaatgacgcgggaaagggcaggggaccgaaccgggtcattaagcaaattcatgaaaacgccaaattcgccgaattccagtaaaagacggcacagagtgtatctgaatacgtaaagtatttcaaacggaaaaagaaagtcagactcagtggaagggagcaaatctcccgcagagtctgtatgtcgaaatttgtagcaaaggtcgaccaaatcggccaagtgatcggagccaacggggacggagcaggccaagtccaagtcgatcgcactcaaatggcacaatgggcgtacgacaaaagcaacggtactcacctagccttaccaaccccggtgaactttttctgaaccgcgacgatccattcgaaattgtcaccgccgagttgctccacgctcaaatggccgagccgaccgtcccactcagccggaagagcaaaattggagctgagaaaattgacagatggcgaattggacgaagcagcagcagaacattggcggaacaatgggacatgggaatgggagagacgagcaaaaacggacggaaaaggcgaaagaatgaggcgaaaggccggcatttctaagcagcagaaaagtgagtaaacatatggaaatggaaaaagtattgaaaggtttggtcaaacaatgaaagaaagaaaaacaaacattataaaaaatgcatttaaaagtgatagtaaggaaaagcgagtgattccctgcatcggtttcttcttctgcattagtctcgtccctcttcgcctgtcgtcaaattgcctcgcacatagcatttcgtctgaagccgaaagagaccatcttggcactttttgtactaaataataatctgatcgtctcacaatagtgttagatcagctcacatggaagcgagaaaacccaatgggtattgccaaatggtggactgttttgaagtgtttggagagtgccgagcctcgtgcatagcgagaattgcacaaatggcattcgtagggagtagggttgaaatccttgacagagagagagtcagtcgaacgggaaccgagcaattgcccccccccccgcatcgtaccccaccccgaaaaacaaatttttttttttttgaactttccggaaggttctctttgaaaacctaaaaatattcttttttaagaatttcaatcgaattttccataatattaattttcaaaaaacccaatttttcaaaaaacacaaataaattttttccttgaaaaaacttctgagaaattggaaaactttacgggcctgatcggaaaatccgtgtccctcgtaccttttggtgctgccttttgtgctctcgaagttgctttgaccaacgaaatttttttccgcacctgttcgcactcgtaaattaagtc

SEQ ID NO: 12584 - DNA, 2536 bp, Heterodera glycines
tgtcggtaaagctttgctgaaagttgttattgctcttttcctccgatcaaactccatttccccaccaaacacgagttccattcgcaaagcaaagggtcgccctgataaacgaggcgacttgatttttcgaagttgcaactgacattgagcagagtgaaaggggttatagaaacattcaaatgggaagacctcacaagttgcggacaacgaccctccaccacggaggcaccattgagcatccgttcggcatggaaaagatgcattttcatatgccgcaccaattcgtcaaacgatgagacaagaatttgacatcccctcacctgacacactgaataaatttctttttttctaaaggcggattttccaagtaacaaaaacatgccaatctcagtcaaaggttcaggtccaaactcaaacatatgttggttcaaatgcgccttgagttggtcagaatgctctattccttcttgacagcctgcccataaacaaatgtatgaaactttcccaaatccatcgctgacaatccaaagatttgagtgtacatcgggactggatgaagattgtccattctgtgcattagtagcacacgcaaaattcatcttcaatttaaaaaggccgaaacagaaaactaattgtaaggaattttatgaatcgaaaactattcgttatcataaaactttacagaaaagggaaattgatccataaaaattatctctacttttgctctttatttgacagtttaatgaaacatttacaagactaaaactcgattgatatcgtactatcagaagtttccttcaagcgttactgattgtctcgctgtagttgttaatgactgcttgaacaacttctgtactatgattcgtgccctgcaaaaaataaatgtgaaaccattttgtattaattaattgaggatttcaggtgaaatgaacaattaatctctaatgaacctcaacattaattgtaagtgaaatgggtttctttatttttggcattgaatttccattccttttttagttttccatggttgtgggcaggcacaggaataacttactccaatgtcgggagtatgcgttctctgctccgtcaatgctttgtaaagggcatcagaaagtttgtcagcataatcgtggagctcaaggtaacgcagcatgtcgatggaagctctgatgaaggcagttgggttggcaatgtctttgccagccaatgaggttcccgtgtttcgtgtgccctttaatgaaagtattctaaaaatgcatgaataaagtaaactcataaaatccatctccaacttgtaaggcaatatttaactttccgacctagcaaatgcagtaaatccctaacttactgtttcaaacacggcatattcttctccaatattccttaagtttcagtaaaaaaatttcgtagccgagtgaaaactcacattccagagacaaggcccggtcctccgacaagaccgcaagcaatgttcgatatctttaaaaagacgacgattatattgtacgttccacctggaagagcagtgtctttatttacaatatttccgtaaagatttggcatcagaagaatcccgttattgaactgttgaggaaagctgaccaattgcatgcacgcgttgtccactgaataaggaaacaaacaatgggagggctaatgtgtcatatgtaatgtaaaatgaataataaaggaaaattcacaatttatgatgtcagcgcatccctcccatccctaaaaaatactccccccccaaaacaaagatacataccaatcatagaattgaattggagacctgcatttttgtattcagtttcagcaacttctttacatacctaaaatcaacacgctttttttacttaaaaggttgttcacctgaagaaaaagcccgtcaccaagcttctgaatgtttgccttatgaatggcggttatctgaggccgattgttcaaaaccgcataatcaaatgcaaaacgagctattttttcgatgttgcgacgagttacaatctaaatctactcttttaaacaaaagacctccagccaaacactttaatgctctccacgatgcctttgacagattcgtgttcgagtccactgtattctccttcagtgttttcacgaatgagaaccaaatccaaatcgtgatgttttgctggtatcgtaggaatagagacacaatggagcacatttgcgaaccagaaaatgaccgacaattaaaaaagtaatgataataacatacaaagcaagacgctttcggagttcaacattacgcgatttgtacgtcgggtcgtcaaatttagtttcaatgttaccctaaagagatgaatttcatcattttgattaattgagtaaatgccacaacaaaaaactgtgatcaaaatcccaaaaattaaaatttgacgtaaaatgtagcttgattcagaaaatcagctagaacttttttgtaatttactcactttaattgcaaggccattacgctgaatggctgtgatggcattttccaacacttcgtttgaaggatctttcgagctcaattcaa

SEQ ID NO: 12585 - DNA, 2604 bp, Heterodera glycines
  misc_feature (2403)..(2404): n is a, c, g, or t
  misc_feature (2547)..(2547): n is a, c, g, or t
  misc_feature (2571)..(2571): n is a, c, g, or t
  misc_feature (2584)..(2584): n is a, c, g, or t
aaaaatcgcccatacgttgtgcgccactctttgcaaatgagtgagtaaatgcgcaatgtgccgtccgcattccgtcgcccgaaccggtaaagccagtgctgaaaaatgaaagtcaaatttagtggctgtaggcaatttccattttttttgtttttgagtctcggttccacccccccattttgtcccaaaccgacctcattacaaaagtcggtgaattggcgtcgttcctcgaccgtctcgcactcgcccacgtcgatgttggccatcagtttccacgacttgccactgttgtccacgtaatcgtcaaattggaccgtcgtgtttatgaatgagtcaaatagtgaaccatcaaaaccatttccactttttttgttgctgttaatcggtgtgttgtcaaggttcttcgtaatgggtattgcgtgctataagaaagagaagtgtgtatatttaagactgggtttcagtatcggatcatttgttggctgagatttcgccgaattgcttttccaagggcttttaaattaatggtattttgaataaattaaagatgtgcgataggggtggatgggttgggagcagtgatggtgtcaagctttaggcttttatcgcttacaattagaaaggggagggggagggtacccactagaaagttatttcttccaattttcggagttttttgtgttttgaaccccttgggatgggttgggtgggggtacgtaccctaaaaaaacagtattcatcataaaaattttgaaggcagaaaaattttacgaaaaaattgttttctttatattttctttttgaattttttaaaaataattttccggggctggggggaacgaactgctccgaccctgcatagtctaccccaacccatgggactgtccccggttggctggccaaccccacctgctgctgcgcctggtcgcgctgctggaaacagccggtcgcttcgttcgccgccatgtcgttgtcctcctcttgcggcggcggatggttgtgcgactgaaaggcgaacatcgctcgccttttcgccacgtacaccgcccgaaaagggcacgtcatgcccttgcggcgactgatgaaaaaataatttttatatataattgcattagggataagagcctcatgagatggggacgggaaaaatcccgtcgctggaattttttttaattttcaaattcagcgatttttaaaatttattttactaagttttttcaaaaaaatttccaaaaatcggtgaaatttttctcaaaaattttttttgaaattttcttataaacaattttttcttcataatttctaacaataagtattaaaattaaaaaaaaattcagctgcgagattttgggctgcaacacacgaaatggcaaaaacttttcggtttgttttccacactttcccaactcataaaaattaaacaccaaaaaatgaaataaataaataaatgctcacttgctaaatttgcagttgaagaaaacattcttcaggtaggtgttctttttggacaagaaataagcttgtcggaattgtcgcattctctccgggtcctcgtcaatgtcgtccaaagcgaaaagccatcgccattgtttgccaaatttgtcacaatgcgacggcggcggtggtgccaaactttggctgatcaactccgtgttgatcacgctgattttgtgttcatcgaaattggcattgtctataaaacagagtgtttgagttaatttgccgacatacaattaacaatcggagtttatttttatgagaattttcatcgttaatcactccgatttatgtaccaagggatgaaaagcagcataatttctcccattttagtaaaactcaatcttaggaatacgtttatgatacaatttttaatctacgacttgtcctggtactcaaaataacgcctcatcgaatggagggcgctttttcacccaaattttagcgtccatcggaatgttccttctgttctccccctccccatcccatgaacaaattgccatcgcaccaatgtcgggcagtgcggcagaaaatgccgacaccgtgtcctcattgctggcacaacaaccgctttgccgctgcagtgccgtcgtcgtcgctgaacaacagcttcctgctctcccccttttggcactgccattttgctgttttttcggtgccgttttgggcgtcgtctttgctaatgttgctgttagtgttgtggttgttggatgattgtgtgttcgacgatagaacagcgcttgccgctccggcaaaaacagtccccgctggggacacggctgagcggacgatcgacaaccggtccagcaacaactgaaagtgaccaagcaaatggggcggtgaatgtcatataatactgaatcatcccccggatggttccgataaataaaaaacccccaaaatggnngagtttcttgaatggtaccatcaccaaatcgaaattaatcaatggcaccgaaaaaattgctgtactgcggttaaccactcagcaccttaagtaaatgcgcccgtcatatttcggcgtccctttgcgatgcaaaaagtgttggntcggcgatttggtccaactgtgcngacatcggttggngacgagcaggcgccactctt

SEQ ID NO: 12586 - DNA, 2487 bp, Heterodera glycines
ttggcactgtcattttgctgtttcttcgatgccgctttgggcgtcgtctttgctgatgcttctgccggtgttgtggttgttggatgattgtgtgttcgacgatagaacagcgcttgccgctccggcaaaaacagtccccggtggggacacggctgagcggacgatcgacaaccggtccagcaacaactgaaagtgaccaagcgaatggcggtgatgccattacaatactgaatcatcccacggaaggttccgattaaatttatttaaaaaaaccccaaaatgggagattttattggatggcacggcaccatcaccaaacaaaattaagcaatggcatgggaaaacttggcagcaaaattgctgtacttggttgaccactcattgtcagcaccttaagtaaatgcgcccgtcatatttcggcgtccctttgcgacgcaaaaagtgttggtcggcgatttggtccaactgtgcgacatcggttgggacgagcaggcgccactccttgctaaatttgtccttgaaaatggccgggttgttgccatcactggtggcttcatcagtgccctgtgccgttgtttccgcttttgggtggcgtgccgtcgttggtgtcgtcgtcgtcgtcgacagagtgcagactcggagtcagtcgaggcggactgtgcttgggctcagactgatgcgatgccgaagtgatggaggaagtggtcgaaaatgttgccgatgtgctaccattgcacgcggcataatcgaaacaacaattgccgtcgtcactctctttcccttttgtgtcgttggcactttcagtcgtttgtaccggcggcaccgccgacgacgaacgtatggcaacgaatggcactgatggtaattgataaaacttttatttttccaaaaaatgtcaccagtaacaattagtcgggctctgatttttgattgaacccaatgtttttttataaatttttttctattttaattttcgaacttcccattaaaaatgaaaactgccaaactcatgcaaaaccagccccattttctgtcacccatttgtcgtcgtcccttcccatgcgcctgttgctgtccaattccgtcgacggcgaataatttgttggtgccgtcggcgttgttctggtcgtcaaattcgcatcggtgttggccggagttggacatttaggtgtagttgaagttggacactattattttttaaaattaaacaaagctaaaaaatcgccagacttttgtaacaaagattccgagaaaaacaaaaattttttggcacttttgctgtttagggcccccgaaaaaaacccaaagggggacccttgtgaaaggatttggaattggtcgatatagctgtcaggttggtttttagcgctccgaaaactccgtgaacatgttttctcggcttatgacaaaaaaaaacttacaaaacaaaagggtccactttttggattttttgggggcattaaacagctaaaatgccgaaattttagcaaaaatgcaacagttttatgtagattgtacagctacttatttttgtgggcacttcttccatttccaatttgtctttttccctttccactcacttccgtctcctccgtcccctccacttttgcaatttgctgcaaatggcagcttcctccgtcaaattcgagctgtttggccaacagttttgccgcatattgcgggtgtttgtccacaatgtgtgcggtcatcgcagtcaattcgcatgaattaaagctttaaaaaacagtaagcataaaatcatccgatatttgctaattgaattttgctcgtctgtactttcctaactgccagagaaatacccgtgattctactttaattcgaaaaatagttcaacctttttccacattccatgcattgagcctcttcgtttccgtttcgaaattgccgtctttcaaataaatcgatggcccaaatgggcgacttttgttgttgcataattttaagtggttaaatttttgtcaaggattaaagcattgtcaatagtctaagcaataaatacaaatttacactgttagctttattttcaaaagcaaccgacttaaaattttttaaaatgttgaatcctaaacccgcggcaggattcccaaaatatggtttttgtgcgggatcccgcagcactatgggtacgccccttcattgcattttttttattcaaagaacattatgccaaaatttttgaatttacagtaacttttattgcatggagtgctgtggctgtggtagttttttggtggctatttaacatttaacggcatggccaaagtaagttgaacaacaatcttgcaaattttatgattcggaataattttaatggacagattaaaattgatttttaacggtgtaccgacatttgcgcttcgaaacttgtcatccaaatccaatattgttggtatcattcgaaagctcttcacatgctctattagccttacaaaaagcaaaaagattttttgggttctgaaaaagtta

SEQ ID NO: 12587 - DNA, 1152 bp, Heterodera glycines
tcaagtttctattattttcgtgaacagcaacatttttcggcgcaaaatttcatttttggcattttacaccaattttctgaaataatgaaatttcataatatctctttaatttttctaaaatctctttacattctgaatttattttatttttattgaaaatatgtttattattttcgaatgagctccagtagaaagtaataaaattttatttaatcattaatttaccaattggcaattattttgtcattaagataaaattattaaaattatttctttgaaattaaacaggatttccttattttattaagtaaaataatgatttattcagttttttaatcagaaaaaaatcatttaaatgcctcaaaaaatgaattgccatttaattgaagaaaaataaaataaaatcttgaaaatgaaattctgtattttattatttttatttttgattgccctaattattccaattgaatcagaaaagaaaaaacttcagcagaaatcatttgatgaaatatttggagaaaaatggcaagaaaaagaagaagaaaggcgaaatgaactcaaaaaaagagaaataattgcaaaattttataaataaaagagaaaatcaagcaaaaaggacgaaaatattcagcaaaagaatgggataaaataaacacgaaaatagcgaagagtttggggacaaatgataattatattaaaaattggattaaacagtttggtcttcaaaaaaagaaaagttataaatcaaaaagtgatgaacaaaaacttgaaattgttcagaaatttattgaaatgtcaaatgaatacaaacaaaaaagaaaatattcaactgaagaatggactcaaaattatgccgaaatttgtaagaaaatcggagttaattatagagcaattacaacatggaaaaaacagtttggcattagtcttaagagaataacggaaaaataaaaaatggaaaaaataaaaatttattggcaaataaaaagagaaaatccgaaaatgagtgaaagggaaattgcaaaaacattacaaattgatagaaagagcatttcaagatggaagaaccaatttggagaagaaatttgaagtattaaaaacagaagaaaaatgggataaattgccggaaaaatatcacaaaaacaacgaaaaaat

SEQ ID NO: 12588 - DNA, 1773 bp, Heterodera glycines
tttttaatcagaaaaaaatcatttaaatgcctcaaaaaatgaattgccatttaattgaagaaaaataaaataaaatcttgaaaatgaaattctgtattttattatttttatttttgattgccctaattattccaattgaatcagaaaagaaaaaacttcagcagaaatcatttgatgaaatatttggagaaaaatggcaagaaaaagaagaagaaaggcgaaatgaactcaaaaaaagagaaataattgcaaaattttataaaataaaagagaaaatcaagcaaaaaggaagaaaatactcaacaaaagaatggagtaaaataaacacgaaaatagcgaagagtttggggacaaatcgaaacaaaatttataaatggattaaagaaattggactttataaatatcacaaatcaaaaactgatgaacaaaaacgcgaaattgtgcaaaaattcattgtaatgaaaaatgaatttaaacaaaacagaaaatattcgcaaaaagaatgggagaaaaattatgccgaaatttgtaagaaaattggagtaggccgtgaaacacttagaaaatggaagaaacaatttggaatgaataaatttataacgaagaaagaaaaaatggaaaaaatgaaaaaatattggcaaacaaaaaaagaaaatccgaaaatgagtgaaagggaaattgcaaaaacattacaaattgatagaaagagcatttcaagatggaagaaccaatttggagaagaaatttgaagtattaaaaacagaagaaaaatgggataaatttgccggaaaaactatcacaaaaacaaaggaaaaatatacatttaattcataataaataaattttaaatccctttttcaggtaccaccaccacgaattttgcaacctccacaaccggccgtggcccctccgagtaaatttaaaatatttttttgacatcttaaatttttgctttcaacaaaataaaagaattaatgctatgattttaagagaatccttatggaggtgttggattcgaaattttcaaaaatttcgtctatttttttcataattttgccacaaaattaaaaaaaaagttagaattggaccagggtttccgagtgttcgaattggataggatttaatcaataaggctttatgtaaatttagtcgtccaacctatttcggataattatgataaaaaattaaattcgattttttggaaacatttttataaattttccataaagtgcaactcgtcccggtggctatgtgtgcaatgccgtgccgtaaaaaggcgccgtgccgaatgccaatgcgcaacaacggcaacggcaacaacaatttttgtgacttctgttgtggcccgtgctgttgtccgccatgcgaagacgacatttgcctatgcagcagaagacgaagacgatgattatgacaacaaaaaaaaataggagaaattttgaaaaattgaaatttttacttaaaggaatttttttgcgttttttttttttgcaaaataaaattgccggagacaatttatagcatatttaatgtttaaacagaaaacagtgttgacgcaatttttagttataaaaaagcacgaatttggggtagaaaaaccgattttggataaaaaaaaattgttcgaattcgggttgggattagaaatgtaaagctttcgaatgatgccacgattgtcggatttttgtaaaaacaaaaaaaacaattcaacaactcgagctgtcgctaaaatgtcggcaacaaaacgactcccccgcacgactcgcttcaaat

SEQ ID NO: 12589 - DNA, 972 bp, Heterodera glycines
ttccttggatacatttggcctaactttgctcaactttgccaaaatttttgaaatttagatgagctagtagagaagtcttagggctatcgaatgatatcaataatatttaatttggttgacatttacaaaagttagagagaagagagtgagtgagtgagagagagagagagattgaagattcggaggggtagagggaatctgatattaaatgtacaatatgtacgttggccattgaactaatttatttttcactggcaaatattcaacgagtaaaacattgtttgttttgtccaaagtttcgcggttttgctttggaaatttgaaatgttattttttcaggaaatgtattttaaaatagcatttaacaaaaatgaattttatttaaaaaaataatgaaattattcattatgcaaatttatttatcttttctattttttcgtttatcttatctttcaaaagtgagccacctatcaaaaaatcagattaatttcattcccaggcggcctatcggtgttatgtcgttcttcaaaaaccataatgcttataaaaggtttttgatgagtaaggaggacccagcacccgcctatcggcacctccgcatttattacaccataaatatttttaatttaaaatttagtaatttttcaatcagaatttggcctcctatttttcgcaggtatcgcgtatttcttattttgttcgtccataataattaatttaccacaacccatcaatcgtataattcaataagagagaaaaaataaataaaatttccgggcatggcattcttccaaaagtctcaaatcaaaaattctgccaatctttcagctctaacagccacaaagacgcaggacacagtggatcgtggacttatctccgattttgtaatccttcaaagtacggccgtcctcaatctgctttcctgaaacaattttcatattagcaagagaaaaaataaacacataaattttt

SEQ ID NO: 12590 - DNA, 2715 bp, Heterodera glycines
aaaaaattagtcaaccagcgaaaagcagtctttgctgatcaggcggatggccttcaatgcgctcgattttggctttgatttcctcgatggtattgcttggaagggcatcacggagtgtgagtgttttgccggtcatcgtttttacaaagatttgcattctatgccaattctgtgcatggaagagggaaaatgtaataaaaataatcgttagggttgggaattatatttaagaaaaatcgcaaaatatacatatacatacataaaatatgtaaaaaattcttaaaaggattattttttggggaaaaaatcatagagaagagtgaaataggcacaaatgccataaaacgaccaaaaggcttaaaatcacattttaatacttgaataattatttttttgatatctcattttttaaaacgattttttaggggtacattttcaaaaaaaattgaatttttctcgagaaattcctataaattttcgttatgttaaaatgaaaatatgtatgaaaaatacgataagtccacaatatgtagaaaacagaaaatatttattaaataaaatcccaacttttgttcgcaaacacaaaaaagaaagcgtttttcctactaattatagcattgataatataagtatttaaatgaaatccatcccaaataaaattattataaaaatccacccaccatactgctggtcaaaattttttttacgaaactcacataatacgtataagagctaaaaacaaaagtcctattcgtgttcagcgcataaaattacagtaccttagaatatttaaaatttattcaggggctcacaaaaggaataagtacccattttctatcttttcgtccataaaaaatcaatttaccaaccaatcaatcgactcaaaaggaaaatggaatgaatcgaagaaaaacaggagagaagacatagtcaaatatcgggcatggcatttcttccaaatttctcaaatcaaaaattctgccaatctttcggcactaacagccgcaaaaacgcaggacgacaaggtgaaagatgtccccatctctgatgttgtaatacttcaaagtacggccgtcctcaagtagccttcctgaaacaattttcatataaaaagcgcaaaataaataatttatatttttaaaaagttgcgagcgaaaattttactgtattttttaaatttaatcgaagtttaaaaagcctgcatatgatccgattaaaaattataacagcaagaaatctttcgtcacttcacccggtggagttttggaaggacttttgtgggtggtggagcattccgacaacaattagctgagcctttggcacgcatccataacttggcactcgtcctcattcagtaataaataaacactgcttaaaacctatactgcccaccgaaaatcagtatttgctccccccgcggatggcctccaatgcgctcgattttggctttgatttcctcgatggtgttacttggaagaacatcacggagtgtgagtgttttgccggtcaatgtttttatacggatttgcattccatgccgattctgtacgggaaaatgcaatttaaaaataattactagggttgggaattatatctaagaaaaatagcaaaacaaattggcttagaatcacattttagtatttgaaaaattggataattcaaaaaaaaaatatgtatttaaatgaaatccatcccaaataataataatataaaatcccacccaccactgaaattgaactcccactaatatttttatcccctgctgttgctggggatgttgacaattttcttttttgcattttcttcggtccatttatttgcgcttccatttcatcaattctggccaaaagtctagcaaattgcccaatacaaactgaaaattgggtttatttttatgaaattaattttgtgctaattgccgggaacaaaatcccagaattaagcgtttatatttataaagtttaataaacgataaaaactagagttgagtgggactggaaacgggaattttgacaaaaaccgacaccgggaccagaaaagccgggaccaagtttttcgaccaggaccgtaaccgcgaaaaagcagagaccggaaccaaccggaaatttcccaatagaaaacttttgaagataccaaaaattttaattaaaatcctatataggtgtgggaggcaggggtccgtatcgttttggcgccgacgttttggcgccagcccaagttttcggactataacattttttgtcgaccaaatctaacgaacttggtatcattcgaaactttaacatgtttagaagctattgcttcgcgattagacaattaccaaaaaagttataacatgaaattgcaaaaaatcaaaattttagaagttttttctatataacttttttacaagctaatttttttgttttttctaaggctgagaatttctcgaaatatttttttcttagaattttcttattaaaaactttctaagaattttttcttgaaaaatttctaaattagcaaatttaaaaaaaaagcaccattatcggaaaaacctgtataatctgttaaagcaaataaaacctaagaatccgcaacgtaataatgtttttgccaatttatttaaagttttactgtattttctggccaattctttttccaattcagcacatttgtccaaacacttcttctgtccttcctctaacttgtggatttgtccaaccaatgcttaaa

SEQ ID NO: 12591 - DNA, 2630 bp, Heterodera glycines
  misc_feature (55)..(55): n is a, c, g, or t
ctccgccctcactcgtcctggacactttgttaccttaaattttgcgtcaaaaagngtttcatttgctcaaaccccttaaacgcccgttgacttcgcagcagaggctaaaattttgaatgatgcttaattttttgtgttcactgatcaaatatcacgaggcactgatcaatgatcacattaaggcatctgtaggacagaaaaagtaatccgcccccggtgttattcgaacccacggccctgaccgactgtcaaaatattcctgccttaaacactgtttgagagagtctccgtctccaagtcgagaatttctcatggattcttccattatttttgaatgtaataaatgctaattgtaagtatgcattccatttgatattttacagcacagagggaggctctggataaaatatctcacaaaatggttaattccaaaaaatatttcaaatttggcagaaacctacaatatacatagaattgtgccaaataagatagacaaaagttatttcaactaaaaaacacttgatcaaaacttattacaactaaaaattgaattattttcagtcttaggtcaaggcataattgttatgtctcattttatttttctttatttgcaaatttcagaaattaattttgtaaaaattctgtggaattttacgcttaataattagcaacataaattttaaaacttcaattaattctatagttaaattgttggaaaaatgaaattaatttacctttccgatggatgaaagtgccgtccccttgggatgtgcactcaattgcgggtttcgttcaaatgttttcttcgggaatcgctaaacgaacaacaaattattaattataaataaaattttaatttttgaaacgattacctgaatgagcagttccacaaatttccggagggcggcgaatcggtccccgttaatttcgtccccgcccgatgaaatcacttcgtccaaaagtgccgtatggatggccttcagcatgtccgtctcgctgacaaagaacatttgcttgcaccttaaataaaaattattaaatttatttattatttatttttgcggcagaattttttttaaataccaaaaatttaaaaacaaaagcaaagagaattcatattttaatttttaaatgaattatttatacaattaataaagaattaaacttatttttgagcctttaaaattacggaaataaggatttatatttattaaaattaattcaatttaaatatttttaatttaatccaacttttccggggattgcgcacagtccaccacctgcaccggttccttatggtgtgccttggcttgttccgtcttgttcaactccaccatcattggcttcaccaattcacgcaacttggccaatgtctgatcattgaggctaaaataattcaaaaaataagctatgaatacggtataaaaaactcgaaaaattgcgcaaaattaaaaatttttggcgcttttttcatagaatttttgaaattgttgtgattgaactcagcagagcatcttctaatctgatcacaattatcaggaaatttatttgcccattaaaacatctcttaaacaaaaaaattttgttgggaaatatatacaataaaaaaccgttagatttgttaatttttcctcggtggctttttcagcactgtattttttaacttaaacatgttatattttgtgccgattgtgcgcagattttaattattttggcttataatttcacctctccgccagaattggctccgttttgccgcgttccatcgccctcacataaggcaatttgaaggccgccgcttccgttgctttgcctttcgctggctttggcacattgcgtggcacttcgtcggcactgcccaccagcacttggcggacctccacgcttggcttgtacagcagcaaatccagggagaacggcagtccatccttggcgtccttctcgaagagttgggccaggaactgtgtgctgttcggcatgtccctccacggctccggttgactgttctcactggaaaaagcatttgattgaaaaaatctttcgtctgaataatcttttaagaaaataataattaaaaattagttaatatgaagcgaacagaaaaatttgtttagaaaatgggtagaggcataaaaagcaaaaaagacctgtttagattagtgttgctcccataacctccgggagagaaaagtcggggatcggagaggaaattcgccgaaaaatttttcggggttggctggagaattttaaaaatgtcgcgcagcaacttacatacacccttgtcgggcagtaaattttcatagaaagtcgaacaaaataacggcaatttttataaaacaaaaacaaaaaaacgcatttaaagaaccctcatcagttttgaacaaaataactttataaattttattaggcgaagaaataataaacatgaaaaagggaaacagaaaatctttcattataattaacattgttgattgacaaagaaagctaaaactgacttgttgtgttggcgttgtgcctccattttttgcaggtagaaatcggcattgcctttgcccgtttcggcattgaactcttccatgatcttcttgtgcacttgctcgcgcatttccatcgccgattcgtacgaatgt

SEQ ID NO: 12592 - DNA, 1263 bp, Heterodera glycines
  misc_feature (1209)..(1209): n is a, c, g, or t
gtaatatttgagattatacgtgcatatagtactgtagtaagggtacttttcggttatatggccatgcctctcaaaatttaaaaaagagaaaaaagtgccagtagcgcgcaacaattatttgcatggataaaagcgcaattataaacctactcttaagctgtgacgaagttgcaaaagtatcaatgatagaaatatttaataaattaatattttaattttatttgctaaataataaatcataacttagcttaaaaaagttagggattctcttgatttttaaaaataatataagatagaagggatatgtggtgctatcagttatattaaaatttttatttagcaaacaaaattaaaataataataaaatttaaatatttctgttattgatatttttgtaaacttcctctcaccacgatttaggcactcagattgggaaaaaacgaaaggcgtttcgtagcaagtactatattccactgtaccttcaatttcggcaccgtaggaatgtcgttggccttgcaaattttcacattgtatgcgtcggcgcagttaatggccgccacttggacaaatggccacgatttgatggattcggaaagcactttgaaatagggcgcaaagcggcgacagtaaccgcaccttaagaaccggacttggtttgaaaaatatcctttggcatattgtcacggggatcggggagcgcgagttggggcccaaccctagtataagaagcaataagataaaaaaattctctatattttagaaattggccaccaagataggccattttgaagaaatttgctattacgagtgcacctgtaagctcatgggttcctgccctttataacatttccacggaaaaaatcgtcaattttggcatatcccattttttttctggcagagcgcgtgcccttcctcttggtgtgatggttctgttactgctactgttctgttctgtctccacggtgcccctatgcccaaacacacgatgccggacggaccagtccttgtagaactcgacgatgtacgcccggtcccggttgggccgcagcacagtgtcctcaaacgtgtcggcgtccaagtgaacaattgggtcgtcgacactgtacagcaacgggttgttgcccttgggctgttggccaacctcggccagtgccgcttctgttgagttcggtaaggaacaacatagcaaaatggcacaaattgccatgncaatcctcaacccagaagggaggaggacgagggccatcttccggtggcagcgag

SEQ ID NO: 12593 - DNA, 1518 bp, Heterodera glycines
atacccaactcattcatacccaactcatccatagaccccaccggcgggtccccatctttttcatatacccgaggcatccactcctaaggcatatccatagacccaactcatccatagacccaactcatccatacccaactcatccatacccaactcatccatatacccaactcatccatacccaactcatccatatacccaactcatccatacccaactcatccatacccaactcatccatagacccaactcatccatacccaactcatccatatacccaactcatccatacccaactcatccatagacccaactcatccatacccaactcatccatacccaactcatccatacccaactcatccatagacccaactcatccatacccaactcatccatacccaactcatccatagacccaactcatccatacccaactcatccatagacccaactcatccatacccaactcatccatatacccaactcatccatacccaactcatccatacccaactcatccatatacccaactcatccatacccaactcatccatatacccaactcatccatacccaactcatccaaacccaactcatccatacccaactcatccatagccaactcatccatatacccaactcatccatagacccaactcatccatacccaactcatccatacccaactcatccatacccaactcatccatagacccaactcatccatacccaactcatccatagacccaactcatccatacccaactcatccatacccaactcatccatacccaactcatccatagacccaactcatccatacccaactcatccaaacccaactcattcatacccaactcatccatagcacgatacgagtcgtcgccgtggcatggcattttctgcttatgtggtcttgaccgtggacatttttgattatgtcggtcttggccgtggacatttttgattatgccggtcttggccgtggacatttttgattatgccggtcttgaccgtggacatttttgattatgccggtcttgaccgtggacatttttgattatgccggtcttgaccgtggacatttttgattatgccggtcttggccgtggacatttctgattatgcggtctcggtcgtggcattttttggttgtacggtcttagtcgtagtattttttggttgtacggtcttagtcgtggcattaaatgccacggcgacgactcgtatcgtgctatggatgagttgggcatggatgagttgggtatatggatgagttgggtatggatgagttgggcatggatgagttgggtatatggatgagttgggtatggatgagttgggtatatggatgagttgggtatggatgagttgggcatggatgagttgggtatatggatgagttgggtatggatgagttgggcatggatgagttaggtatatggatgagttgggtatggatgagttagggcatggatgatgtcgggatttttcgttgccaattccattgaaaat

SEQ ID NO: 12594 - DNA, 1198 bp, Heterodera glycines
gttgggtatggatgagttgtgtatatggctgacttgcgtctggatgagctcggtctatgcatgagttgtgtatggatgagctgtgtctatggatgagtcgtgtatggatgagttgggtatggatgagttgggtatggatgagttgggtctatggatgagttgcgtatatggatgagttgggtatggatgagttgggtctatggatgagttgggtatggatgagttgggtatggatgagttgggtatatggatgagttgggtatggatgagttgggtctatggatgagttgggtatggatgagttgggtatggatgagttgggtatggatgagttgggtatggatgagttgggtatatggatgagttgggtatggatgagttgggtctatggatgagttgggtatggatgagttgggtatatggatgagttgggtatggatgagttgggtctatggatgagttgggtctatggatgagttgggtatggatgagttgggtctatggatgagttgggtatatggatgagttgggtatggatgagttgggtctatggatgagttgggtatggatgagttgggtatggatgagttgggtctatggatgagttgggtatggatgagttgggtatatggatgagttgggtatggatgagttgggtctatggatgagttgggtatggatgagttgggtctatggatgagttgggtatggatgagttgggtctatggatgagttgggtatggatgagttgggtatatggatgagttgggtatggatgagttgggcatggatgagttgggtttaccccgtttttgaggcattcaactagtctgaataataaaataaaattatttttccttagtttgaaaatttttaaatgatttttttcgggaattatcttaagccttcctttcttctattactaattacccatttaattttttcatttttgatgttcttaactgacctgttgaaatttcaactcaatattttgaagaattttctgctgtcttttggcgagaaagtgatcaaaaatggaggaagaaactcggagaatggaccaacggaaatcgaaacgaaaagcattggccaattcggaaagaagctcagggggaagttgaattttgggaggaaagcgcatggcttaaaagcaattaaaaataattaattaattaaggtgcagttgaattttgggggg

SEQ ID NO: 12595 - DNA, 687 bp, Heterodera glycines
atgaatttcctacactttttagtagaacaatattttgtaaattttgatataaaaaatgaaaatgactaacggaaaaataaaataacgattaaaaaacgttcaatcagatggtattggcacgtttcatttggaatgactcccacaaattatatatctatgtagtttcacaaagcattttaataaataacaatgcacatatcttctatatttagaaatgggtttttagtgtcgtccgactgcccccgtccctttacccccccccccccccaatgagttgtgtttggtttttcgtttggttgcggttgcccccatatcgcccataaatacaataaaaatcgatgggcccaaccactgacgggcagcagcacataattataatttatggacgatggtcgcgccctttaccccctcccccccggcgttgcgtttaccaacttcctcccctcgggggtgatttagtcgccgcccatttggagaatcggtggatgaaagtgagcgaagcgactgatggacgacaaaggcggaaggacagaagagagagcagagattgcggattgactgatctgatcagaagcatatcaaacattagatcattagttgcttgcttgtcaatgcaacaatggaatgggctgttgtatcgcatacaaagaaaaaacacagacagactcatggaatttgagtctgtat

SEQ ID NO: 12596 - DNA, 2844 bp, Heterodera glycines
tcccatggaatttatttgtacatattcttccgtcaccgaaataaaatacaatttaagcttgaatagagagaggtgttataaaatgaacgtttcttaaatcttgatgatttggatcataaattataatttaaacagtggcgcgccagaaaatttattagttcttcatttgtgaaatgtatagttaaattttaaatgacaagcgcaggccctcgtgtactgcaagtacacaccgagtcaattttaggctcccagttcaaaaagcaaaaaaaaaaaaaagtgtgtttggcgaagtggttttataagatagtaaagggacaaagggctgaagttcgagtccgtttattattttcgaaaaatatttctgaaggtttttggaaaccaaattggaaaaacatgataaactcttttattttagcaaatcaaattacaagtgaccaaatgattgcgtcgaattcgggtggcgcgccgtaccgcggcgatccgatggcatccgctgcactcggtttttcaaagtgaaggaattgatttttttttttcttttaatgaatgtgtggtcagttttgtgaatggtgccctcatccgacaccctttcgttgtgctgcggcgccagtgccaagtgcatgaccacgcgacacgcaaacatttgacgcccattagtcttttgccggttgtggtcaacttggccgggaaagatgtaaatacttgcagaaagcatgcttttttcacatttcgtttaatagtaattttagtttttccttagggtactttttcgctttggaaaggtgccattggcagcggcgttctttgggtggtttcgcatgcgtcggaatttgtaagtataagcgaattaaatacaatatttcttttacttttattttagttgattgcccagctttttaacctaccaaaatcatttgtacccgaaggcagctccgaacgcttttggcgccatgtttttctcaaaacgtatttttgggacttaaaagataaaattcgggataaaagtgatcataaaattgttttgcttattcagcgcctctttcttcgcctgcactcctttcattgtctcttctttcatcgaaactgtccgcgtccgttttccctttttcttttctttccctttgcatttgccatttccttttcagagtggtgcaagtttatcggatgatttccaactcttcgagattatccatcgtggtcttgaggtcactcccctcccattttgtttcgtgccattataaaatctctttcagcgcctccatttggacattttcggcaccggcgttgaaggacgaaggcgtcacccgctgttccttttggccatgcccactgccatttaccacacggcccactttttgttgtaccgttccgtctattccttcgcctattcctgcaccagagcttatgttgtgagcaccgttcatttacttatgtttaattttcattttacaaattgcgcctttcaaagagtcgcaaattgccttctgaacgcaaaagataccattcgataatgcccgagctgttctccacaatgacctcaatgttcgtggccgatttggtctgttacccgcttgagactgtgcttcatcggttgtacattcaaggtgagagaccgagggcaataaaaaaaatggtcgggtaaaaggtaagtgctttaggcactcggacattggtagacaatttggaccatggacagagttcgctggtgcccgtgttggccggggcgtacagcggcgtagtggattgtttcattaaaattgtgcgcaaagagggcgccctggcgttgtacaggtcgccgtttggatttcatttggctaacgtcgcgccgtttaaaaatgcttctttagcggaatcggtgcgctctttctccaatatttgcttcagcatggcgttgcattggccgtttattgggttctcgacaaaggttttgttttgcgggtgtccttcttcctgactatgcaaaaaatgacttcagcaggtggcagcagcggcggtgacgtgccctcaatccctccggccttgcgttcgcaagaaaactttttgcgtgccgactgcgcctctttcgacgcattcccccaaaaaacatttgccagctcgtcctcctcgggaaccaaccaacaggacattaaggcaaataaaagagaatggcccatttcccgtatccgtcattttccaaacgaatggaagctttgaatttcagcacttctcgccaaacgtcgattttcagcctactcaatccggcgcttttccctcttttgcacagacaagccaaagccaccaaagccttcaggaaaaggacaacccatttttggccgcaatacggcgacatcagcagcaccaacataatcaggatgatgagcagaagcagcatgggacgaaacctctcaattccgattgaatttgttttttcaaatatgtatcttctcctcccaccgtgccaatgccatcagtcggttaattaattcccccacccttcactctttatttttgagaaattgttatccgtttttttctcacttcagtttatagacaattatatttgagaatcttaatccattttgttatgaaaataagaggaagaaaatgaatgttattgtaaatgtatgagcgacaaggaaaaatcagcgaatgtataataaatgcaaacaaataacaaaaataaaaaaaggcaacaaaaaatgtttgatagaaactttgggaaggacaaaatatgagagatttcgtgactattttgtgtcggattaacaaaagaaaatggggaagagcgaagaatgtgcataggaaaggacgtacataaaacggtaatactatagatggtaccccccttttgacgaaaattttttt

SEQ ID NO: 12597 - DNA, 1335 bp, Heterodera glycines
atcaacaggttaaaagaacatataaatgatgctttcgcctgcgccggacacctcccccccccttgctccccaaggtttttttagaaaatagttcgactcaaaaaaaacgtttttaaaaaagcaaaaaagggtcgtcagttctatgtcgagactcctgcgcacaaattccggttgacctaccctttttatgtttggattttaaggtttctggattgatgattcatcgttccattttatattaatattaaaatctagtcaatttacaatacaataacctttcaccgttaaaagtacaatcacatttgtttaattaaaacattgtgatgctcatttgcattccattttaagttcaatttttcatctccgtcgaattttgaggcattgacagttgattctgaattttaaaattaaattaattagcattttattcccaccattttcggtatcagctcctcatagtctgtgctgtaaacttgggaacggacaaacagttctttgtccgccggctcggggtaaagccgggccaatccatccttaattggataacaataattaattatctattattattcaaacaaatgtcactttgtaacactcctcagcaattgcgacagcaatttgaatggaaatttcacagattttattcattgaggggaacaaattgccagaagagagctcatcatcagtgacgaattcagccaattgctgaaaatgattaaaaagggacaaatattcaaaaaagaaaagaaagtgccaaccacagcagcgatcaaaaacaatttgtcgggaatgtgagcaatttggaacaaaattatgccgagagcgacgccagggaaaatgtacgaattgttgcattggccgggcgaaaaagtgcgcccgtcgtcgaatttcacaggggcgaagggactgccggaggcgaaaagagcggagcccttaagttaaatttaaaacgaaataaaccaaaattataattagggaacatatttataatggcgaaaatagcaaaagaaaaataaaattattgtaaatcccccaaaataacggacatttgtgcctttgtacgccgcctgagcagtgcactcggatttgctggttgggttggacagtgcgaaaatgatcggacgttcgttgaaggattccattcgtttgatgaccgcgtcagagaacgcaccatggattgtggagacaccgatgatggcggagggttggacagcctaaacaaggtcggatcgggaggaaccaagaatggcaatggaaaatgccaaagttccccaaaaatcccaattgaagtgtcaaaattcccccccccccaaaaaaaccattcacccaaaattg

SEQ ID NO: 12598 - DNA, 2318 bp, Heterodera glycines
  misc_feature (33)..(33): n is a, c, g, or t
aatggccgccttcaaaaagtgcggatttggcancgattcaaatgccttggcaattcgtcccttaccgtcccggcaccgtggaaaaggaacttcgactccgaaattttcctgcccgtaattcgcaccgccgccaaaagaccggccaccgaaacggaagcggtgccctgcaattaattggcacacttttggcactttggcaatgcttgccgagcacctgaatgtcgtcgttgaaggtgcagtatctgtcctggtaacgcttcagcaatcggtcggcattgttcttgccaaagtcctcaaattggaccaatattttgtggccgaacctcaaaaaagtcaaaatttgacacttttttgggggggggggggtttgggctgtgcaccacactttttgcaacatgccaccatgaaattgtcgatgaattggtcgtattgttcgccgcgcactcgccgctgtctcagtcccgcgtagttggcgtcgttcagcaacgtttcgttgtccgtgccgacgtccaactgaatgggcaggcaccacttgggctgaacgccgccgagcgccacgtaaagcgacaatttgccgacggagatttcaacaccttaaaaatgataaattaaaaagttaattttgtgggaactttttaacttattgatagaagaaaaaagacgtattaaattaatttaaaaaacaggtaataaaatggacaattggaaggtgcatgacaaaagacgcaccgacaaaggatcacagagacaaaagacccacagacaaataacacaaaattaaatataaaaaggataaaaacccaaagaaaaccgagggaaacactttaaatgaccaaaaacaacataagatactattggaatattattttcttttttatatttaatttgtttttgggtcctttgcccgtgggcattttgagcggcacaaaatgaaagaaaatgattaaaattcattaattaatggaaatttaactaaaaaatgtaaaaaaagaattcgtggatttcgtattcttctgctgattatgaacttaccccccaatcccaaataaattagaataatttgtcctttttttaccccccagaataattagtctatttttacccccaactcccaagtcgcccaatcccaaaattctctctccgtcagtgacgacaatcgcacgcacatcctaaagaccgaagacatttaaatccagattagtcattcatttgcttcgactcacttggcatttccaattgctgagcacgcgacagatttcactgacagaattatgccaattgatgttgaggaaaagggccctttaattgggattaattgggcaaatgagtcgcaaatgggggacaattaatttgggggactgctgcttactttgggtgtcggtactcaaaatgaatgcacgcatcgccaacagtgggctgaaatggaaacaaacaaacagttcacaaccagtattacggtatgatttctaccgtatacacaatgggcaacagttcgccaagaaactgcctcatcacgcggaagaaaagcttctcattccgctcctttccaaatcaatttgggcaattaattaattactttcgttaattaatttgctaatggtcggtcacccgaaggccttccaagtgaatgaattttgccatttcgttgttcagttcccgcaaatgtttgatctcctgctgcgcctgctgttcttggcttctgaatcgcacaaattgccactaattaattaattaatcgcccattaattaattgtttttgatttgggacaaacgactttttagctttttattacttcactccttgcggcataagtccgtccaatccgaacaattggcgttccgccatcgaatgagcaagtcccttcaaatttgatatttacaatttgttattttttcataattctaaaatttctggaaccaaaaaatatgaaggctttttactttgtatttgcatttttcttcgtaaaattaaagcaaaaaatagcatttccaagttttaaaccccaataactttcagagtttctcatctgatatcctttaaaagccactgactttgttcgtccgattgtccttcagctgcgaatgtccttttcccgcgtttggtccgcttggctccgttttgtacaattcccgcaacgaaatttgttgctgtttcggctcactacgctccattttactttcagcaatttttctctaaaaatttttgaaaaaaaacaataaattctagagatcggtattttgaaaaaagcctgttttgcctggacctggattttttgagcggatttgacctggacctggatttcctggacaaaaatcca

SEQ ID NO: 12599 - DNA, 2688 bp, Heterodera glycines
gtgttgttgctttctgtggcggtgggtactgcttggattgttggtcatcagtgcgctttgctgttcgacttcttccagttggttgggcagcttctccagctctgtggtgtgcttttgcggctcttcaaagctatgggcttgattaacttgttcatccagctcgttggcagcattgagaagcacggttgcgctcttccatcagacggcgaacaatttgcgcgttatttttcagtggctccattgtaccgtccgcgtcggtcttcagcttcactaagctctcttcgtcctggttgaagttgcagttcgcacgcgggcctgccgcgcttgggcagctcttggaccagccagctctgcaaccgcttcatgtcatccgtggcctcgtccgcttcgctctgcagggcatccacataggtccgctcgtcctctgttggcgtcagggccatcgtttttcctctcctctacgatcttttcacctgttgaatcgatgagcagcaataaatgcgaacttggtcgacaattgagtttttgactttttgttcgaatttgggttcggggttcgaaacgggtcgaaatggatgtcggattcgtgatcagcgaccccgaaaacctatattttgacttttttacttagaaattaaaaaaaaatttatgggggacaaactgaataagagccaacatttgtgccattcattcgcgaccaaattggtgattgttcgaatttgcgagtttggccagctgtcgctttgctgaactgttcctcccccccccccccccacaaaagggcctccccgccccatcactgactgataagcctttctcattcatttcataactcaaaaaagaaatggcaatcgatcgattgttgcgcttttcccttcttttccctccattctcgtcccaattccacgtattcattcattcatctgcccaaatgaatgaatgattgaatggatgggtcggccgattgttgacactgaggcaaaatggggggggggagaaaagggtgggggagggagcgttttgggagtttcgcccgaaaaggcaaacccaagcaaaaagtcatcatcctcttcctcctcctttctccattttctcataacctttgcgaaaatgaatgaatgatggccaattggccatttttattgcgatggtcgagagtcccgggcaatttcggcctaattatcatatttagggctcgacctctggaccttgttgatccaggcatgggttagtcgaggcctggattttttcagtgtatccggtctatgcttttttcggcaacctgggtttcttcctggattttggtctaggaaatccaggtccaactcatttttcaaaatgtcgaactcaaattatataattcgcccttttctgacccctccccaccttaaattctagcaaataatgtcacgcacaagcttaacagatttaaattacataaagagggaatttgggcagcttgcccctgaaaatttgtttaatttttatatttttgcattttcgataagcaaaaaaaaatagtcgcccgcaggggcaaaatgcgcacttttaaaaagcaaattttgccaaaaataaaccacctcttttgaagcaatagtcgctcatttgtcgccaaatcatgcgactgaatgtactgctcgcaatcctcgcccccctcctcctgctaattgcaacagcaacgctttgtggtgccaccggcaaagaagcggcggccaacaaaatcggtgtcgccgccgtcgctttgtcagaggcggacaattcgacgacgccggcgccaccgccgccgccttcgccgggtggcagcgatgacaagaaaaaggacgatgacgataagaagccggacgaggatccggcaaaaaagggcaacggaacggacacgggcgacgacggcaaaaaaacggacgaagcgggcggagcatttggcgcggggtccatttttggtgagtgattatttttggatgaattggccagaaatgtggggtcgcgaagcaagtcgaatttattcaactcgccccttttcctaagtgattgtgcggtttagggtcgctcgagactgaattttctcgacactaaaacgaagctttctcgactctatcccaatgagccaaaatttgttcagtgattagtaatatcaataaaaatcctctccaactatacatcaattggtgttaggctatgcggttaagggccgctcgagaccgaatgctcgacactaaaaacccgagactttctcgacccgatcccgagacgcccctctaccccaacgaaccaaaatttgattatatttgatcagtgattagtaataaagtcctctccaattacacctaatcaaatctgattaattgaattagcaatttaactttttagttgccattcttttcggcatggctttgatgttcggactgatcaaaatgtatgtccattgggagaagcggcgcgagtcggacccaccgaactatcagatgtattgaaaaaacatggaaagcattgggccaaaacaaacaaagatttccttatttcatttgttgttgttttttgcatcatttttatcacttctcattaaaatttctctaaacaatcacattttgggactttaagccagggttttgattttacaaactccggcatttgggcgggggggggggggtccatgccgaacttatgccgggtattttgagtgttttgtct

SEQ ID NO: 12600 - DNA, 2657 bp, Heterodera glycines
aggaaataaaatcacttgaaatttgtttacttttaaagcaatttatttaaatttattaagaatatatttcgtctgaaatgagcaaaaaatttttcttgttattaatattttccgttttttgtcggcaaagaatcgacgggagaaaaaatggacaaacaaatcaaaatgttcaaactttgatccgtcaatttgaaagtaaaataggctttaattagctagtcttattaatattaaaaggatatttaagaaattaatttattaaataataattgtttagcaaatgaattcagtcaaaatggacaagagaatgctgaaaagtttcttattattttatttttaattattattttaaaataattttttaaggaaaattttggaaatattaatctcctttcttaaaattcaatgcgaaatggccaactttggcacagaaaatgccaaacatttcacagcgatcaaagaacagacaaagcaaatttgtgccactgaaaaaacacaaaaatttgacattcaaaaattaacgaatgcaataacagccgcttttgaaaaagaaggggcaaaattggtggaggccatgaaaaaaggagagcatacggtaacagtgaccgtcgacggggcatacggtactttgaccgaacttttgccaaaatcaatggaattccggccttattggaccggaataaacatgctatgcttgatgaatgaacagatggataatgggccgggcaaaaaagtgatcgcaaaatttttaaacgcgactacagtaaccggtgacggaagtgccatcgccaacactgtaatgcctagcgatttgatgaaaattatgatagaactatggcacattctcttccataacgtcacgggaatgggcaaaatcggtgggccaaaatttttgaatcaatcatttggccaaggcgcaaagagtgatcggcaggaaattccgaaacgacggaactctgatcagatcatcgttcacgggcagcaggtaaattcgggacaatgcaattcagttaactatatgtgttcatctacggtattgttcagtttggtcgtgccatccccgcaatcagtggccatccgttgcgtcgccgtcggcgacggaatttgaatattacggcacgacaaatggccaacttgttccacgcgctgactgttgtagtcttggcgctgaatttgctgcgagtagtgctccgaaatatggccgatcagttggatcagccgccgattttcatgatggtcgccctggccgcaacaattcgctatttcatgacgatggactgaatgatcttattattgacatccacccttcagtttgatcggatttttctttctttgattgggatcggaatggttcgggtattgataaaaaagggaaattctcgatttagcaatttgccctggtcataaaagaattataagtgatcaaaattgggtcccgaggtttgattgaaaagtgctgggttggtggttagacaggcacaacaaatttgccattttcggtctcggctttctaaatatttctcgagtctaaatttcgcggcaagttccggtctcgagtttcaattgatggtatttgttgatttcgagcagtagcacataacattttcctctgttaaattgttttgtactagtcagtcgagaatttataataaatttttccactttcaaaaaagtttatagttaaattcaaaagaatttcaatgattgctttgagacgatggcaactaaatgaatttacattgccggaagtggcaaaaaagtgccaaaatcgaggcaaatataaatgacattgaaaggaaaataataacaatgaaatactattttcattttgctaattttccagttcttaatctccaaattctccataataattttctatttttcggattgtttttcaggggccttcctccccaactgttcaataataacgaaatgatggacaacccaccgccaccgtttcgaaaccgtaccccaccggtgagattcaacaatagcggcgcgtcattcgtgcaggaatacgatagtgccaatagagaaaagatgaaggacgaggagaagggaaagggaaagagtacggcacaaaaggcggaggagagaacggcacggccgaagaagcataatggacaagacgatgatgttaatgaggggaccatggccaaaatttggaaaatattcgcaccaaaacagcagttgaagaagcgagaagaaacagtgccaacccatgacaaagtcccaaaaaatgacaacagcagcaaaagtgttgttgacgacaacaatgtgccaatgccaattgattgtgccaactgcgccattcgcctcggaggaaattgaagacaatgttttgtaggtagaggagaagcaatttgaaattttggcacaaattgcaaattagcaaaaaatgatgcaaaacttgtgaatggaatagggaagggaccttacatcagcacacaaatgtttccttttgaatttgtaataccgtaaaagcgtaatcctttccttttcttggatactgtattagtctaaaattttgtcaataaatttttataaaattttaaaatataaaaataattttgattagatttgttaatttattttatactaattgcccttttcgttttcctcaatcgacatttggtcacttttctttgttgtaataa

SEQ ID NO: 12601 - DNA, 3447 bp, Heterodera glycines
  misc_feature (79)..(79): n is a, c, g, or t
  misc_feature (149)..(149): n is a, c, g, or t
gcattcagctcaatgatacatgaccgggtgaagagaggtgaagacgcacaatgacaaattgatggaaacacttcgacanccagagagaggaccgagagaaacggcgacggagttttcacgaggcatgcgaaagcacacgtcggatttgngggtagccattaagaaatgtggaaacacttcggtggctgtttggttaaatagggaaaataaatatttttgctgggacataacaaattcagagaatgcgactttttacttttaaatttttcagcgtctcgaacaaagccggcaagaagacgatgacttccagcaacagctgagttcggttcgtagtgtacgaaaagcctttcaaagtttcaaataaataaaaatgttcaggtgctcagccgagtagattctgtgaggagcaaaaaaacggaaccgaaagtgaaattggagggcgatcagctttcatcgaattgagtgatacgccttaaaaatgaatgcattccaatgccaaaatgtcacttttcttagcacacatcggtcgcttctctctgcgtattgtacctttttaatcgttttcgtggttctgattaaaaattcacagttttcgaaaatccttccggaacgggcaagtcaaaaagcactggcggatttttcggcaaatggtgccattttcgtccgtcctccgtcggatgtccatgggcacaaattgccgcgtttaaaaaaagcgtttcaccatttgtagtggaaaaaggctgttcatgcacatggccgaacacgtgcaccctgaaattgccgaattggctgccttcgatggccatggcatttcacttgggcttcactctcttctcaacacaattcagcaaatccgcatcgccccaccgtcgtccgttctcaaaaacgtccgaatggcctaagatttgcgattagataagcaaaatgtttgactatttgtggagacttttgtttttcccgtttgcttttctcaaatgccattcgatttgactaccgagtggaggggtgtgagtcatcagaacatcgaccaccggcctcggctgtaccgttgggattttcatccattctttgtggatgggaacgcctcgtggacgatagaacgaaaagccgggcaaagggtgccaagaagtgccgaaaatggtgagaccgaacacctgaaaaagaggccaaattgatactgatggtacaagcggaaggagcacctcagtggacgagtcgtgtagataaatgcaattggtgaggctgaaccttttggttttcgagttctcttccgctggcttttcctcctaccgctcgtagccccggggcgttccgcgtcgacccgagcccatcgcccacatcaaagcgtccgcccgacgcccttccacgtcctccccatcctcaaaacccaactcgtggttcccagcgatgacaattttgtacttgtgcggtagtgaaccaatgtcggagttgaactgttccaattcctcgccatctccaaaattggtgaaatcgccgcagtgcagcaaaacctaacaaaaaccaaccaaaaatggtagcaagagaagggataagaaccaaaaggggtaagtttaaatgctcacatcgccataaggaatcaacgacagaatttcacccaatttgttgtgtgtgtcacttatacagacgaaacgaaccttgttcgagtatatcggctcatctaacctaaaaaacgctgaattcgtctatcgtattcaaaattacggtagcgttttcgctggtcggcagaccctttccttcgaatacaattcctcccacaaaaaatgcgggtcgtccgcattcggttcagcttcaacgaaagacatcagaagaatggaatcgcatttatgagttcgatgaatgtatttctttaataaattaatccttataaatgcaaggctatttaaattccaaagataaaaagacgtaaaaacaataaaaaatgtaaacaaatcgttgtgaaaatcatttgaaaaacaaccgcttcgttgaaaacgccctcttcgaggcaggggccatttctttgcgcttaaacagaagcggcggcgttttcggagtgcgcaacggacttccgccctcgccctccgccggttgtccgtttccctttcgcattagtccgacgatgcagcggcggtaatccttcagatttcgcgtctcttcgctgtccgcttcttccccacgctcgtcttcctcgtcacttatccatgcgtttctgttctctttgcccaattggcttttcgaataattcccattttcggagtcttcgcttatccgtcttttccttctcagctgcccatttgattcggaagtgaaactgttctgagaagttttgctgcttttccgctgcgacgccttcttttgctggagaagttcaaggaaatcctcaaaggtccgagaagagagtccctcttgggaatattttgccattaattaatcgtccgtttgttctcaccttcggcttgtcggtgccttattaagtcgccaaatttccgcagcttttcctcctgctgcttgtccatccctttggtgttcatcaaaaactcgttcaaatattccaatgctgtccattcgtcgtcatctttggcacaagcgcgcgctttgaattggattagcattttgccaatctcggcattcccgacggaacatgcttccatcagcggagtgaggccactcgacgtctaatggaggcgaatgatcggcctattgtgtaaaaaaacaattcacaattttgttttgctcctcgtccatcaaaaactctttcgagcgcgtgttcggactcgcccctttcatcagcaaaagtcgcacattggccaaattctgagccgagaccgcctcactgagaggcgtccatccgccgtggtccatttggttaacgtcgtaacccttagacatgagctgtttaaccctccttcactataaaacaacccgctcgatcagttccttgagctgttggtattcgcccgaccgggcgacttcgtgcaaattggactcgccgtaagtgtttttgttggccctttccttcacaattttttcatttcgctccacgactttcatttcccctgcaaatgtccgctgaattcccatttctctcccttcccatttctcactggcaatttcgaataatatttgttgttcgtccatctcgtccaattcgtctctttccgtactttccatctcattttggccaccgctttctgctgaattgtcctcctcttccaatttcttctcccaaaatgccttctctttcagtttcgtttcatattcgccgccagcgcaatgagaaccattggcactcaaaaaggccaaataatcgcccaaaatgttcaactaaatgagtgaaatgagctattaatgaaaaaggctggaaatgccttttgggagggagttcgacactccccgtagacttttctgaacttatccaatcgttctcgaggcggaatatcttcaatt

SEQ ID NO: 12602 - DNA, 1791 bp, Heterodera glycines
aattttctccctttttccttcatttttttttttactttctttttaggcgccggagaagtaagcgctttgctaattgcgctgctatttcctttcaatggttgttgttgttggctcttttgtggcactgttgtgccaacaatcagtctcatttctttcggcgtttttggcggcaaaatgccattgctggttttggtggcatttttttgacgaatcgttgtgccgccattctcttcgttattattgcttgtggtgattgctgccgggctatcatcagttttagttgtgtgcttttgatcaatttgttgatcaaccgtcatagtgccatcaatgttttggccaactttttcggcattttcattttcgggcggaggcgttgaattttggtacggtgcaagtattttttgtatgttactgaatgaaactttccgtgtcaatatgcttgtcactgtagcgaagcataaataaaagaaaagagacagccaaattaatttcattttatttttttaaaaatatctgaaaatgcatttaaaaaattaaatttaattaaaacattgttaaagacagtaaaaattcagcccgtattgttttttcgaaaaaaatagtcctaatttttgtcaaagtcgaacaaattaagcatttttggtatcatttgatagcccttaaggttcttcaagaaaattttatcatgtttaataaaaaattaaggatgaaaaagttaataaaaaatatatatatatatatatatattccgttcataacttttttcaaacagggtcaaatttttttgaaatttttgaaataaagaaccttaaagctgtcgaattatacaaaaatgtttaatttggtcgattttgaccaaagttgtgacgcttttattgtcgaaatatagtacgaatcggggacagtatgacttgggtctcgtccattggagaatatttaaaattaaaaattataaaatgaatggtttttaatcactttttattcacgatcaattgatttaattatccaacatgcatataatcaacccaatttatattcctaataagcttttatttgcgctatctgccctgattttgtcagatttatcctcattcggagggtccaaaactgaaaaattccatgttttttttctctcaaaataagggtcaatgtctttaaatctaatattttttatcccaaaaaaggtgatacggcagcggtgccaatagggtcgggttaattggattattaggaaattaaatattatttttaaatcctatacaatattaaaataaagcaattaaataaatggtttattttacatgaaaaaaattcatttattaacgaatcaaaaatcattcaatcggcttatttaattgaataaaattacctttttttattttttaggaagttaattgacgtaatcatgtcaggcaattgcatgtaaccggcctaacatttgattaaaattggatatataataaaaaataaggataaataaatgtgtctgaatgactttttgtaaaatatttaatgaccgcataaaatccaattacttttgaaaaataatggctaacaaattagcccggtctcgggcacggtcattttgatcgggctaatacgggcttatgtttagccagtgaaactgccccacatttgaaaaaaaatattaattattttggcgaaatgtcttgagttcaatgttaaaaatagggctggtcgggaccgggactggggcggcaaatcccggttttttcaggtcccggtcccggtttttggaaaaattgaaatcccggtcccggcgggactaaa

SEQ ID NO: 12603 - DNA, 2716 bp, Heterodera glycines
ggccaacataggttaaaacctaaaaaatcccagccctttttattatacatattaatataaagctattaaataaattattttatatcgaaaaatgtatgaattatataaattatttaatcggcttatttaattgaatataaacataaaaatgcgttttacactgctttcacagcagtgccatcgtcaaaacaattttgaagagggaggcttttatacgtgtttattgactaattaactttaattacccttttttaaattttttaggaagttaattgacctaatcatgtaaggcaattgcatgtaaccggcctaacatttgattaaaattggatatataataaaaaataaaaaattaggataaataaatgtgtctgaatgactttttgtaaaatttttaatgatcgcataaaatccaattaattattaaaaaaacaaaattattttcatcactttttatggctaatttgtaagcggtctcgggccctgtaattttaaccgggctaaaacgggcataaatttcgccagtgaaaatgccccaattaaaatggtgtaaaactgcaaaatttttccgccggccccaaagggtcgggttaaaattggaatttttagggaattaaatattattttaaatacattattacattaatataaaataattaaataaattattttacctcgaaaaatgcatatataaattattcaatcggcttaatttaatgaatataaacataaaaatgctttttttctgctttcacagcagtgccatcgtcaaaacaattttaaataagcttatatacatgtttattgattaattaattttaaattaaaattatcattttttatttttttaggaaattaattgacgtaatcgtgccaggcatttgcatttaatcggcctaacatttaattaaaaatggataaattaaaaaaaattaaaaattagagacaaattttgtctgcgtcaatgacttcaatgacaaaacaacatttttttatgtaaacatacatatcagggatgtgccgagccagacaaaatccgattccgattaaatcgccgattccgattatggccaaaaatccgatacggttttaaaaccgattacgattatggcccaaaatccgattaattgcgattccgattacgattccgatttttttaaaataattttttcccaaaaattttattcataatcaaaatcataaaaataaaagtttgtccacattctgaggcaataaacgttttctcagatctgtcacaatcaacccagcggtggagaaaagccgttcgctttcagtcgatgtagctggggctgagaaatatttttttgatagcttagattcggaaacgaaatgtcttctgcatacagaagcccaacaactgttttgttttgcaaaaaacgatcaagcatttggaaggtggatgaccaacgcacctgataggaaaattgcaacttagtaataattcattcatggttcttttctgctttaatgtcccaacaaattttttcttcaaaatttcgacttttggttcgaattcgggtccgggattcaaaaataggtgaattggctgctatgttcttaaactgacaccattaacaacccttcaaagactttgacatttttgctaaataacaaaaaacttgattatatcggggagaattaatccggcactgctttgtgagaaaaatttaatttcagtcattatgttaaaataagattaaaacattcgtttcagaaaacatttttttcaaaattcattggtattctcgctaaaaaaattccttcaaaggtcaattcttaggggtgtaataatcggatttcaaggcaaaatccgattacgattatccgattccgattatggcccaaaatccgattaattgcgattccgattacgattacgattccgattcggcacatccctggtgctcagccttctccttttgataatcttcgaaaaggcatttgtgtgatgggcaatcagtggtgcgactcagcaggcaatgattgcgttgtgtgcgaattcgtgtacgatattcacaaaactgttcgtctactttagcaatcctggcaccaaaggtggtgttgctggcacacttatgggatttgaaacggaattttcaaaagtggaaaaaaaagctaaggcaagaatggcatttgataaggcaagttgaaacataaaataaataattaattaattattgatatgcgatcagatcgatgaagacaaggacaaatcaatctcaaagaaggaggctattctgtatctgacctcattgggaaacaaaaaccttacggatcagggcctttccaaagattcgtcgtggtttgatgcaatggacaaaaaccaaaaccaaaaaatcgagccggaagaatttgatcagatactctggcataaatgataaaagaaaaaagtaacgcatccagattatttattcataatggtctttaaatcgtattttctttagaaaaattccaatcaattattatacccaaatatttttagtgaattttataagtaaaccacgcacttttcattatatgagttaatttcgtattatgtccaactacataaatattttttaatttttttgatgatgaaatgctaatgcgtttattaattaaacgcaaaatgaattcatttagtgatgtttgctgattcattcatcaatctatctaaagttatttgatggaaaaacggagaataaattataacact

SEQ ID NO: 12604 - DNA, 781 bp, Heterodera glycines
agagagaaggaacagacatttcggcacagaaagtgcaactcacaggcatggcaattgattaaaggtgccaactcacatttctgctggacaaatacgggtcttcctgggaaaaaatgccgacactgagcataccttaagggaagcgatcagagagaaagggaaagccgagcgacgaaaatggcatggacgaaaagccactctgatcaccaccaatgaaaatattcaagtccaaccgaagtgatcagtgggtaaatagatgcccaaatcgctaaccccaagtggcgccgatcacgtggacggggatgacgcccaccgggtcgtcaatttcgagccgttcaatgagcgggtagacggacaatgcaagggcagaaccaatggagccgaccgcaatgctatccaacggacggatggaatgacacgctgaagcaaagaataaaggtaattagcactatgcactagtttatcagctattgctcagttggcaacctgctgttgtggccactagcgaggcgagcagtccgtcgatgagcaaatcgatttggcactttcgggtggcaattaacgaaattacaatggaagtgcaaccgccgcccagcgaactgagcaaagtgaccatagctgatctgaagggagaaggaataagcatttcggactgaaaagccaatgatggatttgtaattaaaattattatttttcagtagagtgccacgggaccgggaatttttgccaaaaccgggaccgggacttgccgggacctgagcttttcaaaacccgggaccgg

SEQ ID NO: 12605 - DNA, 1611 bp, Heterodera glycines
ggaaaaaaggaaaaaaagagagaaaacgcactggccatctctgtcggggtcatagaagaaatagccaatgcctggagaaaaatccaaaattaatgaaaataatttaaatgctatttaaacgactgaccaatgaatgggttgggatacaaagggccgaaggtaaagcctaagggggagagattaattactggggaaaatgggctaattgagcaccaaagccgaacatccaataggaaagtccgccgaacacaacgtcaacaatgtttttgacctgcaaagaaatggaaattaattaattatttaaaaaatgaatattttaatttcttttaatttggccaattaatcactcattttgatcaatgggattaaaaatgatcaaaatcactgatcagtttgtcccccgtccttttggccatggaaatgcttctccgtctctccccaaaaagcttgccatgatgttgacttcgtcctttgacgacactcggccactctccaacagtccgaaccctgaaaatcagggaaaagtctgaaattccgtcgcaaatcactcagacccgaaaccatcgtccaaatggagaaagagcaggagatgagccaaatgccgtcgtcctggaaccacgtgttcctttcctcggagtacggcaaatagagcccggggggatttgagtaactgaaagtccaattcgaacaaactcttgaatattatggcacctcggctccatcttggcactcttttaaagttggcaaatgacccgtaagaatggcgaaatgaaacggcacaaaagtcgacggacggcaccaaccgatggacgacgaacggtgggaggaaaaaagtcagcagaaaaagggccaatggaggagagaaaaacaaaaacggagaagaagaaacatagcaaaaagaaaaaataaataataaattaaaactttaatggcttaacaaaggcaattagtgaaaagggaaaagccgagtaaaaaacaaataaaaatgggatgaccttttcatttttcaattttaaattatgagaatgcctttgcctgatcaaattgttttgcctccgttgtttggtttatcggtcaattaccgactgaaaagtgccgagaaatccttccggcatttccccaaaggccaaaaaaatgtcaataaaatatgccatgccgaaaagtgcacaaatttggttcgatgaatttcaaatttgcatattttttggtgctattttcccttcacttggcaacaaaaatttcattcggcagcttttcctttcgattgaatttgtgcctccgtcggccgacggatgggaaaagccgcgttaattcctcggaatcggcgccctttcctccaaattctttcttcaattttttgtgtgtctttctgatttatttgttcgctaatgtttccaaatcgcgcagagtgattaattaatgattcgttaatgacgccacggatttggccataaaaaacatttgcacaaatcaaacatttgtaaattttggccctcgagactctcgaagatgaaagcgacaaattaaaatgaattaatgggttaaattcgatcatttaacattccagaccaaaggactccaagaaatgatagtagcagaaggcgattatgt

SEQ ID NO: 12606 - DNA, 1764 bp, Heterodera glycines
ggggggaggggttgggtttggggtttcggcatggacagacaccgcgagtccgcccggattcgtccgtgtgtcgttctgctacctctgcacgaccattgctcccctgaggcgaaatgcccgtggcccgtgccaatggccattgtccgccccccttcctccgcagaaggcgaaatgtccttgcccgtacgtgccaatgtccccccccccactctccaccgcccggcaaatgcgcgcgaatttctcacccccccccccgaggcattcatttgccaacggcggtgctccgctgttggcccgatttgaacactagcgaaatgaaaacgcagaaccaagaaacccaatttgtggtggtgccgtgctgacaaaattagcggggaaagaaaagaaaggaaaaaagaaagaatcggttgccatcccctggggggagaacgaatgggacacctgcaaatgatgaaagaaaaaattaactaaagtgagagagagagaaaagggaaatcaggcaattccttcaagcaaaaccaatttaaagagagagtgccaacggcgcagaatcattttgctaccacaaaaagcaaaaccaaagtgccattcgccttccggaccctttaacatcatttgactaataacaacaatcattcagccccgagaatcgaagttaaaaaggcgctaatttattgtaaagttgcaaggcattcagcaaaaatccgattgtttactttttgcaattatcatgaaaaacaacattaaatagacggaggaataagttaataaaagtaaaggcaagattaaacaacaaatgaaagctgaaaggaaagggagtcgagaaaaacaatcaaagtcaaaggcgaaagaacgaacgaatgaaatgcacgcactttttgcccttttttggttaattttaactaaaataaaaggaaaattaaaaagccaaggcaaaaagtgctgcttctccctgattcaatggtataataaaataataaattggcattttgagtgttttcgtgcacaaaaaggtgagaattaagtgccattcgtgtcaagtcaattccagtccgagttggcaaatgaggcatcgtcgcgcatttcgtcctgatcctcgtccaactcctgcaaaatttaaattgagtaaaaaaatataatcagcaaggacgatttgagaaaatcatatgagcttttctaaaaattgcaacaaatcaaaaaattcgaatgagttccccctcaggaaattctatggagcagtgagtttactccttcgtcccccccgaccgttgctgctccgtctgtccttctccccgtcgttgtccctttgtgttgcgtcgtccttttgctgccaattgtttccttttcgatggtcaacatttcatcggtttttttttgccatttgtgttgggtttccaccaattcgtgcaaccatttgggcacattctgtttgacttggacgagttgctgaacaaatccaaagaaaatgggattgtattaaagcatttttccctatcctcccaaaaaacgtacgtctcgcaaaaattcggccatatacatgtcatttgggtcttccgggttgaagaacacaaacgcctcgccaacatttcccgagcgcccgactcgtccgacgcggtgcacaaactgttcataacgatgcaggggcggcatttcgtacaaaatctgatgatttgaaaagaaatgagataggaaagacacacttaagaagcaaaaaactgaccactcgcgagaggttggggatgttcatgccacgggcgatcacat

SEQ ID NO: 12607 - DNA, 996 bp, Heterodera glycines
cttgcggacggcgtccattgtcgtctggtaagaagtagcattcatgtcacaaaatttcattttcgttaagaaatttttaataaaagatcgggagtttctttttttattttcttttttcaaattataaaaaatgttttgccaattcaaaatgattgattttaagaggaaattccgtttttcggcatttttgtggtcggtattccaaattcaaaaaatgtttagccttcgatattttgattttgaaaatttttgggacctcagaatgtcattccttttgaaaaaatttgccgaattcagtattttatttattttataacacttaaactccttggcgcgaactggatctgttgttcgccgaaacggagaaggaggagccggaggaggctgacgacaacattttgcaacaatttccgcccaaatcagtcgagtgtaagaacgaaaatttttgatataataattcaaaaatttttgcttaatatttaggaaataatttataattgaattctgaagggatttttttgacttatattcataaaattatttatttaaaaaataattgaataatataaagttaaataatcattttgtcagtttgcaagcaattttaggctggtttgaagcatcgtacaaacgtccttcttggaccgtaatcgaggaggctgcggacgcagaaattcaggctaacggagtgcaattgtcatttgaaaaatcttttacacatcctataaaattctaaaattttttattgtttgtaatcttttaggtcccacaaaaaatactgtatacgtttagtgaatttgtgcgcatttttttggtttttgaaaataaaaattctaataaatcctaatacatgtgagttaattaaaactttcgaaaatataagcaatgaataaacctcaaaattaatcaaatttatttaatattaatcgatgtttgttctattatggttaattaaggaattgctggagccgagcaaaggcttttacgacaaaagcg

SEQ ID NO: 12608 - DNA, 793 bp, Heterodera glycines
ttctttctctgtaacatcgatggccaaagtctcttggcatcttttttgtggtaaaggcctttgttgggctccagcaaatcctttgattaaccataattgaatttgcgtcatattatgagttttgaaccggtgcaaaaaatggtttaaactgattttctcaatgagagacttattttccgtgcttagttgttagcatctagatacgaattcctctcccctcccaaatcgaatgcgatcgttcgcgttgtttgaccgtgtatgagtattcgatgttccggtgagcgagtttgtctgtaggagtttaaaaatatttaattcaatacaaaagagtgaaaatttaaccaatttcactataaatcataataacaaatttaagaaatgattttcaattaaggggtttgaactaaggcaaaaacttttggatttttctttaagcagatttttcaacattcaccattaaaaatagaacaaacatcgattaatattaaataaatttgattaatttttaggtttattcattgcttatattttcgaaagttttaattaactcacatgtattaggatttattagaatttttattttcaaaaaccaaaaaaatgcgcacaaattcactaaacgtatacagtattttttgtgggacctaaaagattacaaacaataaaaattttagaattttataggatgtgtaaaagatttttcaattgcgctagaaaaccgccgcacactcgactacggcggccagtaggtgtggcgagactacgggctacggaagaagtccgcgcgtgatccgca

SEQ ID NO: 12609 - DNA, 1513 bp, Heterodera glycines
gaaaccaaccgtgaattttcccaagagaaaatttttttgaaaaaaatttgaaaatttgagtgcactttgttacgaaaatttcttaaattcaaaaatgtacccataaaattttaattttcttttaggggaagaactcgaagaatttttctattcgtcactttttgagtttcgttttcctgttttcgttttcgtccgtcaaaaagaattttcgtttcgttttcgttttcgtcagacggaatttggacgaaaaagacgaaaaaatttacacccttaagagtgacgtttttggggaaaaacaagccatctcgtgtagtgtgtgtggtttagtgctaccgattatcatatttttctttacaaaattcattgaaaattccaaaattcgtactatagtctaccacccacaaaaaatgaataaaattgatgccattcgttctctcatggtctgtaatgctcaggaaaaatactcctgaggtgcggaaatggcaaaaaaaatggtttttgaaccggttcaaaattcgaaaaattgagtgaaaattggggcttctgacccttaaaaacggtcaaattcggacaattttggtatcattcgaaaactcttgaggagctaacaataagtctaaaaatcaaagaataaatttgaaccgatgccatctaagcactgagataactgagtctcagtgaaaatcgacacttcagtaccagaaaaaaatcgaattaaaagtttaaattttcacaaaagggagcacgcattttgttgcaaaagcatttaatgccattttgacgaaaaattttcatggcccaacggagtgcctaaatttgaattggacaccggaaaattggacaccgtcggaattttggacaccaaaggaaaattggacactgtcggaattttggacactggaaaactggacactaaattcctcttttaaaatataaacccaggaatttaaatactcaatatgcacaatgattgatcaaatgtggcaaaaaagtgtacaaaattagacgatgattgatcaagatgccaaaaaatgtacaaaattgcgtgatgattgttcaatgtaccaaaaaatgcgcaaaaatgggaactccataaaaataaaaacttttttcgttatgaatgtatggtgagttctgcagctgatgctacaaataataataacattatttatttcaattaaaatttttgtttttattcttaacttattttttttttatccaatactgtccaattttccggtgtctaatttgccattggtgtccaattttccggtgtccagtttaccgggagccaatttgattccataaaatcgaattaatttcggaatttcaaatgtcaccgcttttaaattggtttggtttcggaatttcaaatgccaccgcttttaaattgaattggtttcgacatttcaatcaaatgcacctctctcgcttcttaggcctctccgctgggttggctcgtcaggccacgtacagcaccactcggctgggcatttacacgtggttgctcgag

SEQ ID NO: 12610 - DNA, 969 bp, Heterodera glycines
ctacagaaaattctttttttcagttttttgttagtttgtattcctaatcattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatgtcgcggcgcaaatgcagcggcgcaagtgtcgactttgctgagcggcgcaagtgtccacttttgctgtgcggcgcaaatggcgcggcgcaaatgtctcatcacggcttaacaacagccgaaaaaaaacatgtttttcgtgcatttcaggaaactgggagctcaggaaaaaatagtgaaaaaactataaatcgtatccctattgattataattttataaatttaaaaaaaatttttggaaattcaatgtttaaatagagaataattcaatcataagaatattaagttttaattttgtgattattttatttgccttggcggaaaagaacgaaatgactcatcatagaggcaaaataagaatataattcataataaccttgtgggtttttttaaatacccagaaaagacaggatgcttagtctgaacggtgctatgtcgttatataaaaaaccatcaaatggaaattttcaacaaaaaactgaccataacttttgtcaaattcaaccaaattagacatccttggtattattcgatagccctaacatttctctattcatgtaaattagaaaaaatttttgaaaatttgcagctaatagaggacacgtagggctatcgaataataacaagaaaataaaaaatctaagaaatttataacagacatttttcattagaaataaaaaaatttgatcatcaaaaattc

SEQ ID NO: 12611 - DNA, 1913 bp, Heterodera glycines
  misc_feature (9)..(10): n is a, c, g, or t
aattgtatnnagtttggtggggagatttgtgcccaaaaaaattaaatgtggaacatttatttaaatttaaatattctttattttaattaaattggataattttaagtaactttattatcacttggtggaatttatgaaacaaccttgcaccttttgcttttgtctcatctaccaaaaaaaattttccattttttgtgatattatggagagttcgaattcgatgtctctgttgtcagtactgtacgtcctgcacaaaaaaaatttacattattttaatgtcagatcagtgatcacaatgaaagctggaattggtcgctctcctatgcaaaatcccacgaaaatcaaattgttaagggagtttcaatggtacggcctgagaccgattaggagaataataaattttcatgccaattaaagaaaaaatttcaaaaatttgacaaaggaatgcctgaataaaatgggtttttgttagtggattccttacgcatgggaaaagttttggtcgagcggtgaaaaagggtgtgtctcacgagcttgagcttttaatttcacttaaatttattgagccattatttaataaaatccacataacccaaaattaagaatataaaataatgatcaacgaaatgcatgccaaatttgatgcaaattgttgccattacgtgtcaatggcctaaaacaaccctcgccgatttgaactcctcagaaattcagtgaggagaaataaaagaagaacaatttattttctggataaacaattttttagttgttggaatttttttaaaatttttttaaaattttaatttttagttttctatccgacagcataaatgttcgttggtaacccaatggttgcttgagaagaagcttggttttttattagttagccattcaattacaccattaaataactgatccttgttactcaattcaatcttttattaaacacttaaaaataaaattacgaattatttgtcaggaaaataaatatttattttatttgttgattgtcacattattaggccattaattctatctttgtcattttcatattttcataatttttttttttggcagtttcggcatattttgcattttgcggacgggatcccacagaggttgctttttacagcacttcttttgcggcgttctttttcaaaaatttagtgccgataaacgccattttgaatttttgtcgattttacaccatattcagattttgacaaaagctcagttttgtcaagagatgacaaaattcgcttttttgaattatgtagtttttaattagctaataggtggagacggatctggcggactgatgggcaccgccggaacaattttcacacctttaactttgattcaatatattgtaatttatgcaaaaatatttgacattctttactttgaaatttcaaaatgcattgcggacccatagggaggcattgcttttctatagcgtttagacttttcttaatcaaaatatttacgtcacaatttactattttggaatatttatgactaagaaaaacatccgtgccctttggctttcttcggtgttcttctgatcaatccccacattgttttttttttgttctcactttcctaatcgatcaatatgtgtaatccggttatccggtccgttgccatccacatttctgcaccggaccaagccttgtgaaggtgtgcccgtccccggcaatgcatagtgtcaaaaaatgcatgcatttaatgtgccgttttcggttgcaatttgctgagccatggagtacaacgaagggcgcagccaaaataaatgaaaaaatgccaaaaaatttttctttaattttcaatcccggttttgaccgggaccgggaccagtcccgggttttttcccgcttttcccagccaaaaattcccggtttttcaatccgaaa

SEQ ID NO: 12612 - DNA, 4171 bp, Heterodera glycines
tttttaaaatacttttccttcctaaaggtcttctccctgtaaacgtttgggcattcgctacaaccatttgttgtaattgccttccactttggcacagtgcacacttttggacgaatttgtcgtggaaagtaacaaattgcatgcattgccggtaaggaaaacgaggcggatgaaaaatagaagaattttttattaaatgatttaggaaggaattttgaatgctttgccgaatctaaagtcgatcaatttgagtcggaatcagctcagtgccatcccccagggcggttatgaacagaccgtggtaaagtttttaaggggaaataggggaatattgacgggttatgccgatgatgcaccacaccatgaatgaactttgattgggtcattcgtcacttcagtcagtcaacgtcgagcacaatgccatctccaaagtgccgtttggcatttttgccaaggccaataatctgtccaaattgaacttcaaagagaatgaattgaccgccttcccattgggtcggtttggttgaccaacggattttatatcattcaatagtatttctttccatccttcagatttcggcacttgggtgaccatcactgagctgaacgtgtccaacaacgaaatccacgaacttccgctcggtcagttttccaccttttctctctttggctttatcttttatccctttccactcattaagacattgacaaattggtcaacctcgaggtgttagttctgtccacaaaccgactcaaaaaattgccaacacaaattggaagtctgaggagattacgcgaattaggtggaggacggaaaagaatttagggatgacattttaatttcagatttggaggaaaacgaattggaagtcatcccttcagaaattgggtttctcacagcgcttacaaaactttggattcaggtaaaaccgttcgttcccttttacttacttatcaattcatcctcgtctttttttatctttggcacttttgcattttttccatccttttttctttgtttcagtccaatcagctcacttcgctgccccgcaccattggcaatttgtccaatttggttgacttcagaataggcgaaaatctgctcactttcattcccgaagaaattggtgagaagcgaataaaagtcaaatttaataatgtattatttcgaatatttcgcatttaatcgaatccaatttgtttctaaggacacttggagaatttgaagagcctttacttgaatgacatccaaacttgcacaggttcttcattcgcctgtttctgctttcgttggaatgcgttcatcttcccccccccccttcagtttgcccttcgaactcgtcctctgctcatccctcgaaataatgtccattgagaggtgtcccctgtcacaaatcccctcaggtgtgtttatctcttaatagtttgttttccaattttctttctccagatataatcgaaggcgggcccagtctagtgatccaatatctgaaaatgcatgggccctatcggggagttctcaacatgtgatcgttctgctcgcatttttctgattactcaatgacaaaagatgccaatgcctctggactgctgccaattgaagattcatcatttgttgctgtaacataatgtaaagcacaaatcacctcttttgttctttttctcaatacttcagcgaatattttattgttatcttttaatctttcctatcctattttccgtttcattttgccgttcgttactatcaaaatttatattatgtaagcccgtcatcatgtcagtcattttttgacaggcattattttgtttgccataatattatttacgaatatatacttattaaaatcaacgaattatttatatgcatcatttttatggtgttttgacacattttgcgggtattaatcgaatgctcgtaataattataaatctctgtatgtacagaataaaataacagtttcttcgtatatgcacggggagttatgaaaagactgatttataaaaagcattcattaacttcctattctttctaatagcatttttataaatctgtccttcagtgttaaggggaaaaatgcgctagttgggagcgggatttagacagacctcgttcgcgaaatgtttgaatatgttgttcctggggaggggttcgacaaatggatggaagataatatatatatatatataagaaaataataaaaataaagagtgagtgaccggagaatggggaaggggcagaggtgaatgtgaaacgtgcacctgtatacagcttccaagagtttgacaaggtgggccaaagatgaaggaaatatacaatgtaaaatgattgaagcaaagggatgaggagggtcaaatgtacaactggaagggataaggaaaataactgtacaatttgggggagtgtggcgggaacgagcggttctgccctgaatgtatgctgtagatatatcattttgatggatgggcgggcacggatacaactcatcggttacacgatttataacagttcaatattttgtacaacattcttctttcacgggttggtgtcgttgccaggtgaaaagcccgactggtcccattggattatgggcgacagctgattgttaagtgaggagccaatcagcggatcctgcccttgaagtggccctctgttctgaacggaattagcggtcattaaatttccgtggttgtgtttgaatgacctggaagggaaactcctccatgctcagctctgcgtaattcaccgcgttgaacatttggcctaactgggtctgtgccgagggccagttcaggcacccgcctggaactggcatcaaaaaagcattgcctccaattgtggtcgcttctacacggcactcactaccactaccgccgcaaaactgttcctcaccatattccatcgattgttgttgctgctgttgcaaaaggtccatgttgttgccgccgccgttgttgccttcgttggtgttatttgcgttggagtgttggctgagataattggccacctcattggacgcatttccgatcataaagccatgatgatgattgtgggttggcccggaatgcgtcattttaagcagtgtcacgtgttgttgctggttggccgttccaatggggctggcaatttgcatgtcttgcagactcgttgcaattttggttgcctgaggcgtgctagaaggcgaaaaagacaccgattgctgagcacagttactgttgacgctgtcctctggaggctctttttttatcgacttgttactgccgttcactgaaagtggcgataaagagcccaaaacgggtagattggacggaggcacgttgatgccattcttctccaattggtgttccaattccttaaagatacaatcccgtggaagaagagagcattccagacccgaacctgaacccgctgaaaatactgtcgtgtcaggtcctccaaccttgcggtttgctgctgttgcctgtagagaaaacaaaagaaataaacaacctaatccacttattcaaccaacccatgctgactgattgacctgatcatgatctctctgtctttttgcagctgacgaatgtagtcacaggacgccttcagaatagtgcctttgttcagtttcatctccctgtgttcggtttcgttatttatttaatttgtacggcctatttcttactcggaagtcgactttgggagcatcagtcccaactccttgatccggtcgttgatgttgtacctcctccgcctttcgactgaatttgcttttcgttatgccctcccctctttcagctctcccttaaactaactcatgttgtgaatgtctttcttgcgcctgtctttgtaaatttccgcctccgttaagccgtgctgaccatttcctcctccatttgtcagttgtgcattttgcgaatttacgacatttccccgacggatgaaattcctaaatcattactgaaatctaaccctaacacattataatttccattctcattgtcaaaagttcacacccccacccatttttggttccaactgtcctttctccacatactcaatgtcacacgaagttggtgcactgctggaaatgatctgacggaagtctgactcattttttggactgtacagtccaaagccagtagccccagttggaagccgggtgagccgcttggagaccgcaggcagcaagct

SEQ ID NO: 12613 - DNA, 1936 bp, Heterodera glycines
caaaattcgttaaaaattctgaaaatatttcctcgcccgtgcttatcggcaccgcccgccccagaaactcataattatttttaaatattagctccaaatcttagtcattttcagacaaaatcttttagcaaattgcataaaattttcaaaatttttcccggcggcgcctttcggcgctgcctgacccccccccccatgttccccagttttttgggtaaagcatgtcgcgaaaaaagctgttttaaaaaatcaaaaaaaagatcgtcaatttacatagctgggacccttcacaaatcattcccaaaatgaaccctaaaaattcaaaaagaatcaatttttacgtcacaaattataatttatttgcctttcggcaccgccaaaccaggagaatcttttaattttgttttaaaaaggcttctaaaagggtgagattactgaaaattaatgaaaaaattttcgaccacagctctgaatcttccatttttgcccctatttttctatcttcctccggccgctcatattttgtgattttttcacctaaaaaaatcatgcaaagcttttattctgatcataagttactcttaaccaattttagattggattttttttaataaaaatttttacaattaaaatttgtttttgaaaattacggattacgtcaaattacggcctttttggacctccgtaatgacggattacggatggccgtaactgaaaatcagttacgtccagccctgctataaatgtgttagaaattaatgaaaataaattttaaggggtttttgaggtcgctgatcacgaacacagcacccatttttgccaatttcgaacccctgacccgaactcgaacaaaacttatttttattaatttctaaaacacatttataggcatctgaaaatgtatgttaaaagtaccccctaaactagataagtacccatttattggatgcttataagtacatggggcacgtattctgcattagaatcgtttttactctttttccaaaagatggattgctcggcttggcactgaccgttggctttggcggtgctgcggtcgttggcgttctcggggcggcgctgttggctcggaaaaaatgagtggtgaaaaatgtgatgcccctaatttttaacttatactgatgagttgactgtatttatccgcatcgattgggtatctttgacactgataaaaatcgcttttccgttacactcattacccttacaaaaaattatttttaatttcgcgctcactaaatattcaccacttttgagcaaacttttgtattgagcgatcactgtgaactgttagtaatttgttttgtgtacaaagtgactttcgtcaagtgtcctgtcattctttgctcatttatttgaattttggccaatttatgtgcggggaatccgaataaattcaaatgattttatgtttaattccctcccaaaagtgggcaatttcggtcaattcttttgctttggtgctgctgcactctgctgattttcttttttgaattgataatttgtcatgcctttttgaatgttaaattatcacattctctcccctcccccccattttttgcttttatttatccgccgtcctatgacactttccgtcatttgcttcgcttttcctctctttttccaattccgccgactgataaaattcacttttttattcctccgtaccttttattttatggtcactaatggaccttttggcctttaagcattagtccgttttggccatttaaatacgtcactttttctgtcggcgttggccctcttggaatggacagttttaatgaatgtgcgcttagattagcctttggtcgccgcatcaatcgccgcccccgccgccgcggccctcccaattttttttttgctcgttttcgtccgccgttgccccaatcgttcgcattttcctctgacttttgca

SEQ ID NO: 12614 - DNA, 2249 bp, Heterodera glycines
  misc_feature (285)..(285): n is a, c, g, or t
ttttttttttgctcgttttcgtccgccgttgcccccatcggtcgcattttcctctgagttttgcattttcctgtcccaattcgttcaattgttcccattttgtccttccgaaaaggcaacaagtgttaattcgcctctcattttaataagttttgactttctatagtgcctttttcattggttgtttaatttcctccgatcaaaagactttttcgccctctctttgtccccaatcagacagtcagagagagagagagaaaaaacttttccccccccccccccccncctctttcttttgagtttgtctatctctctctctttctctctctctctctcttttgagtttgtctatctctctctctttctctctctcccccttccccctctcctcctccatctttccgtccccatctctacgtttattcatttagcttaatccctacctccctttgtccccatggatccgttgccaaatgacgagacaatgcacaaccgtccaacttctgtggttcttcctcctccgatatgtgaagatattgaagtgaacggatcaggcgcaatcgtacaacagcgaacacgggcttttcgcctcgtgcaaataatggccaattttggcattttgtttttcgttggtcagtgtcaaattgaatagatattgttgacgaatatgctaataactccgattaatggtaaaggtttcgttgccgaacaattcttcaaatgggtcggtccttaccagcgcggcttcttttgtgacgacgactccatcagattgccttacaaaagcagcaccgttcccgattggctgcttctggtctatgctttgtgtgtgccaccattcgttgtcagtgctattcaaatgggcgtgggggcaattgttgggaaggcgcgggacggatggttatcccttgaaaaagttgggatggaacccccggggatcttttggctgattgcccccccccctttcttggcaaaaccatctttttcatcggctaacatttgccgatctttcagttcgcttttggagagttcatttgtttgtccaaaccgcccgctttggccattcgtcaacgtctaaatgactttgagtttggggagggcgatcgtttgcgtttcttttgccgattcgcttatttttacggtccttttccgccgcgcttctcacacataaaatgctgctgctggtcatttcaggcaattatctgatcgcgttcgtcgccaatttcaccttcactttggtggccaaattttcggtcggtcgccttcgcccgcatttcgtcgatttgtgtaagccgaacgtcgtggacttttgtgcaacaccgaccaattggcacacgtacattgaacacttcgaatgcgacaaaaatgtgctgcaggaccaaattgacaacgcacggctcagctttttcagcggacattcctccttggcaatgtgcgcttccgttttcattgcggtgagcggccaaatggggccaatcatcggtcattagctcattcattagctaaagagtccccctcccccctttcgtaattagcagattaatgagtgctttttggttttcatttttttcattagctaatgcctttttgcttttcactattttctttgtttatttctgactatgcctttacgttttttgattaatcagctgatttgttttcgtccatgccctttttaaatatttttcattgccaattcgtaataatcagctgtcccccgtcccccccccccccctccgtttgatcatttcccatggtcagctgaacgtcgccacaaaataacgctgatttgtgagacaaaacgttgtcggaaaaaaaaatgaaaaaatgcttgaactccttatttgttagcctaattctagaaattttcccataaaaaatttcaatataagaaccattatatattttaatttttttaaaatttcattaaaaacttttcaatatcaatttgttttcttgaatttttaagaaaagaatttctaaaattaatctaggaagtaaaatttttttttctcggctgcgtccccccccccgttcgttcgtctcgtcactttttgaattaaacaaattgtttggcattagtcccgatttgtccttcccccgcatcgttcatccgtcccccttgtcggcctttcgaatccctaaatccctttcattttcagatttatttgcatgttcgtctctctccgcttttccgtgcccgtctctttgtgctcgtccctctcgtccaaatcgctttcctttctctc

SEQ ID NO: 12615 - DNA, 2065 bp, Heterodera glycines
tcctcaggaagcggaggatcatggctcgaagcaaaatttcctgcttttctaggttcattagtcttcaaactatctagaaaatccaaaattttgtttctagtatggtccccggcttcctgaggaggtcgcaaagtggtccatctggggggggggataattagagcatatacggtaacaagtttaaaatgctgaagaaatttgctgaggttgacattgaattgagtcccagtgattggaatttccgaagttgtttaagaaatgagaagaagcaaaaaaccaatagaactttaaaaatgttgtgccataagaaaatgccaagaaacaagaaaagacaactagaatgctatgaatgttatgccgaaagaaaatgccaaaaggtgtgatgccacgaaccggccgagccattttcggtgttatcattcataattttacaacacaaccgtacttcctagcggttgcgatgcgtcgaaggggatcccggacaatccgtcagtggacaatccgtcagtagtcaaaatacaattagtcaagagaggcaaattagattttttattaacagattttgcaacaaaaaaaaatgatcaaattttgcgattttaaactaatttttaaggatttttagggttttgcagtgccgattaggcgcagctgagagaaaaattgagagttttggccatatttttagcagattttcaacaaagataatttggaattcgtaaaaatttagcgaagttttctagaaaatttgactgaggtaaatgttggagggggtacctagaaggaaaatcaaaaattttaagcaaaaaaaaatattatttttttcttaaaaatttcgggtgtgaaggggtcttgggggaggggtacgtaaatgaaaattttaaatgaatgaaacatgaagttagctagtagcttgatgaaattaagatgaaaaataaggcaaaaataaaataaattcttacaaatacacgtaaatttcggtgcatatcgattcagtgccgacgattcagtgccgacgattcagtgccgacgattcagtgacgacgattcagtgtgaagacgattcagtgccgacgattcagtgccgacgattcagtgtacgttgaaaagccgacaattcagtgccagaaaatttggcaaaaaattttcaaaaaaacccctaaaaatacaatataaattgaagtggttagaaattctgtctgatgttattgttatactcttatgctaaatcaatccaaaattaaaataatgacctaaatatgtttagaatcaccttttaacattaaaaaaattatttttggaggggtacatttaaaaaaagttttttttaattttttcactagaaatttctaaaaattttcaaaaattctcaaaatatgtataaaacaataataaatttgccaaaattttggattttttaacgaatcatgggttcgtctcatggttgtgggatattccccgagagaaatccagtaggctggggatgtcacttatatgtaggtacataatttgttccatgacttctacttgctctatgtagcgaagacagcgctattcttggagtgtttgcacgcgaaatcgggcaaactgcatctagggactgcctctgaagatagctggcgcgcgcatccacatcaaccacacgttcagaactgtgcggatgtgactatgatggagtcggtggcggttggctcgatgcgcacccataccgagggggtcacactgtactacccgtacagacgcactgactaggactggtcggggaatgcgcccattgagggagaccattgctatcatacaaataatatctattcggttttgcttctagttgcgacgttgtaagctagccatcctacatcttttgggcgggggtctcaaattttaaaaatttttttttttccccccttcatttaaaaatcgaaataaattttcggaggcgcctatttgcatcgccgcgctccaaaaacttcaaacttttcataaaaagatgggcacaaaacgcaaaaattggaaaattggtgaaaatctgtaccaaccacacctgattgtccaccccttttttaaattt

SEQ ID NO: 12616 - DNA, 1862 bp, Heterodera glycines
  misc_feature (29)..(29): n is a, c, g, or t
tattaaatttaaaaagattactgagcatntggtacactcatcatcacattgttgctttgtgttgccgcatttcgagtaacagctaaatgatttaatttgaattaattaatgttttttattttttcaatcattaaacgtttggatttattttaggcattacacctccaacttacgccttttgctggtcaaggcacgaactttcgcacaatttcttgcacgcttcctccttaaatattaaaataaaataaaattggaaatgaaatgaaaaattcaaaaaaaattttttcaaaatattgctgcttttattcactctagaatggaaaggaatgtgctaatatcatcgactcgaacgattcttaactcgagaaattctcgaggttttgttaaaatgctgtgaattttaatgagttaatatatcttactcaaaaggtgcatttcaccaattcaaccgcttctttggccttctcggccaccaaagagagcgcctacagagaatgagattttgatcagaaaactcatttctggtcagtgagagcttagccaagcataaaataagggtgaaaggagagtaaagaaatcatatgcagattttttttatttcaattgcccaatttacttgggtttgatctcagttaatattatttttcttgcctaaaccctcaaaaaatttttttcacagtctcaaagtacgtgattaatcgcattttatgttttcaacacatccatttttgcgtaaaaattagcattgaaaatttcgtttttattaaggaaaattgaaggcatttcatactgtagttttgaataccgtaaacactttggactaaaatttattatgtgtaaggtcattcaattgaacaaccttttttggcattttcctcactaaaataaattagggggaaaagtgtgaggaaaataggatattagagattcccttttgttcaatgaaaaactgaaaattcgtttgcatctttcaattctcagatcattgtgattttttgaccaaaaattagcaacttttgaattttaaaacccaataataaaataaagtatttaaattatgtacaacttacgagttgaaagtaagctcacatttgctttccccttctaaataaatttgaattttaccattaaaagtgatgcttatgttaaaaaaataaaatgtttttctttttactccttcacaattgttattaatttgaataattaaatcaacaattgctgtgtgaagcaacaaaaatgacaaactctcgcagttggtgcgctaaaattaatgggaatttttattttaaaatgcaacaaatgaatttaaaaatttaaataaaaaggattatttttataataataaggctgaaatttcaaaatttaaaggaattttgaggccagggatgctaatggcatcatgcaaaaatttggaaatattttaacatattttcgaaaagatgcctaaatatttgagtccatttgaaaaaaattaagagaaatttcttggaccaaatttttttaattgtaggattttcagggttggcaaaaaatttcgagtccaatccggcattcgggtccgcaaaaagtgagaaccttttctatatacgcatcatactgccaatcgttgtctccgaaaatcatcagtgcacctctccatccgtctgttatcaaagtacaatacaagtcgccacgcgttgcctcctgttaattcattcataaattaaatttaaaatagcaaaaattaagtgatctaaaaaggacctcccaacatccataaagggtcggatcgcatctgtggtaacggtttgttctgttcgtacccggcacaaactctcggcagcgtctaaacaatgtcacaaaaatgtgaataggtgcaagtt

SEQ ID NO: 12617 - DNA, 2823 bp, Heterodera glycines
  misc_feature (2807)..(2808): n is a, c, g, or t
  misc_feature (2816)..(2817): n is a, c, g, or t
cactatgggtcaagcacactgtgcagagaaaagcctagtactatctcgtcgtttctctttttctttgtaatttctctcactttggcgtactatctcttcattttaattatgtaaaaaccaacatttacttctctccatataactttttttatatgcttacaattttcaccaaattttgcatatcgatagagaaaaggcagtgatttgattaaaaatttcggcctagaacattactaaaaatgggatgaaaaaaatttgcatttctttttctctccttttggagtactattttcatgtctctaacacattaaaaatcatgaaattcgtaaatgctaacaattttggttataaggatacaaaatcactttgtacatttagaatcaatagagaaattaatagttttagcatttttggtgaaaacagcagtttaggacttgagttataacgtgataagaatttgaaagtatcacaacttttttctaagatgtcaaattgcttagcattcgcttagaaaaagattctccttttcaaaaactttttttagataccaaatttgttcagtttagttgggaatgaagcgagttatggcagatcaaaataaaaaatacaaaaaaggcatttaccagtgtaagtgcatatactttgtttttgcgtgtgttggcgttttgttttacgccaattattttttggcaatttttttcgttttttaccgtccatggaacatctccccaaaaagtttcgctggtcacgtcttggcatcaattttgatcaaaccgcatttccgaaaatatttttcatttttttaaacaaaagataagggaatcagctttagtattagcaaattccttaaaaaaaagggattacaaaacccgtaacctttggaccgtccttggaaaaatcatcaattttgagaccaaacaacgaaattactataaaatttttggaaaaattcgcgttctatacagaataagttgccctttctgacaccatttaaaataattagcataattgttttattttttgaaaaagctgagtaaggtcgtttgtttgcttcctccgttctccgtcactttcgttttcgcgactttcgcctcccttttgatggtttgtgccgtcggtcttttcaatggcggatgtgccattgcgttttcgtcatccctttcgatgcgttgtttcccaatcggtcggtctctttcttccttctaattgcgttgttaaaaatgggcctaattgcagaaataataaaatgcgagtcaccggttgctttttcctttgttcctcctccttgcaaatcggcgtgaatgaaatgggccgtctgatcagtgtttttgcccccgtcgcttttttcacttccgtcgcgttttcctctgcttctctgtcgtcctcttcgtccatttctttcccttcctcttttttgtccttcgatggcgacagaattgggctgagactgcgaaattccgacggagacggaacctaaaaccaacaaaacattggaaaacataaaaaatgaatgtttttaaacctgcttcagaaaatgatttagaaccatatgttagttttaatggccttatgtcaatttttgtgtgttagttaatctttttgcttataatttgttttcttcgaaaccctggcatattccatttttgcttgctctttaccttcgaattcttcagaaatcctttgctcaaagagggaactttttggtcgtaccaatccgttctgaacacatctccgagcgacttaaatgttggatgagtttctgtcggtgcactgtccgttgtaaataaaagttgccccccacctcacaatcagtacgctttgtctgtatggagaatacgttacaaatgtcaactttcgccaaacgtcgcttggcatccgctaactgatcccctttgacaatggcacaatgcttcttcccaagctcagctttaagtggtcccagcagataataattggcggttacatttgaattaaattccaaaaagcgagtcaaaaggctgaaaaaattatttgaataaaaaagaaaacaaataaatattgtatccttacctttgagtttgaaaaacattcaacggagtgctgcgaaggagaaaggcaacagtcacaatcttttgttccaccaaaactaatcggtttaaaagttctaggaaattctttgattgatgttcttccatcataattgactaatgcttaaaaaggactggaaaggaatcggaatttatgtttacaattttttttgtaaaccatcggaaacattcagcctaacaaataaggtttttcatggtatattttgcatacctatttttcggttagattaggcaatgaaatataacgccaattctaaaatgttttacactaattcaaaaacatatttatcactgcattttttcagccataacatgcttcatcttacgccaaaacgagagaaaaagaattcacaattttttttcatcaattaaccttttattgagcctcatttttgaaaaaacctttatatctttcgatgcagaaattttttcaaaattcgaaatgggtttaacgtgtagaaaaaaatgttagacggagaaaagtaaagtcgttttttcaccattaaaataaaattaacgttaaaattttggcggattgattaggccttgttaaatattaaatgttcagaattgatttagaacgccctaaacgatgagaaaaatgcaaattgggtgcgcgcttccaatccctgatgcacttttatttctttcaaaatataaatgaaaatcttaaagaaattattttttaatttaaaattataatttcaatcaatttgaccnntgcaggcnnatgcaa

SEQ ID NO: 12618 - DNA, 1723 bp, Heterodera glycines
tagagaccggcgcgggacgggatcccgcgcgggattttgcgggatcccagtccgcaatcccgcattttttggaaaatgcgggattgcgggatttgcgggattaatcccgcgggatcccgtcctgcaaagaattttgagttccaatcccgcggatccgcaaatttgattttttgtgcgggattatgcgggattttattattttttgaaaatttttctaagacagaatgccaaatatttttaaataaattaaataataaatttaattaaagttaactcatttttcatcgcaaatttcattcaaaatttgtgaaattttcccggcggcgcctatcggcaccgccggataggcttttacttaataatcctgtagaaattgagtcaaaaactgcgtcatttggccaattttggacaaaatctgttaacaaatcgcattaaatttcataaaatttctcgcagatgtcgataggcaccaggtatggcacggaaagacttccgatttccgacatttttggggtcggaattccgacttccgaaatttttgatgaaaagtcgtaaattttttaattttttttttaaaaactagtaagttttgtacaatttctaataataaattaaactgaaatttttaaaaatttcccggcggcgcctatcggcaccgccgtactctcctccaagttcccaaaaagtttttgaaaaaatcgcgctgtaaaaaacgtgtaaatagtcactccttttcccaaaaatgttctaaaataatgaaaaatgacaaaaaaagattttgataaaataattgaataattttttcaagcgaatatactaaaaacatttgtgaaataccttttacttggttaagacgatcaactttttaccgtcggatccaatcgaaaaatcttagtcgacccatcagccccttttaatgcatcccgccagcccctaaaaatttatttttcagcattttttgatttttggaaattttttgaatttaattgaaattttttcgaattttccaaaatcccgcaatcccgcagcgggatccgcaaatttgaaatttccggtctctagcccaaacgcccccgatttgcttacctattttggcgttttgcccaaaataacaaaaatacaccccctttgaagcgacctaaaattttttcagaaatacacctcaaagaatctaccataccagaccacgaaaattttcaaaaacataccccccaagaaatgaaaaattttctcaaaaattcatccccaaaatttatttgtttatttatttacaagaatttgtgattttgaaaattatatggaaatccatatttttctggactgtgggaggcctgaaacgcgagagaaacattttttagttttttggtttgaagtttttaggaaggatttcgagagattagcgctgttgtggaacataaaagttaactcgcccggtgggactcgaacccacgaccccagcaatccgtgccgtgctctaaccaactgagctacgggcgctccttttagaggttctctcaggtcctttatcccactttctcccacactccgttccttctgacatcacactgtccatatttgtccaaaagtcgaaaactcggcaattgttaagatcattggtcccacaaaaaaaaataaaaaacacattttatgggctatttgatgcgctgagcacgaatatgaagtacatttcgaccaatttcgaacccaggacccgaattcgaac

SEQ ID NO: 12619 - DNA, 1164 bp, Heterodera glycines
  misc_feature (1137)..(1137): n is a, c, g, or t
ctgcttggaatcatctaaaaagaaagtttgaaaatgagaacacgcgctcaattgctcggcaagcgatggccagctgcaaacaagcaccaggggagcgggtgtatgaatttgccaatcgattaagtgatgcagtcagaactgcactggccggagagagtgaggaaataatcagaaagagaatgttcgaagaatttttggagaaattgacaccggaactgcaatttgaggtcaaagctggtcggccaaccagctattctaatgcttacgaaattgctcagcattttgagcaacttttggccgcaaagaggcataatcaagtttcaattgccgattcagttgcggaattgtcgcataaggtagaagcgttggccgtgcatcgccaaccgatgcctagcagaggagtcggcgacaaacgtagttgcttttattgtaaacgcccagggcatattataagagactgtcgagaccgaaagagagatgaagaacagaaatttcggccaaatcaaaggggatttaataatagaaattacggggatgaacgattcaataatagaaattacggagacgaacagcgatggaacagagacagaaatcccagagacaatcgctatttttcaaatcgggggagaggtcagagagaggaacggacgcgccgaactccgaccccttatggtagaggaaatgagcaaaattacggggcggagagaaggccatctcctggtcggcgagtgaactttggaggaggaagaattggggcagcgagaattgctagtcccctctttttggcattaattgttatactttcaatatttgggcaaagttcggcaacaaattctatggcaagccctatgatatgccctcccgattcaccatcgagtttgtggtcaattccagttgaccctatctgcccaacttggtccccgactgaaatcccagtgccaatgaaactatccgttttccggttaaatacaattcagtacaaaacaatggcgactgcttgtaaatgtgttgtaaccaaaatatccagaaggataggattttttgggagtcgttacgaggaagtaacgactagccctttggaagtgccgacggcaatatgccggaaaatgaaaggaagctgtgaatcacctgcagggnaaattggtccaacgaatggatctttta

SEQ ID NO: 12620 - DNA, 3941 bp, Heterodera glycines
gaatttataatttcggaccagtcctttgcaataccaccccccgagtactttgaaatgctgagccgtagtctaaacgcaactgaaaaaaggaggaaaaagcgagcatatgcattcgttaacggacttaagcgggaatatgttattaatgaaacggacactactgtgacatggctcgaaccccacccagagatagaacagctccaatctgtcggattagtttactcatcgcaattggcagcacaacttacagctttaagtgccaaagtcacatttaatactcagaaattatttgccgaaacggtgcggaaaatttgcaacagccttcgatttttagctgatcagacactgacgttggcagaggcaaatccgacacttttggcacgatttttcttggctaacccttttttaactgcgagattggtgacaaaggaaatgttagagatcagtccctgttttgcgataaatgatagggaaatgcattttcaatggcaaaatggcagatgttttgaaagattgcctgtgactttttatttgcatagcagttatgaaacgaagaagcatggatttttggacccaaaaacactaatagtacatcacaattcaaaagagaatagttgtaaagaattccgatatttatatgtaccattgaaagggtcaattatgcaatatgatcagctcagcggagatgtcaaggaaattcctcccgattcagtgcggtatttggctagacaagggaaaattgattttccagaggtgcatattcaattgtttagaaataaggtactagcgaatttgtctgagctatattctcccgaaagttttgatgagactatcgaggttgcaaaaattgcaaaagaaattgcacggctgtcaaagccaaatgcttgggaatttaattcggaacgaactgataatatggccacaaatattgtttccaatgggttattttcatttttgagaggaggactgatctcaattaatcaaatgtgggtattcgtttgttgttgttatgttacacttactattctcttacaattaattgtaccagcgccattagcacaggcaatacagtatttaggagtgggaggaatactcctaaataaagtaagacaaatccgaaatcacatgggcaaaagaaaacaaagacagcccagggaggcaataaaaggtaaagctggccaatctgtcatagaaattgagaaaatagcgatggaacaaaccgctgctacacaaatgaaccgtgagaaagcagcagtgaaaagccgagaaaattcaccaattgtcgaaaagaaaaatgtaacttttgctattccacttacggagagatggccatcaccggatgtagctgcgtctacctcacagcaagctgtaagagaacagcaagcaggcaaaaatgggaaaaatgataaagtcataattgcggttgcgggaagtagtcaatgtgatgaaaagtttcgaataaatggagaagcgaatgagtggaaaatgagttttttgttagacactggcgcacatgtgactttgtgtaataaatatactgcgctgaaaatgggcatacggaaattgattgcatccgacatcacggctgttattgggatcagtgataaattagttccgattttgggaaaagcggaaattaaactgaaaatcgccgaatgtgaagtcatcacaaccgtttatgtagtggaaacaaaaattggaggcgcgggatcatacgaaatgattatcggaagaagcacccttcgccaattgccactattattggaccttcaagcgggggctttaatacgaaaaagagacatgaaagtgtttatttgtgagccaccaagtgatcgggccgatgcagaaatacaaaaaaagaggggaacaaaagacagagttggaatggtgccttgaaaagcataaggatgttttttctgtccacgattatgatcttggagaatgtaagttgaaagcacctcccatcttaacaaattcaaatgttcctgaaagagtaaagccgtatccggtcccggaaaaatatgaaaaagaattaaaattacatattgggaaaatgcttgaggccggggtcataaaggagagttatacaccatgggcacataatattgttttggtaaaaaaggcggatgggcaattgcgtccatgtgtggactttaggcccttaaacaaaataacaattccggacccttacccaatcccgcgcatggataaaacaatccttcgagtggctggacaaaagttttactcaactctggatttggcatcaggattttggcaaattccgttggactcggaaagttcgtataaatgtggtatagttaccccttggggtctttaccaaatgttgaaacttccgtttgggctaagaaatgcgcctagcatattccagagaacaatggataaattattggacggaattccgaatgtgactgtgtacattgatgacattttaattcacacaaattcggcgaatgaacatttcaaaaccctcgagattgtgtttgagaaattacgagaaaatggattgaaattgaagatgaacaagtgtagctttttgaaaagtgaatgtacctatttgggtcattttcttacggaaaaggggtaccgaccttccctaagcaatcaagaagtaattgaggcattccctgaaccaaaaaatgcaaaagaggtgaaaaggttccttgggatgatgtcatttttcaggaagtttattcctaattttgccgctacagcaagccctttacaaggcttattaaaagggaaaaacccggaatttgtgtgggaagagtcgcagataaaagcatttaaagaattgaaaaataaattattggaagcaccatgtcttagagcccctaattacgaaaggtcattttatttatttacggatgcgtcagctgtggcgtacgcgggagctctcatgcaacaatgaatggccaggatttgcatgcagtcggttattggtcccgcactttgaccgaaacggagtcaaagttgccccccacccatggtgaattggcttccatagtgcatgccgtgcaaaattttcggccaattatttatggagcggacttaacaattttaacggatcaccgtccgctcacctttttgttttcaaaagctagcactaatcctaaaattaatcgttggttaatggcccttcaagaatttgaaccaaaagtgatatatgttgaagggaaggccaacaaaattgcggatgctttgtcgagagttccgataaaatgggaccaagtggaggaaaagggtaaagaagatgtgccctttttattaacaattgacgaaaatcgaaaagttgacaaacaaatgttagaaaaggagactttagcggacccaattttggcccaagttattagtaaagtgaaggataattgggcggaaccagtgaacgaaaatttaaattcgtatttcagagaaagagcaaacttatttttggaaggaaatttaatcaggaaaaggccgggaatgcaaatagtaattccgcaaggaatgcaaagccaagttttgaaattgattcatcgagctcattttggtattgtgcgaagtaaggcaagagcaagaggcattgtatggtggccgaatttagcgaatgagatggaaaattatgtaaaaagttgtgaaatttgccaaagaaatgcgccaagcgcaccgagaacagacccggagtacaaatggccagaagccagatatccgttcgagcgggtacatatggaccttgcagggccaatttggggaaccaatttcctaattttggttgactcatattcaaaatatccatttgtatgccaaatgcaatcaactcactcaacatcagtaataaattaccttagggaaatatttggaatgtttggctctcctaaatgtttggtcaccgacaatggtcggcaatttgtgtcagaagagtttgagagttttatgactaatga

SEQ ID NO: 12621 - DNA, 2789 bp, Heterodera glycines
  misc_feature (108)..(108): n is a, c, g, or t
  misc_feature (2732)..(2732): n is a, c, g, or t
attttctccctttccttctcttcccctcactttcttttgctgtccttctcctcctctcttcaaatccccttcccatttctcccacttctctttcctcttcttcttccnccttccccttttttagtgatttaatgcctttccctttgttggcacgcaaagtcaaaaagttcgcttctcagcatttactgcagctgaaacaccttttgggcggtaagtccttctgcaattgatcattttgtgctttttcctttcattttcgctttgtttttcttaaggacgcggttttttgaagttcaaacgattgtatcgcctaaagggcgcgcttggccacggcggattcggaattgtttaccgcgcggtacgaataagcgaccaattaccagtggccgttaagtgaggcaacaattggcgatgcctaaaattgtgaatttgcagattcatcgaaagacgcaatgtccgcgagtggggaaaggtgagcaaatatcgacgccgaggaggcgggaattgtgatttatttttggatggtattccgaattcggcaatttttcgaattcttctctccccccccccttttctcctcctttttgttccttgcaccttttgttctcccttttcctcctcttcgccattgtcttctcctccattctctctttcttctgttccacttgtgatttcctttcttcccacagattgatgaccacaaagtgcccatggaaattgctttgttagcgcgttgttccaatgtttcgggagtgattgcgctgatcgattggttctctttgcccgagggttttctgatcgttatggagcgcccaattccctgcatggatttgttcgatttcatccaccaccagaaaatgttggatgaaaatgtcagccctttttagcaatgcccttcctttttttggcattttctatttgttttcagttggcccgtttccttttcctgccaattgtcaaagccgtcatcgaattgaccgaacggaaggtgttgcatcgcgatttgaaggtgttgttgttcactttcgagcttttgggtcggataatcgtttataataaatttaggatgaaaacattctgattaatttggccaacggtcaaataaaactgtgcgttcttttgccttcccccttaacggtgccttcttttttgttcagcattgacttcggtgcagcgacagtgttcacgcgcaatcggtgccacgacttccagggcacgcgtttgtactgtccgcccgaggtgccctttcatttggcactttttaattaccatttgatcatttttactctttgatcactccttccccctctccagtggtttctccattcgctttatttgggccgcgaggccaccgtttggtcgctgggcgttcttctctttaatatgctcaacggacgactgccctttctgaacgagaaggacatctgcacggcacatctgcttggcccattgccattcttcacaactctctccaaaggttggaaggcattggcgtaatgccatagccaatgccaaattcgattattatttgatggaatatttcaacttttcagcggctcgtgatcttttggcacaatgtctcagtttcgagtcagtgccctcctccttttttcctcccacccaatttaaattgtcttccttacaaattagggcgtcttctcgcccgtctctccaccaaattttggcacatcaatggctaaatgatgcgtctgccccaattaattggtgccaactgagtgcagcatgctgtagccaatgggttgtgggaaaagtggaggaaacggaggagcaaagggcagtgaccggcatttgccatcgaaacaaaaacgaaggaaaggacggcgaaggaagaaaacgaggagagacggcattggcactgagttacgacgagcgaactttgataagcgggaaagaaaactgcgcatcattttcacaacaacaaagtcagtccttccaaaaagcgaagggacgatgggaaattcgccaaatgaaattccattttcattcattggcaggacgaattcgccactcatcagcacaacgaatcgtttcacgctctttgcacacaacggcactgtccccgagaaacagtcacaaaacacttaacacaatcagacccacacaaacaacagacattgcccagtgaatatgaaaattgaaattagaacccaaaactaagacgtttccagtcactggaataagcggtttatagtaaaagttttaataatgtaataagtttattttattaaaataaatttgcaattgaaaatatttgagaaaattgcgctttcaaaaaaagctaaagcggtgccgataaaaaaataatgtattttaatcatgaagaaaatatgacttttaagctcgaaaagcggaatttcatttttgatttcgttaactgttctccgttcgttgggcttcgttctgctgttgttcctttgcgtcctccgccttttcctggcgatatttctgcaaaagatcacacgcatctttcaaggaacgcttcaaatcctcaatttcgccaataatctcctgaacaattaaaaaaaggattatttaattatacattccaattacgaaaatcaaacaattattttgccttgttttgtgagtcgagcaattccttcaactgatggcgcgtatgttcaacttaagagggatacattagacaaaaacaagaaagaaaattgagtttttttcaaaactgacaagatgggctcttcttataactatgnaaagtcatcagcgcggcatacattggctcagtcggctcattaaacacaatttcgtcg

SEQ ID NO: 12622 - DNA, 986 bp, Heterodera glycines
  misc_feature (11)..(11): n is a, c, g, or t
catcaaaaatntcggaagtcggaattccgaccccaaaaatgtcggaaaccggaagtctttccgtgccatacctggtgcctatcgacatctgcgagaaattttatgaaatttaatgcgatttgttaacagattttgtctaaaattgaccaaatgacgcagtttttgactcaatttctacaggattattaagtaaaagcctatccggcggtgccgataggcgccgccgggaaaatttcacaaattttgaatgaaatttgcgatgaaaaatgagtcaactttaattaaatttattatttaatttatttaaaaatatttggcattctcttagaaaaattttcaaaaaaatcaataaaatcccgcataatcccgcacaaaaaatcaaatttgcggatcccgctgcgggattggaactcaaaattctttgcggggcgggatcccgcaggattaatcccttgcggactgggatcccgcaaaatcccgcgcgggatcccgtcccgcgccggtctctagcagcgaccgctgcctgtgcaggaaattggctttttccgaaaatgtcggactcgcaagaccggtgccgttcttacaattagccccttaaaatgtaaaaatgtatatccaattagtgattaatttttttcatggacacggctactttcgaaaggacatccagaaaatttcatgaataaagatctcacttttcagatgggtctcattttcatggctcgtattaattattttcgtgctttttcttcaactgtttcaagatctttcaagcagggtaattaatccttaaaattaaattaataaaattatttatgaattttcagtaaagcataccgtccaggacaatgttacaaccattgaattagtcgatgttcctattgcgtcaactcatagagaattgaaggaatctgctgctactcaatctgtagttttctttttatattgcattagtttatttaatttatgtaatgtttaagaaaact

SEQ ID NO: 12623 - DNA, 595 bp, Heterodera glycines
tctgtctgaccttttttttcacctgttatgacctattttttttcatctgatgcgactttgtttagatttcttatcccaattttttcacctgttctgagcttttttttcacctcctatgactattttttcacctgttctgccctttttcacctgctatgacaatatttttcacctgatcgggtattttttcacctcatatgactattttttcacctgttctgagcctttttttcacctgttatgagcgtttttttcacctcctatgtctatttttcacctgttctgttctttttccacctgctaggacaatatttttcaccttatgctttttttcttcacatatattttcacctgtttcacatatgttatgactattttcacctggtttatcacaattttttcgcctcccttgtgatttttttcacctgttatgccctattcttcatatgtttttatatttttaactttttcgcctggtaatcagtgcgcagttttaagagcaacatttctatttgattacattcaattttatccttaatcaatttgcgcaagcattgcgcataagcgcggcgaaagcgtgggggggggggggggg

SEQ ID NO: 12624 - DNA, 2496 bp, Heterodera glycines
aatcagggttgttccgggttacccgaaacccgatacccgaaacccgaaacccggcctttttctcgacccgaaacccgaaacccgacccgatgattttgggtcaggtttcgggtcgaaataagcactggtaagaaaggggtctgggtgaaaattaggtggataaggaaattgagaattttttttgaaacgattgtgttcaatggaatcgaaaattttgtatttgtttttgttcattattagggatgtcaattttatgtaaatacatattttttttcctggattctccatgctctaaatagtaggaaaaacactttcttttttatgtttgcaaacaaaaatcgggacttttacttacatatttcggggttttatacatatttggtacatattttggactttttcttacatattttgatttttttttacataatttgcgggttttttacggaaagtttttggaaatcctcaaaaaaaaatccaaaattttggcaaattttttatttttttatacatattttgagaatttttgaaaatttttagaaatttctagtgaaaaaattttaaaaaaaactttttttaaatgtacccctccaaaaataattttttaaatgttacaaggtgattaaacatatttaggtcatttttatgccattttacgcctatttaacactttacgaaggttttttcccaaaaaataaccattaaaaaaaattttatttacatattttcgtacatattttgggtttttatacatatttcttacatatttggggattttttttacatatttatgtacatattttgaccaatttttgtacatatttttgacatccctaatcattattatcctttttctaaagatattttgtatgaatttcttgaatttaagcaaagcaaatggctgaaaaacctgctgatgtgcgttgtttcgctgaatttgcaatcccccaatttttctggtgcaaattccaaaaaattgtcaatctccataataagtgttccctttgtcttccaaattcgctcatttatcggaaattgcatggggtacagtatgccaaagggcatcgttgcattcggatggtttcggtattgttccacgccgaccacttcgtccgctgttaacaggccggacggaactgtaaaaattgaataaaatgaatagagaaaggtcaactgctgcttgtttccgggggattaaaaaatgtttattaaaatctccaaaagtcggattcccaaatgtcggtccccaagttgcaaacccccaaaagtcgggtagccgtcatagtatacgcaaaatttctgtttgaattaaatcaccccaaaaatcatatgtggcatatgatacggtgtgttattcataaaaattttaaaattatcgaaaatgtagatttaaaaaagattaaaagagaacaaatttttctatcaattgatattattaattatttaaatttaatataaataaataaatcaatattggtcatttattttgggcaaatcaaaattaaatatttatggccataaatgcgattttttatgttattttttatgaatttgtgatgcattcctaaggacccaaaaagtgagaaagttacatatttggtgtttgccctatttcttcacctaaattttaaattaattaaaaaatatatttatgaaaataattatattttattctactcgtccctccaaataaagtcaaatctataaaatttaattttcatttcgtttttttaccaatttgaagcgaaaattgcatttttggcaagagtgggaagcgaattttgaacagtgccgggccgagcatttgacggagattgtttgccgaacattcaatgccaatttgacgacattttgcgtcagcccaacggagtgccgaaaaaaacacaattaaaagaaatgaaaaatatttacaattattttattaaacatttactgctttccaaattgaaatttctccattgatttgcaattcttcgcgttccaaaatttcgcacaataaattcaggtcaatttgcaaaaattcctccgatttgagcaaagattccgcatttttgtcaatgtatgctaaacaattgtcggcatagaactaaatgaaaaaaattatgcacttggtcaaaaatcggaagtattaaatagtttaaaaagctaaaattatttttttaatatagcaaattgaatttgaaaaaaaatcggcgcaactttgaaacaagtgttagaaaaattaaatttctagctttttctagtaaaaacaatgtaaaaacttgtttttcttcttttgtattattccatagaagtttagcagaaaaaaggaataatttatgattaaccaaaaaaggcatattcagataaaaataaaataattaaattaaaaaaacaaaacaaaatttttgacaaaatatcaaaataataaaaataatgcccccacctccaagtcgaaaagccgagcctgagcacacgcaaagaaaacattgcgcagttttggaattggaattgcaa

SEQ ID NO: 12625 - DNA, 2487 bp, Heterodera glycines
  misc_feature (1123)..(1123): n is a, c, g, or t
ttattccttcatttattcctcctttttcttccatgctctttctccattctcttttggcttttccttctcctttcttccatgcttttccttttaaaattcactgcttttcctcccctttcctccatgcttttcctccattctcttttggcttttcctcctcctttcgcttttccttttcaaactcctgctattcccccccccccatctttcctccttgcttttccttccccacccctcatctccagccgccctacgccctcctccgtttggccattcgtcaattcgttgttcaaaaatgccccaggggatacccctctcccccccccctgttgttcttctgctgttccatgtttcgcgtgaatatgtgatgggtgaggggggggggggagagaggacaaagtgtgtgttgtgttgtgtgggtgggtggagggcttagttccgagcattccgatcacttttcccccaaaacattcataaactttgaaattcccacaaagaaacgacgtacctgttctgaaactgggtgcagtcttcccatgggtacatttcacaattccctccccccggcagagagaaactaaaaaatttcattttcaaaaacggccaagcaccgatttttttttaaatgacgccttctatatcgataaagatttatgtgtgtattatgattctaatccattgggaagaggatattatggtacaaatttaccagaggtacaagtggtttagaaaagcattgtacagtcaattagcatggatagaggagttaataatgtcaaatgaaaattccgggtcagattttcgagtcattaaaaatttggacgaaaaagcaaaagtaaaaattcactaattggttgtccaaggccttaaaatttgaagaagataaacttcaaagcattaaaaacggaaatgtcatttcaaggcctcaaaaaagaaaaacgaatctttggggcctaattgaaattccaaaacttttaaacattttgtaaatgaattcacgttaagttccgaaattggatagacggaatttccggtctttaatacttggaatttaaaattcgtccaatttgtgccctaaataggccaagtgccatagccaaaaattcactttcccccccccccncctccatccacccattttttataacgcattcaaaactcaattcacttaagcatcccaaccgaagctttcacttcagtgtcccctcatgaggatgtgccaaattcggcataatgtgtgcccactaagttaagatggcactccttccccgcgcttttgacgtgccattcccccctccccctctctctcccggcacttccgttttgccttctccgctctccttttcggcttcctcctccggtgccgtctttcccaatttgtgctcatcgcccgttgaaagtcccgagcgttaaaaggcttctttttttacggtcgcgaagcatttgaccagtcaacagtctcatttatcccttcattttttgttctttgcctctggcgtccaattttattgaaatttcgaaactattatttcttcatccctctcataatttcgttaatttaccatcaattaccgttaattggcccattaatcattacacagtaatttggcaatgatgctcggtgcccaggcattacgcacgaagcaaaaagcggaaaagcgggagaaggagaagcgcaagcagaagaagatgaagggactgaccaatgaacgggagaacctccagcgagcggcaaagtgtgcaatttacttgcaaattagcagcatttgtagcggagcaattaataaaggcctaatttgtggcccaattagtttatgcgacgctaatgggacttcatgtactttaatgacttttaatgctttctcatgggataacagagaatttaatgtcccttccaagctattcacatgaccataagccaagcctcggcacataattattttggaagattgggggaatgtttataactcttgagtacattgcgaactgctaatgtcgccaagggaatgctaattgctataggagaagaagctctctcttcgatgggagagggataaagcccagggagagggggcggaggggagttttgttttagaaaataaagtgcattgagagggcacttccactttttttgaaaaggtttccaatttcaatctgtttccttggccatacatgaacgtgggatgggacccaaatttttgccaaccaaagggtttgggggggggggggggtcagcagcggccaattttgcgaaggggtcgtccggccatgatgtaaaattgacgacctttttatgttacttttcaagccgcttttttgcggtatcttttttcaaaaaatgtttggggaacagcaggggccagggtcaggcggtgctgccgagaaaaattttgggtttttaatgggtttgttaaaaaatttgcactctctacccctcgctgcgaagatgtctcccattttgaggcaattttcgagcgaggggggggg

SEQ ID NO: 12626 - DNA, 1575 bp, Heterodera glycines
  misc_feature (39)..(39): n is a, c, g, or t
  misc_feature (46)..(46): n is a, c, g, or t
agtgatcagatatgagtggggaaagacgaggagagactngggccancagagagaatggagagggagagagagagactcagagaatggagagagagtgaagcaatccatagaactagtgatcagagtggagaagagacttttggaaacagagagagtggggaagagacatttttaattttcttttttttctctattttaacctgattttagacttttagaactcaatgtttattcaatttatgcttgtccagaataaggtgaaataaacaaaaaaaaagaaatgatgaaatttatttgatatgcaaaaaaatatatatatgaaaaaaatgcaaaaaaagggctcacaaaatgtctttaatttagtaatgatttttaaaaatttaattgaaaaattcgtaaattgtcgatttttgaacaaaatttattagcataatacttaatttggatttggccatccttttgttattataatttttttctaaatttgctgtgagccctgtgtacaaaaagcagcagagaggtcataaaataaattaagtaaaaacaatcaaagtattatatgtagtaaagtaataaattaattatttaaaatttcttttgatgtcaccgctggcattgaatggaatcgaaatggacagctaatcgatcgaaactgaaaaaacaaatgacaattagcgaagcaagcttaatcagaggccaattaatgggctaatttgttgacgagaatttggcctaattcgacttattagtcaaagccgagaaactttgaccaattctcagacaattttgatgtgatctcgagagtcatttgccaattcccgagtccaattatcattttggaattcaaatgtgatgcatatttctctacctgagcacgtcatttcttcgccattcaatgattgagtcacggaacagctcgcacactttctgtttgtcctccatttggatcagattggccgaccgacaccgttcgtaatgacacgcggcgagacattgggccggcctgaaacaaagagagggcaaattggacgcaggagtcgagagcgaaattaaagaccaaaagccgagactgagaatggccccaaatgagagagaactgaccacacagactcaaggtcgagaatgaacttagagagtcaagaaaacccaaaattggacaagaaattccggatcaaacttaaccccgtattgggaaacaaaatgtgagatcaattaaagcaactgacgaatccacgagcagcctcttcagcagtcgtcccccgttgaacacggtttggtagagggccgagaagcgacacggtcccaccggtgggtactcaaatgggcggtgttgtcgttgttccccggcttgtcatcgttgagtttgttgttgagttcgctgttgctactggccgttgttgttgctgttgtcgtcgttgttcttgtcgtatccgatgccgtttccgtgggtggtgttgctggtgctgctcgtcaaccccgctgctgggtgctgctgggtggttgatgttattgctgctgtgtgtgggtgtgctgctgaatggtactgttcgattccgccgaaatgatggagaggat

SEQ ID NO: 12627 - DNA, 4467 bp, Heterodera glycines
  misc_feature (63)..(63): n is a, c, g, or t
  misc_feature (66)..(66): n is a, c, g, or t
  misc_feature (69)..(69): n is a, c, g, or t
  misc_feature (72)..(72): n is a, c, g, or t
aattaaggcccgcttggactctttaatccatgcacttcctggcgcattggttttgacaggggnggnggnggnggcctatcagctgacaatgcgacgggcgaattgggcactgacaatgagcaggaacagcgccaacaacagaacgatgctcagaatcagcagcagcgaaatgaacaaaatgaataattatgaatggaattttaaatgtgttaattgtacgcggtgattattcatttatttctttatttttttgttattttaaatcatatttttttcaatttttggtttctattccctttatttattttattgcttccttggctttttcaaatacaactttttgccagtgaatggaacaacaaattgtacgtcttttgggcgaacatccggaagaagggctcagcaatgcgcgacttcttcaaggtgtttgtgctgttgttttattttgctccttttttaaacgcacatttattgtcaattccgtacaaattgatacttaaaatacggggtttaatagttgacataaatatttgcgtttcttttaccacaatttaagcggttggcgatgattctgcggatggtacggatgcttcgtcctctgtcactgaacagctcggagcagccatcaaccggctgttggcccaagggaccatcgaaatgttacgtgagactgtgccaacgggcgaaggtgttggcggcgccggagggttcattttgaggctaaaacgaggcagtcagttgaacaacgccagcccggaggaacaattggtcagtcttgggaatgtattttttgccgttagtttttcctctttattttgttcgcatcctccaggtattctccatcattgaagagtcgcagcggatgggcgtttggatccgcgacattcgcgaacgttcgggcctcaacgaagtgcagctgaggcgcgttctgaaggcgcttgagcagcgaaaattggtgcgaagcattaaggcggccggcaccacaaagaaaacgtaaaattcggcgcaaaaaaacgaaacccaattaactaaaacagttaatttgcgtttaaatcgcttctatttttcaattttacaggtacattctgtccggtttggaggccgacgacacactgacaggtggcactttttactcggatcaacaactcgactcggaatttgtccaaacattgctccacgtctgcgtcaattggctgctggtacatgaacccaaaatttctataaaaacagtttcttttgtgtccttttatggttggcccgccgacttggaattgcttaatttttctcggcagttccatggcattcgaacattacttaagttctcattgtcagaaacccaacaatttttaattttaatttatcgctttttaaattttcctgcgcttttcagcagcggcgtcgcgccgcggaagagaaacacccgggcgacccttacgcgcagagggaggcgtcttttgtggagtcggacgaagtgcggaagagccttttgcacattttagtgttacctcaaaccaaaggatttctatgactaacaaaaacttattttaggcacattacttttcgctcgtctatttgttgttttttcaggtcgcccgttatatccacgaaaaaggcctttgtcgaatccaattgggcgtcgcggatgttgagaggtgtgcaataaacaaaacaattaaacaattacttctcacaatcagtgttttggacattgctgtgctggacggtaaaattgagaagcggttgaaccacacatatcggtaaatttttattatctcatattgtggcgaattttttgcattgatttcgtcacatttttcagtgcgattcgtaagcagcaactccatccgtctccgttggcttcggtgccctgtctgcaatgtccggtcagtgccgagtgcacccccggcacaggccatctcatctcgcccgaaaattgcgaatatttccgactccattttgatttatgacctattgtttgttttagttgttgatttatcatttcttttaacttattgcctcatataaatcttcgttttcttttttttgttgctttgttttttacctttaatttaatatttaagtttcatcatttttcatatcctttttatatttctccgctcttttggtcctcagaatgtcaacccatcgtttgctcccgtccctcccgcgtttaaaagtgccaatcggacatcggccgcaacggcttaaacttccgtacattcccaacccgcgtgggcacttggaattggtgcgcaagttggtgaacagagtgatcagagaagaacggtgcgaattgaagtacaatcgagcggaagagtgccgtcagtacgtggagagggtcagtggcacttggcaactatttgctgatggtttcaaaaatttcacagctcatccaactcggcatttaccgtggcccgaactgtgcctacaccgcggaaatgtttcagtggtggttcattgagcaggatttggtcgacaaaatgtggtctattttggtgccccgtttttcgcattatccaatcgatcagtcgtacaccgaaatctatcgattgccgaccattcgactcaagtcgaaagtcaacaaagagacagagttctggaaccgttactcaattgccgttctagaactgaaaggtcgagaaactccctcatcatcagagtttccatcataattctgattgtgttttatttagagaacccttttccgccaatggatgacttagaaaaattgcgcaagaaaaatctggtcgattatgtggagaaggaattgctgaggactgaagaataataatagacgtcaatcggaatattttattgtttcctttccatcgattattatgcttgtttccttttttggatatacatatatccgaccggaaaaaataaaacaaggattcccgaagtaaattcagttttttattaacagagataaagaaatagtacaccaaaatgagaggtgtgtttttctctgctctctctatttattggttcatttctcttttcgggcactgtgttaagtcaatttcgatcatttacagtattttataatttttaaatagcaatatgcttgtgcttttttttggggttgggactaatttagttgcagcgccctttaagtattgttgtcagttgtcactccctccctctgttatgccttcactgcgtcgtccataaatacccacgtcgattgacctttcccgtcattttttttcttttttaaaacttgttttctcattccattaatattttttggtttgattattcctgatttatttttttgcggatggggcaactattctcttatttcaagtctttgtttggtcatcgggaaatgcgaatactaatattgggcctcgacggtgctggcaaaacgaccattctttacaggcatttttaaaattgctacagaaaaacacaatagtgggtggattatgttttgtaatgggttggatttaaaaaaaaaacaaagtttcgaatcggtcttccactttccaatgaaattgaagaagaaatctaaacaattttttgaacatgaaatttcgaaatattaatgccttttccttgttcaggctgcaggtgggcgaagtggtgacgacaattccgaccattggctttaatgtggagcaggtcattcaatgtcgtccatttaaaataaaacagcttactttctctctttttaggtgacttacaaaaacttgaaattccaagtttgggatttgggcggccaaacgtcgatccggccctattggcgctgttactactccaacaccgatgcaatcatttacgtggtggattctgcggacagagaccgagttgggatttcaaaacaagtgagtttcgggtgacaaaccctcacaaaagtttggttgcgataattgtaattcatattcaaggaattggtgtcaatgctggaggaggaggagctgaagaacgcgatcctcatggtgctggccaacaaacaggacatccacggctgtctgtccctggcggaagttcacaaggcgttgggcttggaggtctgtcgtccaaacttatttgtattttatattttcaatttaggcgatacgaaacaggacattccaaatcttcaaaacctcagcgaccaaaggcgacggactggacgaagcaatggaatttcttgctgcttctcttcaatctgccaaatgatcagaccaatgcataattatttccaattattgtattacagatttttacgttctcaatttatttattttttgcttggtaaatacaatgtcattcaaaatgttgaattggtatttagtatatataggtataacccttttatatttaacttgtgaagagctagcgcaactaaaattctcccatattaaattgggttcatttaccgtttattttaccagagacaattttcttcactttcaatgtctttgtggcgttcaattgggtaaggtacacgcgttactcgcaggtaaaaaggctcaaaaa

SEQ ID NO: 12628 - DNA, 2107 bp, Heterodera glycines
  misc_feature (10)..(10): n is a, c, g, or t
  misc_feature (1770)..(1770): n is a, c, g, or t
  misc_feature (1772)..(1772): n is a, c, g, or t
  misc_feature (1779)..(1779): n is a, c, g, or t
  misc_feature (1784)..(1784): n is a, c, g, or t
  misc_feature (1808)..(1808): n is a, c, g, or t
  misc_feature (1811)..(1811): n is a, c, g, or t
  misc_feature (1818)..(1818): n is a, c, g, or t
  misc_feature (1831)..(1831): n is a, c, g, or t
  misc_feature (1836)..(1836): n is a, c, g, or t
  misc_feature (1838)..(1838): n is a, c, g, or t
  misc_feature (1847)..(1847): n is a, c, g, or t
  misc_feature (1857)..(1857): n is a, c, g, or t
  misc_feature (1872)..(1872): n is a, c, g, or t
  misc_feature (1878)..(1878): n is a, c, g, or t
  misc_feature (1897)..(1897): n is a, c, g, or t
  misc_feature (1900)..(1900): n is a, c, g, or t
  misc_feature (1911)..(1911): n is a, c, g, or t
  misc_feature (1915)..(1916): n is a, c, g, or t
  misc_feature (1922)..(1922): n is a, c, g, or t
  misc_feature (1941)..(1941): n is a, c, g, or t
  misc_feature (1943)..(1943): n is a, c, g, or t
  misc_feature (1955)..(1955): n is a, c, g, or t
  misc_feature (1959)..(1959): n is a, c, g, or t
  misc_feature (1963)..(1963): n is a, c, g, or t
  misc_feature (1976)..(1976): n is a, c, g, or t
  misc_feature (1980)..(1980): n is a, c, g, or t
  misc_feature (1990)..(1990): n is a, c, g, or t
  misc_feature (1993)..(1993): n is a, c, g, or t
  misc_feature (1996)..(1996): n is a, c, g, or t
  misc_feature (2002)..(2002): n is a, c, g, or t
  misc_feature (2005)..(2005): n is a, c, g, or t
  misc_feature (2018)..(2018): n is a, c, g, or t
  misc_feature (2035)..(2035): n is a, c, g, or t
  misc_feature (2040)..(2040): n is a, c, g, or t
  misc_feature (2045)..(2045): n is a, c, g, or t
  misc_feature (2049)..(2049): n is a, c, g, or t
  misc_feature (2051)..(2051): n is a, c, g, or t
  misc_feature (2054)..(2055): n is a, c, g, or t
cgaaacgctnttttgtaccaatccgccggttcgcatttttccaatacatcggccaatgtctattaaataagaaaagcattaaaaaactgactttcattacctgaatttccaactgctcgattataaaatttgccgtttcagcatccattttgttcatttccgctccctcaactttgccatttttacctgccatttcatcgccaatgtcttcttcgttccctttttcactttttgcttttttatttctgaagctaacggaaccaaggatcactaactaaacgacagcaaacattaattctcgttaaattaataattacataccataattgtgttgtatacgataaactgtggaattttgcttttgtcttccaaattatttttccacaatgaagtttccgctttttgtctgtccgatgttgagaggaaatataaattgttgcagttcaaatagcgtcgaagttcactatcggtgacatgaacggatggaaagtcggcagcttcgctaaaaacaaattctttatttttttcaaaactcccccatcttttcaccgaaacaaaagttggtaagatgctcggaaagcattcataaaaaaaaagtccttttgctgcagttggtcttccattttgttagtttgcgagaagttcagtgaggcgagatggttgcgcaggtcaagcagttctttgtaactggccattgtcttcactatgtattggtggtgtgcataacgctccttagaacggacctcacgcacacccgcggccaacaaagaataagtcgttttagtgcgcgattccttgagaaaaaatgaaacaatgggtcaaaattttaattggcaataattaccggaacgtattcgtgcatcagtgtacgaatcacttttggattgggccaaaaacgggagactggattcagaaaaaaactgcatgctctgataagtaacagctaaaaaatgaattagttttatggcaatgccaagcgacgaaggaccgaccatatctctctcgcgttgcgtgaagcgacttcggaggtacgctttgtgctgaaggctaagtttgtccacagtgtcatagacgcggcggtcttttttgttcaaatgtcgtaaattggccactgaacttgggaattgctcctcttcgttctgtttaatttgctccctctctttgtttaatcttcgtttttttacgccttgtgttggtttcgtcaaccgacgacgttttgcagaatccacgagagaatttagcgaacgctgtgaaagcacagaaatgggtgtccccgctccctttttggtgtatttcctaaattagtaaaagcattaaatccattgacccaccaaaaacatactgcatcgagattcgctggagtgtgttgaatgttttgttaagtaatgacgcaccaatttctttttcctccacttcctcctgcttcaaatcggatgtatcaacaattccatcgtcactttttccgcctccattttcggaagtctttgcttctggctcttgtttaaggcggacgcccgagggaaaacttttgctctgccctttgaattccgcttttatttgtttgagtgcttcaaaaatgagtggatgttccaaagtttgtattttcggagctgtgatcacgtcgacagagtttgacaatcctcgctcagttacctccaatttcatcgtattaataaaattcttttttgctaacgcaattatacactttttcaaggattttcgatcgaccttaaattttcttttggctgataatataaatgaatccttcgntnatacctnataanaatatccttctttcctttcttctnctnatatatntacttcaattttntattntnttattacanctttttcctngtaaacatattcganaattcnaaccaatctctttaaaatnacntcacttattcncaanntacctntaattaaaaaataacaatnanaaacaattcttnactntttnaaataatcatttntctncacaaaattncanatnctaaanacncacttaaattatnctgtgtaaaagttatanattcnccaantttntncgnncattcgcccctagcagggttgtttaaatcgtttgtaaaactcggccaaagca

SEQ ID NO: 12629 - DNA, 1933 bp, Heterodera glycines
tattaggtaattggattgcttaattctaatttttactagagaaagcggtgtttgccttccattttttggaaaacaccaaaattggtcagggtacgttttcatcacggcgtggatggaatttgaaacagttcgattactaaattgattgaattaattgtgacagttttcatagaacgaacccagccttcgttttggcatttatcccaaagtgcttggatatttcatatcggtcaacgccttccatccctgaatgatatatgagtgaagcaacaacatccgtttgaggtctgtataaatgcagatatgagaaggaagaatggtcatatgccgaaaaaattgaaccttaataacaaaattataatgaaatgagtgaatgaattgttaccagtgtttgaagcccctccttccgcttcatcaacgccgactacttcagtgaattcttcatcagattccatttaaaaatgaataacaataaattttgtgtcttttcagcaagaatgaattatttggtgttaataataaaatgcaaatttaataatttttaaaattagtttcattagacatcgacattttgaaaaaagttggacctgggttccattttggacctgggcctgaattttcgggagaaaaactccaaggaaaatacaggtttaaattgaaaaaaaattggtcaaatgaaaagttttgtcaaggacagatttttcgtgtttaatctggacctgggcctgtattttttttcatatttgatctacatacctaaatttcctgggcaaaaacaaggaaaacccagctgtcgaaaaatagcatgtaccagaaaaaatcaaggcctggatccaggtcctggtcaatctctagttttcattggtttgggggttcgctgcaaaagcaaaaacatgagattgaattgaaacctttcttaaaattttattctgtcaatcttaaatttatacgcacaattattatttaacgaatttatgtttacatacataattacatactttttcagtttatggattccttaatagtaacttctcttgtatttgacatcgattcattcgctagaaaattttcggccgaacaaagtgacttcactctaagtcgcttttcagaaatttttatggaaatggaactttcaagcatatttcttggtcgcttttctttttctgacttggttgaggtatggaatgcgttctctttcaaagtttgtataatatgacattgtcgaggggttttcgcgaaatccggaaaatctgaatttgcgacttttttaattgaaactttacttcctttttacagttttctgaaaatctgttcatctattgctcacgttttatgttcaccccattttcgagcactggttctgttggaaatggtgatcagattcatttcaactcagatggaatgtcatccggtagaattgcggaccgaaattacaaagtattttttccaagtaatctttcacaataaaaattttcagcaacgattatttggactttttctgtgctacagtttttactttcttcaaccttcgcaatacgttgttccgatttctgttacttcttctcagttggatgatttctatgaatttactagctccgttcttttacctgaagagaatttcgaggctctttattgtttttaccgtcttctcaacgcaaacgcattctcaattgcccctgttttgggaaatgtgcgttttaaattgttttggattttgccttttccttcagttcaatccgcttctccaagggaccttccacccgaccctcctcgacaaatcttagtctgaatcgagtggtatcgaactcgtccaagattttggattacttttttctctgagtaatagtgaagtgaagaaggtttgtgtttacaattaggtgattaatcgttaaaagaagaaaattattttagcaatcggaatcgtgcaccagcg

SEQ ID NO: 12630 - DNA, 2291 bp, Heterodera glycines
  misc_feature (1607)..(1607): n is a, c, g, or t
ctctctccccctttctcactctttctcactctcactctctctctctctgtctctccacccatttatcgctctatatccccctcgcactctcttcccctctatatttctcattttctctctcccacccgctttctctctttctctatcgtgtgctattctttcactaattcttcaaaaacgcatttcacttgccattggccaaacaaattacataattttgtatttttaattttccaaattatcattttttataatcatataataaaatgacttttccatttccctgttttatcctttatttgctgcttcccatacgttctcatcggcactttgtgccatcattgccatcacccattcgcttctgatcactttctccgcgtccaatcgttttgccaccgccgccgtaagcattccaagcagcagctttttagcttctgccaaaaatacgaaaatgtacttttcatttttgaataaagattcatttgacttgttccgatcggactccaattggggtgatcgaaagtgaattgtccatggacaatttgctggaacaattgggccctttccgagctgtgaaaaggcgcaaagccaaccaagccttaagtggcgacaaaagcaatgggaagaaaaggaaaagtaattacaaatgtgcagaatgatgcccaacgaccaaatgtccaccgccacaccgtaacctaagcgaaaaaacagacatacggtacggtatttggacgatttcggtgggatttacaatacaattggccaacggaaacacctttctgagtgagaatttcgggtgcgacgtaagttggggtcccacagactgaaaatgaaatgaaaaaagcagtgatttaaatgttttaactgcggtaaagcgggcccagaaaaaaacaggcgaggccgaagtccgtcagtttggcctaaaacaaaggcacagacttaagcaatttccgatcaccgatcagccgaaaagtacgcttacggtggagtcggccccgagcagaatgttttctgaagttgaacatggtattgtcggcactgtttgtgttggacactgacccggcttcacgtcccggtggacaatgcggcggcggtggagaaaagcgagtgccgaagagatttgccgagtgatttgcgcggccgaacgttccgacagtcggccaatgcgtcggatggtctcgaaaaggtcgcccttcttcaataaaggcattcatccacatcatgatcagtgccattttaagctgattgactctcttagcacctgggcataatcgaacagaagaaagaacgcccgtcggcactcaaaggcgtcgattagtcggcaaatgtttctgtgccggcaccgctgcagcagtgcaacttcattctccacaaaatgcaatttgcttctcattcgttctttgtcaatttcctgcggcgtaaatttcactgttttaatttctttggcaacaaaaaacgcactttcacagcgtatttttcgcctttctccgagctaaatacgagaaaaacgtcggagaaattgccttggccaatttgggagaccaattcaaaagttttgtaaaacatcgaacggtcggaaatgcgagtgactgaatcggggcactgtngtgaacagacggacaacaaattaatgggccaagcgcaaagtgccaaaaagagtcatggcacaccaaccgataaaagcttttcgttgcgatttcgctcctccgagtccattcgctttagtgccattcctccgcccattctccctttgtatttgtcgctgtcttcgaagtcgtgccgtggcgaatggacccttcggcccaccgaatttgagcctttcatttttaaatatttctcttcccttttcgcttgtcattcattcttttttgtttcggcatccctctgactttggcacttccctccccccccccccccaatttcgccacctcttctccaatttcgttcgcctgcccttcccttcgtttgctgcattttctgctgattcccttcgccggtattttcgtccatttccaaagatgagatttttctcgctgttcgaaagtcattccctttgtttgccgttgcatttttcgcgatttctgctgacattggtatattttaaggttggaaggggtgaatttgtccagacgaaatgtgaattgtccaatggtcagaaaattgagccgaatggcgtggggggggggagaaattgctgtggtcgacggtgtccgccgctgccgggccaaagggtgccgtccggtggtcgtcagagtcatccccgggcaaatgggcgtaaggggtggtgtggg

SEQ ID NO: 12631 - DNA, 823 bp, Heterodera glycines
cccccccccccccccccgcccaattcctttgaattcgccccacggctctttgtccaatgtttgtcgcatttgaacaaagagcaaaagccaaaaacaacatacactatgattttctgttaaaaataatcatcagtcgacaattaaatggccaataaaataaattcgttcgtccaaaatttctctcattttttttttgcctgttaaaggaccattcattccaaggcaattgagtcgccgccattctgtcgtcatgggaacacaaaaagtacaattatttcgacaaaagcatttgcagaaggacggcatgactttagtcattcggcatttcaactttaaataaaagtagtaattaaaaagtaatcaaatcggtgctcttcaaagaaagcaatttcattgtcaaggaattagacaaattaacgggaatctatcaaaattccaagaagagttaatggacgtggtaagtagtgaaagtgatttggtggccacgtggcaagtgccaatgagtgacaaaatgcacaaaattgaattcgaacacggcacaacgacgggaaaacgaattttgcgggtggacggaaaggttcagggcatgtgtaaagattctgaaaaataaatgcctaaaaatgccaggaaatcctacgacacgaatggatgttcaaattggtgggcagggaaatgttcgaattgaacggcgttcgctgtgcggtcagtgctaaggaaactaaggcaaatgccaaaacaaacaaaaaaacagattaacatcgatgccgcgggaatattcgcctacgaatattcgctgaccgttggcggaaaagcattcgaaaaa

SEQ ID NO: 12632 - DNA, 908 bp, Heterodera glycines
aaatggaaatttacacaaaacactgtcgtttttgttgattaaactaagtttagggcgaatttgcagacgaaggcaccaaaacgcacttagaattggccacggggagttcggcatacattttgtcggagagcagcggtaaccgccacatcggaatggtccaccgtttgttcgtcaacgacagtttggtaaagccgagcgaattggcggacgaaggcgaagagaatgaaaaaccgaaatgagagaagtgtcccattttaaattaacaaacacaccatggagaaagaaagacatcatgaaaagggatattacttttgtttatctctccaaataaatacaaaacaaaattaagtcctaaacattgtacattttggtacctctaattactcgtcataagtaaaatagcccttctttaggaattttgtgaccgaatctatgaaccttttcggttgctccgcgtgcagcctgaaattttaaccaataaaatttaaaatgttatttttactttttttctgaccaatggcccgcctcggggatttcttcaaagttcgcgtgggagaatatttttcttaacgcaattttgtcgtcctccagaaaatatgtagaatttgcgccgtgaagaaacaaagtcggcatggtaactctctcgcgggaaatcaaagggtcgaaaatatgttccaaattgtcagacaatgcgtccaaattgcaacgccatttgaagggaccgcctctgcaatttaaaaaattatttttaggattaatggaaacttggacaaatcaacggaaatgccaatgaaaaaacaaaaaattaaaccttggcttatataaatttgtgagaagaaatgctcgaatggtttcttctggaatttttgactaaagcgatcggctaatttcgcttctgctcaatcgca

SEQ ID NO: 12633 - DNA, 5063 bp, Heterodera glycines
  misc_feature (4930)..(4930): n is a, c, g, or t
tcggatgctcagcgtggagatgagggagaagcagcagcgatcggtcactttgaacgatttgggcattgacatggaccaacttgcttaggcctaggcttcagcttaggcttaggctaggcttaggcaaggcttagactaggcttaggcttcagcttgcttagacctaggcttaggcttaggctaagcttaatattgtaagttgccttttgtagaggatccatatccgtattcagcaacttcaaaaacccctaaaaatatcgtaccaggtgttttcgacagtgattgatttcgacagtagttgatttcgacagtacgacaaattccttgtataagatcccaaatgggtggaaaatctgtcaactagtgtcgggtttcagtgccaagatgcaaacctacaggctctagcagaattcgaaaatcgcaaacccctctgcaatgtataagagcctgtgcttatccttatttaacgaggcctataccatttagaacagttttttaaaaacaagctttactgtcgaaatcatactgtcgaaaccaacactaaatatgtttgcattgtaatttagaatttcgactttttgttcgaattcgggtccgggtttcggaattttgcaaaaaaggtcatattcgtgatcagcgccttaaattaccctagaaacgaacttttatttgaaaatttcagggggggggggtcacaaaacagaaaagtaccgtaatgtgtacttacttagataggcctaacaacttttttatttgaatttcaatgcccttaaaaattaaataatttttttttctgccgttggaaagaacaattatttattctttttaaattgaaaagtgtctgtgataagataaaattcaatttgaattcaacaacaaattcgccaagtcaaatctcccaaaaattctttgccgatcgaagtcatcaaatgttcatgatttgccctgaaaaggcacgcaaattgagcacatccaaatgcaaaattaaattcttaaaataagctcgagattaaaataataaccaaaaaaaaattgaaataattaagggttttttaattgtttttcgtttttggtataaaaataacaaaataataaatatacaaaattacgcctatttcgaaaaatcttgtagattaatcatgtaaagtttaatttcatcaacaccatgtcccctcatgataataggaaaaatcattttacaattgggaagaattggttggctcagagcatttggcgaaatgtacaaaagaaaatccatgaattggtccatgtcaatgcccaaatcgttcaaagtgaccgatggctgctgcttctccctcatctccacgctgagcatccgatcgatcaccggggagaagcagcgaagccgagcagcggacaaaatcacctgaaaaagcggatgaaacatcacaaaaatttaaaaaataaataaaatgaaatacgaatttataatattcacctttctgtcaccgatttccaccataaaatcatcgtccggagagatgagagattgatatgaacttaaaaagaaaaaaattaattaattaaacgaatgaaacagattgattaattaaacaaaatcaattagtaaatgcatttttacttttccgctgatttgtcctttttcttcaaaattctgataacaattgaacataaatcattgaggccatcgaaccgcacatttcacccctaagaatggcatttttgtgggggaaaaggcaaaacatttatacaaaaattgattttttttaaccatcttgacaaatttttatgaaatatagtaaattttgcatatgttttcttatatttttgtggtttagtgattgttgcttcaacactgatagcacttttattatgagttcgagactggttgactgtttcctttttaatttatttttatatgattaataagattttttaaaccaaaaatacccattaaaatcaatcatccttggcataatttatagacgtattgaacccaattttattttcattaaaaattcaattttttgactaaatcatgaaaatttacaaaaaaattaaaaaaataaaatttaacggaaattcataaattttgggtgaaaaaatgttacaaaatagaccttaaatttcaaaattcgcccggcgctgcctatcggcatcgccggcccctcaaaaaaaaactattttttcttaaaaaaatttgacccaaaatcgaaaaaatctatcattttttggacaaaatctgttaacaggcccatccaaattttcaaaatttttcacggcggcgcctatcggcaccgccgaacccatttctcctaaacgtctttagaaaaagagcgccgcaaaaaaaaaagccaaaaaaagatttatacagattttcgctgaaaattggccattttaaatgccttaggtatgtgcttttaattaattctatacaaaatatttatgataaaaaaaataataaaaagcacataaaattattattacgaaatttaaatatttttaagcaaaaatttataaagttttttgactatttggcataaggcaaaaattgaaaaaccccgaccccgaaccccgaacgatttggcaaccccgaccccgaaccccgacacttccaaccccgacaaccccgaaccccgaattttcaaaccccgacgtcggggacgcaaccctaataaaaatggtggcattgataccgtttttcataaaatagtaccccctgggcttaattttttcaaccatcctaaaaatggatgggggtgactatttcaaagggggactgtattttaacaaatacggtaatcattgtctgcttttccaggtatatgttccccgtgattccgcttttgcccgtctttatgccatccgctgaacaacttttgcttgccccaaccccatacagtaaaaaacaaaatcaaataaataatgaaataaatttgttttcaataaaaatttgatatatttttgaatgttgatgggttgatgaattattctgcgatataatttttaaaaaaacgtttaaattttaacaaattaatttaattatttaaccgcggttcatctaaataaatttaactaaatacatttagtcatcggtgtgccggcttccttcttcccatgcaagggcattcaagtcccgtcagatgtgcttctggtcgatttggacactaatgagatttgtccacccaccgatccaaccattcgaataccaaaaatgccacagccggaagcaaataatttaagagtacaaaaatcaatttaaaaataataattttaaataataaaaaaaatttaggaagaatttttgcggtcattgggacggcaagctgttgaacataaatcaattgactctgaacaacaacagcaaccattgaacattgatggagaccaaattgatgtggcctgcagagtggctatggtgagaaaggcatttttttgattttttagaaattttatataaaatttcagatacatttttacaacggagcaaatatatttgcaaatttcagtgaggtgagatttatattttaatggaaaatgtataattgatataattaacaaaaaaaatagttaattaattacagtcatacccaggaaaaattcatttgggaattataagaactgaaaaaaaattttccaaaattttattgttacataagaaaaaagtattgttagtttgtccaaaaatgactcagttttaaataatattttggtcagatttttaaaatttaaggagaattagtctttcggcaaaaaaattgctatacaattttcataataaatctttttcttttatttttcaaaaagtctgtaaaaatttaaaaaaaatttttttttcattctttttttgaaaattttgggttttttaatttgtaaaaataagaaaaaaaacaatttgaaagaaatatattttcaacttttaaaactgaaaattttagtttttaacagtttttttcggtggggtggggcgagctactcaattgttggattagttttttaccttattaattaactgtagcatactcgtacaattcggctttttcctcggcctgttgttgcgcttcaggcggactcttttttgcgaagtcggccacaccaaagtgaattcatcatggatttatgcaagactcaggccgtggagtatgcaaattattttaattaatttaaaatttaagctaattaataaaaatcattttgaattaaaaacggacataaaaattttgtaaatattattaaaacagaaatttaacagatattttgctgaatgttcactttgtccagccaacgaagcatatgtacgggtccaagccgggtgtacgcaagcagtacaaattggggataaggacaatggttctcgactcgttgatgcctgtctcttttaatgtacagtttaaaaagtttttgttaaaatttggatagggtccgggattttgaaaagcctgaaaattttctaaaattccccccccccccctcttcaccgttaaacgcccaccactttctttaagaatttttcaaaccaatttcttcaaaaaaatattttaattttttaacaattttcagtgaaaaattaaaaattagcttacacttataaaacaaaaaatatcttttcttccgatcgaaaatctcatattgatttttttggggatttctcataatttataatttacctaaaaaagcaaacaaaataattaatttaaatacattaaacaaaggcatatccctatggatcgtcactggctgaggccatttttctggcacgtattgaaagcagtcagcaattgttggacagaacagactcatccggcgattgtgatgatgctgattatcccgcaactgcgacgcccagcgatttggaatcaatcggttccgcggatgccggcggatggtctccgtttggcagcagatccccattgaatatgggtgtgtttaaatatatttttgaaattanattgttagggatcggatttatattaaaaaaaataattaaatttttagggaactgtatttttccctcctctggagatatcccatttgcattagaaaaaaaaattaacaatttcgtttggagcatggagcaaaaa

SEQ ID NO: 12634 - DNA, 3265 bp, Heterodera glycines
atttgccattgagcccatcctcgtatttatcactactctcattcttgcgatttcagttttgttcatcattcttcccaattcttcaaattcacctgtcctttggcattgtctctgtttcttgccattctctcctccctttgattttgtgataattgccgtcttcttcctctattcaaatttatgctcccatttaaatcgccatttccattttcaccttgctcccttatttttgggcactttaatttcaatgttcggtaatggcattcctcaaacgcaatttgttgcataaatgaggccattaaaaggggaattagtgagttatttgttacggtaatcacatcagtggctaaaggaattaactgatcaaaacgatgtcatgacaactcgtacaacggcttaagctaggcctaagctttagactatgcctaggcttgcttgggcctaggcttttgctttatttcgttaaattttcagagtacgaatttccattgagtcctcaaaatggcaataatggataaatgataatatttttcctttaaaaatttattgtttgatggaaaatgcacggaaaaagcgacaattttcctctcctcacagcgaaagcgacgacacaaaagccaagcgaagcgaagcaaaagcaaagccaaatgatgactcatccaatcatttaatcatttataagcatttccaagggcaaataaacggagaggaaaagcgagaaaaaatgtttggagcggagacattttattgcgctttattttgatgaattattcacacccccagcagaaaagcgaatcgaatcgaaacgttttttattttaaaatttaaatgaaacaaaaaaaatacaaaaagaagtaaaataaaatagtgagaaaagtcttagaaaattcaactggaaattaatcattgaaaggtcgataaatttaagcggagaacaaagaaaacatggagaaaaggacggatggcattagaggtaataaattaagtgattagtcccttaattaagtgattagtcccttttactgtcaattggcctttagctgatcatttagccgaagaaaggcgaacgatggaaaattggaaaagaaatgctagcgaataaggggcgacccgtttgagatggaatcaaaaagaaaaacaatgccgtaaacggaatgccaaagtcagagcgaaagccaactccatactacggattcacaatcattaccagccgagagaaggaccgcaacttaagtgaaagcttcggtttcaaagtgttaaccaattaagaaagaaattgaaaattggccagtactgagttggcggttcggagttggcctatttcggggagaggaacagaagccaaaggaaatgctttagtgtcaacattggcaccacaaaacagagcgccagtgccttttgtgagtgggtaacccatttctacggaataaactgaaaaattaggggggataattaattttcttcccagaatagtcttcggtttgtccaatggtcactctgtccggtggctttaattaatgtgttatttctggtgcctatgtcattggtcgtcgctggaaaaatgcgcgaaattgcggtgccgttggagttggcttccgctgccaatgctttccgaacgcgcgacgagccccgggccgctggcacccgtcgacccgtggctattgccgccgtaaagagacaatgaggagccgttggtggaatgtttctgaagataacggcactttttattcgaaagacggcacgcaccctgcacatcggctttggcagctcctcgcaagacatggacaaactccggctaaccgaacctccgccgcaggattggcacgaagtggctgaattaggaagccgaatgatcacaccacattcagtaggcgattctcgttaattagccaattaattcctaattgcaattaaaaatgcacataatgagccggaggcggtgcgcctacgcattgcgccatcgccgttgccaaaagttccgaagccgcccccactagcagagcctaaatgatcaggcaccaattagtacagctggtcctaaatccattttaatctgccatttctcacccccttcgctttcttccaaagcgccgtcgtcgacgcggagaatgtcatggaaacggacaggagaagagaagatacggcccaaaatgacaatggcagtcagaagggaggaaagagtgcagatcagcaggaacacgggaggcacaacgacaaactgaggggaagagaaggagaatcagcgaaatagcaggtgaaagggactgatcaacgcaagagacacagacagacagacacagacaacactgactgactgatcgaatcattttcgggatttgtcaacaccaaagaccagaattagatttgtcaaaaatcgttgacccttttaatgtatttgaaaatgatcgctccgctgacccttttctgctgtcgattctcaccagagaaaggagaaactttttgcggtgctgctgccaagcgtaggaatagaaaacggtgagcaccaaagtccaaagggcgagctgcgcctgcacaatgtcactgatcagagagggacgacgacgatcctgagtttcggaggaagcctaaagggagggaaaaaggaaaacaaaatgccaaaagaatgaataaatgccaatgccattttgacagactcaacgaagggacggacgagtgaattcacatgaaaaaccaaaacgaacggagaaaaggcactgattgtttgatatttgacaagacaattcgataagagaagccaattttgcaaaacgatttgtttgtttatcaatcaataacagaacggactgattaatcaataatggaacggattgattaatcattagaacggactggtcaatatttaatgggacggactaataaatcaatatagaacgtaccatcaaccaatatttaatagaatgaactgatcaatcaaagacggactgatcaatcaaattaactaatcaatattaaaaggtgactatttgatggatggactgatcaaagaggttgatcataatattaataagacggatgatcaataattgttcaataggacagactgatggatcaatattgacaggatagactggtcagtcaatatttaatatgacgtgaataatcactatttgataggacggactgatcaatcaataagcaattgaaagcccacctcactaaggcacgtgctcagcttgtccaattcgtctgacgagcttcgcatcaacggttcatcctgagaaagccatccctggaaaacataagt

SEQ ID NO: 12635 - DNA, 4795 bp, Heterodera glycines
agtcactatcttgtgctgacacgtaacccatccgggcaacttcaggtacggacagtcggatctcaattgtttccaaagcgcttaaattattttatggagtcatataacgatgcaacaagtcaaccgtttagctacctggttataaatatgcatcctaatgcacaggaaaatgaacgtcttactagcaaaatattcccggacgaacgcagagaaatctatttaccgagcgaataacgtattacactaaccgcattggctatataaagacatgaatgtagaaaaaatccaaaatgtatcaatttagtccttacgttagggaaaatacagatttttttaaaaagcttgcggccactaggtctgataaacgaaaaaacgagctactacagggagcatcagcagaccaaatacttgcccttgtggaaatttgcgcaaatattttaaaatttaattttcgtttaaattcaagccagaagcgacggttgtcacaatacgcggactattacagggccatagcacgcgctcgcagtgagaactcagctcggcaaaaacttcaacaagggagcggaattgcccttggtgctattcttgtgcctgttctcagcgttttagcccaacatttgtttgaaaaaataacagcataatgaagcacacaaagaaaatggtggtcatggttccggaaaccgaatacattgcgcttatgaacatagtgaagagtatgggtagccgaggcgatcctatacaagatgaaaaaacatcattagactcaaatatacataaaaatttgaatgataaaacaatcggagctgatattaaaatgaaacgacactcttggctgtacaaacggagacgtcaactcaaagagctgaaggaaaataaaccacagaaagtgatcatagaaggaaacccgagttctgcaataccaaacgttgctccatatatgggaattcataaaataccaaaaatagaaacagccgtagaacaagagaataagcgacagccgatacgatcaataagagcatcacgtaaaaagaaaagtgaaaacgtgtttgaatcatcggcagattattcttcggctacagaaggtagcagtagtacgccaatacgttcccaagacgtaaaattaagtcagaaaaatttttcaaaaattatgaatattattggaaaaaatccggacaaatttggaatcgatatgcaatcaggacaggttttgaccaattttaataagccagtcaccggatcgaattatactgaatcgctgaaattattatcaggtgaagatatttcttcgcctcgaggtcatacattttttgttcaacgtttgaagagggaaccggaaattgcaaaatacttatttaatttacaacagggtaaaggaaagaagagaagaactaaaagaaaactagtccttgtccaggttaaccctataaaaacccaaggactaaatagagaaaaaccaccatttaaaccagtgttatgggcaaaactatagaaagtcaacttgaacaggtttattacaacctaaattcgccggccagctacgtaggaatgcaaaaggtgctagcagaagcgcgaaaacgtatccccaacctaaatcttcacgatgtacagaagtttcttcataaacaaaggacttacacacttttcaaaccaaaaagaaacaaattcccacggttaaaaaatataaagacatggaacaacaaaagcgaataccaaaattcaaaattggtgatatcgtaagaattacaaagagaagggagacttctccaaaggatattttccaaattttactgacgaattattcaaaattgttcgggtaaactcgaccaatcctacgtcataccgaatcagtgatttagaaggtgaaaatataaaaggaattttttacgatcaggaactagtaaagactgttgctgctgaacagacaactcatcgagcagaaattttgaaatccagggtgcgaaacggtgttaagcaacattttgttcgttggataggttattcagaaaatcacaataagtggattaaggattcagatctcgttcgttaggcatggacgatttttatattgtactgccatcaaatgttccctttccgggaaatacggcatcccattttaccgtaagacttccacataccttagagcaagactcaaactggtccgttgcgctttcctccatcatctatccacactcgttcccttccgtaggggtggatgaggacgactttgtcaacataaaacttctcaatcctgactataaaccagaggtacaggtccgactactgtaactctgaaggtaaaaattccaagcatacagtttcacagcgtagagcatatgcaaaaatcattgaacagcattattcaatcggcctatgatgtaaagtttccaaaagaaaaaagggtaaaaagagcgacggctgcttctgcagacaaagaattggaaccagaaacgcgaccagaaccggataaggaactgacacgtgaagtgtcttcatctaaaacattggataaggaactgatacgtgaagtgcctttaccagcaacatatgacattgaactaccacgtggagatgagccaaaaccattggagaaggaaataggacgtgaaacaggaccagcgcaactttctgacaaacaattgggtgaattagaaggtgaaaaaccgcaaaaggaacagatgccagccactcccattgttgaacatggtgaaatatctacgatagaccaagtgcgcatggacttagccaaacgagtaacggaacaatcgtggaaagagaccgttaaattggctgctaatgcagccgatatcgcggaaaaggctaaaacagccctcaaccgagctgaacaagcccgcaaacgggcacctaatgctccacatgtaaagaaatggttcgacaggctatcaaatatggagaattatttgcgtgaacttgtggaaaagatttcacaagagtcgaaagaggcggccgaagcaaaacggaaattagatgtacattatgattcctgcaacaattgtttagctctccaacagtctgataattttttgtatcctatatttatgtataaataatgtataaccatccataggtacaccgattaaacggggatacatatatgtatatgggcggaaaacaagatttccttaacgtgatttccctcaaaatttttaagattctctacatattaaccagtattttaaaaatctacattaacgtataaattggacgtttctgtttaaaaaaattttttattatgtttccaatcaattattgctgagctcagcaatccattcagttttttctctgaccactttggtgacatctgcaagcactcgtcattcaatcgtatggatgtcgtcagcatcttcatcaatagcacgctcgacttgattgtttttggttcgcttcttaggcggctcgcttgaagatgcctcttcctcaactccatcatcgttgtttttgtcatccaaaaccttcaccgacaccggtttttccacagatatggaagaaataatccagtcaagcttcgccgtatcattattttccttaaaatatgcgtcttttagctgacataatttttgcatggaacacaatggactagctaatgtgggataaacacctagcaaaaaaaacatgaacccaccttgatgttgactttgacgagcacgggttgatctatttttgactgcaaaatcgattccaacttattaggtgcgttctctgacaggttgtaaaaagcttccacgctggcaatgctcaaaaagttgatggctgcataggaaaatgctgttgtttcctgctcgcattcctcgtcatcacaatcttggagtacaacacggaggtacaaattgcggctgggctttttcgcacggtggacgcacgaaacacaaaagtcttcactgtcgagtttcttacgacatggaatacccttacttctcattgggcaggactaaattggaagcataatgatgtaagagttatattcgcagggatttattgtccatctcaccttgtaaatgcaaaacaacacgcttacaagctttgcacgcagaaaaaaagtgccagccgagtcgaactccttgacttcgctaagcgttttcgtgcgtgaagttggctgctcctcggagcctttggactctgccgaaagaggcttgatttggaatcgtttcaggttgtttctgttcatcttcgtacactgagtggaaagaatagcgacagggaaaagcggactggtatgctgaaaatgagctcaaagtcgattatagcgacactgaaccgagagtaaataatgatgcgtaatgtcacgccaatgaacaataaaaatacagatgggagcaaatcttataatattgtggataaaaacatagcgatgtagtttccaaagccttaaagaaaaattcgaaaaattattttttgatgaataatacttaccaacactattccgtcctttttggccaaagtcccgatcacgaaagggtgtagtcaattgctgcagtacaatacaaagatgtataaaatcgtcaaagtgcaaccgagcttaatttaaatacaagattattttaaaaacagcagctctggtcttttacccgaaattgtgcgatcatacttgcgcaacaattcacaataaacgtcggcagaaaatcggtagcctataaactaacatctgaaataataatatcagtgacaaatacctaccgtattcccttagagcaatttcaagtcgttcaacgccaattgacggctcattatcgcctgctaattgtttaaagaggccttccattcctcaacgtactaaaat

SEQ ID NO: 12636 - DNA, 1271 bp, Heterodera glycines
agttcggcatggatcgagaccgggaatagaccatggaaagagcagctcgagctctacaaaaagctgtggtcagaaaaaatcggcactttaggagcggttttattttctgagaaaattccaaatttgtagaacaatttcccttattgaaaaacaaattttcaatttctcttaatatctttgtgagttcggcacggatcgagaccgagaatagaccattggaaagagcagctcgagctctacaaaaagctgtggtcagaaaaaatcggcactttaggagcggttttattttctgagaaaattccaaatttgtagaacaatttcccttatttgaaaaacaaattttcaatttctcttaatatctttgtgagttcggcacggatcgagaccgggaatagaccattggaaagagcagctcgagctctacaaaaagctgtggtcagaaaaaatcggcactttaggagcggttttattttctgagaaaattccaaatttgtagaacaatttcccttatttgaaaaacaaattttcaatttctcttaatatctttgtgagttcggcacggatcgagaccgagaatagaccattggaaagagcagctcgagctctacaaaaagctgtggtcagaaaaaatcggcactttaggagcggttttattttctgagaaaattccaaatttgtagaacaatttcccttatttgaaaaacaaattttcaatttctcttaatatctttgtgagttcggcacggatcgagaccgagaatagaccattggaaagagcagctcgagctctacaaaaagctgtggtcagaaaaaatcggcactttaggagcggttttattttctgagaaaattccaaatttgtagaacaatttcccttatttgaaaaacaaattttcaatttctcttaatatctttgtgagttcggcacggatcgagaccgggaatagaccattggaaagagcagctcgagctctacaaaaagctgtggtcagaaaaaatcggcactttaggagcggttttattttctgagaaaattccaaatttgtagaacaatttcccttatttgaaaaacaaattttcaatttctcttaatgtctttgtgagttcggcacagatcgagaccgagaatagaccattggaaagagcagctcgagctctacaaaaagctgtggtcagaaaaaataggcactttaggagcggttttattttctgagaaaattccaaatttgtagaacaatttcccttattgaaaaacaattttcatttctctt

SEQ ID NO: 12637 - DNA, 3457 bp, Heterodera glycines
  misc_feature (3410)..(3410): n is a, c, g, or t
  misc_feature (3433)..(3433): n is a, c, g, or t
agggcgtttctgtctttgccaatccattcaacaagccagtcaaaaggcgaaatctgaaaaacaaaaatcaaatattatataattcatgctaatgatagctttttttctgattgaccgtgatcggaatgcaatggtgtccggcgggaggcaattttgagaccaagaagtaaaataatgcgtatttcggttctccggttgttcgtctattggtgctgttcataaaaaattgcttgtacaatttgttgaacattgagccaaattcgccagtttccgagtcctgtccaatgagcgtataatcgcaattgccaatggatttacagaggaaggtctgaaaaagcacatcatttatggatcatttatgtggaatttaaaatttaaatgcaattgacttttgggtcggcaaaagtgccgcagaattggcgcagtgaaatgagttgccaaatgatggtcaaagtgagcacaaattgcaacagtttgaagtagactatcttcttctccataatgatgttgccacacttataacttttgttttctgtgaaagaggaagaaacagaacgattctttaacgcaatgggcaaatcggaaacaatgatgaaaatagtgattgaatgacgcaagaatgtgagcattttgttcaatgcgttcactttaaataggcattttgaatgtgtttttttcgagtgatcattttcaaggacattttgaattctagggataaaccggacgcaaaaaggggcacctgccagaggatccaaaaagggtaaaaacccaactcgttttcagccaactcgtttttaccccaactcgtttttgacccaactcgtttttattaccccaactcgttttttgggtcgaaacccgaaaatcgatgccaaatcgcttaaatttcaaaatgttttgacctaatttaattcgggaatactttttatgtcaaagaccaaaatttaggaaatttgaaaatccgaattttctaactttctttcgaacttagttttttttttgaaaaaaaaatttttttttattacggcctgaaaacatatttccgggggttttaaggttcgctgatcacaaatatgatatctcttgctaaatttacaaaatcaaaagtaattttgtggactattttcagtgtttattcggcaccttttgagttatggctgtcgtttcctctgctaaatcttcttctgcccacaaatgggtttcactgattgtgctcattggccaaacaacggcgctcgtgctgactttgcgttattcgcacacccaaaaatcgtatccctccgacgggcccaaatatttgtcgtcgactgccgttttgatggccgaaatagtcaagtttttcacatgtgtcgccgtcttagggcatcagaacggatggaattttggccgtttgttgcgcgattttgactggaaagatttgctgaatgtcggcgtgccggcgttactttatgtgaacggttgcggcttttcgtccattgtcagcagttccctccttttcaggttgtccaaaagaatttgctgtttttggccctttccaaattggacgccgccacttaccaagtcaaaaaagtgatgcatttggcgaaccgttctcccattttatttaggtcacttaccaattgaaaattctgacaacggcctttttctcggttacgatgttaaacaaaaagttggacctcatcaaatggatgtctttcattttgcttacttttggcgtcgcacttgtccaggtgactcggaatgttcctccggcacttccaaagcgcaaatgccaccaccctttgtttttaatttatgcgagtcgcttattgctaaagtattagcatttgcaattagtagctaataaccacaagggaactgctggttcggaaatgaattcgctcttcgcaaattggattttccaattttcatttgaacttaaagctcccaaaaagttttccgaaagtccgtcactcgctgccgatgaaaacgcatttggtgctgacaatcggccgcaacaatcgaccggcgatggattcgtcggactttgcgccattttggccgcctgctgctcaagcggatttgccggcgtttatttggagaaaatcctaaagacttcgcgagtccaactttgggtttgcaatttgcagcttggtccgtccgcttcccaaattcccttttcattttccaatttcagcgttcttcagcatgtttggtgcctttgcaatgactttgctttgcgactgggctcagcttcagcagtggggctttttccacggatacaattgggcatgactcgtgttttttttcgtttgttttcgtaatccccaaacattcagataatttggacagttatcgcactgcaggtatacggtgagtttggttacggtgtttgtttgcttttgcttttgtaggcttacggtgggcttgtgattgcgcttgtcgtcaaatacgcggacaacattctgaaggtggtcggtccctccccagtttcgttttcatttgccactgttttctgctgatttctccagggtttcgccgtctctctgtccattcttttgagcagtttcgtctcgtgggcgtttctggccgacttcgttccttcgctcactttcactttgggtgcgtccattgtcattttgtccactttcctttatggttacgagccaaaacgattgttataaccggcggaaaggtcggcatgaaagtgccaacaaaatcaacagattctgtgattcgaatacaaatgcatatcattgttgttattgttttgtttaattatgattgtgattatacaataaaatgttggaatttaacttccttttttattctatgggcttttccgttgcgcatttttatgccaaaattggagcgtcacaaaggcagtgccaaaagatgaaaagcattgacttttgggtcagcaaaagtgccgcagaattggtgaagtgaacggagttgccaaatgaatgccaactgagcacaatttgcataaactttaagtagacgaccttctccatgatgccgtcgcgtgtgactacttcttccgtttgctatgaaagaggaagaaacagaacgatgctttgacgcaatgggcaaatagaaaacaatgatgaaaatacagatgaacgcaaatgagagcattttgttggaaacattccctttatataggcccatatagcattgaatcggtgtgtaaacgaatggaggaaaaattaggcagtgtgagaaaatgtataaaaggcaacatttccactcttttaaaaaggggttttggttttaattagataattacttttgccaaattttcaggacttttttgaattatggcattaattttgaaaaatcaaagttttttttttcaattcgttaaacttattttctttttccaaaagtgtccattcgtcgtcatcccttcgcttattttcccccanaataaaaatagtgcttctcacanagaaattggagacacacgcaccaa

SEQ ID NO: 12638 - DNA, 1551 bp, Heterodera glycines
  misc_feature (1476)..(1476): n is a, c, g, or t
  misc_feature (1487)..(1488): n is a, c, g, or t
  misc_feature (1496)..(1496): n is a, c, g, or t
  misc_feature (1509)..(1509): n is a, c, g, or t
  misc_feature (1534)..(1534): n is a, c, g, or t
aaaattattattattatttctttgcaattaaacaggatttccttattttattaagtaaaataatgatttattcagttttttaatcagaaaaaaatcatttaaatgcctcaaaaaatgaattgccatttaattgaagaaaaataaaataaaatcttgaaaatgaaattctgtattttattatttttatttttgattgccctaattattccaattgaatcagaaaagaaaaaattgcaacaaaagtcatttggcgaaatatttggagaaaaatgggaagaaaaagaagaagaaaaacgaaatgaactcaaaaaaagagaaataattggaaaattttataaaataaaagagaaaataaagcaaaaaggaagaaaatattcagcaaaagaatggagtaaaattcaaacaaaaatagcgaagaaattggggacaaatcgaaacaaaatttataaatggatcaaagaatttggtcttcaaaaacaaatacagaaaagctacaaatcaaaaactgatgaagaaaaaattgtaattgtgcaaaaatttattaaaatgtcaaaagaatataagcaaaaaagaaaatattctgaaaaagaatggaaacaaaattatgccgaaatttgtaagaaagtcggagttagccatagaacaattgaaaattggaagaaacaatttggaattagcagtaaattaacggagaaagaaaaaatggagaaaattaaaatttattggcaaataaaaagagaaaatccaaaaatgagtgacaaagaaattgcgaaaactgtgaacacttctcatcagaatatttttaattggaagaaacaatttggagaagaaatggttcagagaacaactgaagaagaagcctgaagtgccttttgcttttaaatttgaaaatatttttttggatatctttttcaattttagtttcagtatttactgaattagtaacccccgtggttctaattcagtaaaaacggtatttgggctgggattttttatgccataaaaatgaccttttttggcattttagaaatggttcaacagaagcaattatgaaagaattagaatattcataattggaagaaactctttgggaaacaaatatttgaggattaaaaacagaagattttaagaaattccgttgagcccctccccgatcaccacttttaaaaaattgggaatttttatttatacaaaatttaggcaattcctcgatcggggtcctggaacccccgacaatttaacactcaccattcccgaaaaaaaatcctgaataaaagcattgcaaatcagattcaatgttcaaaaatgaattaatggaaaaaaattaaattcatttttgagaattaattaaatattctttaattattatcttttatatattgtcaaagttttttgaagtggttttcggaatgtaaatgcgtgaaaccattttaaagactctttgtggcgcacgaacaaagtgtaacaggctcttanaaattgacaanntatatatnaataattttcagncattttcaaaaatttttacgacgancatttttactttttttt

SEQ ID NO: 12639 - DNA, 2762 bp, Heterodera glycines
atgtttattattttcgaatgagctccagtagaaagtactataattttatttaatcattaatttaccaattggcaattattttgtcattaagataaaataattattattatttctttgcaattaaacaggatttccttattttattaagtaaaataatgatttattcagttttttaatcagaaaaaaatcatttaaatgcctcaaaaaatgaattgccatttaattgaagaaaaataaaataaaatcttgaaaatgaaattctgtattttattatttttatttttgattgccctaattattccaattggatcagaaaagaaaaaattgcaacaaaagtcatttggcgaaatatttggagaaaaatggcaagaaaaagaagaagaaaaacgtaatgaactcaaaaaaagagaaataattgcaaaattttataaaataaaagagaaaattaagcaaaaaggaagaaaattctcaaaaaaagaatggggaaaaattgaacaaaaaatagcgaagaaattggggacaaatcgaaattatatttataaatggatcaaagaatttggtcttcaaaaaacgaaatgctataaattaaaaactgatgaagaaaaaattgaaattgtcaaaaaatttattaaactgacaaacgaatataagcaaaaaagaaaatattcgcacatcgaatggcaacaaaattatgatgaaatttgtaagaaaattggagttagccatttcataattaaaaaatggaataaacaatttggcattagcaagaaaagactaatggaggaagaaaaaatggaaaaaataaaaatttattggaaaataaaaagcaaaaattcaaaaattcttgataaagaatttgccaaaatgatgaaaattgatagatcgaccatttcaaaatggaagaaacaatttggagaagaaatgtttcagagaacaacagaagaagaagcgtgaagtgccttgtgcttttaaatttgaaaatatttttttggatatctttttcaattttagtttcagtatttactgaattagtaacccccgtggttctaattcagtaaaaacggtatttgggctgggattttttatgccataaaaatgaccttttttggcattttagaaatggttcaacagaagcaattatgaaagaattagaatattcataattggaagaaactctttgggaaacaaatatttgaggattaaaaacagatgattttaagaaattccgttgagcccctccccgatcaccacttttaaaaaattgggaatttttatttatacaaaatttaggcaattcctcgattggggtcctggaacccccgataatttaacactcaccattcccgaaaaaaaatcctgaataaaagcattgaaaatcagattaaatgttcaaaaatgaattaatgtaaaaaaaaaattaaattcatttttgagaattaattaaatattctttaattattatcttttatatattgtcaaagttttttgaagtggttttcggaatgtaaatgcgtgaaaccattttaaagactctttgtggtgcacgaacaaagtgtaacaggctcttaaaaattgtacaaatattatataaataattttcagcaattttcaaaaatttttacgacgacaatttttaattttttttttctaaaaaatattaggcttattccattcgtttgtcagtgcactttcatagttttatttggtttttgtttttgcgccgacctctcctccttttttgttgttgttgttgctgattttaaaataaagtgaattgtccagacgaatccagcaagtttattacgcagggctccaaaaatgtattttcaaaatagggacaaacgaggttaaaactaagattttgccccaaaattacgattttttttgaaaaaacgacgttttaaattgttaaaacaattaaaaacagtgctacttagtgcaaatcttcaatatcagcatttagaatccaaaatcagcaattttgcaaaaatttattccaattaaaaaaaaatgaataaaaatttgcggcacgcttttttgggaacagcgggccggcgatgtcggtaggcgccgcagtgaaaaaatttgaaaatttaaatgcattttattaacagaatttcacgtccggcggtgccgattggcgctgccgggaaaatttgattgcgcttaagcaaagttatggcatgttttgtcgaaaattcgctaaaataccggattttagaaacgacctagaaccatccccgacttgtcattctgacggaccccgctcaccaacaagagttacccgacggggataagggagcttggttaatatttagtgatgctcgatatcgaaaattcctgatactctagtgactaaaaccaagacccaaaaagcccgggacttttaaggagtcgagactgtggcatttggcaagatttaggacgggtaagtcgtacaaagtggcaacatcctgtttagattagtatagatccagagaatgatcccttgaaaataacgtatcatggaattcagtccagagatatatttaaatttttgtttcccgaattagatttaagtttatttgcatgaaaattgctggatatcatgatctcaaactgattttaggcggttcagaataccaaaaaagtttcactctaatctagtgaataacattggaatctattttccgaatttaaccattttcattggatttttactgaatgcaaattctgatccaattataagccaaaaaatctagatttccagaccctgcctgact

SEQ ID NO: 12640 - DNA, 956 bp, Heterodera glycines
  misc_feature (942)..(942): n is a, c, g, or t
tttcgtaaatccgccaacgtgggcatttcgtaaattccgccactatgggcgtttcgtaaatccgccaacgtgggcatttcgtaaattccgccactatgggcgtttcgtaaatccgccaacgtgggcatttcgtaaattccgccactatgggcgtttcgtaaatccgccaacgtgggcatttcgtaaatccgccaacgtgggcgtttcgtaaatccgccaacgtgggcatttcgtaaattccgccactatgggcgtttcgtaaatccgccaacgtgggcatttcgtaaatctgccaacgtgggcgtttcgtaaatccgccaacgtgggcatttcgtaaattccgccactatgggcgtttcgtaaatccgccaacgtgggcatttcgtaaattccgccactatgggcgtttcgtaaatccgccaacgtgggcatttcgtaaattccgccactatgggcgtttcgtaaatccgccaacgtgggcgtttcgtaaatccgccaacgtgggcatttcgtaaatccgccaacgtgggcataaaaaataataatgtgacatataaaaatgcatgacttgtcataaacacacaaataataattcatggtatctatcattcaatagctcctggatgttaatattaattttataattttttgaaaaattggttataaaattcaaaaaattttaagtccttttttggccataagctttttgaaacaatgaaatgttttgaaatatttatttaatagattatacaagggaatcaaatcccaaaaaagaaaatataatttagttgcttaagaaaaaaagcataaatcattaaatatgttatgctttttgccatggtcacccacatatattatatgtagggttgtaaattatatggattaacatattttttctgcgcatatgctatgaagaaaggggctaaaaatagcatttctgcngtaaaattttttga

SEQ ID NO: 12641 - DNA, 2725 bp, Heterodera glycines
taaccattgctttttgtgcgtaaattaaattttgtcttcttaccccccctaattgctttttaagtgccgaaattgactattgaataaattatttttatagttttgtcagtttatatgtaattgcatttaccgaacccgactttttcattgttttttttatcccatttttcgcaaatttttgccaattaaaatacaaataaaaattcggaattcgtccaaaatttctgaaataaatgaaattttttgtaattttgtcatactctggcattgaatcagcaaaatttaccgtatgaaaaccataaccatttgaaaattttggtgccaaatttaccgtatgaaaattataataatttgaaatttttgaaaattttctattacaatataaaatttcttagacaaagatttacaattatttgaagccaatgcattcattgtttaagcaccaaggagcggctgagctgtgccgtcccctccctgtatacggtatgcaagcatctccgctgtaccgtaacggaggcgttggccgcgcacgcggacagtggcggcaaattggtggtgccgttgctgttggcacgggacgaggacggcattttgtacccgacccctcacacatttccctaccaattgcagatgccggcggtgcaaagcgaaaggcaaaaactaaaaaaaaatccgccaattaaaggcctcggaaaatttatcaaaaaatttggtacttttttgagggattttcggggttgctgactgattatgaatatgacatccatttagaccaattttcgaaccccggacgagaattcgaacaaaaagtcgaaactccaaattttcgactttcacacttttttgaatttttgactttttgtccgaattcgggttcggggtttgaaactagtcgaaatggatgtcatatttgtgatcagcgaccctgaaagtcattttttattcatctacataattgcgtaataaaagaatattttttttgtaaaacccgaaaaaactttttttcaattttttgctaaaaaattgaaaataaaaatgaggggatttctgagtttatcataaaaacttttcttttttttcaaaattcatcatcacgaatccaaaaataaaaatttaaaataaattggcaaaaaaaaaaaaaaaaattttgcgccatccctaaaaatttcacagaaaattcgaaaaatttcggcgcataaaaaaatgctcccccaatttttagttcagcggcgacaatgaatggtggtggtggcaccgcaaaaatttgtgctgctgattcctcggcacttgccaaaaatggcggcacattgtgcagtttggagggaaccgttccggaaaggtacaaaaaaaacaatttgaaaattcgaaaattttcatttttttcaggtttttcgcggaaaaccgcagcaacggaatcggcgaagcccaacaactgttaatgatgcacaatgccaattgacccttttttattattgttaatttgttttgtttacagttgaccattttaatgagcccttaggcccattcaaattagcaaatttttatgtacaaaaatgaaacgccacagtttttttttgtttgaccataccgtaatccattgctcctcacaatacataccaccgtaccgtaccctttcctccttctcccatctttttctgctgtagaaaaagcatttttttcccccaattttttgtccattgtcacatgccatgccggttgttttgttcaataaatttttgtgtatttattttattttttattaaattattatttaaaaagtaaaaattcttattatttaaaaagtaaaaattcatttttattgttacaaaattttttaacacaaaaaattttgaataatttaaaataattctattacatacctttttcaatttaatcattttccaattgtcctaattgagcatttaagttaggtcattaagaaataatggctttgtttttgtgatttgccaaaatttagaaattttccatttaattacccaattttcattaaatttttagagacaaaactttcgtcaaaattcaatttatttttaatggaactaatcaaatggaaattttatataaaaagaattttatttaatcaaaagaagaacattttacattttggcgaatttatttaaaaatatataaaatttaatataattttaattaaatttgaaataaatttttgccaaataaattagacggaatttatgccaattttcgttcaccgattattaatttggaaaatcgacgcgcaaatttcgcagcgttccgcgcctaattaagtaaaaaaattctcacgttctctgccgctgtttttctacaggcagagtaatctccatcaatcatcatcataatcagcaaaattgagcagtaagagatttgttcaaattgataatttgattggaaggcgtcggtcgatggaatttttttgttttcggcgctgttttctgtgccccgacccctcgcaaattttatgaaaattttattgtttatcgctgcctaattagtacatatagaaatgcattaaattttaaaatttttaccatttaaaaaatgcattttcatgatttacggtttttttaattatctcgacattttttcgtattattttgattctcggttgagaagtatcttgagccagccatttttggattttggtctcgggcttaggaaatttttcggctgcttcgagcctctgattttatacatccataaattt

SEQ ID NO: 12642 - DNA, 965 bp, Heterodera glycines
  misc_feature (25)..(25): n is a, c, g, or t
  misc_feature (29)..(32): n is a, c, g, or t
  misc_feature (35)..(35): n is a, c, g, or t
  misc_feature (37)..(37): n is a, c, g, or t
  misc_feature (39)..(41): n is a, c, g, or t
  misc_feature (43)..(43): n is a, c, g, or t
  misc_feature (47)..(47): n is a, c, g, or t
  misc_feature (50)..(50): n is a, c, g, or t
  misc_feature (56)..(57): n is a, c, g, or t
  misc_feature (63)..(63): n is a, c, g, or t
  misc_feature (67)..(67): n is a, c, g, or t
  misc_feature (73)..(74): n is a, c, g, or t
  misc_feature (76)..(76): n is a, c, g, or t
  misc_feature (102)..(103): n is a, c, g, or t
  misc_feature (108)..(109): n is a, c, g, or t
  misc_feature (111)..(116): n is a, c, g, or t
  misc_feature (118)..(118): n is a, c, g, or t
cccccccccccccacccccaataanccannnnaantntnnntncatnctnctaatnntatttntaancacatnntnttcatcccaatttaaaataaaaaatnnaatcnnannnnnncnccaaatattttcattaaaaaaaattatattcttaaataaaaattgggaggaaaaaaggacaaaaaaaacattgaaattcttcataattttaggtttgtatagtaaaaactaaaaactaccaaatatttttgggcgaaagcgtttggacccccagaaaaaaaaaattgaaattttatttattttcactccaaagttcaaagaactcttgttatgatcaatgattttgtgatatgacaaggtcgtttcagcattttctcgtgtgaccccaaagaacgccccggggtttatcaattcaattttcatttttgagcgagtgtgaaattgcacacggagactcatttaaaaaagaaaaattatttggcgatttgttttcttgctattttgcatttttttccatttcgacgaaaacgaaattttacaaattttagggggagcgataaatacggcaaaattggcttttaaatggctcagagccccataaaattgttcgacgttgccaaataaggcctaaacaataaaatttaataaatttttccaaatttccccccgattttcaaggaatggtgctttgcgagcgaacattttcactgtcagagcctttgctgcccgaaacaatcaaattcatcaaggagagcttggaaaagcaaggcgaactccatttcgaattgccccatgtttttgtggttttcggcgcatcggtgcgccaaaattttccaaaaaaaaatttcttaaaattttccccctcattttagggcgatttggcaaaaaaggaaatttacccaaccctttggtggctgttccgcgactggggagccaagaggcaaattttcaaaaaaaaaaatcgaaa

SEQ ID NO: 12643 - DNA, 2171 bp, Heterodera glycines
taatcacccaaaactgttcatacgtttttttagaaagtcgaaactttagaccaaaactctcgaacagcgctaacaattattgagtgttctatgcattattcatttctttttaattatttcaattaattaattgcattttttgtccatttggctgtacgtccagccagggtcaaaagtattgcatcaaaaaaatatttttttgaaaaatacgattttctctaaaatgaatggagggaaaaaagtattgtttacgccaaaagaaacgtcaattaatgcactaacaaatacccaaaaactgggcccgataactctctttgtcgtcgagaattggtcatgaccaaaaaaaccctttttttgatgggacaaaagtaatgtatcaaaatattttatgattgttctcttggtttcatacgatcaaaatagcgtaatacttctctgattagagtcttaatatgcgtaaacgaaattacttgtcgacaccaatcaaacaacaaattattaaagcaaaggaggcaggtcaaactgatcgagccgtctccgagcagttcaacatcagcaattcgactgtttcacgggtgtacgcgcggcacagacaaacaggcgacatcagcacaaagcccaagtctggacgtcctcgaaaaacatcggaatggcaggacagggcaatcgcaaggcaattgaaattggatccaaacaaatcggcgtctgaagtggcggcatgggcgcgtggcactttcggggtcaaaatgagcagaaggacggcatgcagaattttaaaacggcatgggctgtatggacgaaggccggcaagaaaattctcctgaccaccaacttttgtttctcaccaaaaaaaggggggttgtttgggtgatgatcaattttctcgacgacaaagagagaatatcggggcacttcctggctggacgtacagccaaatggagaaaaaatgcaattaattaattgaaataattaaaatgaaataaataatgtagagaacaagcattaattgttagcgcaattctagagttttggtctaaagttttgactttcaaaaaaacgtatgaacaccgttttggatgattatgcttttttttatcaatttgaaaaaaatattaagtcttttttagagttaaatatttttttaaattattttcttaaaatcccttttttaggtcactcggtcgcacagccacgcgccgtcctccacccgaattgaggtgctaatcgccaaaagtgacatccgtcgggcggcagtgaacgcaattagtgcaacgcctggggcaatcgttgccaatgcgctggagggcatcagcgacgcggcaaagcatcagttgccgaagattgccaatctgaaaaagacggccacccgacaaaggaagggcattggggacggagcagcgggtgagaagggaaacggactatttttcaaaattgataaaatcaaatgaaaaatggaaaaaattttcattgggattcctttcaaattaatgatcacttgacaattagttacttcctttaagaaaatccgctgccaagcagagaaacactgcgcaaaagattggtgcaaaactatcgcaacggcagtcaccgacggacaaccgttacagtaccaatgccacaaacatcgcattacggtaagggcaggaaaagggagggggggggggatgagaaagagaacaaaagaatcatcttttacaaaagcgtgggaaatttatttaaggaattgtttgaaatttggaatttaaaaaagtttcttgatttttgagcaaggcaaataaatcgacgactctttggcattttattttttatttccccattttttcgttgcttctgctgacccagcgctttcgataaaacaaagccaaagggcagaagagggacaatgccaaatggcaacgataaggtaattttagaaattaattatggaataatcacttagtctcaatacataattaattgcttgttcattagcttccgctcacttttaattttgattagtcactaattgatttattaggcatttaattagctctgccgcattggatgttgtgctagaggaatcactgccgcccaatttcatagaacgatccgaagatgcgatagctatttaaagcctgacttggaacaggagatggaggtgattttagagcttaatctgatcagacatcttt

SEQ ID NO: 12644 - DNA, 2890 bp, Heterodera glycines
  misc_feature (2858)..(2858): n is a, c, g, or t
ctgaacaaactgatcggacgcgttcgagtgatcgtcttttggatatggtagatgcattattgtacatatataaactaatgccatcataatttgttcaagacaagcccaaaaaccgaaaaagccaattcgatggcacaatattcatttgtgtagctaacggagcccttttacaaattttgccatttttttttgccttaggttagatttccataaaaacaatgacaatcctttcattgtcagtgaacactttggtggtgccgtttctctctgcccttccgttcaattgcgtctgtttttgccgaccgcggacaatcgccggcgcctcttcgccagcacagtgacaatgctcagttcgttcgtcagccaattggaggaggtcgacgcggtgctgcggaacagcgaacgcagcggaggcggcggcgcggaaatggcggcgcaaatgcggaaggaattagaacacatttgtgcccataaagaagatttggaggcgtatttgatggccactgaaccgatcgtggaatggatcgaatttttcgaagtgaatcatggaggaaaaggggacgagggagggagtgacaagcagggagggcggtaggtaattagcggaattaaattacccaatagcaaatgcgaggggagagggagtatttaggtgaattaaattatccattaggagatggaaggggagaggggtgttttttgaggggagagggggtgttttttcaaaattcctgaaaaagccaacaattttctccaatataaaactcgactccctctatttttttccctagatctttttttaaacattttttaagtttagctttttcccaatgttttttaattactttaatttttctttttccatcctttaatcttccggatcacttaaaacgatcactttcattcacttgcatttgcctcaagaaaacaatttccgttttaattaatatcatacataagtttatgatcattttaacagtgtccattcaattatttataataatttcaggaaagtgatcagcccaccatccatcgcgcgttgcccgcgttggcgggcattgaaagcggactgaacacgctgcgaatgttggccatccaaagttgtgacgggaatggcacaaccaataattgtcaaaccatgtccaactcggcggtgcttcagcgcgaactgtgcgaagcggcactggacgcactcgactggaacatctctccgctgaggggcgcgaagagtgagtttttacagacagcgaacggttggcatttcctgccaaatttttactcggcaaggacagcctgactcaaggaaaattattgaatattttatattgtcatttttttccaaatgccaatttaattagctgctttgactcattaataccattaagctgttcctaaactaggacagctgtgccattggagaatggaaatgggattaatgatttgcccaaactctgaatttgaacgccgaaagcattcatgcttaattaaaattttgcttgatagtgcccgcaattcattcagtcaacaagcatttgctgtgcaccgctgccgcattgaacccgagcgcgtggcgtcgtgaattgcccgcggtgttcgccaaagtcgcgcgttggacagaggaggaggtgctaatgaacgcagaaattaaaaatggaattctgctgggagttggccaacaggagaccaccgtgtagattggcggagggggtcgacaaggacgtcccaggattgtggcttcggggtgatatcccccggaaaatgatttttttttttttgcttttcattccactttttgcgatgcgtttttcaaaaaaaaattttggtatcagatagtcgccgccggaaaaaaaattaaaaattgagtgcaatttgctaacaaattttgtccaaaaaatgaccattccatttcaatcaaatttttttaaaagaaattactgtgtttttagagtccgcggtgccgataggaccctgagaaaataattggggtcgaaaagcgctttcagcagtaatcaaaaacatttattctactttatgttttgtttcaatttaacttctgaaatcagatacttgccgaacttcgaatatctttcgcgcatgccattctttccgaaagccatcgtcagaaaatacagcagaaacacaaaatgccacggcgttctgtgttgccctccaagaggccgttgttcagctgtgccgtagaagcggaaggggagggaaacgagcgggaggaggatgagcagagggacgaagtggcggagtttgtcacggtggcgaagcagtacagacacaccaccgccaacagcagcatcaactttgacctgctcagctattggaacaacgatttggcatcactagtgggcacttttttgcatttgattttgtaattatagatggaatggaaaataattgatcataaattaattatatttttaaatgaattgatcaattcaatccgaattctgacttctccttacacaattagacattttccaatctccgtgcgttggctcgtcaaattttgtgcgtccccggcggacacatcggcacggagagaatattttcagttcaaaatgtgaaacaaaaactggcagaggaggataaatttgagggaaatgaagcggaggtgccgccccgctgttccgtcagcacttcggcactgtctttcgtttcttccattggctcggcggtgccatcaacggcggcggcggatgaaaatggtcggactaatattaatgatgcttatggcgacgacgatgatgatgataatgatgatggttgatgaatggtatatgcaacagagtcatttactgcaacaaaatgtgccaacgatcgaatgggagcagcagagcaaagtgggnggatcgatcaattgcaaatccattttctttta

SEQ ID NO: 12645 - DNA, 937 bp, Heterodera glycines
tttgcttttatccctgcggattttattttctccttctttaatcacacaaaacttctctaaaattcaagcagttattagttggtggtaatttcactgcttctctgtttactgttttttccgccccactatttgttttcttttgtcccccgtcccctcctctcctccctccctccctctctctctctctccccgtctctctcttcccttacttctctctccgctttcccctctccctctcttctttcattgttcatccagtttattattatcttttgttttttgttctgatcagataaattatgtaatcatgcgtctgtgagttcccggccctcacccataaattgcgcgtcccttccccctccctgaaaaaataacaaaattcagaaaccgtgtttttgaaggcctcaaagtgtttattcaactcggaaattttgttttgccccaacagcattctgacaacgtttaacaattgatctattttccgactgatattgacagaaacactcgacccgagaaatttatcagtcggtacactaagtcatcagttgcttaagacctaaatgaattgcaaacgtaattaaaatgagcgtgttgtatactgaagttgggcatcagggaagtcatgatgtgaagaaatgccttccacacattttggaattgcgttaatttggaaagtcacatcagataaatcatcaggtctcttcccattgaggcgtccaggtcaacgaaacgttcgcgaatgagcaattcactagtggagatcaaagtagatttgaacaacccgatagaaaacggaaagacacatttactgatcaccatagggacatccttgaaaaaagtgtcatgaaagcaaaaagcatctcgcaagggccaatgaattttttttgaggacaattagtcacttctgattagtgctgagcatctgacaaacagaaaa

SEQ ID NO: 12646 - DNA, 2443 bp, Heterodera glycines
ccaagaacaaaaaagtcatcaaaactccgactgctaattgatctcagcaagcgatcgcttttccagaagaggcaaaggcgggagacaaatcgaacgacggacagaagcagcggtagatgagcatcggttggtttgacgcgttccgcgagaacggagctccgacttggtgaggaaaaacacacgacaaaaaagacattcgttcgcttttgaggtacggcgagaatccgacgccggtggtgttggacttgcaaatcgccggccttctctccctgtttctgaccccgaccatcgcctttctgctaattcttcccggaatccgtcgcttccgcgctgtctccgctttcatttttctgttttccatggccacaggggccatcattctccgtaaatagcaaaatcgatgctttttgttcgcttgtcattgtcgccccccccccattaagtgtccattcattatccggcatggaattcgggccatattcgcattttcgccacttaccgggcccattccaacgagcgcatcaacgcccttttgggcgttcgcattgggctgacccacgtgaacatcactctgggcagtgagttcgaaatggggataaacaacatgccaaaatttaaaaaaaaaaactcattaaaaggcgaaagtctgtcaccggaagagattctgctgaaaagaacggttttggacgcgcgggagcaggacagaggcaaaatggagccggacagagccatggaaatgctgctattcaacacggacatagccatgaactcaagcagtagcagcaacgcaagcgaaagcgaagccaatggagccgaaacggtgccacaaacgacgggtccgaacagtggcagcagcacaaccacagcagcgattagagagggcgaggagccggaacaacaggcggagctgtactacaatgaacggttcaacttcgacgacggtgagacgcttttttgaaatggaaaatcgaaagcattcatttggagtgagtggcatggaagtgatcgagtggctggagaagggactgccctaccccatcctgcaggtggtcgagtacctcagcgtggacaggaccggctttctgtggggcaagcagtaccgactggccgggtactacactcacgccgtactgtggtgagtttggccggacaacggattgggccataaaccaaacatttggccattgtttcgctttgtcctcgagtgatcactcctactgattgatctgctctttcccattttcaggttggcatttgccatttggctgctccaaattgttcttttgggtgccctcccccaccgttttggttcggtaagctcaatttaacctttgtctcgtccatttccaatttcaaattcgcttaggtagcatttgcctgcggtttggccattttatttgctgatttcgtttacttttgtctgacccccggcgacctttttttggtcttttttggccccgacgaacgttcccatcgcctcactttccatcccgccctgtgcttttacgcccctttgggagcaggtgaaaagcccaaatgattttacgtcaattaattaatattaattgattatttcagtgaaaacttcttatcttcaataaatttaattaataaattccaaaattgaccccccccctaaagttcacctccaaatgaattattgttttctgaaggaataacaaaattttctctcagaaattggccaaaatgcatttgttttgcttatttttgatctttttaatgtttttcatttttggaaaacgtttttttattgtgggtcgtaattatggggaaggaataatgatggactttaaagggggaggggagagaccggttggtggtgggggggggggggacaacaaacataaaatgaacaaacatttgagggggggggggggcaaagtgttgtgtaatgtaaattaaagtcattttgatttatttgttgtcggagccgacaaaagtgaaaattggattatgacactaaaaaataaacaaaagatttaatgagtttgttaaaaaaattgatatgaattatcagggattgattgggtcgtttcgtcatttcggcgttataaattttttttattgtcgaccaaatccaccaatattggtatcatttgaaagctttctttaaattagtttagttttttttttggggggggaacggtctaaatgcgataaaaataacattcacgttgcgataaatgtcctatgacaagtttattggttgaaacaaaaactttacataataatacccctgcgagaagggagtggtaaacatgattacaaaattatcaattttttctagtcttatctactcataacggttcagaattcaataaaaataacattcacggcgcgaaaaatggggtttgaaaagcttattggggaaaaaacgactttacacaataatacccctgtgagaggggagtgggaaacatga

SEQ ID NO: 12647 - DNA, 1352 bp, Heterodera glycines
ccggaagggtttgacctttctgccagtgagttgactttgttccgctccagctgaatgaaaaaagctgtcacctctcgacgacgaagtaaagtgagaaaggacaaatgccaacaaaatatcagtccattgtcaaggcaaaccgtcgtcaaaatgccaaatttaaattttacatggcatttcatttcattcttttctcctcccccgccccccaaacacttcggtcgcgccattcattcagcgccatttccctttctttctgatgctcatctcaatatccaattgacttagtgcacgcgagggtaaaggtgagaacatttgggacgaggaaaagcgggggggggggggggggtaaagggttcaggagaagccattagcgacttggcatgggtttgggtgtggcatgggtcggctcacatttgtgtgtccccagcgtattgaatgctcacttagtgtgttttgttcagtgaatgtgtcacctttttgtgcccacatacggtaccaaaaagagcagccgaaattatggcaaattgcccaattagcacattaatagcagcgcataaatttcgtacaattgccgcttcttctttggatgggcggggggggaaggatcgttggtcgctatttgcttttaatgccaataaaatgcttcaagtcgggatttttctcgctctctaatgggttaatggcacctgtaaaaagaaaagccgcaccagggaggtaagtccggaaaacggaggcgaagaggcggaaggacgagaaaggcttcgactgcggcgtcgccacctttcgccaataactataaatgcttctcggctctccgcggctaatggtcacacccgcgaggaaagggcggatgatgagagatggcaggatgaaatgggatgggatgagaggggagggaagggaagggaagttcggtgggggggagggcggatgataactcatttatttgtcacttacccttcttctccctccctcccttctcttccgtctcccctcgctgcaccaactctccactcaaaatgccaatgtatcaattaattcccccgccttctcaatttttgctgagttttgttgagaagccccgcagtcattcgaagttattgcccaggtaagtgaatccctccggcaaagtcaatttggctaatgcaaatgaaagaatgtcactcactcttcttcgtccgtgtcaatgccatcaaaggaaaagcaagcgaaagcggaaccatccttcgcattcgaattcgaattggcatttcttttttgctttcaattaattgagtgtttattagcctatcattcttcccccccccctcccctcccttagtcaatttactttttttgtgtgcgttttt

SEQ ID NO: 12648 - DNA, 3109 bp, Heterodera glycines
tacagtatgtcattaaaaatttttttagggcggttccgtatggacaaaggactggcgcagcggcaaatgctgttgtgttggccaaggcatccggcaaattccgctggacatggccgggccgggacgcgcaaaggcagtgagcacaatgtgagtgggggacaaacacggtggtgatgatcagagtggccagatcagtgtttaaaattttgatctggtcccacagttttgatgttgatcagtttacgtgttttatccgtgataaggccttcatttttaaaactgacataatctgatcataattggttatttaaaaatgattactgacactaatagtatgaattttattctgatcaaaacaatggatgttcactgatctgacacgaatgatcacttggcacatcaagtcataaatgttcacccgttttcagttatttcttcgacgtttcattgggtcgtctaacgcccgcttcattcgccgcttttcctaatttggaagagattttcttggaccgcgcttctctgttggcacacgttgacagtcgggcattttctggactcaaaaaactgagaaaaatgtaattttaattcaaaattggcattttcccttttcgttcctcgttttttttggaaaattgcccataaattaaaaaagagttctggcatcatgttcatgctcgagttttacgcccctccccttttcagcacaatttcaaactgccccgcactggtcagctggactggcgttatgttgcgcgaaaacccgcaaattcaaacactgtcagtgggcgcccaactctcgagactttaccccgaaactaagaatagagagcaacaaaaaaaaccagtctttcccgagtcgagatcatgaagaaacaccgattctcgattgcagtgcggtgctgaacagcggcgcgttgcgcgagttgccactgctcgagatgggcccgcagcattcgctgcccatggaacgcatcgatttcagtggtgggtggtagagagcggaaatttctaattttctgatcccgctgcgggacttgaactcatcacgcgctttaatccacaaaatcccgaaatcctgcgtttttcaaaaaaaaatgcgggattgtggattgggattcccaaaaatcccgcgtttgatccagtcccactccgccggtctggagtaggtagtaaaagtgtttaaaatctcctctcattttgtcattgtttattttttgtttcaggcaattgcattgcacaaattggagaaggtaataaataaatatacacacatagacacatcgggaaattgtcggaatgcccttttttgattgccggtttcttacgaagttttttggtgccatcggaacccggtttccgatttctgaaactttttgagggcgtcggttattttcactgatttgcttagatttaatgtttaaatttcaaattgcacaaatactatgtgaaacgccgcccgcttaaggtgcgctgcgcaatgtgcaggccaaaacggtgtcatttgcggacaatgcgccatgccttcgcgcaatcaccggaaacgcattcccggcatccaaatttgtggagctgtgcgtttttttttatttagaattgggaaagagttccgccagctgccattatcattagctgatgtgctcgagagtcttctcgagccgaagatgaacagacagtccaaccgctcgcaaccattttggcacttttttccatcatttccaggcatttgtcggcaaatccgagcctggactacattgccgagactgcatttgccggcctggcacacattgagcatttggacatgtcccagaccgacatcacggcactgcccttcattggacttcgttcgttgaagcaactcacattgaaggtgtttaaccttgttagctgagttatgcgctgataatttaatagcagatagctgattaaagtggctctactcgaaatttcctaatatccgagattaagagacgaaaaatgatctcttttttcttggcacgatgtcgtgacgtgattctcgagcaccctagatgtccaattgaaacccactgatcattctttcccccggcgggtcatttaaattttgcatctgatcagttttctgcccaggctctctcattgggtcttttgatcagtcatcactttctttggtcactcccctccacgaccgataattagctagtttctcactagcaaaatattttaatcaattatgttttgatcttttaaaacttgtcgcttggcctttataccaattcctaaaatctgatcaaaggacgtgccacgcttgaaagtgttgccgccggtgttggcattcccaaatttggtgcgtgccgagttcacctatgcgcaccattgttgcttcttcaaatatgccacaagggattattatgaacggaaaggcattggcggcaaagtcggcattggcggcgcaaaaagccaaacgcgcgagttggacgaaaactttcgtgccattcagcgacgtgtgtgccgacgacggcaaacggtggcgccggaaggcgctgaggttggtgcgtgaaaatgaaattgaaatgacatttcaaatttggacaaaaaaaaatcaattcgcaaataaatgcccccaggggaaaaaagtttttccgccaaaaattatatttgatttgcattttgagccaaattttgaaataataaataagttttaggttaaaagtgccgacaaatgtcattggtctagattaaacaatattgatatcgaaatgttttaattttttccatgtgtttcttgttaaaagatttttgggtcaatttttaaaattttagcaaatttttggggatatataaggccgcacctaaaactgacaattttatggcatatatcagttaaacctcaccagataagtaaaaattatttcccagtctgttgatcatggccaatcatcgcgctctgctgatgctgatcagcaggagaacaacaacaataacaaccgaagcagtagtggcgccgccgcaagacggcggcggcgccaaagtcggcacattgtcgcgcatgacaacgcgggggacaaaatattcaagcagttagcggaatgtaacgaaacatggaactgctgcaacagcagcagcaaatgcg

SEQ ID NO: 12649 - DNA, 1555 bp, Heterodera glycines
  misc_feature (1547)..(1547): n is a, c, g, or t
aaggtgtgcaaaatttgctcaatcaatggtggagtttttgggtttttgcggacgtttgtatgctgagaaatgacactttattccccagctaattttattttcagttttttaatagatagcacaattggaagagataggaaagatgagagtgcgtggaaatagtgggggaccattcctcctttgtctcttccccccgttgcaacccatcgaaaataaaatataaaatttgtttggatgtatttatttggctcttcattaaattgttgttgtggttcgttcggctgacgccgtttcccgccgtgagtcctctggactcgattaaaatgtagcgggaaatattcttgtgtgttgatcacacctgtgacccagtctgggcatgacatgcgcattgtctgtggcggttgcattcggtcggagtcggcccggacggaccaccaaatttttatttaaacattcaaaaatactagtgcaaaagacatttttttttaaaaaaacaacagtttatttcctctaatgggggaaaattatttggtcagttattaaaatataaaaataattatatgtggcaaggacgtagccagaggggtgaggtgaggtgcggatgagtgatgctcgagagtcgagaccgaaaatttcccgagtgtcgagacttaaaaattaaaaaaataaatttttaaggcttttctaactattatttttttgttgctatttttataaggttatttataatttgttgtaatttattaatatcgagcccctcctcattattcacctgcatgtagcaccattgaaagtggtgctcgaagagtgaatgcaataatgagagaccacttcatgttgcgaggttggaaaggatgtgagagtggaagaaagaccacttgtgagagattgtaagaagagcagagtgatgagtgaaaaagttggaggccgcttttcatgggattgggagggatgtgagagtaagtagaaatagtgggggactactcccactttatctcttccccgttgcatcccatcaaaaattaaacttaaaatctgcttcactatatttattggtttatttgtaagtttttgtcgtggtgcgttcggctgacgccgtttcccgctgccattgtgtcctcactgctcggatgggcctcgttgaataaggcgggaacagtcagggagatctctcccagtgacccggcctgggcatggcactcacattgtttgtagcggttgcattcggtcggagtcggcccggacggaccaccaatttttttttgaattttcctataatttatccaatcgaatatttacacagtttttgggtctttttaaatcataaatcttacacatattgtcactttaggtcatagatataactttatctaattttgcaagccctgataataagtaccgaaatcccggtttaggggctcgagtcaatagacttcacctgaaactcaggaaaataaaaattttataaataaaattagtaaaatataaatttgttcaaatccttaatttgtttctaaaaatttaaattttagcccaccatcacttgntttatacc

SEQ ID NO: 12650 - DNA, 872 bp, Heterodera glycines
ttcgtccggaaacaccgctgccattcgaggccggggaaaggtgagagaaccgttggcttactcccaacccccccccccccctctcgaatttggacaaaagtcgacaacttttcgagacagacattcgactttttcttcgaactcgtcaccgtaattggacgaaattgacacattcacttttatttgctttctttttctacccattttgcccgattgagatgacaaattggatgcccaagaactgtttgatcggagctttgctgttgaggacgaggaggaagatgaagaggaggaagaagaagaccatgaagaaggggaagaatgggcggatggaggaggagaaatggaatatttggagagagaagaagaggaggagtgtgaaaataacgaacagcgaaaaagagtgtggattaattaatactaatgaatgatggttgaaaaggcaagggtacgagagaggggtactttcctttttatggccaagttttggattttaacaaattgaattgtaagattctttaaaaaatcattgccacatttggaccaaaaatttttatacggcttttctacaagatttaaactcttctgcctaatcaactcgtacaaacggactcgctcagttcggccccgcacggttcggctcagccaagttttcggtctataacttttttctttggcaaccaaatccaacaatcttggtatcattcgaaagctctttacatactctctattagctttaccaaaagcgaaaaggttttcaagcctggaaaaaaatattaagaaaaaacttcaaaaatttcgacttttcgcaattttcatgtataacttttttaaaaggtgtctaatcgcgaatcaaaagcttagaaaaaatt

SEQ ID NO: 12651 - DNA, 918 bp, Heterodera glycines
  misc_feature (911)..(911): n is a, c, g, or t
ggcgagatttcggcggcgagattttggggtgcaccctgacagtagtccccccccccccccctttttcaaaaatttttgaaaagcgcgtcgctaaatgaaaaaaaatacatttgtaaatttaatgggttatttgagtttctttcttcgcaaatgatttgatccgtctacggtccattttacaatttcagcaccttttgctgacaaatccgttgacgctgctgagtttgaccagcacgagcagtcggcaaaacgggcgaagaaaggcaccgaaacgaagtcttttttggcacaattctcgccggaagaacggcgccaaattgaaaatgccgatcgggcgggtgggcagaagacatttatttatttaatattaaaataaaataagatggattttaagaaacattttcatattttattttaaaaatccttaattcattttcctttattttaataatgtataaacacaaataattgttttatttttcaggtgaattggactctcgcggacagcttttttcgccgtctttaacaaaaaaattgatgaaaaatcggccaaaggaaaatgtaattaaaaattgaattcgacaaatgacaaattaaacccccattgacaaatgagtgctttagtctccaacttcctctgcttctgctggtggttccaaagggcaaaaagtggcgaaatgtccaatgaatgctcaacaacgaatcgccaaaaaattgggattaatgcgcaaaaagaattaggaaagattgttattgttttcaaaaccgaggcccttcggaaacaatttttttattttccttaatgaaaactaagaaaattggcgaaatttttactgacttttttgcatccctttaagtttttgtattttattagattttttgctgaagattcacgattttttactaccaanattttca

SEQ ID NO: 12652 - DNA, 824 bp, Heterodera glycines
ccacttattcttctccacttttgctaaattgtttactttagacggtgtcaactgatcagacgaattcggccacatctgaccctcgtcctctgcccgttgtcaccgagtcggtgccggtgagtcaatagcagttactgaaaaaatgtaaaaccctaacaattttaggaagaatcgacttacgatccgccttgggacgaccgccctctgcgtttcatcaaaaccatggctgctttgcaatcgcaccgatcaacaaatgtaattgatatctctcctatctttagttgctttttaaatgttctcaattaatagcaaatttatttttcttttattgcatttttgataaattgtgtttattttaggtgctgcccactgttccctcaacatcggccgattcggaccctcgtcctctgcccgttgtcaccgagtcggtgccggtgagtcaacagcagtttcctcaattgcaaaattttagaaaaattttcaattttgaaaacagcctttgtaaagtgtaaaaatgtttatctgttgaacaatggataattttgaatttgttttggacccgggcccagccattttatggccgtcttgtttttattgaatcgcagtgtaatttttaatctttcttttcgactattaaaatcgctcattttattttagacatccgatcttactgcccttttcgcggagtttttgcgcaccaactgtgttggacatgtgcccaaagagtttcttgtcaaccatctggaggaggccatcaaaattttgaaccttggcggcggacaaagcgacgacaattccaaaatgtccaagtttcgcaaggtatt

SEQ ID NO: 12653 - DNA, 1944 bp, Heterodera glycines
ggccgattcggaccctcgtcctctgcccgttgtcaccgagtcggtgccggtgagtcaatagcagttactgaaaaaatgtaaaaccctaacaattttaggaagaatcgacttacgatccgccctgggacgcccgccctctgcgtttcatcaaaaccatggctgccttggaagcgcaccgatcaacaaatgtaattgatatctctcctatctttagttgctttttaaatgttctcaattagtagcaaatttatttttcttttattgcatttttgataaattgtgtttactttttggctgccctcctcaaaacggtgagtcgacagcagtttcctcagcaaagttttataaaaattgtcagattttgtaaacaaccaaaaaattactagcctaattcggtcgtgttttatttagatatcggatattgttgctcgtttgacggctgtcgtggacgccaacgagcttacgcgtttgccccccgacgttgtagggcacctggatgcggctgttacccacttggaggcatcagctcaacggctgaaccttggcggcggacaaagcgccaacactcccaaaatctcaaagttccgcaaggtattgtttcattcattactcaataatcgaacaggacgggcccaatggggttttaccgggtcgccgggtatcactttcttggaccaaccaccgggaagggccgcccgataaaaccctggtttttgacagggcggcccggccccggtcaatcgtctaatccgggtgctttcaaagtaccggttccacgtaaataaaaaaataatggataagttaattttttcgggtgtgtgacaaaatcatataaatttttctttagttcattgcgacgttgaagacgaagaagaaatgagtggacaccggaaatgtcttccaatttctcgccgtacacaaataccaatacaaacgaacccttaacactcacattcaatgccacttttttgttttatttttcgacatttgtctcatggtttttttcattaacataattttcttttcctgtttattttttgcttgcgttttccaagataaaggaaaatttctctttgtgcaaatttcttacacaatgttttatgtgttgaattaattggtcggtaaaatttagcaaattttttgcgattgcagatccagcgcataaaaccaaatccacccctccccccttcgataaattatccgttaattgaactttttttaatactgtttcgacaaagacagacaataacatgacaaatacacagcatatataacattgatcattccatccgatttcctcataataaagacacatcagtggcgtgcctagctgctttcgctgtcgtcgtcggtaccagtcttctcatccttctcattattcttgtcaaagattttcgaatccacttggccaagcgtcgcataatcaggatcagttgctgaaaagaaaaagaattattaggtaaatccaacgaatttatccatcattttttacttgtcgcataaccccgtccccctcctttcgcctgctgtttgattggcgctgtttttgttggtgcattattcttcacaaaaatgtccgggtcaagcttggccagcgtcggataattgggattgcgcgctgaaaaagagataaagcatttgaattgaacattctctgatcaaaaaatggttttactcgaaacgaatatcatctgtccttcctttgtctgctgcttctgctgatttgacgttgcttttgttggtgcattattcttcacaaaaatgtttgggtccaattggccaagagttgcataattgggatcacgcgctgaagggacagaggaagaagcatttgatttgaacattcctctgatcaaaatgctgttactcgaaatgaatatcggtccctgcttggtctgttgatggatttgttgtggcggttttgttggcgcatttttctcaaaa

SEQ ID NO: 12654 - DNA, 3688 bp, Heterodera glycines
  misc_feature (3677)..(3677): n is a, c, g, or t
tccccggtacgaaaacggcggtacgaaaacgaccctgaccgaagacatgaaagtgttcataaaaattgttgtttttgtttgaatgttcagaattcaatcacaactcaactcacgcgttcaatcaaaaaatttatgtgttcaattaacataggtaaactagttgcataattagattagtacttgaaatagataaagatacacaaaattcttgggtttttctttgcccatccccgtgccaaaaaaagcgcaaatttgagccgcaaaaagcaacgccgagaaagccaaaaaaagatatattggcaaaaaaggaaaggaaaaatgagtaagtgaatgccattctttggatttattgggaccgtctcaaaaaaccaccaaaaaagaaaatgtaaaaataaaaaataaatttctaaattgaaaatttaatttaattttttagttttatttctgctgactgttggctttgtgtatttgatttgcttaaaccttcccaacttggccttggaattgcgctgatcagtcactgatttgacctttacatcgatgaacacttcaaaacgcgcaaatggacattgaaatctattcaaattgatcgaaaatttggaaagaatggcacaaagcaaatggcaattgtcaattcctcttggaaaccattgccaattccgcaaaagccgttgccaaagaaagtcgtcggattcgaagccatttcaatagggtaaaatggattaattaaccattttcaaatgtaaacgagtccattaattgattttcacagatatatcgactgcaataccatcgcttttctccaccgttttcgtccacttttcgccgcctgtccaatcaatttgtccatcgatacgacgaatgatcgcatttcggagttcattttgcacaacatttggccaatgctcgggaaaaacatccatggcattgaaatgtccgcctcgtttttcaatcttttgcgacaaatggcgccatcaattcttagcgaatgtccatcacttcgttttgtcattttttatgccggtgatctcttcgccgaattccctgccgatgacagtgccgcggcatcggatggacaaatgttggccaaatggcttttcactccacgtccggacgatgtgccaaaagtgctcaaatgctggttggacactgatgatgggaatttggcatcgaagattgaagccttcaaagcggtgcttactaataatttgtttatttggcactttggtggtctttgggattcgttgataaatttttataaatttttcctcattttaggcatttctcgatgcgtcttcccccgccaatttcatttttgtcatttggtttccgccgtctgctgattccgttgtgccatttgaactgatcaacgaatttactcgtgaacaattggcattggaaaggattaacaatagcgatcgttttctgctgatccgttgtccaattgtacgaaatgcgagcaaatggacaaaatgggagaaggaagcatttaattggcgaatttatgatcagcggaacagaattgacattgaaatttataatgaggatgacatcggcgatcggtcagcgaatagtttttcaaatttgtttatttcatttttatttttaggcttctcgacgaaattcccgacccgagtgatcagcagaagtgaatgaatgaattgttaagaaatgatcgaccaatttggattatggaattattgacgtgatcataaacattgttttcttttttgtaaattggactgttcatgtttggttatgttatgtcattatgatattttgtggttttctaaaacaaaacatacgcttcaattttcaatattttccccagcaaatgtgttggaatgatcaacttggatttgtgttattatgtcattaggataatttactgattttctgaaataaatgtgaaaatattattttggggtctgaatgttttcatatgaaaagttaggcccgtcaattttttattcacccaaaatggacagtggtgcactttaggcgtccaatgttatgtgaatggatcatttgcagtttaaatttggaaaatgaaagtctgtttcgatgtgctcattaaatgtttattttcaacatggatttatgcctgaattagaaataaatcccaaatttcttttcaaaatttcaggtgaattcgagagttggaccattcccgaatttgcccttcaatcgccccaccctgtcctcaagaatttccatttcagtagcagttccatgtcgttgtcgcagtgatgtcattatgcaaatggaatttgacctaattttaaattaattttttattaccacgactgttttgccaatttcgcaatccaatcacttcaaacaattaattccctttccctcttttcattcagtttaatgttgatgttgtttcatttcatttcgtttgtgtgttttctctcaatttttaaaataaaatccgccgtttcccaatttcacttctctttcaaagtgttgacaaaacaaaaacaccaaatctacacaaaaacgagaactattccatttaaattgaccatttgaacagttttttttctctttcgtttttataaaggaatacaagctaatttttcttaatttttttggttttactaagctaatttcaaatccgtctaaatctctcaattatttacctcatcaaaatgtcagaccgccgaaaagaagcggaggcaaagatggcaaaagcaatgtaaaataattaaaaatgccaattttcaatttcgattttaaattttgtttcctttttttcagtttcatttccgccgacggttggctcaaagtgttcgatttgctgccgccttcccaacttggacttgaaattgcgacgatcagccaccgttttaacgcctacgtggacgaacatttcaagacgcgaaaatgggcgctgaaatttattcaaattcgacgcgaaattggaaagaaaggcacgaagaaattggaattggccaatttggatggagaaaaattgccaattccgaaaaagccgatgccaaagaaagtggtcggatttgaagcaatttcaataaggtgagatggaagaattttgttgttttcaaatgtgtaatgccattttcacagatttgtcgacctaaataccctctcttttctgcgccgttttcgtcgtcttttcacctcctcgccaattgtttttgccatcggttcgacgagtgagcgcattttgtttttgattttggaattgatttggccaatgttcgcgaaaaacattggttcgatgtatttgatggcggacactttcatgcgtttgcgaatattcgaagcgtcatttctcagcaaatgccaatctcttcgcattgtcaaattttgcgatgacgacaatttcttcatcgaattcccggccgatgaccatgccgcggcatcggatggacaagtggtggccaaatggcttttcactgccctccctgacaatgtgccgccgaagatgttgaaatgctcgttggacaaggatgatggctttttggagtcggacattgaagacttcaaagaggtgatttcggattgtttaatccagcacttttacgctttttgggattcgcttacaaaaatgaatgatttctcgcctaaaaagacattttcgaatcaaaaacgtcccatctgttggcattttattattaaatggccgagtgccgtcccatctttggctntttgtgccgct

SEQ ID NO: 12655 - DNA, 3461 bp, Heterodera glycines
caaattccgcctattgtaaaacttgacggatgtataaaaaaagaccatacaaaaatccgcttatttgtaaaactttacgcacttaaaaattaatacaaattccgcctatttgtaaaacttgacgcatgtattaaaaaagaccatacaaaaatcagcctatttgtaaaattcgacgacactaaaaaattaatttaaaaaatccgcttgtttgtaaaacatgatgctcttaaaatgacttatttgtaaaacttagtgaacttaaaatgattacaaaaatccgcctatttgtccgcctatttataaaacttgaagcacgcattaaaaattaatttaaaagtccgcttatttgtaaaacatgacgctcttaaaatgatacaaaaatccgcctatttagcctatttgtaaaagttggtggactcaaaaaattgtaaaaaattcgtttatttaataaaatttcttaggcttttgctttgtgtatgaccaaagaaatttaaaaatttttaattaattttttcaactgactgggaacattggatctgcgcaaccacaaacgcgcacaacctacaaatacacatactcattaattaattaattttattaattaattggctaatttcaaatattttgcacctcacgttgtgtgcaacttcgatgacaaccttcgattgaataattgtaattctaaaattattagtttactaattttgcatcaaaatttttttaattaaaatcatttagttattaattaattcttttgcctacttcttttttgttgtagatgtaccattcggcacgttctccgccttcgcggcaatgtccgtatgggtgctcgaggcggaaaaattttttcttaattaattgtttattttttaatttttaagcatttttttggcataccatacgtacgccaaatgctgataaagtgccggtgggtgcgttgtaaccaaacgcgtccacaaacggcacagtccatctgggaaataaagtgatcaccgatcagcaagcattattagggccaaaagttaatcagaggctcattaataaatggccagacctttgatcagcagatcaattaccaaaattaatcggaaaagtgcccaaaataattgagttaatttatcaatgccaaaattgttcatgaattagtcagttaatgcgcctttatttccctatttccccaccccgcctaatctttcccacttgtcatgcacagtgatgcgaaagccgacagcttctgtgatgggcaaatattcggacacgttggcgtaaaccagcacacgaaggcctaatacgttgtttaattttttaaatttgttattcatgcaagaatctaatagggtgcatgtactgtatttaccgtaattggcgcctgcccgatgggccgtcacttgagcattacggtcccaattgaaggtgtaacaattgccataggtgggatcgtggaacaacttgaagtccctgatgagggtatgaattttcataaatttaatcataaaaaaatagaaaattcatttacggtattacagtaaattttggaaaaattcacacttttcaatatcacagtcatgttgattgaatgagcatttgaggatcaactcgtccttggcttgcgagaggcgaacccgttcatccaatggcttttcctccactgcaaaaatcagattttcgcgcgcttggcctttgatcgcaatttcgtcgtgcaattcccaaaaaaaatcttttttttaattaaaaaaaagatttattaaatcttttacacctcaaagcccatggcttgctcaatgatctgctgctcttccgtgtcatttgtgctgctgttgctggtttcatatgtcttcagtgccaacaccacagcttgggatacttcgccacggcgtcgaaccccctaaaaataatacgaatccaatgaaaattcgcaagcaaataggttccggtacaggatccaatacgttcccccccccctcgcggacgagttcgccctgtatcgttgttccccgccacccgattttataaaaaatttctagcgatttttgtaagaatttttgaaaaaacttgtaaatcatcaaaaattttcaataaattttttttaattttttgtcttcaaacttcttattaaaaaaatttccaaaggaaatatatgaaaggggggggggagctgcttctaaggcttatggtctgcgctataaaattatgccaacaatggaatgtgccaaccgacttcagtcagatggctgatattcaacaggttcaggtcatcgcccggcatcattgtggaaccaaaaaacacagcgacaaaaaaatggaaagaatttctcttaatgcgtaggtggtatataatagggctgcacgggtccgggtatttgggcaaaaaccgggtccgggtattaccgggtattgaaaagccgggtaccagttttcaaaccgggtccgggtccgggtaaaaccgggtattaaaaatttttcaatttatttttttttcaaaataattaccaaaatgcctttaaaatataaactaaaaagatatttcaatcaaaaatcttcataaataagcagttgattattctccaaaatcttcaataaggttttcatcgacaatcacttcctcatcaaccgcttcatcatcctcttcctgcaattgagtattaggtgcaagcaaaagctggtccaaattcgcttttataatcaaaattttttcgacaagttcaccagataagctaaaagagaaatttttgtcaagtaataaaattttgaaaaccaatttcgaagcctattgctataaaaaaaaattaatcaatttttttatttccctcaactttcacccagacccccattcttgccagtctattttatacccggttgaacccggtcctaccgggtcgggtattggattttcaaaaaaccgggtccgggtagtgaaaaaaccgggtatccgggtatgggacccggtcgggtacccggacccgcgcagctctagtttaacccaaacaatcaaaaaaaatttttaaatttaaagttggtgtaatgtcggtttttccagtgtcggattatctgcttgtgtcggattttccagtgtcggattttcctagagccgttttatcggcacctgaaagtaaaaagtctatacttttttatgatacagaacttcgaaatagcattctctccataataaatcgaaaataaaacttattgcacgcattgatcagcgtaaatctcataaagcaaattctgtttaagaatccaagtgatcagaccgaaatcaatttatagagttggctaaaataaggcttcaagtgatccggggtattgacaattacaatatggggcattatgacagtttatggacatgctgacaacgcaatacattgcaaattcagcccggtcgcatggtgtagttcagtgtatgcaggagggcgttgagcgcgttcacgttgatgttcagctttgacgccttgctttgtgca

SEQ ID NO: 12656 - DNA, 990 bp, Heterodera glycines
tcctttgatcgaccaaatttctataacaaattaatcggcctacgaatcagaaagataaatattagactggtgttttttcaaataaattatatcattttaaaaaattgaatttttttttccttttaaaattctttattttatttcagtgacgaaaagtttagtgacgaaaggttcagtgacgaaacgttcggccacccaaaaaatttgggtatttgaacatttttggccataagttttttttgaaacttgtcgaaattcctctcttattgcggttctatttttctagagaaccgaatttttggtctaaaatcaaaggcgttaaatttagagtctcaattcgaaaaattgagaggatttcaagttagttaagcgaaaatatctttaaaatgaatttgattaaatttcttgtgaaaattaaataagaaaaaaaagaaaagtgattttattatattggaaatctctggacaataaaaaggcaaaaaattgtcaatagaattttggccagctaaaagtaaaacggcggcctaatgggttatcggacgttaagtgatttattggccaaaggaccgattgttggccatcaaaacaaaggcgagatgagtaattaatgggccgagtattaattggtttttgtttcctgtggcggatttgttgggaatttttatttgaatttccgattaaatattttaaaaagatggtaaaaataggaaattaactgtgaattaaaattattatttaaatattctaaatttcgaagcaaaattggagagaatggcgcaaaggaaatggaaattgtcaatttcaatggaaacaaattgccaatcacgcaaaatccggtgccgaacaaagtcatcggattcagaggcatttcgaccgagtaaaaatgaattgaatttgataatttatttatgcacatcacactttcttttgattttcagctatttcgacaaaaatgtgctcactttccttcgccgttttcaccgttttttc

SEQ ID NO: 12657 - DNA, 1022 bp, Heterodera glycines
acaaagccctaaatgaacactaaaattgtgctttttcttcttctcccacttctcataattggttgggtcacgccgacaaatacgacgaacgaaaagcggaccgataagggaaaaggattacaacgaagtgcagaaggctctgcctttagcgcttatattaaatccgcttttcgtccgtataagcaaaaagacaatggcaaaaacgcgaagaatgaaactgatggccagcagcgagcggatgtgataggagacaatgagaagttgcaagcggttgcggcagaaaatgttgatgaacagcgcgcgtatacaacaggagacaatgagctgttgcgagcggtttcgacaggaaacagtgagcagtcccgagtagttgcggcacgggatgatgatcagcatagagcaatttcggcaggcggtgttgatctgcaagaaatggatgcggttgccgaacccatggacgtttcagcagatgggtcgcgcagtgcgaaaacgcaaaagccaagcggcggcggagacggaagcacgacgtcgatgcgcaaaagcggtgtaaatcagtcgtcgcttggccggcacgaggacgcgcaacagtccagcgaggcgacattatcagcggacacgccaaatgcggggaataatggcggcgccgaaaatgacgaccacgaaatggccgagcgggatggcgaatcgcagaagaaaacgccgaagaaaaggcgtttaatcaaacagaaaacaatggaaaagtccagcaaacggtccgctgccgaaaagaaaaagaatgtggacagtgtaagtgccagggttgtacaatgagctctactgctctcctctaacagtcgcacaaatttcgtagtgatacgcattgcaaaactcgaaaaaataaaaaacagcggccgcgggactaaaaattttttagatattgtttatgtagaagtatttaaaaaattgaattgcttaaattcaggactagcatttggttacaattttaatcattgtccgtatttcagcttattgtcctgatttta

SEQ ID NO: 12658 - DNA, 3504 bp, Heterodera glycines
  misc_feature (3327)..(3327): n is a, c, g, or t
  misc_feature (3369)..(3369): n is a, c, g, or t
  misc_feature (3443)..(3443): n is a, c, g, or t
atcgggatcacacaactttcccttattaataaaaaaaatgtccttgttttgaaataatcattaatatttatacccaatacatactattttctcatttttgcaccattttgtgcgtttttagtactgaaaagccaaacattttgcagttttttttaccaatcatacgattttttgtttctcagctttcaatggagcgaagtgtgaattcgaaccctttcaaaagtgcagaagatgcgccatcattagcctcaacgagccaaaacaatttgctggaagcgcaagtcaaagagcaggccgcacaaattcaaaaactgacggaagttttaaatgaactacagcaaaaagtgaatgttggcaaagaggaagggcagcagagcacacaacaacctcaaacagtagcagcatcggtggaacaacaacaacaactcctacaacaattacatctgtcccaagagccacccgaacaacttggacaacaacaacaacagttgcccatggcacaacaacaacccgttgctgatgttcctttgcagccacaaaatgccgccccattctcagttgctcaacaatcgcaaccacaaccatttgcctctgttctagacccaattactcgtcagcgtctttcagtccgaatgataacagctgggcaactgttagccgatcgtcaacaacagcaacaacaacaactacgaatacagctacaacgacgaatgcagctacaactgcaacaacaacatgagttgatgggttcgccaccggcgtcacgttcgtccagcccaaaccgactgaatatacaacatttgcagcaacagcgaccacagccagccgctagacccctgacaagttccaacgtaagcaaccggctaatgtcagacttataaaaaaatacttacaaaaaatgaaaatccccggatccggaaatgtaataatagagttggatttaaaaagtgctataataaccgcccaaaatttaaaaaaattttcactagacttccctaaatatgaaaactttcctatcaaattaaaaaattgctaaaaaaatcattgtattttaaaacgactcctgttttccctcttgtaataaatattttaattgaatattttcataaattattttttttttattaaaaaatcgggttttaaactatttatttgtttttgtttttaaattattcatgctttgttaaatttttttaacgttttgggattttttgtcaataaaagctgaatgtaatataataaaatttttcaaaatcatagctgtccccgatatcaaacgcgcgacgtgccaaggagcagcaacggaagcaacaacacgatgctggcaccagcagtgggtcggttgctggtgaagtgcaacaacaatggcaacagccgcaaggtgactatgccattgatgcaacaccgctcagagcgtctataccccttcgcgaaggacaacccaaccaagttggcacttctggtgccggtccgtcgggctacagcggtgatcagcagcagcagattcaacatctgcgcatgagtgccaatgtaggcggaaatttagtcgagagtcaaagaagacattcgagagttgaaaaggcaaaagtaatgttgttgcattggtaatttattcaattaggataaatcgttttaaaaaagtttaatagccgtcagggctttcgctttcgcaaattttgtactctcgcgtttcgcatttaggcatgaaatgcgatattacacactaagaatgagggatgaaattcccctaaaattttcaaatttggccaacaaattggcaattttcactgaaaaccttattaaaaatgggcaaaatttccaatttttcaccgatggcgtctaacggcaccgcaggaccccaaaaactcatatttttttttaccaaaatggcaaaatttggtaatttttggcggaaatctgttaaccaattgatttattttcatttcgcttttttgcttgcgcaaattacgctttttgcattttatttttcgatttggcccatccctacataaaagatgcaccaatttatgtttttaacttttattcatataagtttttttattttatttttttaaattgattcactaattgagaacagaaaatcccaataaaaacatatataaactttataattgaagtacataagtaataaataagatttgtatgattaagagacatatgttatagaacaagttttttttaaaaaacaaactttattgtcgaaatcaatcactgtcgagatcactcaccactgtcgaaaactaacagcaccatttatcatgcttattttgccaaaataagtataaaaaaggtgaaaactaagaatagaatgccaaaaaaaaagacttaatactctttgaaaaatttcttgagtaggcgattgggtcggcggtgccgataaacgtcgctgtcgaaaaagttatctcagacagtatttggcataaggtcacattaaattctcaaaaaaagaagaccgcgggataccgctcaaaacccaaatttgcagaccccgctgctggattgagattcaaaatttttgagggacgagattccgcaggataaatccagcatttccgtaaacctcgcaaatcccgcattgcacaaaaatgcgaattgcagtgtgtcgcgaaaatctcgcgcggggtcccatcccacgccggtctcgattaattactgctaaagatttgaactaattttatattattatttaatttaatatattatatttagcaaatagccgtaaccgcggcagcatcggatgataatcaaattaagaatgtggaaaaaattgtattacaagcaatcaaagaatgtatcaaaaaaacgctaacaaaaagtggcattgaaccggaaatgttcaacctctcattaacatcaaacaatgaatcaaacaataaatacctaaatttcattcaattaaacagggacaatcctgatgacataattagcgaactgatgacctttttccaaccgaataatggagatggttgtggtgatgaggcgacgctaattatgcaaattttggaggagattaccacggaaattgaaagctttgacagcaatggtccgtcgtcaaattcggcgtcatcggtggaaagagcggcccatcatcagaagaagcgctttttgttcgcaaattatcgcctctaccacaaattattgaagctgctcagcgcaactgctcagcagctgaaagatgggcttagagaagcgcccaaccactttcaacaactgcacaaatgggtcactgcgatggtcaaaggcttccgacaaattttggagaaatttgagaaacaaaatggccacgatgaagtggggaccaaacgngaggggcgggggggggggcgggggggtgttgtgcccctgtangggggcataaataatcataataatttgaggggtcgtgagcagcgatgccgcaagtgttttagtgcttttttggntccgtttttcataatttgagatgaatacgaactgacacgactgttccgaattcagtttggc

SEQ ID NO: 12659 - DNA, 1363 bp, Heterodera glycines
tggattgagtcccgttgattggaatgttggtggattgagtcccactgattgaaatgctggtggattgagtcccggcgattggaatgttggtggattgagtcccactgattgaaatgctggagggttgagtcccactgattgaaatgctggagggttgagtcccactgattgaaatgctggtggattgagtcccgttgattggaatgttggtggattgagtcccactgattgaaatgctggagggttgagtcccactgattgaaatgctggagggttgagtcccactgattgaaatgctggtggattgagtcccggcgattggaatgttggtggattgagtcccactgattgaaatgctggtggattgagtcccggcgattggaatgttggtggattgagtcccactgattgaaatgctggtggattgagtcccgttgattggaatgttggtggattgagtcccactgattgaaatgctggagggttgagtcctgttgattggaatgttggtgggttgagtcccagtgattgaatgctggagggttgagtcctgttgattggaatgttggtgggttgagtcccactgatttgaattcgggagaattgagtcccaatgattgaaatgctggagggttgagtcccgttgattggaatgttggtgggttgagtcccagtgattaaatgatggtggatgtttagaatgccgcagatttgagtcccagagattgaattgctggtgggttgagtcccagagattggagaaaagccaagaaaatgatgcgagggcgcgaagcggccgagccagtcgattttatcattcataattctataacacaatcgtactgcctagcgggggatgcgccgaaggcgctgaccccgctagtcagataaattgaattagcgctaaattatataatttttggcgtttcaattcattttgtcggcgctagtttaaacgctgcccgtcatttcgtcccgcgtcgtttcgtcctgcgttgtttcgtcccgcgtcgtttcgtcctgcgttgtttcgtcccgcgtcgtttcgtcctgcgttgtttcgtcccgcgtcgtttcgtcctgcgtcgtttcgtcccgcgtcgtttcgtcccgcgtcgtctcgtcccctaagccaaaatgagtcgtttcgtccccaaattaaattcttttttaaaaggttagtgcttattttggcattttttagagcctaaaaatccgatccccagttaatgaattaataaaatactttattaattgagcaaataacataacataattgaaaaaacataaatcaaacaaattctaaggggcattcatcgaatcttccgtattttcatagtccttcaattttcctgcgtatcct

SEQ ID NO: 12660 - DNA, 2266 bp, Heterodera glycines
cgttgcgtactttcattttccgccatttcattccgtcttcgtcttccattttcactattatttccattgcatattcgtcgtcattgttcaactgcgctgattcgcatggtaaagtttttttcatgaaatcattttacagtgatttttttggttgtaatttcatcatcgtataaaatttaaatccccctcccatttacgaatttttgtttttaaaaatgatctttccactggggattttcaaggcgctgatcagtgatcacgaacgaacctcttccccttctagaaaatgttttgtacgatttcaactgaaaatccgttttcagaaactgaaagtcatctttccacggggattttcggggtcactgatcagtgaaatgacccccccccccctgaataaatgttttgcacggtttcaactcagaatcctttttcaataactgatttttccccacatttaaggcagatgctgaacatcccactgatgctgctgttgtggacaacttcgagacgcgcgctcgccgcttcttcgacctgatcaacgacggcaacatccaacacttgtgacagatcgcaaacggaaattggtagagagacgaaaatttgaaaaatgccataattttacccatcatttttctcccacagccgcatttgccatcggacaacgaacttcttcttctgctgctgcttcttccccggttcaattacatcacagaaagcaagcaaaggacacgcaccaacaacctgcgcaccctctgtcagtgcatggcacccgcattttgttgtgtttgagtctctgaatcgcatccctttcccctctttcagcactgatgatggcaccggcaacttcttcctgagcgcatatgccatgtcagcgcaaaaaatcgccagcgattcggagtggaagaaaacggtgggttttgggggatttggccggaaattttttatttttaaaattaattcatttatttttcagcccatcggacaaactggccttttcaacatgggaaacacgtgcttcatgaacgccactcttcagccactgttccatacgcccggattttctcaactgttccaagaaaagagcgcgcagcgattcgtcaatgggtgcgtccgcagtgccggggccgtcttcgaattttcataaaattcacaatttgttttctttttcaaggaacaactcgtttggcacgaaaatgtcttattttaaaagtaaggcaaaaatgccttaagtactaagtattttcaaaattagagccgaaaagaaaaaaagtaaagccaaaaatctttctttttcaaggaacaactcgtttggcacgaatggggtgatctccggctcattctctgcgctcaacgacctgatctggtctggcaagttcaacgcacttcggcccaccgccttcctggtgagtgactctgtgcctttgatcaatccattctaatcaaatttttcctttttttcccaaaggaattctttgctcgccgtgtcaacgccgaaatggccaaccgacagcagcacgacgcccaagaatttcaactctatctgctggatgcgcttcacgaggacaccaaccgggagagttttgccattttatgttccatttttcacgctccccccctccccattttcaggtcaacaagcgacaatcgtttgaacagaactacgacgacaccgacttgggcgccagcgcttcggatttcaatgagagggcgaaactgttctcttcgtcgccggtcaacgatctgttcaacgtgagtttggagccataattcattttgtttttccgccgccaatttctaatcattttcccctttgtttcagctgacaaacatctacagggtccaatgcagcacgtgcaatacgacgagtgctcgcttcgaggtcgtcaaccaactaaggtgggtttgagtcacagacccaaagaaaattccctaatttgaatttccctttgaatttttcagcctcgaaatgctgaccaacatcgacggcctgacgctcaaggactgcctggaggcgcacttttcatcagcagtgagcagcaccacagcctgaatttgtgtctgatcccattttcccctccctttttcagagtctcgaggataaatgggagggattgtccgaagtgcaaaaacaaacagccggcgacacggagcacaaaaatttgggagattccgaaggtgctgatcgtccatttgaagagattttcgctgattgatggacactacgtcaaaaatgacgtaagtttccgttggggttttgagcgtgttt

SEQ ID NO: 12661 - DNA, 2952 bp, Heterodera glycines
aaaagattttgagaatgtataaggtttggtttttttcccggtgatacctattggcactgccattcgcattttcattattgtccaacttgccttggattttcgccggttccgctgttggctgtgttgcgtccgcgggtttttctgtcgttgtttgcggttgttggaccacttcttccactccctcctcttctccgcccactttcgtcttttgctgccgttcagtttcctcaatttttcgtccaatttgaatttgatcattttgctctttttctgcttcttcctcttcgtccctttcctcctcatttccgctttctattatttcttcttttttcgcctctttcacggggtgtggcgccgttgggggtgcaattgcccaagaaaagtgtcgaaatgttttggcggcaactggcgaagatgcttcttgtctatcaaagccagcaacattctcatcaacttcaacatcgagttgctaaaaattgtgtcaaaataagcaaagaaagacaaaaattgttgtaaatatgtaactataaatgttaaattgcctgtgcgcaaagaagcagataaacgaaccttcctctttcgctttttgagaggtgttgttggttctgaggcgggcgatggatcgaattttgacacaaatcctcctgcaagtctaacatattcttggagacgaaaagccaaatcagctgcactgccttttgtatccagccctgaaagtttaatggtaaggtccattaactaattaataacaaaaagaatgcgcaccgcgagcttctaattctttcttgactcttgccattgggagtaaatgaatcgttgatgggttcagcccacccgaatccacaattcccgaacgtcgcgaacgcgttgacgacatactgaattaggtatattgtacctaaatagaaaataaactaaagtgacaaaaccgaaagcacaaaaaggaggaaataaaaataacaaaattaattaattaaggaacgaaaagtaacattaaggcacggcacgcgaccaaaacgaataaaaggcgcgacgcgaataatgccaatgtcaatgcggaaggaaaattaagagatacgaaaaagaagaagaggaaaagccgtagaaatgtaagaaatagagaaaaaggaaaacaatcgttgcaatgaattatccaagcaaaagaaaaagtcacgccaaaaagtttcttttaatctccgccgacgcagacactaattgtaaaagcttttgtttttgcaatgatatgtgaatttcaattaatttcacagtttattttcacagcctttttcgagaatggatggagttaggaattggagttgccagcgatgtactcttattaatagaattaacgacttaaagtgtagagcgtgccaattcgaatgtccttcagtaaatgggcgatcaaaatttcttcacaaaattaaatgtttgtttatttttattgttagctaagagtaaagctttaaaaagttttttagtaccacatatttccctcaactcggcattggaaaagattgacaatgccattgattttgttgcaaattcaatcgtaccaaaaagtgaacaaaatgtacacttttaccatgctcccgttgttttgtgcgagcatcctcaacccaagtctgtgaattggacatgtccaagctgtgcacagaccaacacttcgacattgaagaagtgttcatggtgtgacacggacagagtcacgggtagttcaagcgaaattgaattcaaagcgtagataggtaactgtgattgaattaaagatgttacaacttggtactggtgctgtcagaattcgaattgtgctcttcgccagccctttcctccgttcgacttaaaatgtcctttatgccgaacaaaaacttcagcaatgaagccgggacattccaagagtatggtgagggatttatattcgtcaatcaaatgctttaaagtgttcccatataaataccacgatacaaaaacatctaatgccatgattgtatggattaaccaagcaagaaagaacaaaacttatggcataaaattaagtctggccaattattggtgttgtgaccgagcagtagtctattgctcggtcaccacaaaaaaggaacttcaagtttttagctctgaattgagcactaagtcacaaacgaatatcagaatatgcctcacccgactgatggggatattcgctcgacttttcagtgcttttcacctacttcctcccctttatctatactttttggtgcttatcagcactacaatgctgccgtagtggcgtaatgtggaccgtggcggccttatggaattaggttcatcaaaccaatgcgagagctcagaggcccgcttgatgaattgctcaagaaggaggccaaatgggaatggggagctgagcaacagaaatcttttgagaaagtgaaagaaatcacttccaggccaaagttgagtaattgccgatcacggccaaagaaattgctgattcatgaaaacggacgacttccttcaaagatcagcaaattccccgctcaagaatggccacaaaaatgcacagacactgatttaatgccatttatcaaaaaagagaccaaataaccgaaattgatggctgtctcacgtatggggcgaccgtggggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttgtgccacgcggcgccgaaaaagcaatgaaaaagttaatttttgaggttttttggccataacttttttgtaaactgacgaaattttttgaaattttacaggctaatagagaatctgaagagctatcgaatgataacaaaaatttttaatttggttgatcagttaaa

SEQ ID NO: 12662 - DNA, 2044 bp, Heterodera glycines
gggcagcggaattcgcaagttcttgcaattatgggcattctcacattcattcctccatttgttattttattctctgctgtccttctccccatttacctgtttaataaattacttattatttgacaacatttggatttggtcgaaggtcaaacattttattgttgtagtaaatacacaacaattgggagcctaaaattcaatatagccatcacttccttttttgggccttcatactcctatcatttgaaattgtttaagccacaactcagtccttcttcactgaccacagcaaattcgtcaaattatgcgccgattgatgaataccagacaataatgcacagtcagaattatcacgagataatggcgttttgcgagtgggttttgccgtttttattttcagtatttttatggcgctgaatgagttgttactggaataaattgcttatttttgctttttctgaaacttttccttaaatagaaaaaatgaccaatttttcgtcgacgattccttctcccagtccaatcgttcggttgggtcacttgcccaattggagcgcagggacctcgccatagtttggttacagcccgaccaaattgtcacccgtgacggtcgactgtccaggtggtctgtgtttaacgacccccaaccgacggacattgagcaaggtcatcctccccaattcgcatctcgtcatgttccattgtttaggtctgcttggcaattgttggcttttgtctgcgttggctgtcattgccgaacgacccgacattctcgagaaactgttcattacgaaggagtataaccatagaggggtctacgaagttaggtttgtggcaacataattttggtcttatcggtctttattaggctttgtattgacggcatttggcaacgggttatcgtcgacgattttttcccatgtcatcggtcagatcgacgcctgatttttgcggttgggaggaaaaaccaactttgggtgtcattgattgagaaggcacttgccaaagcttatgggaattatgccattctgcgagctggacgaactgtggaaggcatcaattttaaatggttggggtaattaccataacattttgttcttcattaggactttcaactctcacgggtcagccgacactttccattgaccttgaatatttggacatggaccaacagtcccggaccgctgacttggacatcgcttgggctaagctgataagtgcgagagaagcgcgctttctgatgggatgttcttgtggtgctggtcagtttttttgcaaatttatcttaacttcgaactttttatgctctcttggatatttgtgatatttttatgtttaaattattttggcgttatgctggcttccttttttaaattgttttgttaatttcgtttccctcagttcgtagttattgtgtttttagttttattgttcataaatagggctgtcaaaaatatgtacgaaaaatggtcataatatgtacataaatgtgtaaaaaaaatctcgaaatatgtaagaaatatgcatgaaaacccaaaatatgtacgaaaatatgtaaataaatttttttaatggttatttttttggaaaaaatcttcgtaaagtgttaaataggcacaaaatggcagaaaaatgacctaaataggtttagaatcaccttttaagattttaaaaattatttttggtatttttaggggtacatttaaaaaaaaagttttattttttcacaagaaatttctaaaaatttttccaaagttctcaaaataggtatgtataaaaaataaataaaaatttgccgaaattttggattttttttgaggatttctaaaaatttccgtaaaaaatcctcaaaataagttaaaaaaatgaaaatatgtaagaaaaagtccaaaatatgtaccaaatatgtataaaagcccgaaatatgtaaataaaagtcccaacttttgctcgcaagcacaaaaaagaaagtgtttttcctactatttagagcattgagaatccaagaaaaaaatatgtatttacataaaattaacagccctat

SEQ ID NO: 12663 - DNA, 3631 bp, Heterodera glycines
ggaatgatttcagtcctggaaggggtactgaaaaaccttgggctttattgcagcttgcacgcccataaaataatttgactacttaatgcaccgtaattttttctagaaccacttaaattcaatattctattatcaatatttacaaaatttcaaaaagggtcgctatgtttcaaaaaagatgtggccaaaaatgttgagaaaagcagtttttgagttttctggcataacgaaattttttgaaattttgcaggctaatagagaactcttagaactatcgagtggtatcaagaatgtttaatttggttgtttataactgtaaatattaaatgcttctgttttcagggaccggttccgctacggtaactacaaccgctactacggtgtgcgcaaccaaggctttgaccacgacccgtaagtgatttgttgttcagagaacggggctatttggattttccctggatgctgaaccgagcaattcggcaatgttaattcaagaaaataacctaatttgtattctcgaatccagtctaattcccgtatcccgcccgacacaaaattcaaggagttcgaccattgtactaacgcattgtttaaatttccatttacagccgtgtcgacttgtttcccgtccaatggttccatgggcgtcgcgtgttggacattggctgcaatgttggccatttgacgcttgaaattgccaagaagttgggcccagcgcacattgtgggcattgacattgacgaccatttggtcggtgtggcgcgcaaaaacattcggcattattgtggcagcgcgcaaaaggtgcgtgaacagccaacgacgggcttttgaattgtaaatgagagcgccaccgaatgacttaaatttcatttttcggtgcccaatgactcatcaaccaattaatgaattaatattataaacggtaattccttggcagatagatgactatggttttacgtatttgggtttattccaataaaacacgcttttcttacaattagctgatcggcaaattccccgcctcactgttaccaccggcggaggaggcggaagcgtcgtcaacaaatgctgtcaacgacgacggcaaaagtgccacaaaaatggagtcggaaaatgggaaggaggaggggccatcttcgaccaccacaaagcccgccgttctcccatatgggcaattcccaaaaaatgtgtggtttttgcgcgaaaattacgtgctcgactgtgacgagttccttgaaatggttggtccatattggtttggtatcatatttttatcataataattagctaattgtaaccttctttgaaagtccggtacccaatttaaaaaaaccaagccttctcttggtctatgtatcataggcgtaactgaatttcacatgttacttttaatcatcgacatttttcgggaatgccatgggtttttattggttgacagaaattcgaatgttccccaacgggtcattaattgtcaatcaaatttgatattagaaaacattttcagtgtttgtttttttctaattttctccgccccaaaggttcgcgaggagtacgacgtgattttggcgctgagcatcaccaaatgggtacatttgaactggggcgacgatgggctgaaacggttcttgcgtcgcacctttttgaaccttcggccgggcggacgactgctgttggaagcgcagccattccccagctattacaaaaaggcaaaaatgacggtgagtaattggagaatttgccactaattggtggcatttgttttttgaaggcttgtcagtatgtttgattttttacaaattggtattttcattacagtctgatatgttcgagacgtacaaggccatccagttcaagccgtaccagttcaaggacttcctgctgtccgacacggttggcttcagcgagtgcgaagagttgggcacaccgacggcaattagcaaaggtaaagaagaggagacagtgtttagtgcataatcattgtcaattgggcgtcttttaagttcttgggttcggcacttttagaagcgcgggaattggttttgcaaattgctcattcgaaagcgctcctcctctccgcttaaaacttgaaattactatgactaaaatagtcaaatttgttacaggttttgaacggccaattttggtgttcaagaaggcgtcatcgtcgactacaccaacaacaacaaagcggaaaagggagagatgtcttcgtccgtaaagggcggcgccgagtagttcatcttctgcagacgatcagacacgggaattgtgacgaatttatttcacgaattggacatggatttttctcccgcctcaaatcgatgtgtgccaaaactccattccatcccatttattttgtttgtttgttaaacactttgttcattttaccatcaccatttttctatttttatttgaataaaataggaaaaaatgcaaaaaacaaaaattgggtagttccgcacagcccaattgcggaggcgcccgggagaaactgccgccttcggggataaatttttgaaaatttccatttagaaatgttgtcgattctaagtgtggttcttgttttttttcgtttttgttgcattttcacacaaactaatacataataagtcttttatcataattgctctatcactctttttacatacataaatatcacaaaacaattaaaataaatgattttgatggcatttttgtgccatctcatcgccatgccctcgtccccctgctgctgctgctgctgcaacatttgctggcaccgtcgctgttggttgccgcaacaacaattcgtaattgtctccgccgctgtcgtcgtcagcgtcttctcagtcgcccgttgcggtgccgcaagtgtcgctgatcgccctgagcagcgggtcggcggaacgcgtccgattcgaagcggctaaagcagtggcacgtcgcccagtgcatgtgccgccgttgctgccctctgcggcatcgccgctggaattgtcgtcgcgtgccatgcgccgctcgggcgacgcggtcatcgcctcgcgccactcgcgtcgcttccgttccgcgtcgccgccccgccagcgcttcttgctgtccctgctgctgccgtcctcgtcctgatcgccgtcgttgctctgcatgctcgccattttttggcgttgccaccactgtcgctggctgttctccagcgcgacacggcgcaacagattggcaaccattggcggtccgccaccattcgtcgtggtgccgtcaccacaacttgtcgtcgtcgttgtcgctgtggtcagccgcgacgatggcgagcaacaggacgaagaattgaacgagggcggcaacggtcgccaactgccggcgccgccgttcagtcgctgttgttgcaaatgcagcggcagcgactgctccgacattttgcgccatgtcgccggcgactgttgtcgctgttgtgtcgtcgccatgcggccaacagtcgccgctgttgtgaaggacactttccgcagctgttgctgctgctgttgttggcgtattgtcgccgtttgttggccaagcgcggagtcggcacttttgcgatgtatgttattgttattgttgctgaagttgtaattggcacacacgttctcctccccgcgcaatgcgtctgcaaaagtgataa

SEQ ID NO: 12664 - DNA, 1592 bp, Heterodera glycines
ccagtttttataacgcattcataaaatccaaattttgccgccgccaaaacatgtcaatgggcgctaaaagtcacttattcttttctgtccaatattcctagcactaatctttgctgatcgccccgaaccaaacaaagaaaagataacatctgtatggccattttgacaatgagtcaataggacggaaagaatttcgtttcacccggattataaaacttgactagaagtcattgatggacatcgagtggtgaagtccttttgttataaattacttggttttccctatttaattttgtgaaattttaattttttatttaaaataaatatgaatttattttgagaaaataaaattatttgtaaatttctttatttatcttaattattttttttaatcatgacattttcgcgttgtcattcattttgttaaggcgaggctgagtttctttttgttaattatctaaattatttttagttttattttccttttatttatggcttttttgttttttaaataatttaatttatttgtgttctttatatttttttctgaaaattaattaaattttgtaaaattttaaagaacaaaattcatttttttttcttttttttagctgaaaatgtagtaagactcaataagacacggcaaaaacctaaggagggtctgactagtcccccccccccctccggcctctttatgatcacacacatatctcttatgctctcatcagtccaaattggcatcaccccccgccgccggggcgacggtggcggcaaaaagtgcgaccaattaatggatagacggaatgtgacaattaattttccccccgagcggcgtggagtctcgagagtgagtctcgaggatcaacaacattcttcactcaacacccaacgagacggttgttgatcaaagtccaacaaccaaaacgtttgtgttgttgttttgggaataggaggacaaaaataagcaaataaaaatgccgtaaatgccattggcatttttcgtcaaaacaattttttttcacaaatggcgaacacaccggtgagaaggttgttgagaagagtgctgggcaaacagaacatgaggatcaacaagtcggcaatctgaaaaaagacaaaataaataaaaaattttggacgacgaattcatggcaaaaataattgccggattaaccgggttaatgagggaaagcttagaaattagttaaaagaaacgccattttcgtgaccatgcagcgaccaccgttaaccctcaggaatatgttttcacgatttaaattgctaaatgccaaatctccaagaaaatcaagaggtggtcagctgacaaagacctttgggcaccacaaactttggcaattttacagaatcaatttaaaattattttttgtgccaattggcattatgtccatcacacataaaattcaaaaacggaccgcaagcgatgaaataagccaatcagtggccgtcctgaatgttttgttcagcgcaatggcagccaccacgaacacgttgccgaccaggccgcagaagaacaccgcggcgtagaaggagacgaaaacgggaagagggagggtggcacgcgccacgtgtccaaa

SEQ ID NO: 12665 - DNA, 1325 bp, Heterodera glycines
attttgggtattttaattaccattttcacagattatgattggatcagggattttgaaaaattacttcgcgatgatttacatccactctccatgggtcaatgacttatgctctttggtgttgtcaagttggctattgttttgcacatgcgacacttttcggcaacaattcttcaaggatttttgcccaaaatgcatttatccgacccaacaaaacgtcataaacacaacgccaattgtcatcatagcgccaaaccagaaccaactgtttcagaacttataatttttaaatgaaaataaatgagcggttttaattcttttttcaaagagatatttattttttatttttcccaggttaattacttatccttaacactatcaatgcgcggatttgaaaatccagttgaattctgttaaccgattttgtctttgagtgcccagttttgtgatttttgtcttgtcattaaattttttctggtcataaaaattcattttatttaaatttaattcttttttccatttgtatattttatggcgactttcccctaataattttccaatttttctctcaatttaacgctatttttctgttgatgttttatgttttcgttctgcttatctttaattgcatcacatttaaaatttggtcggattttacctttttctatttttatatgctatgaaataaaataataataattagggttgcaaccccgacgtcggggttggaaaattcggggttcggggttgtcggggttggaagtgtcggggttcggggtcggggttgccaaatcgttcggggttcggggtcggggtcggggttttttaattttttattttcgctatttaaggttcattttttaaattttattcaggtaaatgactcaatatttttaatcatcattaatcatttcattttcataatcaatgagatcgataggatcaggttcaagaattgaatgcacaatttgagcaatttttgccaactcaggaaagcgaagtcctttccttccaccacaaaaatatgtcagcatcaattccaactcgttcaacatctttgtaaagcgctaattgagcttcaattttggtgccaacggcgggggcaggttctccagaaagtgttgatggcgtaattgatgaacagcaaggagattttgggttactgttccaaatgtccactaaaattttaaataaaaattaaagtttttcattcttgtttacattttaaagcgctctcatcactttcactaaaatccgtaaaatgagcagattctgattgatccatttgttgtgtttcggttaaaattttgcgcatttggttcattttc

SEQ ID NO: 12666 - DNA, 1689 bp, Heterodera glycines
ttcgtgtactttgtccgtaagttccttagatttaggcccaattttgagtacatcatgcgccacaagatgtaaaaaatgagccacacattgatgacttaaattttcgaataattttcgttcttataaaatgttttacctcgattttcctaagaccctagccattcgccgcacgtttttcgcgtcatcacggacaacggaaattaatttctcaatttttaatccgttttcatcaagtgcatcataaattgagtcggcaacgttgtcgccagaatcgtgattcgataggtactcgcttccaaaacaaaatcgtttcggttgaattcattgtcaatatgatgaatagtaatgctaaaattttaacttaaatataacataaagagaatttataaccttaataatgaaggagttgaagtcggttgactccaaccatctgttgttattgtgaaataatcgtttgaaacttgtgaacaaattttctccttgattgcatttgccatttttggtagaacaattttacggaaatattccctactatgtagctgcaaaaaatgatttttttaggaataataaagagaaaaaataacttcaaatccaggaaatgctttgctgtacagctctctcaattcaggcgattcggtgattaaaaaagatgaatttgtccgcaacattaatttcagaaccaattcgtcggccttttgcttttggtcatcagattgttgaaaaaatttcgtaattttgttttcttgcccctaaaaaattttataaatcacagaaccttttaaatttagtacttctttatttgtgtttcctttgtttttttgccattgttcaaattcgtcattatgcatcgtctttaaatgatcccataatcccttagtcgacgatttcttacacgaaaaagaattgcgacaaaggttacataatgccgtttccgatgtttgcgattttttataaaaagaccatatttcagacatgttatctaaattaggtacaatatattaacctgaaaaatgcagaaaggagaaaaattttctatttatttttagataattttattaatattggcaaaatgttctaatttcaaaattttttgtcatttcaaagacaacattcaaatttcttataacttttttgccttttcccccacgaaaatgccattcttaggggtgtatatttaaccccgaccccgagtcggggttaagggtcggggtcggggttcgtcggggttggaagcgtcggggttggggtcggggttaaccccgaaaaatggcctaaaatgtcggggttcggggtcggggcggggtcggggttgcaaccctaataataataattaaactgcaatttttgcaattttaatgggaatttttctttgaatttcttaattttatccccctaccttttcatagtaatcaatagggaggcgatttttaagtttaactattttgtttgctcaattgttttgaagaaaagagctcaaaaacgcatttctgcgttttaatttttcatttgaacgtcatttatcgtcactagaaatcattattttggcgcttcgtcactaaaaaaagttaaaattcactattatggagtattgtcacattttatcactatttcgacattttttggaaaatatatttttggactttttcgcactttttcgtacatattttgcatttttttatgatttttaag

SEQ ID NO: 12667 - DNA, 2866 bp, Heterodera glycines
  misc_feature (14)..(15): n is a, c, g, or t
  misc_feature (28)..(28): n is a, c, g, or t
taaggtttgcatannttcagtggtttanccattggtctctggtccaacatgggtttattatggcaataaatatgcccacgagggccaatgtccaagttggagtcactcattgtcctcctcgatcattgttctgttaccacgaccatcattcggttcatggtatggttatcttatgggcagtcctattagctgttggactgatctgtgcactgttcttttgtttctgcgcatgtatgtaaatcgtcgtcataatttgctgtatggttacgatattacgattacggcaatatgacttttgcatttcgtgctacagttctgttgtcaagccccaagtgtttcattttgataagctgaagtataactgaatttcttggccaaatttaaaataattagattttaacactttttaaggaaaacgagagccctttttaaaattgccaatttttcaataaaaaaatattttaaatgaatttttcataatcaaaaaacatagatttatttacaggaaatttcttcttttcaaatttaaacacttgcctaaggcattctatgtgttgtattctttttttcttctggactttggccattctgttgaaattctctccaattcttttttattcatttaaacattgggtgatactgtcattgatttaccgtaacctatttactatcgttccaggaaattgttctatttcctttcctatttgaatgtttttattattatattgtatttccactttttctttctgtcagataaaaattttgctttcagtttgccgactgttgattgtcaaaaaaataactattaaaaaggtgacaaaaataatgataaaaaaaattagtggcagggaaaatataattaataatttaacgaatcaaataattggaagaaatccttaaaataaagtacgtctataagtagggaacggttttttagttgtttaactattttttctacggctttatttcgatgagaaatgcacgaaaaaacatattagctcggaaattcttcgttttaacgccactattcatcactaggaatcactatttaagggctttccactaaaaaaaactattttggaagctggccactaaaatagttttttgccactattttggcgttttgtccaaaatttgttaacacagatgcaataaaaacgaaaaatacaccccctaagaatcgaccaaaaaaaattcagaaaaatataccactaagaatggaccttaaaatttttaaaaatagacctataagaaatgaaatttttttaaaaatttaatccccaaatttttttttctcctctgacatcttgcgacgtgcaacgatctttttccgtttacgaatcaattttggccgataaaagtgtgtcttttacccccgaaaaaaattctaaatgtacctcatttgtaactgcaatcagtgaataaaatccttttcatttaatttaaattagtttcatgcaaaaaaacagctatttaaaaaattacacccctaaatttggaactttttcgccactattttggcatttttttgtcactatttaattaattattttgggattttttgccactaaaaatcctggccctatatacatataagttgtaaattgtgaatttaatgaaatggtttaaatttttgaccaaaatgaatttctacaattttttgtttctgctggtcatttttctcaacttttttgcggcgtgctttttccaaaaaagcttggtaacaatgggtccgtcggcgccgttagggaaaataggattttttctatgcgatttattaacagattttacaccaaataatgccataagttaataaacatattggtatagaatttcaaaaaattataaaaatttgagtgttttttccaatgcttattttcaaggataccttaaaacaaggaaattttcaagtgagaggacccaatttcaaggacgtacttgccattccgaacgaatagcagccctgaaataagacaaaaaggcttgatttctacaaccgacagcaaaaatgtgcttttttaaaagacacaaaagaacaagataaactcgggtctgtttttatttggcccaataatttcactcatagacaatataaattttagagtctctctattgcataccagggttgccgcgggtcgagaaaaatatcgggtcgcgtttcgggtcgagaaaatgtagggtttcgggtgatttgcggcaaccctgttgcaaacccggtacccgacccggtaggtccgggtccaaaagtacactggtaagaatggggttctggatcaaatttttgagcaaagttggaggaatgaaaaattaatgaaaatttaattgctcctgtggcttagtggttaatctctttgtttctgttccttctttctcagtttcaattctttctcatggttagctcttttaaacatttttgaagattgaaaactgatatttattttttgtatttaaaatgattttttcggcaattttcttttatactgctgaagtcaaaatttaaccaagaaaaactcgagtctgaagaatctgctggaggagaggggcgggtctaatcatttaatttgaatgtaaagcaattttatttcgctaagttcgcaaactaacccaaattcattcatttcgccaagcgatcataattcggaaatttacaaataagaaagcttcaactgctattaaattaagcaatagcataaagcattattatttttgtaaattccattgctattaactttaaaaacaaaatcattggcctctcaaatctgtttttgaatttattttctcgcaaaatgaattgcaaaagcagttcaattaggaaaaattgccgaatacgttaccaactcaaaattacataaaaacactttctgag

SEQ ID NO: 12668 - DNA, 3930 bp, Heterodera glycines
  misc_feature (47)..(47): n is a, c, g, or t
  misc_feature (52)..(52): n is a, c, g, or t
  misc_feature (67)..(67): n is a, c, g, or t
  misc_feature (74)..(74): n is a, c, g, or t
  misc_feature (3908)..(3908): n is a, c, g, or t
  misc_feature (3915)..(3915): n is a, c, g, or t
cgtgcgtttcaggccacgggaagctcaggaactaccctctagggcgnaaaanccttaaaatattagncttagtnatccttatgggcaaaaagtcacgaaaaaattcaaaaatagtcttgaaaaattagccaaagttaaaaaagaatatccattttttaataattttagaagaatattttataaaaacaattaattttgaatacaattgctaaaaggtacaaaccattgtcataaaagtgcaaaagataacctatcccaaaagtagaaaaaagtctaaaaaaatgcatgttagaagcttcaaaccaagcgtataacaaacactttttaagccatttaaagtcagcaaaaaaagtcaaaaagtcatctgacttaaatttccagccctattgctgaccatggattcatatgaatatggcatccatatttataaatatattgaattcaaataaaaagtcgaaaattaaacaataaaatgaccaaatgccaaatattcatagtaaaataaaatttataaaatccgaccattggggtgtcattttaggaaaataaaaacatcccaagaacatttaaaacaattgcttatacatatttacacgcttaatttagcaattatcataacatttacatttttgcgttgcgctgcccctgaacaaataaataaatctcttaaacatcccacccaaattattagctgttcaattttcatcaaaaacaacttcgaatttaaatgttccatcgtcacagcatttttcgcaatttcccccgccttaaatcgttcgacgctaaatcccgggaaagcgcctcgtcgagaggcgcaaacgatcttctcgcttatttgagtcggtaagacagcgaatgaatgaatggaatggcacatggcacctcacaagaacatatttcagaatattcgttcatgtttcatgcatatttgccttaattttttcaaaattatctcatttttgaacggctcattagcgtctttgggtcagaaaattttcttaaaaaacactttgaagggaatgcttaaataatttttcagaaaattttaaacaattattaaaaagtaatatcaaaaatggaataaaatatttttcccaaaatatcttaacccaaacatagtttttctattttaaatgactttgacattaaaaatttttttctaaaatttaaagaaattttgtgaattttcgggtgtaaaattcttttttgttcaataaatttcgtttaatttctcaaccttcaaacattattcatggcttttcaattttttggccttcccccaaagtgtcgtctttttcttccaatatttttccgtttgcttgttaatccgggaagagccatcaattttacgcattataaatgtgtgctgtcggaggaaaatttgttttgctccgccggagggaatttcaatttgcaggcgcaggttttaagtcggaaggaaaaaggcattttgccaacatcatttttgttattcacaaaataattaactttttttcgtccatttttatttttattaatccgccatttattttttggggttattcccccaaatttcttttgtctcatatcaatgcaccgtctcccaattatccatcatccttttttaacaattaagccctaatagccgctaaaactgctgcaccaaagagtgaccattcattgctcggcctccgtcactttccgctaaacatttgccctccccggggcactcactttggccgctgatccctccccccggggcaattcatttcttcaaagtgatgcctcaggggatttttgggccacggacattccccggcggattgaatgaatttttcacctgtcagctcaattagagagggccagccgtcgtcactgtttgctaccatccggccaagcactcactcattcaattcattgtgtgtctgctcagtttgacttggccacaatggccggcggcagtctttctaattgatcagtcactcgctttgtgctgatcagtcattgcttcccaaattgatcaattcgccattgaacaacaaataacatcttatccctttacactgactaaatgccaacggcaaaattcatttttttaagtttttagaatttttatttggcaatttgtccaatgtgataatgtttttccctttctgaattttgcattattccgtttttcagtctttggcaattcgtccgtttttgtctttttttcaattttgggaaatttttgcactttggcattccgtaaattgtttggcattttgccttcccaaatgtcctcttcggtcgcttcgacccccgcttcgcccatttctcttacggccgccccacgccgcgcctcagtttttgccgaccttttgacggtattccggcgcaagagtaccgccaccactgcgcttagcacacggcgtcgttccatttaccatgcgccggtgccgtcgtcgtacacggcacggaaccgacgcagcggagcggcaaaaaaggcggaagagatggaactgttcacggacagagacagtctccagtaaaaagcgaaaaattatagaggggaaaatataaaaggatttacaaaacaaatatgttaaatcgaacttagatttttgattaattaaaaatttgatcatataaaaaagaaaatacaaaaaaattcaaaatgatttttttttaaactatccaatccatttgcatgtgaataataaatgtcgtagaattgtttaattgtaaaattggctaattgaccaaacgatcgctaatcctaattaactaataattgagctatctaattacatccaaaaatcaattgccatttttatttgtcactttttcagtgaggctgatcgcggagaaaaggacgaggaggaggagacggccggcaaaccgttgacacggcagcatttgttgaacaaaattcgcgaaaagaaggaagtgatcaacaaactgcgctgccaggcatggaacatgaacagaaagagacgaacactaaggtgggatacggtagcaaagagaagaggaggaaaagaaaaacagtgtactgtataagcggaggaaaaggaaagaaatatgtactgtagaccaaatgtaatttaataggcgccaaaaatggaagaaatattcgcaatttttggacatttataataaatccaataatatttaaattttgttaaattatttcccaagtcaataaaatacaaaaattcagacttgcccagaaatacttggagcagaacgagtccaaagtgtccaaaacgcatttgtacaaggaggagttggtgaaacggtggcgctggttcctccgttggttgagcaacattggcatttattttgtgggaattgtgccactttttcagtgttttgtgatttattttcattttaggtcccttgggagtcgcggataaaacgaattgaaagtgaaaatttcatttaaaactgagaatttaatttaaatcaaaggccaatttggctcagtcgtgtccagttacttcacattccttcgctgggtgatcttcatcaattttattatcactgtaagttcttcccctttttcaaaatacctttgattattattattgtattaattaattatttattttttacatttcctcagtttatactaaaaaaagtaattttaagccatttttattttaattgtttttccagatcattttttattactttttaaattatttttttgtcattaaattattaatttatatttcattactattttctttcttttataaataataaatttcaaatttcccaggccattatcattgcttttgtcgttgtgcctgaatgtgcggccgacgcgaccgccgatgccggacgccaaaatcggacggcaagtcgaaaacgcattccgcccgaggaacagtcgcacgtggacgagtgggcggtggtgtggcatttcgataagggttggcacnaatgccnaaattcggcaaggga

SEQ ID NO: 12669 - DNA, 1624 bp, Heterodera glycines
ttattaagaaaaaacttcaaatttcgacttccttcaattttcatgtataacttttttggtaattgtctaatcccgaagcaataccttacaaaaagcttctaaacgtgttaatatttcgaatgaatgcactaaaatatgctttaaaaattaaccaaaatgtcttttaaccctcaaaaaaatgccaaaattgtgtaaaaatacagaattgactttaaaaacatcaaaacaatggctaaggagcgtttttatataattgcaaaaaattttgattttctaaatttatatatgaaatttcgagtttttaaaacttttataatatgctaaaacaaatttacatttttcttatatcaacaattttttttcaaaagttctaaaaattcaaaatattttccgattttcaagggtatatttttatccaaaaaagtcgatctttgggggtgtatttttcactttttttttgcatttttcttgtgaaaatttaccaaaataggccaaaatatggattaaaaacgcaaaatggcaaaatatttcaaatttttattttaagctcctttcttcatagcatatgcgcagaaaaaatatgcaaaatcatacaacttataaccctaattataatttgttcaatttggtgaggtaataaatagtattctccaatttaccaaaaatgtttgcttcttccaactataaatgtttgctttttttccattttcctctcattataaaaaatatttctaacacaattattcccctctttgtgtgacatccttcgaaatattgcaaattgtgctaattgccacaaatgaaccgacggtttggaatttctcttcaaataaccaattttaatttagcctaactattccacaatttcagttgggtttgcagcgatgtttggttggacattttccctcattttgaccgtcctcaactcggcttaaaattggcacttctttcgaaccgttttaatgcgctggtggacaaacatttcgatggcaaaagggaattgtcaatttggagtgacattacaattggcaagatgggagcaaaagcaaaattgtctgtggagaagagcaatgccaaatctgtgcgctttccattgcccggccattcgctgcccaacaaaattcgctttaattaccttcagattgagtaaatcaaacaaaattcaaagaataattaactaataaaagcatacccttacaggtacattgattacgccgtcatcaaatttctccgtgccaaccagcaaatttttgccaaaggcaccgatttggatttgcatgtgcctttcccctataaggccaaggatgtgcagaactttgcctgtgaaatttggcccgtttttgcgacaaacattcgccatttgagtgttactgatggtcgtcatcttgaaaatttgcgtcgccacacttcgccgacaattctctccgacctcaacattaatgccatccattccgatgatttgttgcccgatgcaattgctgacgatgggccaaatgcaactgctggccaagcgctgtcaaaatggttgaacattccgagaagcgatggacagccaaaacaattgagttgttgtggtgctgtgtcaagaaccattaaattggtcaacagtttcaaagaggtgtgg

SEQ ID NO: 12670 - DNA, 2215 bp, Heterodera glycines
aaagcgaaagaagcgttttaatcgtgaaaatcaaaatttataaattcccagcacagagagaatattattcaactaataataacagacagaaaatatgaaaaaacataaaaggctttgtcgaacactcataaaatattaaatctttctggaattatcatttcgaacagtcattttatgctgtgatttgtgaatgaacatgtgaggggcaacatcgggtaaagttaccgtcatttgtttttcatttccattgtgtttaggcatttctccatgccaccacttcttcggccagctacataattcgacttgaagattttgaaccaacggaaattgagccatttgaattggtgaacgaacggaccaacgaaatgcttacattcgagaaagaagacgaccatcaaaatactaataatgttgcttgtctgttgaagcgatttcaaattggggtgacggcgacgattcattgggtggacgaaaacctggacaatttgaacaatgtcaactttcatctttatgaatttgggtgaattgggcaacaccattttcttttgtttcaaatttcacttcattcatcaggccattgtctccaccaaaggcgggccaaatgaagtcaaaaagtcatcggaaaatgaaactcgggcccagcggacagcgaaataaaaagaagaaaaagtgaatgaattattgggaaatgacaaatgattgatcattcattatgaatggaaattgatctgctgataattgctcctcacatttgttgtttcttctttcgtttgaatacatttaatttgcttttttgaccaaaaatattgagcttttttaaataaattgtaatgctaatgaaaaaaaaaaccaaaaaaaaattaactaaaaaaagaaaaaaatcaccggatttttttttaatattttttttctgtttttgttttttagttagcatattgagcaataaactaagcgaagatttagcatatggggtgggggatatcctccattttgcatgtcattccgtcctctgttctcgaatcattcggttccagccccctcccctgagtttgtcaatgtcttccgaaaagggcaaaatcatgagaatttacctggacctaatcctcgccaggcaaccgaagctgatcagatcatttttcgtgaaaaaatcgacgcaaaacaaaacaattctctgtaaattcaattcgagaacttggtaaacctaggataaggaaaattttaaacctaaaattttttatcaagaaaaaaaatgaaattttggcgataaatttttgagaaaatttttcatattttctgaaattttttcaatacttacaatttaggggtgtattttctgaaaatttttcaggtcacttcttaggggtgtattttcctgattttattgcattttttatggaatttttcgaaaaaaacgccaaaaaaggcacaaaaatggcaaaatgccaaaaaagtagagtattacgggaccgggaattttgccaaaaccgggacctgagaagccgggaccgggacctcggttttttttccgggaccgggaaccgggaccaaccggggaatttttaaaaattcaaaaaaatttaaaaaattcaaattttaatttatttcaagtgaaaataatacaaaatttaatttttattttgctatttattttttaaaacccaaaagttaacgcaaaaataaattataatgatatttaatcaatatttcaaaccaaatttacttcaattattcaaacagttaatcattttttgactaatgatcgaatattattagaggttagaaataagaattttgtgaaattctaagcatgaaaaaccgaagttgatttttttgcggcgcttttcccaaaaaacttggggaattgaggggccggcggtgccgataggcgccgccgggaaaatttttgtaatttttaatgcgatttgttaacagatttgtccacaaaaggggaaaaattgagaatcttgaccatatttttagcagattttcattaaaaaatcattaattttgtgcttttttggaaaaaaaattggttcttttctggtttttataaaacatttagcaaaattttttggaaaatttgggtgagattttcgttttgatgctctattaaaaacccaaattattaaatatgtattgtaaaacattatgccaatttatcaaaatttaaaagattctgaggattttccccaaaagcctcaaaatttctcaaaaa

SEQ ID NO: 12671 - DNA, 3097 bp, Heterodera glycines
cggcggcgcctacctgcaccgccgcctccctcctcctccttggtcaccaaaaagttttttcaagaaatacgccgcaaaaaattttgtaaaattaataaagggagtcaaaaatataaagttaataaatgttttgttcgaattaattataaaaaataatttatttaagcaatttgaaaaaattttctgatttttgactcaaaaataagatttttttatttcaaatttctcctttataaatttttctatatatttttaatttaataaatggattgtcctttaaatttgtgcattaaaaatatttttgtgagtttttaattaaattttcgaattactcccgctcccgcccgggactcccgttaaaaatggacgggattttacgggagcggaatttttacgggaatcctgttcgggactcccgtcccggaaaattttgaactcccgatcccgctcccggaaatttttttttaccggactctagttaaaattgaaaaaaatttaaaaatgtaaaattggccaattggcgattcgaatggatttaaaacattgctgattttcacttttcatttgtatataaatgaacgagaaaccgtcacatcttttcattttcccatcgaaatacgaatcttctctgtttctctctcacatatccacaaaattgttccgtaagtttttttccattaaaaaacattgtcctattttctctcttagccaatgctgcaagctcatcagtaccaacttcggcaaggtcatcgtcgcgtttctgctcgcagcattttggcccatttcggtttcgaattctcgaacgactaccgacttggctgcggacattacagtaaagtgtacaaaggtggagtaaggggcagagtagttgtgtattttcgcagatcaaatttatcttccaggctatttcaaggaagcgcaacgcacttttgccatcaaagtcaccgacttggaaagcgtttccgagaagttcaagcaaaagtttctgccacgtgagctggaagtttggcgggaattggaccacccgaacctcgtctatttgtacaaagatttccagtggaacaattatcagttcgcagtgatggaattggttgttggtggtgacttggtaatttcctcttttgttttatgtgtgttgcattacttcaccgtttactcttcagctttcgttcctccaaaaatgtggccacgtcagcgaaacgacctgtcacaattggatgctccaaattgttgctgctttggattatctccaccgtaagggaatcgctcatcgcgatctgaagctggaaaacgtccttctttgtgaaaacggcgtcatcaaagtcactgactacggattctctaagcaggtggtgaaaattgtttttgcttatttgaagttgattttcagagttctgatttgtcttcaacattttgcgggtcgcgttcctattcgtcaccggagattttgcttggcatcgcttatgacatgttcaaatcggacatttggtcaaactctgttgtgccatcctttttatgctgatcataatttcaggtcattaggcgtcaccgcgttcatcatgatcacaaacacaatgcctttccatgaagacttgcccaaccagcaaatcgttgactcgcagcggaagcgccgttacaaatacccgtcatggcttaacattacgaagcaatgccgcactgccatcgatgccttgctgacttaccaaccggcttttcgtccggtagagttttgcttttaattcgcttctcattttctttcccattcagaacatttccgaatgtgccaagttggaatggtttgctcaagattccgcctctttgtgttgcggtggtcgtcgtgccggtgttggagtgatgggtcaagtgcgtgggcgatgataggccatgtgatgaccaatggacagaagatacatttgataggattaaatccaagcctaagcttttcttcattttgtatgcgtatctttagtctttgtttgtacatacacacacttgttaataggaataataataataaaaaaatgtttaggtttttgctgaatcccttgtttcaccgcctaattcaaattatccaaaaacctccgctattttgcttccgttaaatttggggtggaggtacggtctctccccgacatttatgaccctacgggctaaactacttgccctcagttatggcttttgatccgaaaagaatgacttcgatggagtccattttgtattgttttgtttgttgtttttgttaactttgtgctcttggatattaaattaaacgtggtttcaaaaattgctcatgagtcatggacctactgattgattcaatattctggggtgatgcttcagcagcgacagatccgatcgaaaagacaaaaattcagagttagcccctgagtacggtatgccaagttcggtacctcgatgccattggtataaaaggatacagcgaaatatgtaggcaataagaccgatatgtttatcattaagcctgaaagtcgcttttgtcactaaagtgcaattaaaccgcgttcttttttactcttcccgaggcattcatcctcctttatattttaatgtgattttttaataaataaatcaccactataaaaggtgttcattcgcaatcgcttttcccatttgcttagtttttggtttttctattcatctgcaacatattgtattatattatggccattgctcggacttcggttctgtccccgttgctcctcttcatctttcttctgttcaactgttgcctttgccagccaaatgtcttttcgcctaatgatttcgcttgcgcgaagaaaaatgccatttttcacgatggactgttcactctcactgaagacaatcgactgtgagttgctattggcttcaaatgttttaaaataatttgttttgtttttttaataattagccgcattgacccgtcgaagcaaaaaacgaatgacactgggacacaactcgacgctcttctcttgaatcccatcaaagaaagactggtcttttcgctcattttcatcaagggaggcgaaaactgcaagcagtttttcatgaaacatgccgaaaggccgagttgttgtctgttagcgatgaaatggaa

SEQ ID NO: 12672 - DNA, 1594 bp, Heterodera glycines
aaaaaagggaaaaaaaattttcaaaaaaagtcctctttgccaactagcgccaaaaactttccccatcctctcaaaagacaattccatcgccatttcaatgcatagctaatttcttctgacattttttgactgtttctaccatttggcccaccacgtcgttcgacgaatttgaaactaattggccaagtcattgtcccctctgttaagtccactgggaattggtgcttctccacggctcttctttctgttgttctgtccaaccgcaccttcccaccccaaaaagtcctttcattcacaaaaattcactcatccaaatgacaaaaacgcatttttgttcaaaagttgccaaaatgcgaccacactttggcccctctctcctctcgcttttcgttttgtctcttctgatctttgccatcgcttcgttaaacgccgctgacgaaatgccgggaacagaaggggaggaaataatcatcccttgtgagtaccaaccatcaattgtccttcgtctcatccaccaatgatcatgactagggatgccaatcatatggatatccatatttttttcctggactgttgagggcctgaaacgcacgaaaaacatgtttttagcttggtttgaagcttgtaggatggatttctaaatccatatttttccatatttcgcgatttatgtccatatttccatattttggtccatattttatgtccatattttggcaattttcaaaaaaacctctattagaacggcccccagcagctaaattagcctttttgagcccaaaacccgaaaaatttttcaaaaaatcattttttcgccaaaatttctcgagaatattgaataaatttaaatttccttaaaaattaaaatgattgcacgtaattgcggaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatttccatattttgagatttttgccattttatgtccatattcgcgatttttggtccatattttatggccatattttgcgattttatatccatatttttggcatccctaatcatgaccattccccgcgtgtttagggaaaaaactctaccgaccgcggggccccccgcgttttggaaagcgcgcctttgtgctgctggatgatgaaacggtgccggtcgcttggaggaagcgattggactaaaggaaaagtgatcgaccgcgggaagaaaggaaaagcatattgatcgaaaatgtgaaactgaaattgatgaacaataaacagcagcgtcccacaaaagcgtcaattacaactttttcaagggagcacagaattgtgggaattacgggccgggacgttttcgtaccgccgttttcgtaccgccattttcgtaccggggacgttttcgtttattgtttattgtcagtaaagaaaaaagagtccacaaaagggaaaatccgcttacattgaggacaaaaca

SEQ ID NO: 12673 - DNA, 2455 bp, Heterodera glycines
  misc_feature (2342)..(2342): n is a, c, g, or t
  misc_feature (2356)..(2357): n is a, c, g, or t
  misc_feature (2401)..(2401): n is a, c, g, or t
aaggtgcgccagcggaggagcggaatggacgcggtggagtgcgcggtgggcaaagatttggcacgcgagttccaacggatggacgagaatccgttccaaatgcgcggcggtgcaatgcttcgactgagcggtgcgtgccgctaattagttattaattagtccaacatttaaaatgcgtaaaatgggggtggcaaacaattttccgggcacacagtttggcgccagtgaacaaaacagcgccaatttgaaaacccaccgaattttagaccaccaaaaggcggcgctgagcgcagcggacattgaggcggacatcaaagagcagttcaaaaaggagacgctgctcagggacgaacacgaagagatgtgagtggtttgttgggtatttttggaattttgaagcctaccaaaattaatttggatttggcaaatagcccccaaatgcatcgctttaagaacatgagatgtgtgaatttgcacgccttttttgcaaatttttggtgtgcaaccccaaaacaggaaagtgccggaatttttgtgccttatgttaggttcctggaaaatcctttacctcgggggtggaaggttcggctatttcctgtccgggtgctctcgataatcttacgttttaccggctaactgtttctcataattcgattgatggactctctggcgctactgtaaatgttaccgattttgaaatttttttcacttttttttcatgcaattttattttctattttttattaaaattagcattattaatcacaaaaattataattacaatgtaataaagcaacaaaagccttaaacagacatgaacatttacgtgagactcaaagcactattgtgaaaaaaacttttgtcgcgcactgttttgaatggatgacattggtgacagtgccactaaaaaaaggacttaaaaaaagatttttttcaaattacttcaaatccatcctttacaaaaattgtaaaatctcttcagaattttgggaaaaaagccatctcaaatttatatcgtccaatgttggaaaagcgatgagtgacagattgttggaatcattaatggaatatcttgaaactttaaccatttgctaaaaaaagtttaaaaagcatttatagaaaataaaattgcatgaaaaaaaagtgaaaaatttttcaaaatcggtaacttttacagttgcgctgactctctcatatctcctttcatcattggacaggcgtcgctatgtggagacgcgaattgcctccgagtgcccagcagcgttggcaatcgccgccgcaaatgccaaagagagcgccggcgacggcggtggcccatcgacggccaaaaaggtcaaagtggcgggccccgaggacgacattctgtaccgggcggccgagcaggtcaaacaccacggcagcaaacgcaacgaggaactgttgtccaaccaaatgctggtcggcatccccgaagttgacctgggcattgagtgagtgtttgttggttgtgtagcatacattaaaaaatgggtggggggtcgattttttttttttgccgggatatggggttggtggtcaatttttaccaagggtccggccatgtaaatcgacgaccttttttaaacaatttttttgcggcgcgtttttattcagaatttttgggagttgtgggtccggcggtgccccaggggaaactgcaactttttaataaaaattgaagttttttggtccggttttgctgataggcgccgtcgtaaaaaaactaagaatttttaacgaattttgttaagaaattagaaccatttgtctgtctcggaatgtgtttaattcgatcatttttgaggactcgaatgcgcaacatcgaagcgacagagcagaagaaggtggagctgttgaagaaaggtatttttgtctcaatttttattttttatcgaagttatttcaggtgcaattccaaaacgcgtgaacaattggcagccgttgctggaggaggaaacaacggaagaatgaatgaatgactttttttttactttgaattttccattttttagtagtcaaacaaaaaacgagcaaaaaataatattttttaaatttcatttttatgcaaaagtatgcaaacaaaaagtggtctaataagacaacaaaaaaagctaaaatacatcaatggatgggggaatgtgtgggttcatacagcccaaattcatatgataattaattggtctcaaattctgagaaatgattattattattatttttcataccgattgcaatttctgatcaatgatcactttcattgaccatatgaaaaagcgatttgatggctaatataaatgtcaaatttcacttaaattcatcaaaatttnttacaatttattanntattattacataacatacaaggcaagttttttagtgtcggtgtncttgtgtgcctaaaaggggggaagaggacaaaaagaaaatagtcaaatggctaa

SEQ ID NO: 12674 - DNA, 1159 bp, Heterodera glycines
gcgatttcggaaaattttaggggattttgtacagaattattgtagatccccaaactactaattgaacaattagctaattgccaaaagaagcacctggaagcagtcaatgtcgcccccgtcggtgccggtcacacaaatgttcggcacttccatgccgtccgggctggcggagaagtgccggcacggcgacgactgttgttggtgttgtgccatcattgctaccgttgtcatcggcgtctgctgtgaccaatgctgctgctgctgctgttgttgttgttgctgttgtcgtagcagcagtgggtgctgttcagacatggcaaatgccgtcaccgccgggctggtcggcgcggactgtgactgtgccatggcgaacgcgttgctcggcatggtcaactgctgcagttgctgcggttgggcggaaaagtgatgctgctgttggtggatgagcgacgtcggcgtggacagtggtgaacagccggcggacgacaattgcacgcctaatttttggtttttaaaattttaaaaatggaaaaccgcaaaaaatcttaagcgcctctgtttacctgacgctgtgtacaaatgttgtgatgtcgtaacaccgtcctcacaatttccataaccgtcatgttgttgttgttgctgctgttgttgatgttcctaatgtgccaaaattcatcgtaaaacttttttttttaatcattttcaacccgaaattttctaaaagtcatactaatcttttaatatgaaaattttagcataaaattttgaaaatctagcgatatttttttcaaaacgttataaaaaaagcaaccctatgggcggtgttgttgttgttggcattgatgttgttgttgggttgttgttgttgctgctgattgtttgtgccgccaccgcccgtttccatcgtttcggttggtccaccaccacacatggcagcagcgtttggcgaggaggacgaggacgcaccaccgtaaccaccatgactgttattgttactgttgccaccacacccgttgctgctactgccggtgttgttcatctgctgctgttgttgctgttggtggtggtgggatagagggacggaactgactgcaaatctgatttcaatacgtcacacacaataagaaacggacaaatcacaataaacaaaaaagtttcc

SEQ ID NO: 12675 - DNA, 2901 bp, Heterodera glycines
ccggaaaatttccgaaaaaaatcattttttaataaaattctctcgaaatataaataaaatttaatttccctaaaaatcttaaatttaagtcaaaaaaaagtaaaaaaaaaaagttaagtttccctttctagttgattttttgctaaaaatgagtaaattttagatttatcatatttttttcttctaaaatgatttttaataccatatttagccatttttgaaagttttactttaatttagcgaacttgaaggaattttgaaaatataaatgcaattcaacaaataaatttgaagaaattttacactcaattttgaaaaatttatgtccatattttgacatttttgccatttatgtcaatattttgaaatttttgccagtttatgtccatatttcgcgatttttggtccatattttatggccatatttcgcgattttatatccatatttttggatgccctacaaatgagaagtgatttaaatgaaaataccgttaattaaaaatgacaacattgcctttttgtgcaaaagagtgcaaatattaaacaaacaaatataatacacattaatgaaaaatttacaagacaaaattaatttgtaaattaaataataatttaaaaagaatgaattgtttaaaataaagaatttaaaataaataagaaataaaaattaatttagaagcttttcttcagcagaaaaaacagtgctagctagcatcggaactaaatattttgtaaattagaaattgctcattacaatactttaacatattaaaagtctaagtgaaagaagtttaagtcaagttatgcatttttaaatctcaatatattcaaattaaaaaagacagataataaacataaacttatttaaaaatagatgtatttttaaaattattctattaaatgttcaaaaaccataaggataaataaacaaatatattattaaaataaatatttttgagtgattcatattactcaaaatgatatgatttttggccaccaacaccaaattaaagaaatgcaaacgttaactgaattgaaaaatgattaaaatgatttaaaaataatgtatgaggaaatgcaaaattaaaaaaaattccagcttttggattgccgtttgataaccaacaaatataaatcaacaatgaaattacaacgaaaaagggaattgtcctctgaggctcggctggttgtagcaaaacgctactagtccggtgttttaacattaaaatataatttttgatatttaatttataggatttttgccgcaacatggggcaaaaataattttggtcaatttcacagatttagcgcatgccaacaacaataattgcataaaagaaatatttgatttggcaaaactcggcaaaatcgcataatatgctattttaaaacgtcgaatcaatagttattaattttttttaataaaatatgaaaaatatattaaaatatttattatgtaaaaataattagaagttttgtcaaaattttaaaataactaaaaaaatatttaacaaaaaaaatttgttttattatgtaattattcaaattttattcacttattacaaaggacggcatcctttccattgtatccatcatgatgcagctcatgtttaacggacaaatttatttaaaaatataaattattttaattccatttaatagcaataaagaaattggaaataataagcggtgaccaatgtctaaaaacataatagaattcgcattttatgggttaatagagccatagttaatattcaactataaagaattaatgaagctttaagattttggcttaataaataaactaataaaaatataaattttaaaaatcctcgaaacacctaaacttaaaaaaaccttaaaccttaaaaaggataataataaaagattaaaacattttattagtagcaatgaatagtagaattcaataatttatataataaaattctaaataattaaatgtttcatttggccaataaaggatgggtgatgcgacatttgcagcgctgacatttgcggcgctgacatttgcggcgctgacatttgcggcgctgacacttgcggcgctgacatttgcggcgctgacacttgcggcgctgacacttgcggcgctgacatttgcggcgtgacacttgcggcgctgacacttgcggcgctgacatttgcggcgtgacacttgcggcgctgacacttgcggcgctgacatttgcggcatgacacttgcggcgacgacacttgcggcgccgacagatgcggtgcccagtcaaaacgacttttgcggcgccgacacttgcggcgcccaatcaaaacgacatttgcggcgcagaattaagtgaccccaaaaaaatttcaacaattatattgattaaaaaaaacatgtgtttaatcactctttaagtcctattcttccaagtttcatccataggcggtattgcaatgtatgaatgtgattaattatatcatcatcgattttgttttccttattgtcaaaatcgatgactaattgacggatcgcttcatcatttcgcatatttttttaaacgaggtctttcggcaatcctacgacggtctacgtcagttggcacgtttgggccccagcaagtttttggactataacttttttctttgtcatccaaatcaaagatttttggtatcattcgaaagcccttcaaatgctctattagcctgcaaaaatccaaaaaatttcgtcaattttgaacaaatttatggccaaaaaggttggaaaatttgcttttttgaatttttctggccataacttttctgaaccataacgaaatttttcaatattttgcaggctaatagaagacatttatggctttcgaatgctacaatgttggatttggttgacaaggaaaaaagttatagccaaaaaatcgctgg

SEQ ID NO: 12676 - DNA, 1701 bp, Heterodera glycines
attttaatattaattttacttaataaaagcaatatattttcaattttatttttatacgaaaatattaataaatatatgtacatatttaatttttgtaaaaatttatccttacacctttgttaatttttatgcttatttgaaagaattattattcgagaaactgatcgcatttttaaatgctttttgcatatttgtttatttcgtttaggtgagcagtatattttgaatattcatatgttatggttaaattgtttttttttcatttgtaatattgaatataaatttgttaaataagatttacaagtaatttttactgttgtgaactcttgttatctttgtaaatgattgattctttttttattagtttattccaatgtatttgtaaagtaaaatcttgttttcactccacaaagtgatgtattatgaatcaagagacttgctaacctagtttataatgtgatgaaaagtgttattaataaaatgatttgttatttgattaattcattttttattttttggctactttcactagttagcatctatttggtataaatattttcatcattataattatacatgcagattaccacatttatgcaaaaatttttatttttctcaaggtattttaaataatttcattagaatattattttgaaactataattgatgttattaattttctgaaattccaatcaagtgattttttatattaatttttgaaattattctatttagtgaattataggagcgagttttacatttattatttttaattatagaccaattacttgccgaatacactaattaaatctaaatgatatagtaaatatcaataaaagactctaattcatgagggttttatttttaacccttatttttcattcaaaataaagcaacaaaatggtaattttttggtaaaatttcaataaataccgaattcaaaccaagctaaaatatgttttttgcttaatatatcggaaataatgcgcagaaaaaaaagcatatggttcaaaaactatttgagcaaaaatccaataaaataaagaatattatactgacgcttataaacagtaccaagcacaaagctatcaaatagaaaatctgcttttatctgttcgatcgcttttttcttatgagattgttatttttaatggaggcgtgaactgacccgaataataatgtttaaatttggcaagatttaacagaaattttcgaaatgcgagtttaatttagcaaaaaattaaaattgaaaagaattattattctgcatatttattccttggtgcacaaacacaattatgattttgtcgatttttatcatattataagggatttttataataaaataataaaaaaaacaataaaaatagattcaaatagaccataaatagaaaaagccagaataataacttttcaagagcgatcaacgcgccagcccaactgatgttttacaaagtaaaaacaaggcaaattttaaaaacatctatattcggtgacgagctttgagctttaatttatttaatattaataaatatataataaaaagcacatggctgaatatttgtaccatgtactaactcaatcatagatcaaatttgaatatgatactaatatttatccagcccgtataaaatttactaacaaaattttttcacaaaaaatcatgttttgaaaaacatttgcttttcgatatgaaggaga

SEQ ID NO: 12677 - DNA, 1521 bp, Heterodera glycines
gagacgcagttggccatttgacactaagacgcagtggccccaagatgcagttggttcagacgcagttggcccgttccgtgggagtttacggtattctcccgtaccaaaattcaaagcatttcaattggaaaattatctcgaaaaattagcaaaaaattttatcactcatgatatttgaaaaatatttcaaaattaattccaaggacaaagaactataaatgaattatttaagtatttgatttaaaaaaaaatcaattaattagtcagctaatattggtagaaaactgcagcatttcttatccatttctcatttttggcatggagttttgtcagtcctattttaataatataattgtaagccataagagtgaagtcaccggccgaagaataaagaggagaagcgcatacttgaaaacaaattggcacagtttgccaaataattttattttagtttaattgaacgggcgacacatttaatggatattatgaaacaattattctgaccaattccgctttgtttgcttttaagaggttaggaccccaaacccgtccacgacatttgagcaaaacgttgatccaaaaatgattttacaaactaggcaaaatgtgcaaatgatagaacaaagtaggttcatcagcagaaagatgatctgatcaaatttttctcgatttattttgggtccaaaagtgattggaatttacggccagctttctgatttgggtttataatgaaatgaatggccaatgtgcctttgtcttcgtctttgtcataaaagccattgttcgggtccatcaattccttaattgtccctaattaggtcaattaagggaaacaaactcaccgcaagtgtaatgaaagaagggaatccccagcccttatttgaattgttaaaagctgcactgaaattgtcagtccaattcctagcttcatcattcattcgagagacaatttgaaaggttgccgagcaaacgcagttccaattcgcatcgtaaaaacatcgattccgattcgaaaattgcagtgggtacagtatgccgtcggacagatggttatggtatttttccattccgccgttaaaacattggagggaactgtaaaaaaaaaaggaaaaatcccgtttccggatcaaaaaaaaaattttaaaaattgggcggcgcgctcggtctagaccaaattaagagcagtcaatgggaatagaactcatatgttcaaaagctaaagcaaagcatttacccactgcgctacgccaccttaatagtggaaagtgtgaaaagaaatgaaaaggaaatctttttttgtgttattcaaggcaggagatgagaaaaagccctgcaggtaaagaagtaaaacaaaatgtagagattaattgcattttaaattccctaattaggtatatattggtaaaccaaaataataaagaagtgtctcaaacttgaacatcgattccgattcgaaattgcagtaagtacagtatgccgtcggacagatggttatggtatttttcacactgatcacttctt

SEQ ID NO: 12678 - DNA, 1960 bp, Heterodera glycines
  misc_feature (427)..(427): n is a, c, g, or t
  misc_feature (1910)..(1910): n is a, c, g, or t
ttataaaatatcttccaaatctcctatatttcacttatgtgaaaggacctcgggtctgggctctttcattcaattattggatttctcaaaagaaataacaactttttaatgaaacaaataatttatagcaaaattttctaccttcaatatttttgcacaaaaaatttaagaaataacatagaaagccacaaaaattgtgaggtcgtgttttttaattgttttttgaaattgttttggctcatcagaaaccaaacgatcgtaggaaggagcatcaacagacgggaaaattagaggggccattagaaacgccggcggcgggaaaagacggtttgtagccatttattctttggcacttatgatcccgcgcacttttaacgctgcctattgtgtggcattctgcacgaaaaccaaacgcactaataatatntaattgaccccacccccaacagattccgtcccaaatccctcctttttctgtttaattttctttcgaaaaccaagagaagaggccgagtgagttgaatagcagcagcataatcaagagggaaatggtgaaaagttccgattttcttttttggtgccctccctctccaagctctgggaccatcgcccctgcaagagtgactgaccgagtggcactaactttaatatatattaaatttatgcaaaaaataagtgatcggaatttaaacgcgtgtcatttgctgacaatgagaaaaataaaagcaaaaagaattcattcactccgtcccggcatggtccataaaatggaaagctttgaattgaccaattcgctgctccccgtcgtaatgaaaagcacggaaacattttctgcagaaaaaggcgggagtcatcggcagtcgatcgctttcggtcacaacgaaactgaaaaagaaaaacattttcagattgttaaaggccgaggacattggcatgcgccaaaagccaaaaaaacaggaccagctccctcccccccagctctggaattttttcgttttcaaaatttcttagaagtttttctaaaatcaaaaagtttgattattaacccttttaatattttttattatttccaatgaaatttaaaaaaaaacacggtagttaaagtttacagtttttatttttttgaaatttattttaaaaagaaaaaacgtttgaaaaagttaattaattgcttagaaaatctaaaagcatctaattgacaataagaatatatttaaatacattttaaaagggtcgcttgaaacaacaaattctaaaaatattatcgagggattccaaattcttttttctttgtctaacttggacctggatttaaaataaataaagtaacgccattccaaagagctgaaacaaagctccattagacttaagaattcgttgttaaaaatgactttttatggctgtttttttctatgacatatggcaaattaagtttttttttgaattgccgaaaacaaaaaaaaattagtcggaggaatgaatgcttaaagaatgttttggtttcatcacctcgctgccgaatcggtgcacacaacgcacattttttggtggaccgagtcgtacagtctgatgggatattccgccaagttttgctcgtcgcccggcaacaaaaggcgaaggtcggagaaaatgagactgaaattacgcaaacaaaaaggatgtacaacaaatgttagcaccgtaaatttaaaaaacggggggtgggggcacgacggactttttctgattttcgtcccagacatttttttttgtggttattttgctaaattaggccacgtcggagcacaaattgcgttttttcctcaattttggcccgaaagtgtcttttttatttaagagaattgttcgacggttccgagaagtgtcgcccggtgaaaccttgacaaggtctgtttaggaaaatcgagctnaattttcatattttgtcaccagattttctctctaaaatttatttttttcc

SEQ ID NO: 12679 - DNA, 1206 bp, Heterodera glycines
agtttgaatatttgattaattaaagaataataaaaaccctttaacgctggtacgatgctgattttaatttaagcagtatctttaaaaaaggagattaattgggaagataacagacacttcgcatgaacattttaaaaccttataaataaatttacttctaaaactgtgaaaaggccatacccaacaaaattggcaaaacatgcaaaagtagacatatgagttttaaaactcaaaaaaatgtcaaaaaactttttcaaaccgttagaaattggtttttgaattaaaaaatagcaaaaaaaaaacaacaacagaaactgctgcataactcacggagcagtcgtgatgttgtgctgccttcgtcgtgctcggcccctgtccacgttgctcgtgccttcattgtctgttgtcgtcggctctctttttgtgccgttgtggtcgacgacctgttgagatgttgctgcttgcatttgcctatttatgaacactttaaagaaattaatgaatagggttttcaaaaatatggacataaaatcgcaaaatatgcgcatcaaagtgagaaatatgcacatgattatacattaaagcgaaatatgcatataaaagtgaaaaatatgcacataaattattccaaattgaatgtaaaatttcttgaaattttttaaaattaattaaatttaagcttaaatctcgaaaatagctaaatacgtttaaaaataattgtataagaaactatcaaaataaagttaaaattattaatttgaaaaaattgtctaaaaaatagcataaattttccatttttagtcttatttttgacacagatttccaatttttaaacgttttttattaatattttcgagaaaactatccaatattaatttttagaaaaattttcagtcattagggattaaaaggccgctttaatagagggaccgatttaatactcggtggcccaaaaaattctttattttcttaactcgaaaccaaaaattggtcattttggacaaaatctgttaactaatttcactcaaatatctcacttacaattagcgaaaactgttgaattacaaaaattttgttcataaattttacagaatttgttacctcgtttttcagccaattgacgctgtgccgtcgtagtgaaagcagacatttttcgtggtgacgatttaccatgcaattttggtggaattcgaaaactgtaactca

SEQ ID NO: 12680 - DNA, 2672 bp, Heterodera glycines
gcagaaaaaaatggtcatgtaattggtcaatgaatgaatttgttaatgtgccgtcgtcatttgtatcttccgcacaaacattaaaattacccacctacttaaaagcaatgtttggggattggggcgggggtaaggaagtttcatttggccaaaaagggggaagccgagccacaaatgggaggtgaagagagggagagagaaatggagtgggtgacgggggaggggagggggggggggacactttccccctttttactcgttttatagggaggcaaatgagtgccggtgccgaaaacagcgaagaagcccagtcaccctgtcttaaaatggacacagaaaaatccgtttccccttgagggattttgttataaataccgcccgcccctcccccgcccgaaacgaaatgcaactctcagcgttttgtgtgaggtgcgttttttgaactctcatgggacggcacttttttttggcacataatgtgggaaagggggaaaattggctgcttttgcgacaaatgatgctgataaagtgtccagataagccggcatcaaaaaacgtgcttagagctgcttttttgggttttcatgggcaatttttaataaagacaaacatttttgactgagacaaaaattttaaacaattattatggaaaagataggacaaggaaataaaaggtaatttttaattaattttcccagcgggtgaagaatgtcttttttcttatatttgacaaattccgtcacaaaaaagggtcattcaaattaacgcgaaaaaaatataatgccaaagagagaaagagaaagagagagagcgatggacaagagagggcgaaagagggagaaagaagagagagagcgaggaagagagagtgaggaggggagaggaaagagaaaacgatagagaaagagtgagtaaaggagagaataaaagaaaagataaatgagagagagagggagaaagaggaagagagtaaaggataaaagaaaggataaagagagagagaaaggagaggacaaaagagagtgtgaggaggagagaagagattaaaagagagagagaggagagtagagaataaaagaaaggataaagagagagagagagagagtaaggagaggacaaaagagagtgtgaggaggagaagagatgaacggagagagagaggagagtagagaataaaagaaaggatagaaactatagagacagagtgagtaaaggagagaataaaagaaaagataaaatgacagagagagagagtgaggagcatagagaggaaaggagggagagagagtgaggaggagaaaatagggaagaatgagggagggagagagacgtggttggcctcacaaaaagtgcaaagttgctaaatttttgactaaatcaactcataacttttctcagacacacataaattgcacaatcttggtaatatacgatagctcttgaattgctttattagcttgccaagtttcaaaaattttattatgtttttcaaaagttttagccaaaaactggaaaaattgtcataatttttgaaaaacataataaaaatttttgaaatttggcaagctaataacgcaatttaagggctatcgtatggtaccaagattgtgcaatttggttctgtctgagaaaagttataagttgatttagttaaaaattttttaataatacccaataatttaaatggttggctttttgttgcagtttctaaaaccaatttaaaattttatttcgaaacaatggtgaaatggtaatttcaattttcactattttaattatactttttttgcatcaaaaagccctagaagcaatttcaatattcattttgacaccatttttgcctgctttccaattgtttactttctctttgttttctcatcacacaacagaggaaattaaaaatttcttttgataagtaatgaattttaaaaaacaaatacatattttcgaataaaaacttaatttattataaaatttcaaattatgagtatgtttaagaaattagaacaaaattggatcactagctccaaattaggaaaaaaaatttttcttttcaaattaatatatttaaaaagccctcagaagaaatttcaatattcaatattggcacaattttttgttacatccaaattgtttgttttctctttgttttctcatcactagggttcggaacaaacctgaatagtcgggatatgccaaaattggcattattgtgatgctgagttcgcatgattcctcaaaattccggacatttcagaacatcagattgcctatttccttcaggacaaatcaaatctaaaaaattgggatattacaacaatgccaatttaggcatgccaatttttttatgtttgtcctgatttggaactaggcaatctgttgtcctgaggtccgggattttgaggaattcatgagaatttggtccttaaaaatgtgtttaaaatgcaaatgaaaacaaagacatttattcacactatccgtaaaattttcagtttttgtaatttttatagtcataattagaagccgacttaaaaggcgtcaaaaatcgcgaaaaatagagtataataggcaccaaaaaattgaaaaaagacattgaaaggcacgaaaaacccgaaaaaggcatgaaaatacatttaaaaaatttttttattaaggtttttttagggagcaaa

SEQ ID NO: 12681 - DNA, 3587 bp, Heterodera glycines
  misc_feature (3472)..(3472): n is a, c, g, or t
  misc_feature (3570)..(3570): n is a, c, g, or t
  misc_feature (3576)..(3576): n is a, c, g, or t
tttttattaatgaattatcgacttttagtttgctttcctatatgtaagccatttcaggaagcaaaatgagaaattcgaaaatttgaattttctactttttgctcgaattcgggtccggggttcgacataggtcggaattgatgtgagatttggattctccgacccttgaacccctaacacaatttttatcgaaaaaaaatttcaaaaatttgattttttgaaaaagggggactaccatcggtactattacccaatcatactttaaacaagtcaaataaggttttttagagataataaaatatgaattaaatttttaattacgaatctttaagtgccttattctctttgtttgtctttatcattaggggtgtcaaaaatatgtacaaaaaaacccaaatatgtaaataaaattttttttaaatggttattttttgaaaaaaaaaatcctcgtaaagtatgaaataggcacaaaatgtcataaaaattacttaaatagtcttagaatcacttttaatattttaaaattccttttttggtatttttcgtggaattttttcaatataaattttcaaaatttcttaaaatatgtaaaaaaatttgccgaaattttgaatttttttttttgaatatttccaaaacttttcgtaaaaaatcctcaaaatatgtaaaaaaaaatgaaaaatttgtcgaaattttggcttttttttagggtttccaaaaatttccgtaaaaaatcctcaaaatatgtaaaatatgaaattatgtaagaaaaagtccaaaatatgtataaaatcccgaaatatttaaaaaaatgagtaaataaaagtcccgattttgttcgcaaacacaaaaaagaaagtgtttttcctaccaattagagcatggagaatccaggaaaaaatatgtatttacataaaattgacagccctatttatcacctataactcgcttcattccccactgaaccgaactttcatagttctccaaattagagtagagcgggaccagggctgggcgaaacttcggcttcgaaaacttcgggttttttgagcttcgaacttcggcttcggctattttacccgaagtttcgggaaaaatacacccctaaagattgagttttcaatgtgaaaatgcaccactagtgattgacttttggtaaacttaaaattaatatatatttaaactatttgcttatttgtgttttttcgcatgcttggtcgagtggtggttctctcggctcttttcattatgtttccttgggtcagttcccatcaaagtagttgcttttcttctaatttttcaaaaatattcatttttttcgacagaaatttaataaaatttaacaattaaaatcgcaaaattttttcattttggactaaatctgttaacaatgcactaaaaatttcaaaaatttcaccggcggcgcctatcggcaccgccggagctccaaaatttcctttattttttaaatcgactcaaaaaccgtgaatattctaagaagtataaaaatttacaaaatatattgcttaaaaagttaattatatttatttatcgaaaagggttggttggtctctagaaactagagaccggcgcgggacgggatcccgcgcgggattttgcaggatcccagtccgcaatcccgcattttttgaaaaatttccgatttcttgcaccgcaaaaaagtggttttgaaaagaaaaaaaatagtcaaatttatgaaccgttaataatttgatttccgatcaactttttaccgtcggatccaatcgaaaaatcttagtcgacccatcaaccccttttaatgcatcccgccagcccctaaaaatttattttcagcattttttgatttttggaaattttttgaatttaattgaaattttttcgaattttccaaaatcccgcaatcccgcacgggatcccgcaaatttaaatgcgggatttgcgggattaattccgcgggatcccgtcccgcaaaaaattttgagttccagtcccgcagcgggatccgcaaatttgaaatttccggtctctactagaaactgcgtcaattgattaaatttgatatttaaccgaaattatgtgatgaaaaaaattttggaattaaaaaaaaattttgaaaaaacttcggcttcggcttcgaaaacttcgaaaacttcgggttttttgggcttcgagcttcggacttcggcttcgaataaaaattgggcttcgccttcggcttcggcttcgagtactaagccgagcttcgcccacccctggtcgggacaaggacgtccttggcatccaaggacattttttattttcaagaaagagggcccaatttcaaggacgtccttgccattcaaggacggatgggagccctgaactatctataaatggtagatatagagtaatgcttgcgaaccaaatgagaaaaagggcggtggatcagcaattctaactaaaacaaatattccttatcagacactattctctgggacaaaattccaaagcgaaattttacacattaaattactttttaaaaaaccaatccaaatcataaatatatattgtccaccgaattgtacagttcagaatactaaaaagctactcaaatttatttcggaccagagtaattctgaaaatatcatatattgtggggattttaacatcccaaatattttatgggatgaaaataaggtaaaacatataaatgatcctacgtcaaatatgctgattgagttaatggaccaaaaacaattgaaacagcatgttaaagaaccgaccagagaaaatacgattttagacttagtaatgactagtgaatcagaattaattaatgaattaattgtattggaacatttttcaacttccgatcataaaatggtcggatttaaaataaaagaaaaattccggcgtaataatcccagtgtttatagaagagattttaaaaatattaatttttcgaaattaagtcgggcgatacttgaaaatcgaattgatttatcaataaactcagtgcacaccgttgatcaaaaatataaagaattcttaaataaagtactgaattatatgatacttttataccaaatagacctctaaaatcgataataaaactatcgtatcctcaaaaaataagagatttattttcagagaaattacggttacataagcttgtaagaaaatttcctgaaaaaagtgaaatcattttaaattacaaagttatttctagtgaaatgaaaaaacaattgcacaaattaagaaatgaacaagagtcaaaaattatttcccaggggcaaaattcagttaacaaatttattagaaataaattatcaaaagttaatgaaattcctacgttaattgatagtgctggaaatatgttttccagcaatgttcaaaaatgtaagatattagcagaaatatttcaaaagtcttttttaagaaaatcaattgttaatggtccacaaactcaatcaacacagaatatgattanaatttctgacattgaattgaacgctggcataatttggaatatattaagaagacttcccaggcgaaattccacttcaccggataacattccttacattntattanaaaattgtgct

SEQ ID NO: 12682 - DNA, 1089 bp, Heterodera glycines
cttggaaaaatggtcaaaaataaatgggttagaaatttcaactgaaaaattttatatttagggaaaaataatatgaaaaaagaatattttattaactcacaaaggatttcagaatcggataatgttcgtgacttgggaattataattgactcgaaactgaatttttcagaacatattagaaaaattgtacgaaatgcatatcttagaattttccaaattttgagagtgttgaaaagcagggaaataaaaactctaacagcagcctataaaacttttgtacgacctcaattaaaatatgctactgaagtttggaaccctaatcttaaaaaagacatagataaaattgaacgcgttcaaaagtttttcacgagaaaagcatttagaaaattcggtttttgtacaaaaaatatggggaaagactaaaaatcacgggtttacacaaattggaagaaagaagaaaaatcaattatttaacaacatcttttaaaataatcaaagggttcaccagcctcgattctgggaaaagtttctttttctcaaaaaggctcaggaggcctttacttttacgggtaaagcgccacacggccaaaactcaaaataattttttcaatagaatagtaaaaaactggaataatcttccagtggtagcggtacaaattaataaggcaaaggaattcagggatttactaaaagcaatgagttctgagtaggattttccatgttgccatatttacactatatttttatcacctgtgaatttttaacaattgattgaattattttattcatttttattacggtattcattttgtatttttaatttgatcaaatttatttgttgttttctttttggcaccatataagagcactaatgtgcctttggtttgctcgataaattaaattatttatttaaaaaacacaggattttttttcctcactttcatcactttttgtcgaagattttctctaaattattttcttttcattattttataaatgcaaaattgcatttttcacctcattcatttcgagcaactcgcaaaagcgtctttttctgcacaaatttgcacattataattaaaataaatt

SEQ ID NO: 12683 - DNA, 1842 bp, Heterodera glycines
aacaaaaactgaccgtccatgttttggcgtgaccctttgtccggtattgcggccccatggtccaccgtcgattcgtgcggcatcagtgccattggagcgcggaagaaatagaagaccggataatgaaccaagttgaggcaggagccggcatacaaatcggcataccgttccacctgaaaagggcgaaaataaaaattgatccaaaaaatttttttgttatgaaatttagtcagttttacaaggaagggatctcctcgccctaataaagtttttaaaaatcggaataatttatattttcccagtaaaaaaaaaattttttttttttttttggggggggggggtaataccccacggttataggacattttgcggcccgacaaatgtggtcggacatttgcgtccacagccaaaaacgacatttgcggctcagctttttcgaccccaaaaaatataaacgtcagaaaattattttccatccaatttaaccgattttttatgggttttcaagtaagccgattcaagtctttaaaaaaaacttttataacccacacccaactggaagcaacgaagaggaggaaaagaatatgagcgaaacaaacccggggccgaggcgcaaaggtccggaccgcaaatgtcttaacacgtaccccactcgttttccgccctcccttcggaaatttttccaaatttcttagagttttttctagtaaaaaaaagaaaataaaaattcccttttgaaaaaccatgacgattttttcaagaattcaattttttattgaaaatttttaaattttcttcgagcatttttggtgggggcggttttcataaaaaaaatctgaatgagttggcatggcatcgctgaaccatgggacttttttataatgtaattaaatgccaaattcaaatgccatgactagggatgcgatttttaggtaagaaaaatcccagaataggtacttaaataggtaaaaaaaaatctcaaaataggtattaaataggtacaaaaattccaaaataggtaaataaaattttttattaacgatttttagtggaaaaaagcaaacaaaaggggaaaattttggttctatttctttgtaaacgaataatttaaatatttttaatatgttcttagaaaacattgacattttaaattaaaaattttgttacataaaaaaacaaataaatttttgggaaaaattttccaattcttagtggtgtattttttgattttattgcatttttgttaaggaattttctgaaaatccttaaataggtataataggtagaaaaactccaaaataggtaaaaataggtattataaaagtcatcgtagacacccaaaaccaagtggaaaatgcttttttcgtgcttatctgtgcgtattaaatgcgcaaaattttaggtatttaactaaaaatcgcatccctagccatgacccatcaattcaactaacacccacttgagaagcgaaaaatgaggtgcgcgtgccgcttcggaacagagagccgaaaacgccgtactgttgttccattgactgtgtaacttcctacaattaaaatattattatttttttcacaaaaagtttttgtaaattcgccataatttgcaaatgccaaaaaagggagcaggtcgccccccccccgtcgtttcccgtccgaaaaatttttttttaaaatttcaaacctagaaattgttcataaaaaaattcgtaggaaattttttcataagaaattctaagaaaaaaaaaaatttttttttaaagtttttcagcgatttattggaaaatttttgaaaaaacttagtagttcattacaaaatttcaaaaaaatcgctgaaaaattt

SEQ ID NO: 12684 - DNA, 3358 bp, Heterodera glycines
aatttcgtaaaaatttacgaaatagaaaaacgaaattcaatttcgtaaaaattttaacgaaatgcgattcaaaagcgtaaaaattttgagttttttgcacaaaattttgatttttttttccaatttcctaaaattttcccatctttaccagtgctttttcgattttggccaaaaattttacgaaattgcctcggacccaaaatttttatagaaattttccacgtcttgccatccagtttttttcgtatggaattttttgtaaacattttttttcctagaaaaaaaacaaaaatataaaaaattaaaaaaacaaattttcagcaatttttttttttttgaattttatgatgaattgctaagttttttcgaaaattttttccaaaaaatcgctaaaaaaatttgcaaaaatttttcttggattttcaaataaaaaaatttcgtcggcgaaattatgtttccggcgaaattttggggtgcacccaacacattgaacctatggtaacaaattttctccgccctttctcgtaccttggtgtactcgtagtcactgttggtcaacagaaatgtcttccgtccggtggcccgcagttgggccaacagaacgccaatgcgttcgtctttctccacaaaatcgccaattcgggtcaaaatttttttcttcaattgccccacactgatgccgccgtgcacatggtccattgcggcacgaatgtcctacaaaatgataaaataaatgaaaaaataataatgggacagccaaaatcgaatttttcacgccgcttggcaaaaatgccgtacatttttcatcaaaacagattttatatatttttgaaagaaaatttataagggcaaacaccgtcatggattttttttggaatttcagcaaaaaaattaaataaacctatggcaggcagctcccaattttttttttttttaatattttcgtgtcaccgacggcaccgcgaaaactgggaccgtccatgcaacctcttatcgaaaaataatcaaaatgtgtacctggtaaattgcgttgtacgacattgtcacgtcactgtatcggacgcccgttctgtctggcgttctaaaaataggactgttatttaaaaaaaaaactcgccgaaaaattgtttaaaaaaattaaacaaaaaatttattcgaagttttgaataaaatgtcgggtaaccggattcaggtaaggaagccaagaaaataattttcttgcaacatttgttcctgcttcggcttggaaacgagggatagattcaaagaatttctaaaattaagggcaatcatacaattttttagaatttgcctcctttccgtcccctttttgccatggcgaaaaaccctaacacaaacaaaaactacaacgcactgttcgaatttgtcgaaaaagtcgacaagccgtgtgatcaggtatgcatccggcaggttgaacaatgtgttgagcacgtaaatttggcgttccgacaattgcacaaatttgttcgggtagcaatcctcaacctctttcctgaaaaaaatttttggaccgaaatatgcattgaaattttaatttaataattttcaaaaaaaaaaaattccaatttcagcgttaatatcgtaggcataacttttattacatgaaaaaaatcgggtgcaccccaaaattttgccgacgaattttttaaaaaattttcaaaattagaaaatttcaagaaattttttttttagcgccatgcgattttcctataatcatgagattttcttacaaaaaaaaatctaaaaaaattttcgcgacacttaaaaaggcataaaacgctaaaatttatggtcttaaaataaaaatccatgaaacacttaaaaatgatgaggtgtttaagaaacaaaagttatgacctaaaaaccgtcaccgattggacccctaaaatggaatagagccaattttttttgaggatttgaaaaaaaaaacaacaacaaagttcttttacaatcacatcgattgattgcaattaaaaaaatttttttttgaaaaatttgtgtgaaaaaccatgtcaagaatcggcggccatgggacgcgcgcaaaatgttgccgaaaccgtccaccttcaacaggttgccgaacttgatgtcaaaccaaaggccacgaatggaaaacatcgggtcgtattcgaattcagcaatttctctggggtaactaaaatttaaaaattcaaaaaaaatcaaaaaaattagaatttgatgaacccaattcggatcagatagtcgatgcaaaacttgaacgtttcggcctccatgattggcgacttgtactctgaaaaatttgacaaaattagaattttttgcgtaattttatgggttgtcccctcgatttttcaaaaaaaaaaacaaattccaaaatcaagaatcggcatccatttcgaccaattccaatcccagacccaaactcgaacaaaaattttagttcgaattcgtgtccaggcttcgaacttgtccgaaatgagcacagtattagtacccaattttttcgaaaataatttacctttttatgaatttgggataaatgtatttaaaattagtggggaggggtgaattcccccagccaaaataatcatttcggacgagtaaaaaagggttacgaattccattttttctcaccgacgctgggtatattgtaaaaaaaataatgaaattttctaattaaaaaaaacgtcgccttaccagccaatgtgtagtccatgtcaaagccaaacaattgaattttctcaagccgaaccgtccggttgacgaatattctgcaatttggaaaaggggaaattgaatgaaaattgggagaaaaaattgtcatagattaaattaggcccaaaaaagttgaagcgaaggctacggcggtgccgtaaagaaacgcattttttttaaaaaattttcatgggtcattttttttttttgggtgtcgtaccgcttttcgggctcccgtttgttgatgatcgagatctgtttttggagatgaaatggcacactcatgctggggtttgcattaattgctgctgaagaattcattttgaattaaaattagctaaaaaatcaaaaaaaaaatgagagtgacatttcaagaaaaaaaaaaaattttttttttgtcccattttttgacggtgtgtatcagggatggcattccgaggctcaaaaaattttcggaaatcggaattccgggggtcaaaattttttcggaaatcggaattccgaggcccaaaaaattttcggaagtcggaattccgaccccaaaaacgtcggaaatcggaaatttttgaaaaaataaaaatataatcaaatattctaaatattttaataagctaaatttaaaaaaaaagaaattccgaaa

SEQ ID NO: 12685 - DNA, 2172 bp, Heterodera glycines
  misc_feature (2116)..(2116): n is a, c, g, or t
  misc_feature (2139)..(2139): n is a, c, g, or t
aaatttagcgctgcctatcggcatcacagggcccaaaaagtcataaaccttattaaaaaaattggctcaaaatcgcaaaaatttagcatattttggacaaaatctgttaacagatctaaccaaattttcaaaattttcccggcggcgcctatcggcaccgccggacgccgtaccctttctccttaagtctttagaaaagagcgacgtgaaaaaagatgttttggaaaacaaaaaagtaataaaaaattttaaaatttcaagaaaaaaaaattaattctatacaaaatttctgataaaaagaaataaaaaaatataaaaacaatacaaatattattatggaaataataaatattatttccgaaaaaatattaaaaaaattttgactattttttacccatgtgaatagttgtcttcttcttttctcatgtcttcaacgcatttgtattgccgccattccatccatttgaatcgattttggaagataaatgtgaatttttttgaaaaatgaaattttgactttttgttcgaattcgggtccggggttcgaaattggtcgaaatgaatgtcgtattcgtgatcagcgaccccgaaaaccccaggaaagacgttttgatgaaattcaaaaaaaaaattcttttttttaaaaaaggggggggcaaaccctactattaccgaaaattatgtcactatttcggactttttgtcactatttcttcactattttgggatttttactcactattttagttaactatttcggtatttttcgtcactaaaagttgctgccctagtaatcagtagagcccggatttttatgtttttacatattttttacggcttaattatggcgagagaagcccaaaaaaagcattttcaaaataatttttgctttagagcgacttataaaaatataaaaacacatattttggccttttggcacataaaaacatatcgcacatacatatttcggggttggcacatattttgacattttaggaaaattttgtaagaaaaacagaaaaaattgaaaaatacactcctaaaaatcaacattcttgcaattgcttacaacattttcaaatttttaaaatttatttcaaatgccgatagtaactaactcaaattcttattttgtcattggatttcgaaattctctgctggagcttttaatttataaaaatttttaactgaaaaaaatatcaattttactttcgaacaccttgaaatgtatttgttttgcaattgttcgggcgaaaatgataaaaaaataagattttttggaatttttatgcaaaaatgcccttaatcccgcatttaaaatttgcgggatcccgcgcgggattgcgagattttggaaaattcgaaaaatttcaattaaatttcaaaaaatttccaaaaatcaaaaaataccttggttgagaaagaaaaaagttatggtccgaaaatttattcagtgattctgtgtaaaaagtggcgagtgttttcgggcaacaaggcaaacaaacattgtgaaactaatgggacttacaacgcaaaaatactcaaaatctcatctccttaaatttttcttcgttcttctttcctcatgccatgggttcgacgtaaaagttcgcaaattgtctgtcgtagtccaagataatcggcgttgaagaatcaacatgtttgcgacgcaaattcgcttatgtactgtttggccctcatacagtagttctgcagcaattcctattgtcgcagttggcaaaaatgtaaagtcattcgacttcagaaatgcaatgtggatgcttttgacgcatggtttcgtttggtgctggcggtcggcgtaaataacacggatacgcattttccgagtagacatagccataagagaatggcttctttaatatacagaatattatcttttacccaaagaaggatttccaaccggaaaatgttttttgcattttccatcaacaagataacgttgggctgagtatgtatgggtatgctttgtggtgattgttttgtagagttcacgcatcctctttgcctcttctgctgactgaagtcgcgtgtccggcatagaagggacgtccgcacaaatgtactcactcatgtaatcttctggactctggatacngcatgaagtcggatgcattcccnatccatgtatactaccgaagctggactcgagcg

SEQ ID NO: 12686 - DNA, 1616 bp, Heterodera glycines
tcaatttaccgtattaaatatttttgtctagttttttttgcttcagttacatttctttcgaaataattaattataattagaaggcttggggacctttccacaaattacgtcataattccacagtttggtggtgagttatccttcattttatcgactgtatacataatgagcaaatgcattataaaatcagaaaagagttgaatataaaggtcatcaaggtctatcgactccttccttcacttggcagtgagttatttgattagtgcgaattgttaccatcggcaaggtatgataatgccgaaacgtctcacaatcagcctatttaggtggagaataaaaaattaaatcagaatttagatcacatcacgcaacaaatattttaacatgacaatgagatttatgagttttcatccgagagagaacttctctaaaagattacatttaacattagtaatattctccaattctccaacgttaattatagatcttataagaagagttctggtatccaaattgttttccatataaatgctagtcctttctatatactgaaagaacttttttggaattttgcagggtaatagtgcatctgaagggctttcgaatgataccaagaatgttgaatttggttggcaaagaaaaaagttatagttcaaaaactccgccccacgcgaaatcggcccacgcgaaaacggcctggcccgtaatatgttaacagaaaataataaactgaagcattcgttttaataattaaattttcaaatatattcatttgacgagcatcagctggacagggagcaatgcgaagagcaccatggcgttgcgtttttggtgaagcagatgggagcagtgttgagtgtgtgaagtgaaattgtatgtggtttgagctgaaaaaatgggaaaaccagaaaattcggaaaacagaatttgagggcggttctattgcagttttcccgaccgtaaaaattcaccggaccataaaaaattggacaggaaaaaacgaaagaattcaaaaacccgattttttcgcatttttgttatcatgttttgaaacctttgagggaacccatatgttgtactcatagatctgaaagataccaagaaatggtggattttagttgccctagtttttttatgggtactgtatgttaatttttaaggtcggatacatcttttaacgcctaattctgtatacccgcggtgtgtttgcgttgttcataaactttgtaaaattatatgtactcaattttccagtcatgtttgtggtgatgtaaaagttttagcatttctcgcttttcttgttatttaaatttttttgattattgacacgataacattttccttttggcattgtgtctttatttgaaaaaataaaaaaagcagaggcagaagatagatactgaagcgagacgggatcacgcgcgggattttagcgggatcccattacgaggcgggacaccgtcccaaaaaaaatattccaaaagtttgaatttttgttctatagcagccgaagtagaggagcgccaagtcaaatcaaatcaaggcgactcagatttttccctcatcaaaatttcataatgtgattttttcccctccgattttcctaattacagatt

SEQ ID NO: 12687 - DNA, 3779 bp, Heterodera glycines
ttgtttagcgacggttcgacccttaagtcgtttctttcatcgtttgagaaaggataagtctttgccgctaatttttgtgaaacagaaagttcaacaaattttgttgagtgaggttcgatcagtgtactgtagacaatgcgtacataatccgatttattatcggcgcattcaaattcgatcagctcaccattttgtgagtcaaaaagttcagctgattggtcgtagattttgacctttattgccattatttgccgattggaaatgcttctttttgtccgtcatccactgtttcatcgcattttgtccaaaattttcggaaaaaatccaacatttcaggtgtattgctgataacaccgtcacactgaacattggaagactcaacttgcttttcgttctgttcgaccaggaaatttttttttagaaaatttcgtgattgctggtgttgctggcgctgttcaaactgattttgttcggatttttggctgacattcggatttgaatgtgtcgccatttgtgctctattggcaccggtcgcattttgattttggccaaaatatcgacgctgatcctgatctgcaaaacgcttaaaacaatttctcgccacatgtccctctcttccacaactttggcacgtgattcgattttcattgaatcgctggaatttgttcggctcaaatgcgtttgtgctttgtttggccatcggtccatcatattgtctgtgtggctggctacggccaaaattttgttgcgttctgtccgaattggcccttctcgccgcattttgggtcgtttcggcacgagcagctagagctacaaactcatcaaaactcattcctggccgacgatttagctccaaactcaaggcaagttcggcattatcgaaactgcggattaggtgtttaatcgaatactcgtccgccaaatttcgcgtcagtcccggataggcccttcgcaccaggctcacaattcggtcggccaaatcatccagcccttctcttggctttcggcgaatgccttgcattaattcatcaaatgctgccatttcatgacaatccgtcgcctcaagttgttggagaatgtgtctttttatgttttcaaatataaacggttcattggccaaagccgaattaaatgctcgctctgcgcgcccactgagtttcgattccaaggaatcaatgcgctttttattcggccaatcgctggtatactgtgaaaattttttgaaaaaagatttaatgctgtcatttccttcattgcccttaatgtccggcaatttgtccagaattaaaacgcattcgaggccgttaagagctgtttgctggccatttatttgggttggactttggtgacgaatttgggtcggttgcggcaccttagtgttcgcatttccaaacatttgctgatttgggtaacccataggtggtgggggatgtggatagtaaggtgcgggatatccccaataagtttccggaattggtggctgaactggcggatataccgcaattggttgttgaataacttgaggtggaggaattagaacgtttgggttggcctggcgctggttatcagtcacagttttttgcaaattttgccgcacaaaattaggatttgcttgaatattgggagggttttgacgcgggtgctgaatatgcaactcatgaataatgtgctcgttattaggcgttgatgtgcgcagaaaatttcgatttagaatgtgatgactgtgatgaccactattgttttcgttcccagcttgccacaattccctttcactgttttctcccaaatttggcaagcgtctgaaacgcattctcaaacctccatgttgctgcgtcaaattcggatgaattgccaaatcttgattttccacattttcttcatcttgtccatgtccactttgtcggtttgctgacccaacattcaaaacggcgtgaagaatttggtcgtagttcatggtgtgtgctaaaatttcgccatcgtttacagaattttcggcaaccccagtgttagcggtgttaatcggccgattttctatattttgtggttgttcatttctgtcattttggagatgctggactggagcggcttgttgcattctgagcctttgccttgtcagtggtggtgagcggaaaatcatcagaatttatcaacacgatataaaacaataaagatcagttttaaaacaacacgagcttttaacaaaattcgttaattcgtaaagcacaacacgagtgcttttaatcggcgagcagaaagttgtaaggtcggcaaaaatacgccgaatgatgctttaaacccaacacgagggtatagaaatcactttgttcacttgatttcacaaaaattttatggccgatattatcctttaatgaatagtcgccactaagccaaacctttgtcgccaggagcgccaagttgaacaaaaccaacaaatttggatggggatgggttgtctcttttcagaaatggatcaaacacaattatctgtcggcttgtcagcacctgtttcaaaacgaattcgcaaacactttaataaataaacaaaacaaaataatttacggcgataaattttaaaccgcaacaataataattaaaaagacgagaccacaacaatcaattgagaagaagtcagcatcaaaagaaattcaaagcaattcaagagcagacaagaaaacaaaaaaaaccgaacagtaaaaaactcacaaatattttaaggtccataaaaaaaggaaaacaaaacgccaacaaataattataattcaaaacataaaaagaagtcaaaaggtcaattaagtaccacaaagcaaatcccccgatgcacttcgctcacagagaaaaaagcgttaccgaaatggataaggacggacaaggaagggaaaagaaaggagccctttttaagtgggccgaccgtcctcccctccctgtgatgacaccgcccgaggcaaaagacagaacgccgcgtcggttcaattgggcgagcaaaatcccacatttagcaaccctgctggctgttctgcccctccttttcgacagtgtgaatgccggttcacgggttctcacttgtgatgaacggggaatttggatttttttgaacccccaggctgagaatgcactcatatgctgggaggggatttgtagcagcaggggccatccctcaccctatttgcttcccctccccccggacttattggctagtgggtttgaatgccatgttgcgtattcaattgcgggtgaaaagatttcatcccaaacgcaatgtgacccagtcgaggggtgtagtcttataaaatgctatttatgctgggaaagggtacttaatccccattgttcgcccttccttctcgcctttgtgcttggcacggttgccggctcaattggggcggcactgatcctttgttgttgtttcctttggtcattaagaagaaatggtgtacggtactattgggggggggggggggatgtacgaacttttgccgcaaaaataggcgaaggagaaggccggaaccatcggtggaatggcagggtccagttataagagaggcggaatcggatgaagggagcgaggtgcgaatcaggcaccggggattgaccggaagattaagcccaccacatcaagtgggtggggcaaatcccgaggaaagtacgcttcaagcccctccgcgattagccaataacataaatagcctaacccgccttggatacgccttggctccgtccctactcgggctcattgcctgtcttaatagattgttttcaccggttaagtctgacctggaagt

SEQ ID NO: 12688 - DNA, 1394 bp, Heterodera glycines
cttattggggcaatatttaaaaattaaaatcccataaatttacataggttctaaatgtgggggtttctagcttcattttgaagctttttgagcggcaaaagagggcaaatttcaaaaattaggctttaaggattttttttgtaccgtttaaatttttttgtaaatttgaaaattaataattgtggaaaaacaataatttgacaactattttcaaaatatttctcggcgacattcaccggcagttcggcaccaccttaactaacactaattcctatctaatttttttaaaatatccgaacccccccccccctccattaccatatttttaaaagaagcaagaggatatgatgctttttgagcccaagcgagactttattttttgtggcacgcgtttaatcaggcggtggtacttatgggcttaatccactggaaatcccaatttctactatgatttacgtggagcctgtatttgtctgaaattggaaactggggcattcattcattctttctgggatcccggccgaattcaactcacaaatccccccccccccgccacaggcactggaatttttgtggtcggttacgcttcggaatggtacgcgcgtcagcgatgtgcccaagtgtaccaaaacgtgttggtggacacgctcgtgccccgcagttgggcatgccatcggataagctaaagaaaagccatccattgatccaaaacatttgaaaaataatttattgtaaatttttgatttttttatgtagattttgttagaatgcataatgtatattacaaatattcacatggctaagtggtttaaaaagtaaaaattttcaataaatttttttgaaatatttcgtcaccgtaaatgcgcttttcttagcacaacggcgaaaacggtggcgactgagggaaagatgaaaaacgaaaatcacacacaaaaaattgttaaatttcccccccccctccgtttttttgctttgtcggtatggaaggtggatgatccgaatcagattatgaggcgcggggcattggtggccgcaacgtgcaaaaagggggagaaaaaggcgggggagataaatgggatttttgctgttttaaacattgccaagtttatccttttcaatatctccgagtgccatgccgtgttgatgaattctaattgtctcaaagaacaagcccagtggttgtttcggagtgtgctgtcctccgccggcgccgccgccgttgtttgtgggcagtgccgtgccgaatgagtaatccatttgctcattgggaatttggttgttcaagagtcttggtttttagtctcgagttaattttgatgcgttttttgtgtcagtcttaagcacaaaccgaactttgttaaacagtggtcaatccaaacgcaaaatgccaaaat

SEQ ID NO: 12689 - DNA, 2238 bp, Heterodera glycines
  misc_feature (102)..(102): n is a, c, g, or t
  misc_feature (108)..(108): n is a, c, g, or t
aaaaagtcgctctaaatcgaaaatgtttaggagaaaatgctatttttgggcttctctcatcataactaagccgcaaaaaaataggtaaaaacctaaaaatcncatccnctattgattgtaatattttttaatttaaaattttttgaaattatttattttgtacagaaattacttaagattttggggcattcatttcttttttccatcgactaattgcttcgctacaaatgctaaattcttgtcattgtgaattcgtcaatttttgcaatgagtttttaataaaagattaattaggagcattaattcggttctttgaacattgatgattttcataaatttactggccatcaaactatcacagaccatcattttcgctatcaattcaattatttaatgatatttaggctatcagggaattattggaatttttgtgtatttttaaagttttttcaaaaatatgtatccgtccaaagttatcttttattttatagttctttttttgccatagaaatcgatcaaatattcatatttctgaaattagggatcagttttttaaattttgccgtaattcaattttcaattcttcgggtgtatttttttgtttttattgcattttttatgaaatttctaaaaaaccaaaataatggcaaaaatagtgacgtattattttaatggtaaaaattccaaaatagtggacatttttggagaattattatataaaaaatcaaaagattataattgaaatctattctggattcattcttctctgtcataaaaaaacacattaattaaaagaattccattttggcattgaaataaaaaaaggcaaaaaatttggaacgcttcacgaatttgcgtgtcatccttgcgcaggggccatgctaatcttctctgtattgttccaattttagtatatgtccatttggaatgaacagaacaaacggaacagcttttccttatatatgaaagaagagaattttgagcaacttttgtgatgggtttaaatggcagcgaggcacagcttacaaattagcgatctctcaatttctctttttcttttccttacacactctctttacatctcccatttctttgtcttccctcctctcctattatctcttccttttttttgcccagctgtgcatttgtctgactgttgctaccttttggagggagagaaaaagacggcgagcaaaagagtgaagaagttttcatccaaaggacacacgagcatgggaaggaaatagtgcacggctcttggggaaaagaaaagagtgtgcctgtggaaagagtgccttctcatcgctctttttctgtccatctcttcccccactttccaccccatctccccctcatccttccatcgttcctttccttggacttgctgctgctctttaaacttacctggctggggagttcctgcgatcaccaaggcagggctcctgtggcgaggctccaccattgcactttcggtcggggctgacccgcagggcggtcccgaactgggataggcccacagctaaatttttgagtgctggggacggcgttcgcgcctcccctttaaaacctttgcttcatctaccgtatttcctcgattataagccccggggcgtctattgttcaacccccctccaaagggggcttatattcgaggggggggcttccaatcgagggggggcttttattgttcaacctctttccctatataaattcttaaaattttttgctttctgcataatggtacaatttaaatcttaatctaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaaatgaagaagttattacataaattttggaaaaattcgttttttgagaaaaaaaattaatagcgctgttctgaaaaggttttttgaaaaacacgaaattcttcctctataagcttctgtttattctatatttttataagacttttgaaaaaagtacaaaaataaactgattttggaattcgggatcatagatggaagcaaatggtttttttgggccatgggttcagatccacttgcctgtaaaaatgttttttagggtctatgggaccactagatcaggaacttgacatccactttgctgagttccaaag

SEQ ID NO: 12690 - DNA, 3888 bp, Heterodera glycines
ctcttcatctctgatttctctctctttatctctcactctccatctctgatttctctctctttatctctcactctcttcatctctgatttctctctcgttatctctcactatttctctctctttatctctcactctcttcatctctgatttctctctcgttatctctcactatttctctctctttatctctcactctcttcatctctgatttctctctttatctctaatttatctctctccttttaatttaaataattatatttaagttgaaataacccgcgcaaaagtgtacactttggcaaagtgttccacagtgatcgcctctccagtgactttctgcgcactttcgtccaatctccgcatcccaaagtgtttggctgctttgaccatttccattcgcttgtcaatgtccaatttgagcagttcgctcatgcacttggctatgttaccataaacaaattcgagcagtactcggaaaatggtcgcgtcgcattcgctcatttccaacagtccgttgggttttctgctgataaaaagcgcatttttgtgcacgactaaaagtcattctttcaattgtaacttcaaaatccggcgaaattcctccgaagcattgaccaaaacaatgcgatggccataaacaatttggccatcgctgaagcgaaagcgaatatcggacagatcgggcgagtcgacaaatttcgggtcaattggcaaaatcggagaaaaggacggcggaggagccgtggaggagccgaaaaaggcgttgagttccctctcaaaatggaccaacgaatgccgttggagttgcgcaaaaagcgaagagagagcacgcgcggcaccaaaacggacggaagagagtgacgcggaggagagaagacggaaaagctagagagagagggggaatagaggggagagagagagagagagaatagaggggagagagagagagagagagagaatagagggggaacagagagagaaagaaagagagagagaaagaggagagagaacagaaaaaaagaagatgaagtaaaaaaggaacaccattttgctaatttaaagaagttacttgacccgatcgccttttcgacccccccccattttctcaccaattgtcccatccgtgccattccgtcgtttctgttcccccgccccattctgcctttctccccattttttgtcaattcgcttgcgaatgtcgtcccgaactcgtccaccagctgcgtcaacttccgctgatcatcgctgtccatggcccattccatcgcatccatccaaaagccgacatttggccacccgacgcccaattccctcagcttaagtgccatttcccatcttaaaaaagaatcatttttggacagattttccgtcttccgtacctttgtgtctctgctgccaaataaatggcttcggagaaagcccatttttcgtagtcattaagagaagcgaagcgaagtgagtccatttgaaagggcggctgaggggaaaaagcgtcggaggaacggcacaacgcattttggccttgaggaaaagccacggaaaatatgagccgaattgtttcagtttaacctttagtattgtcccattgttggcgcaaaaccgaacaaaaagtgagaaaaaggccgaccaatttttgatcaccgcgtgaggcggcgatggcaaaggcggagggacaaatttgggaagggccgaagggaagggacgaaaagggcaaagggacgcagaggaagggattggcaccggcacggagcaaaagctcacagagggcaaaattaccagtcgaagcagcgatctgaaggaggaaaagggaaaaagatcagaaaagaggaatggcaaatgaatgaaatggccaatagccttttcccttccccccatttgtcaaattgttcaattaatttgaattgaaacattcgaaaatgatgcccctgggcattactctcccccccccccccctctccatcaaaaatttttttcctctcccttcccacctgaatgtttttctcttcgcatctcaccgccctcgcccctttcggctgtccaatcgctgcgcccactaattccgtttcttccattgctattgcccaattcagcggagtccatccaaaaaaatcagggaatattttcgagtcgatcggaacggccgatgatgttagttgatgcgaatggcattcagtgcccaaaagaatggcttttgtagcggcacaaaaggggagactccacgaatgatcatcagcgaaaagttgggaagcagtgggaggagggcaatcgaagtgggggagaagcaaacgagcagcccaaaaagggaggggagaagggcattaaaagtggcaaaggaaaagccaaagaaaaagccaaatggaaaagccaaagaaaaagccaaaaggaaaagccaaaggaaaggccaaaaggaaaagccaaaaggaagccaaaggaaaggccaaaggaaaagccaaaggaaaagccaaaaggaaaagccaaaaggaaaagccaaaggaaaagccaaaaggaaaagccaaaggaaaggccaaaaggaaaagcattggaaaaagggcaaaggatgataattaatcggaaaagggcgagtcagaagaccaccccacctgaacgatgtcccagggccgaattgttctcgcgcgtctctgaagtgcgtacaatacgccctttctcagccactgttccaatggcggtgccgtttttgtactgatgaaatggtgcagtgccaacaccgactcgccattcatgcgcaatttgtcgccaaccaaagtgccaaattgtgagatttctgtcgatgagtcatccgccgaaatcaattggccaagtggcgaattttggacaatgagtgacaattcgttaaaggaatatccgtcggatgcgatgggcggggacaataagtgaaagttgcgcgaatgtggcaaagaattggccaaggagttgagcaattcagagacagaaacggactcggaggagaagggagcgcaatggtgcagaaagtgggaaaggagaaagtcgaaaatggcggcgaggaacagagagacctgccgatgagaggggaaagaatggcaccgaaagaatggcacggggagaagagaccttctcgtcaacaatggcaccaattcgagagtcggtcatccaccggagaaagagtccgccgtttaaatgcttcaattggcttcgatcactcagcgattgccaccgctttgactgatcagcgactgttcggacgaaatgttcggaggttttctgagcatgacgaatcgcatgccaagcaagagaagtgggcaaaaacagctgaatttggtggagagtgaaggaaagtgccaaactcagccgaccaaagtgactgtgccaatgtctctgcacgtgcatttgcccaacacagcgcacaatcggcgcaactcaatgcccattctgacgagaagttcagtcagcacttcgactgtcccgttgagctgatccctttgctccttctgagcattggccttttgccgaagcgcaatcgcctccaaactgatcggggcggtcgcccgaagttgatcagtgctgatcagatttgtccacacgtacaaacgcgggttgtgccgcttggatgcacaaatggcactagggctttgagttggatggagtggcgttgcttttgacggatggtccgatgggagtgagtgtcggtcggttgtgcctttgtccggctgcttttcgcgccccatgccacccgtgccctcctccgtctgattctcccgaggcgtccctcccctcgagcggtatccgctgtccgtcgatggtttctttttgccgcctatctctcgcgtcgctccatcgaaattagcctcgtcccgcaacgatgttgagcatttcagtgaataactgctcaatgaactttgcaaagagcct

SEQ ID NO: 12691 - DNA, 1753 bp, Heterodera glycines
gttgcagcgattgatccggtgaattttaattttgaattgacaaatagggttaaattttaaagtacaagaaaattagtttgaaaatttttattaatttaaatagctttaacttttggattttataaaataaaaacctaaataaaaatttattatttaatattttcacctgaaataaattaaaatttgatttttttttaattttttgaattttttaaatttggggtagcgacgagtcgggggtcggggacctcggggggcgacatgtcgggggtcgggtcggggaataggtcccaaaaaggtctcgggtgggggggggggctcggggttggggcttaaccctatttgaaacaatcgcgtcgataaattttcatttttaaaaattatgctaaaaacccaaaggttgcgaactgcgcaaaaaaatgttgcagatcacgttcgtgctctacccctggactgaaataattcattttttatttaattattttaaaaccaatttcgcatagatcgctccattttccgtgtaaaactctgatcgctttgttcgccttttgctcttcctttctcctttttggaacttccatcaaattcttcgtttttctgtttggcatcaattacattttgcttaagcattgcttcttcattcaattagtgcctctaattggctcatcaattgctgtcactttgcaacttggcattggaattgatcgtctgtttggcgttatgttaccactatggtaataattaggggctaatatttataggtgctaaaaactagagtagagcgggaccgggaattttgggcaaaaccgggaccgggacttgccgggacctgagaagtcgggaccgggacctcgatttttgttcgggaccgggaaccgggaccaaccgggaatttttaaaaattaaaaaaaattcaaaaaattaaaaaaaattcaaattttaatttatttcaagtgaaaatattaaataattaaatttttatttaggtttttattttataaaatccaaaagttaaagctatttaaattaataaaaattttcaaactaattttcttgtactttaaaatttaaccctatttgtcaattcaaaattaaaattcaccggatcaatcgctgcaaccatttattttgcaataaattgatacagaacaatgtaaaattgagaaggtgagatttatgctaaaatgttatttaaccaaaaaaaaagctacagatcgccaactgaaaaattaataaaaatttcatacatacagagaaaagaagcaaaaaatctaattatttttttaaaatttactagaataaaattataatacagtcatggtcatatgtttaacacaccccaaaatttttttataaatttagccgtaatttttttactaatagcatatgttagatgctttataccgaagtagttagtatccaggtttcgctgtagggtgtgaaaatgattaatgggttttttccctttgatctttgccgccggcccggggggggtgattaataattaatgaggtgagggggggggctaattatgagggggggggggtgagtgtgcgaattgggaggagcagtggctgtccagtacaggggatgggttgatcattgatcagagtgttgatcagaatttggtgatgatggaggggggtgtgcgtgtgttgaagggatgggggggcgtcaacggcgaatgatgctgccatgcatatattatgcaggcagagaacaaaatgaagaaaagaataaatgagagagagag

SEQ ID NO: 12692 - DNA, 3286 bp, Heterodera glycines
aaagggtaggaggcaagccagccgatggtcaagtggttactgtgcttgcttttggtggcgtggtctctgtggttcgagtcccattgtgatgtttgtttaaaggaaattaaaagggtggaggcaaggtcgagctttttgcaataaaagaaaggaaggaaaatgggcattgaaaggtgaagtggcaagcggccagatggtcaggcggttagtgtgcctgccttttatagtgggttcgggtcccactgcttcagagtaatttgaaaaaatattatatataattctactttttgttttgtttttttatttaattaactttatggaaatatttgtttatttgtttattcataaaaaataaaaaagtcatcagaagggcgaaaaccacttactctgacgactattccggtaaatgtgtcgtagagtaagtgacaaaatatatggatgatcacaggaattaaaaaaagacaaaaatatgtgaaaataaataataaataaattgaggtcaaagtcaaatgaggtcgaaataccaaatcacttagaaatttgttacattctagctttcccggtcttacatattaccctagtgaactttaagttttattttaaattgatttaaagaatttgtttttattagttctttatctagttgattccacaattttgttaccctcccagcaaagggaatgaattttttgcccagtttgtattttgtgttaaatctataaaaggggatgttaaagcgtgctgatggattaaaaatagaaaatagtttcagatctgttcggccataaacaattttatgcgccatgaacagatcaaacagctttcgccttttctcaagtgttggcagttgcaggtattctaatcgattttggtatggaattggcggaaggctacatttaaaaaatacttttttggtgaaatatttttgacacttttcgatttttttaatatttttttgaagagacggattccaaacctctggagcgtattccaataaaggcctaatataagttttatataacgtaatccaaatcttagacgatttggatttaattattctaaacaaggaacgcatacgtaaatacgcattccttgttatttggttaatatgatcggaaaattgtaatttgttatcaatgtttactcctaaatccctaattgtatccacagcatttattgtatttccatcaaatttatatgtttcttttggggtttttgaacccaaatataatacaaaagttttttgcattgaaacttttatttgccatttatttgcccattcgaataaattatgcaatgctttatgcataatctctgtgtcggttcttgctttataacaaatatataatttatcatcatcagcatataattttattttcactcctgatggcaaagcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtttgccctttataccaattttttccaatttgtataaaagtaaattatggggcactgagtcaaatgctttttgaaaatcaatataaatacagtcaacattttttccatttataattgcctcgtaccaatcttccacaactgttattagttgacttgtcgtagacctatttctaacaaaaccaaattggtattccgaaattttattgttttttaggagaaagttgtaaatattttggctaagaattctttccataaccctgcaaagtgagcaggttatagaaataggcctataattttcaggattaaatttgtccccttttttgaaaagaggaaaaactattgattccttccagatatctggaagagaaccagagtctaatgaaatcctgaataggtcagtaataacagttgctaatgaagaatggcagtttttcaatattttatagctaatattatccggggaggtcccgtttttattcggaagttttttcaaaagtttttgtgtctcgatgatgttaaagtctatatctgatataaaacattgattaacaaaagtattgcccaagtttaggtagcctgggtcaacatcagaattgttaaacgaatttgcaaataagttggctaataattcacatttttcatcaccatcatgatagcatttgttttcaaagactaaattcggtatttcaaagggattaacatcgtatttttgtaggtatttaaaaatggaatttcttccctttgaaatagcctttttctcaatttgcgagtgaaatttatttgtttgtatttttatatgtaaactaatgctatcataaagtgctttttttgttgggtcagttttacattgcctatacagtctggctttctctttgatggaggccaataaatgcgttggatatttaggggtcaaatcttttttggtaatttttttcattggaatacactcgtttaaggtttctagcaatgtattattaaaggcgttgtatttttcgttcatactaaaatgctcgttagataaagcgctaattctagaagaaaccataatattaaaaagagaaacattcgacggaaaaaaccgtcgattgtaaaagaagtttgttttttgtagtgtttttggaatagtcaatgtgaaaatttgcgctaaatgatccgatgaaaaaacaccaccttcaatagtacattgctttacaatttgatcatttgccggcaaaactaagtctaaccacgaatttcccctggtgggtccactcgtggcattgaaaaaagaaagcttactaaaaaagtggcaaaaaatttcaccaaatttactcatagaaatgggctgcccttccttccataccaggtctttattcggaaaattaaaagtgaatcgctgtggaaaccgctaacttctagctggccatctttcaatttatataagcttacggctcgcactacagcacttttgatcatgggtacttgcgaacctgggtcaaagaagaccaaaatcctaattctctttgtaggatttcttctggagaaaattgtgacgtatttcgccattagaagcactctttttggatcagaaaccatcgtggctactgttccattttctgttgaaccaattgtcgttatattgacttctgcatgtgttctcttgaattgtgctttcggctttgtctgactagtgttccattcacggccggatttctttgtattcggacaaataactttgttatgcgctcctttgcat

SEQ ID NO: 12693 - DNA, 1651 bp, Heterodera glycines
ataaacatacatatgtattgatatgataagtcaaatttcattttgtgtccataattttcaattttaccgattttatatttcggaaatctcaccaaatttgaagaaatattaacaaagaagcaatggttgaagtatttctggtagagttggagcatccgatgtgctctgttggcgatttgatgctgctgaacaccaaagggataaaagcaaaaagtgtttaaattactgtcggaatgtcggattttgagtccaatgtgaagatgttgaccacaatggtacctgacaattttatcgtagtcattgccaatttggccaatgcttttggcacttcttctgttgccttaccattctcggccaaattggtgctcaattccttgaccgttttctcctccgtgaattcatcctggggacactttcctggcgattctgagttaatgccatggcaaatgtcaacaacgatgaagtggaattgagacgctttcatttcaccggaaaaattcagttagtagaaaaaagtacaaaattacagtatctttgtgcctacccatttttgggtgctcaattaatcttgatcgtgccgtcaggtaaaacgccgggttttccacaagaatgcggtggtgttccgtctcctcaaaggcgaaccatttcttggctatgtaatgcagcgcagggtttggttcgactacagtaacctcatactgtatgaattgttctaatacggtaagagagaacaaaaagcgtaaaatgagctgacttttgttgataaggtggcgaagaaactgttcactgctgaacctcgaagacccaagcagagaattctccgcacttttccgtccaaaactttccacggagtgagcgaatgggcgaaagtttcggtgataaaaggctgagcgacgagcactttttggtagtcgacggtgattttattggtcaaaacggaccattggcgagcatttttaagcgtaaatgtgtaatcttgagaagaaagacgcactaatcacttaaataatccaagcaaaacgcacggagaggaaagtccaaatcagactcggacagcaaaatgttgtggtgcaattccatcgccagggatcgggaaaagccgcttaaataaaaaagtgcgaaatcgccgaccaaatcggtcctgccaagacggaccttccgaaaagggacggtccgtcggacaccaaataacagcccgtgtgctgcttcttctgtcgttgcttttcctccgccactctctgttccctggggcagactttttcctgcacaattcgttcgccttctctgccccctctttcgatggccacccattggggaggcaatttcctgcggggaatcattccgctgaaaaggcaccggcgaagtgagacttacgcgctccaatgttggctctgccaaaaatgccacctccaatggacgatgaacagcagttgagcggcctttagcaattaaatgagtcaaatttgagttttggtcgggccaatgatcccaggagattactataaatccatcaattttagcacatccctgcccaattaggaaatgataattttaaaaaactcacaataataataccggagaggaaaattagcgcaaatttccaagagcttccactgagtttcatttgtttaattggggggggggggtaaaa

SEQ ID NO: 12694 - DNA, 865 bp, Heterodera glycines
ggtcccgaattttgaaaagctcaggtcacggtcccggtcccggtagggcaaccgggaaccgtgaaaaacaagcactggtaagaatgggggtctgagtgaaaaattagtgaagaaaattggagtcaaagggaaaaataaaaaataataattaatatattctttaaaagtaacactgcccaagtgtgcaaatggcctaatggctagtctccttgactttcccttcttctttcccctggttcgatccctcaacagaaactaacatattttgaatttttttttgtatactcgtgggtttcctatagagaaaaaatgattcctcatagttttttttaaattgatacatattttatcattttttaaatgaaaatcctaccaattgagcttaataatcccaaaaccaacctttttttgctgaaaatctgttaacaaattacacccaaatttcaaaatttcccccggcggcgcctatcggcgcctatcggcaccgccggacccccttcttccccaaaaattttttgaaaaagcgcgccgaaaaaatgtgatatgaaaagcaaatattaatttataataatattcaatcatttagtccaaaaaatgattaattgtttgaaataattaaagaaatttgtttgaaaaatttcattaatttaatttagctttaacttttggattttattaaataaaaaacaaaataaaaatttaatgttgtattattttagttgaaaaaaataaaaatttgaattttttaaaaaaatttttgaatttttgaaatttcccggttggtcccggtcccgaaaaaaaaccgaggtcccggtcccggcttctcaggtcccggcaagtcccggtcccggttttacccaaaatt

SEQ ID NO: 12695 - DNA, 1533 bp, Heterodera glycines
tcatcaatcatcatcatcatcattatcattcgtcgtgccactcggccagctccacaaatgagccctccgtgctgttggacgacggcgaaccccaggtgccgaagccagaacagccggcctccgtcgctggtccatgtcgacggcgacgccttggcggacgaatgtgctgctgctgctgagggctgactgtcgcttcagctccgccgtggtcgtcatcgatactgtcgacatcgtcgttgctgtcgtcagcaccactggcgtcgacggtcaacgattcgcccgtcagcatatgacgacgacagagtgggcacgcccgactctggcatgcgtgcgtccacaaacaaacgctgcaaaagcgctgagcgcagcagcccgtgcacaacagcacctggtccaccaacggctccatgcagatgggacacgcttcggccccgacgtccgccttccggtgcaccccgtcggacagttgttttagctccgaatggtccagcggggtccattcgtcgacggtctcgtcgtgaccaatccagtcgtccaatggtcggccgtcggccaggatcacgtcgcgggtggtcgccaactggtcgccatacagctgccagtcatcctcctccagcgccctgtggcgctcgtcttcgccccactcgtgctccaacagtcgccagaatggctgccgttcagtgcgcagacgtctccgcaacagacgttgtcgacagcgtctgctggagcggcgttgctgcttacgacgctccgccgccgggtcgccggtcgtcgacgactgatggaagatcacccggaagaggggtctgtagcccggcgcacggagccgtgcgcttcgccgcggcttaagcacaaaagataaaggatcgcacgcgtgcggcccagtcattaagcgaccgaccgcgtgcgttcctgctgaaaaatgatcacaaagggcaaatccgacattaagtgaccgcccgcgggtggcccattcaacaaatgatcactcgcgtgtgacaggaacataatgtaaccgttcgcgggcgttacagtcgtcaaatgatcacacacgtgcgccacaaacataatgtgaccgctcgcgagcgctccagttaacaaatgatcactcgcgggcggtccagtaaccaaatgatcacacgcgtacgccacaaatataatgagaccgctcacaggtgctacagtcaccaaatgatcacacgcgggcggttcagtcacgaaatgatcacacgcgtgcgccaaaaacataatgtgaccgctcgcgacccctacagtcaacaaatgatcacacgcgtgtgatctgaacataattgagcgctagcgagcactccagtcaccaaatgatcacatgcgtgcgacacaaacataatgtgaccgctcgcgagcgctccagttaacaaatgatcactagcgggcggtctagtaaccaaatgatcacacgcgtacgccataaatataatgagaccgctcgcaggtgatacagtcaccaaatgatcacacgcgggcggtccagtcacgaaatgatcactcgcg

SEQ ID NO: 12696 - DNA, 2962 bp, Heterodera glycines
agcattccaatcactgggagctcaatccttcgtttttcacggattcttcggcatcgtaatagtcgaggactcagttatccgacattacaatcactgggtctcaattctccgccattccaatcaccgaggattcaatccttctgtattacaagcaaagaacttagttttacggattgatcgtcatcaaaatcgcgggagttagtttaggcttggcaagcatacatcggcaatttaaaagaagtagatatcatgtggatatctatatgagtatatagtgattttgttcataaacgttcattctccttgacttccttcccgcgaaatcacacccactcccacacacgcatcctcacggcacacatacccatacaatacaaaatatgtacgtctgcaatcgctcgccaacataggcttacatcgcgccttagagttaagataatttatttaaaatattattaactatggcaattttttgtatgtcatcaatcatcatcattatcattcgtcgtgccactcggacagctccacaaatgagccctccgtgctgttggacgacggcgaaccccaggtgccgtagccagaacagccggcctccgtcgctggtccatgtcgacggcgacgccctggcggacgaatgtgctgctgctgctgccgagggctgactgtcgcttcagctccgccgtggtcgtcatcgatactgtcgacatcgtcgttgctgtcgtcagcaccactggcgtcgacggtcaacgattcgcccgtcagcatatgacgacgacagagtgggcacgcccgactctggcatgcgtgcgtccacaaacaaacgctgcaaaagcgctgagcgcagcagcccgtgcacaacagcacctggtccaccaacggctccatgcagatgggacacgcttcggccccgacgtccgccttccggtgcaccccgtcggacagttgttttagctccgaatggtccagcggggtccattcgtcgacggtctcgtcgtgaccaatccagtcgtccaatggtcggccgtcggccaggatcacgtcgcgggtggtcgccaactggtcgccatacagctgccagtcatcctcctccagcgcccggtggcgctcgtcttcgccccactcgtgctccaacagtcgccagaatggctgccgttcagtgctcagacgtctccgcaacagacgttgtcgacagcgtctgctggagcggcgttgctgcttacgacgctccgccgccgggtcgccggtcgtcgacgactgatggaagatcacccggaagaggggtctgtagccgggcgcacggagccgtgcgcttcgccgcggcttaagcacaaaagataaaggatcgcacgcgtgcggcccagtcattaagcgaccgaccgcgtgcgttcctgctgaaaaatgatcacaaagggcaaatccgacattaagtgaccgcccgcgggtggcccattcaactaatgatcacacgcgtgtgacaggaacataatgtaaccgttcgcgggcgttacagtcgtcaaatgatcacatgcgtgcgccacaaacataatgtgaccgctcgcgagcgctccagttaacaaatgatcactcgcgggcggtccagtaaccaaatgatcacacgcgtacgccacaaatataatgagaccgctcacaggtgctacagtcaccaaatgatcacacgcgggcggttcagtcacgaaatgatcacgcgcgtgcgccaaaaacataatgtgaccgcccgcgggtggcccattcaacaaatgatcacacgcgtgtgatctgaacataattgagcgctcgcgagcactccagtcaccaaatgatcacatgcgtgcgacacaaacataatgtgaccgctcgcgagcgctccagttaacaaatgatcactagcgggcggtccagtaaccaaatgatcacacgcgtacgccacaaatataatgagaccgctcacaggtgctacagtcaccaaatgatcacacgcgggcggtccagtcacgaaatgatcactcgcgtgcgccaaaaacataatgtgaccgcccgcggctacagccaacaaatgatcacatgcgggcggccatcaacaaatgatcacacgcgtgtgatctgaacataattgagcgctcgcgagcactccagtcaccaaatgatcacatgcgtgcgacacaaacataatgtgaccgctcgcgagcgctccagttaacaaatgatcacacacacacacacaaacacccacacgtacaaccaccccttccctaccactcaaaacacatttgaataatgcggtttatcaatttgaattatttttaacataatgcatttacgatacatcatcgcccctcagctcaccgaggtctgctgatcgcctcgcacttctcggacttcatcagagaaaacgaacaaatcatcatcttcctcattttcatcgacttcgtttctcggttgtagttgtggctgttgcgcgagattcacggtggcggtgcccgaagtgccaactcgagtcccatctgttaattggttcataatggcaataatttgttggcattgtaccttcaaaatttgcaattgccaaaacattctgtggcaatggcgcgctccccgttggcgtccactctgtaattggattattaattaggcaacagtgacaatgaatggcatccccacacgctatccaaaactataccgtggccggcatgcgcgatgatgttcatggttgaaaactgcccgtacgtagtggaaaacaagaacgtgttttcgaccgtggccccggccttgctggtgacaacgttgagacggttgagttggacacggtcgcgcggctgagcacgggcaagctcgctgggtcgatcatgccgctcccactccttcacggtgaggagctgcgtcacttccaattcaaacttcaagaccaattttcttcctccgaaaatggacttgtcagtccccattgggccacattcggccacca

SEQ ID NO: 12697 - DNA, 2359 bp, Heterodera glycines
tttgaaccgttgccgcttctgcaagtataattgacgagacaaaatcggttcgatacatacgaatggtgaagaacggactcaatcgccagtcgatgagcaatggattcttcggtacatttcctattatcactaacgcttttctcaccatcctctgtcatcactccgtaaacatttgcctgaaaatttggccatgatttaggctaacgaaacaacagcaacagacgaacccgcacataatcgcaataagtacgctcacaaaaccgacgactttcccacaccggttccacacgaaaagtgtcgtattcggccatgatgcattccaaattgtccgtcattccaacgggccacgctgactgcccatttttgaacctgtaaagaaattggcttacattgttttcactgaataatactttgaaaagcattgcacatggccaaatttaaacagcgaaacaggaaatgcctgccacggataccagtaaagttgagggtccattttagccaagcattcctaaaagaacttttgagtgtaaagtggaagtgttcctggcctcactgaattcatccacgccccgtatccttcgtcaatgaaatgaacgtaagcaaactgataacagcgttcactacgcgcattcaccacctccaccaattgagtaatcttaatatatattaggtaaatcaatttgaatttattttttgttacatactcttcctcgagaataaacattttcctcaagcggtgccatcacatatttataaagttggatttccgaagaaaagggcgacgaagagtaagaaccaactccttcgtcctcactcgaagctgtctcttcagattcgtgtcttctcttgtttcgtgcatcagttgaatttattaactccaacgcactcaacggctcgctaaaatgagagactaataaaattgattttaattaatgcattttacgttagatgaatttgcagttgatcagttatatgattgtgcagtttgaaccatacacagttgggtgattgaatgtgagccaacttgcaaattgctgatgacccagaaagaacaatacgatgaatctgaatatttttttacaattcaatataaagacgtagtatatatgtttgtaagattatttcattaaataacacattttgccttttcctcatccgttatcaattcacgctgacgtcggccaggtccttccaaacgcttaagaatcggagaatttgaccggttacaagaagacattccagcactttcactgtttagtgagcccgatttttggttctacagtctgttaagaaattatatgtaggtccaagaattttttctacttcacagatcgttttcgcgccagcccgaaggcgccgctcggtaaaatttgaaaatttgagtgtggtttgttaattaacagattttgcaccaaatacataatgccataaattaataaaaaaaaattgtataaaatttcaaaaaattgtaaaaatttgaatgttttttgttaatcattctgatttttggatatggtatgtagagtaatatttaaaattaaaacaggactttttgtcaaggatcctgtcgggttcacctggaattcggattctggtccgggttttaacattccgcgttcaacttatccttatcaataaaatgaccagggtttccgcccgaaattcatttgctgtcgaaatcaggcacagatagtgagaaaagatgaaataacttactgtcgaaatcactcattcgaaaccaatcactgtcgaaaagacatagcaccggcgggggtgggatcccaaggattttcaaccccatcccctgtttttcctatacccgaaaaatgggattgcagaagcagcaaaccaagttaaaaatatatttttcgttcgttccaggccattttaaattttggaaaaaatatgcatgtgaattaattattacacgccctattaataataatctaaatataatatttacaaatgttcccacaattagaaagacaaacaaatcattaacaaattatcgacatttgtttatgtgttttctgcgtttattatttttaggtccaaaaattcataatttaaatttaatttataatttaacaaataattataaaaagaatttttaatttttatggtgccaaactttattgtcgccactttcatttatcaaataatccataaaatgcgccttggcaatgtcatcaaattttcgtcccctcaagcgttatcatttatttctgttcaaaatgtcaaatgctgaaaaattacgcaaatttttttggttggtagggaaagaagatgaagaatttgtgccgtaatttaatctgtcgtttttagtggttggactgccggggggggagggattttattt

SEQ ID NO: 12698 - DNA, 1777 bp, Heterodera glycines
ttcttaaagctgctggtggaatgccattctttgttaaggccaatttgtcagtttcagtgccatggggcaagtcaatggccaagctaattactcccataaaatggaaaaagattgctcaggagcacagtaaatgatttctagcaagtccggtcaaaacacccggtttagttcgtttttattccggcattacgcgccgttgccaataaaattaagagcatttacacggcggacattgccgacgaagccaaaaaaggaaaggatttgcctcaagggatgaaaagttcttcattagcttcgccatttgttttcccattttctccaatgttttaaattcttttttaaattgccgtttcaaattcaaaaaccgcaaattaatctaattggttcggttattttaaaatgtatggcttagacgtcacattaatacataataaattggatttattgacacacgaaaaatactaattaattttagcaagctaaggactctttttgccttgctctgacaatgcgtttgaagcttttaatttcattttttcatcattagccttaaattgaaattcgattaaattttattttaatttaatttaatttaattattttcgcctttttttaattcccacagtttttcgaatatcagcaaagcaaactttccattagcttatgaattcattttgcacactctttttaacattttctcatttatgtaaattctccaaatgtgagaaaccctatcgacggaatgaacttcaaagaattcccgcaattattaattaccagtaattgtttccccgggctttttttctttagtgtctgagcttttgatactaatgttgcatattcattcagcattcattttaatacctttacaaaaatccatttccattttttggccaaatgataattttctaaggctatcaaaatttagggtgggaccgtttaatttaaaaaaaaaaaattattttcagaaataatgctaattggtcatcttttaaggagttgggggttggcgcgacagaattggccgcctcgcttctccccgccgccgccccctccaaatacccccgcggcattttctcacaagtcacaacgcccacttccttctcgtattatttggaaaatgattgcttcagggatcacgccggtgtttttaaatttgcgaatttaaaaaccaaaaaattccataaaataattttaatcataaatctctttaaaatttatttccctgtttttcgaaattttgaaaaggtcatttaaatttttccctttttattttttaaaattggccattcatttgcaaaaatttcgtagttaagaaaaatgacagctaataagcaattcaacaacagcttccttttcccctcatttgtcgtcgtttaaattctgttagcaaccatttcacttacttttgtttggtgtcaaaatttgttgcggcacaaaaaaaacttttaaatttaaatgacaaaaattacaaaaaaagaaaataatagaaaggaaagtgttgaaaatttagacattcattttgcgtttttaagttaataaaattttcaaatttaattccttgaaattgtccattggttccgtttgccatttgccgatgcttttccctccaatgcttttcccctaaatccctttcatttctctccccccccccccaatttcggcaccattgcgccttccgtcactttcttcgccttttttgacaacgacagtcctcccattggctcccccgcttcttcttcccttttggccactgcttctgactctagaggtcccc

SEQ ID NO: 12699 - DNA, 2436 bp, Heterodera glycines
  misc_feature (42)..(42): n is a, c, g, or t
  misc_feature (2309)..(2309): n is a, c, g, or t
  misc_feature (2350)..(2350): n is a, c, g, or t
  misc_feature (2369)..(2369): n is a, c, g, or t
tttttgcactggattagttccctattctgttaaggacatcanaattagtcttatattaaaacgcttaaaattttagtttaaacgattaacttcaacaaaatcctctcatctaaatttagcattttttccaacgctgatcgatttgaagtgaaaaccgaatggcacataagcaaccttctaattctaacaacgttcaagtcccttcttgggatgaattcaatttggtgcaagaggaagcaaattcaaatcggctttctgccaatggatttgaaaatgaccagcaggaaattggaccaatttacgaacctggacatgctgaagaatttggaccgaatttaccaccaggtttgttagaccgagtattttcctacattaactttaggatttgtccttggtgaattacaacaagaggattcggtttctgtcggaatgaattgtgatggcgcaaatgacgacttttctatcccaatcggtttttgcttttttattttaagttcttagttttttttagaagcttatgaccttgatgacccagaagaccccctccagggcggcgcagctgcacagaaaaaggcgaacaatttggaggttcacaatcatccattggtattgccgaaagttgtgcaccaaaaaagtggtcggtctgtcactttgcgaacagagtttagcatttcttaagacgaacaatgttcgctcccttctctgagcatttcttcggggcaattggccgattttgtgcccgtggaccaaaggccgtgcagcagttcgaccatttttcagtgcgacgatgaaaaaacttttgggccggcacttcctcccgaattcgtttctatagcgtcgcaacaatttgatggttggtgaataattaaaaagcaacgtttatcaatctattattttctaacacttttcattgtttgttttgttcagaatacgatattggaacgtcgcttccaccggatgagccgcagtgttcaatggacttggcaaagaaagtgccggaagggactaacattcatcgcaaaccaaaatcgattctcgaacggacgaacttcggcccgactttgccgagcagtagcgacgaggaagaggaagagaaaaaggaggacaaaacggaagacggaggaaacgaacattttgggaagggcgaagggactgatgagaggcgacacgacgtggggtgggaagagggggaggaagaaacggttgggccaatgccaccgatgcccgggaagacggaggaggagggacacgccgaatatctgggcagactgacagaatttgaattcaacaaacacactcaggtcatttgaggtcccaaaagaagggacaaaagcaattatgactaattaaaatggtaacggaagactgcgttattttgcattgtttaagtcaaaggaattacggcgttgaggaatggatgacggagttgccacaaaaaatgctcaaaactggtgcatttgggcttactgcgaagacttcgttttctcgaaggagttccgacctttcactgcagaagtccgacctttggacgaatgtgccaaatggaaactcagcgacgactaagccgaaaaaggaggtgaccccgttgtttggctctatttgtctgaccaacgacttacagaaactcggcgaagttgggtcttcgaccaaaacggcagaaaacgaacggttggaacagcaaaaagtcgacgaattaaacgtaatgaaattccattttgtttaattaacaattccatccatcgtttagaaggaaagaggcgaatcgctactcgaacggcaccaaaagaaacgcaaaattgacaacgcccagtcgtcatctacgagtgtaagacaaaataagtcggaattttcagtttcttttgtccttttagctaattgtcactgagggcggagaacgaaaacctttcgacagagacagagaaattgaggcattttaagggaaaatgcgagagggtaatttccgttttcagagccgttgtttccgtgggaagggtggcgccgggggaagcggagaaatgaaggaacggatgggcggcgaattgtcgagtcgttttgggcacgcgaatgaccgtaaatttctttgagtgttggacctccaaaacgctccacctcactttcttccgctccccacctcaatgtcactccattcctattagtattttattttttaaatgtttctatttgttacaaatggctgatttccccctcgttctctcgtattaaaaaaaaaattaaaaagtgaactcttttcgtgttctttctttttttagaagttttttcctgattttttaaacctggtgtttattgtncacttaaaatcaagtaaatgcacaaacgaaaaaattataanaatttggattatttcatcnaagtccccattttttggccgcactcatttaaattttatttattcgcaaagaaaataaccgcccgaag

SEQ ID NO: 12700 - DNA, 2520 bp, Heterodera glycines
gccccaagagccccccgggtccaaaaatttttaaggaaaaataatattttggctgaaaattttaggttttccttgctgggctggtaccccccaccccacagacctggcctcgcccaaattttccaagaaatgtcgctaaatttttcaaaaaatccacaaatttttaatgaaaatctgctaaaaatagctcaaaatcacaaaatttggtcattttttggacaaaatctgttaacaaaccgcatttaaaaccgcaaaaattttcccggcggcgcctatcggcaccaccggaccccctgtaccccaaaatttttttgcaaaaacccgccacataaaaaacgggtgtgaaaagcaaaaaaaaaaaaaaaaggtcgtcgcccggggggaggtgcccccccccaagccaaaatcctgggaccgtccctgcggagctcctttttcaatgtattttttatggaaaaattccgctttcagtgcgccgtatgcaaaaccatgggcaataatagcaaaggcacattttgatattaccactatttcgactgtattgtaagaagcaccttactgataatgaggctaaattagcatggaaaatgggtacatttttaatttgaagcaataaaaagtgatcgggcttatttatcagtcagtctgccctttgacactctaaggcaaatgagtgagtgggggggagtgatttcgtcttttgtctgttcgttcgtcttatgtgtcgtccatgcgggcgcttccccctcacattggctttatccacggtgaattggcacgtttcgagtgccaaatgccgaacttcgcccgcccaattcctccgccggccgcaaaagattttctgtcaatttgtttgaacggctgataattgcccttcataacaaacctccgccagcgaaagcgccacccgaccgatactcgcgcgaggcggctgaagccgttcggcggaagtgcgacgattcgcggcgttcttcgcctgacgacgcattggcgccgaccgcgccgctcaaacgcgactcggtgcgcagcataggcgaggccggtggaagaacattagcggccgatccgctgcgacggaactgaacggacgaaagggttgggcggggggggggggcgtcgcttttccatttggcccacctcctcgcggaattcctcccgtctcgcttcgtgtcgcattccgttcgcgtccgtctacaattgccaaagtcaaatcccttcccccggcacattggctgacctcgcgtttctcgaattccgttcgatatccgtccgatcgcgggtttggcgaaaggtaaccaccgccgccgttcgccgctccgttcagacggctctcagccctgtaataatcgttggccgaccctcggcctgagtcggcgtagtagcgatcgcgcggcgagtatgagctcgagcgcgacccgtagcccccgccctgacgacgcgagccgctctcaattggaatggaacgttcgccttccacggcctgccaacgcttttgggcctcgacgctcagacggccctttgggaatggctaattgggcggtggggcggcaaactcacagaactgtcgatgtgactgctgatcgagtgggactccacatcggccggcaattggtatttgcggacgaaatactgaaaagagtgctctttttttctctctcatcatccctttcccgtctctctctctcaaccctctcttctctctctctttgtgccgtcactttcccttccaataaataccattttggtgtaattgtctctgtctcgaacatcttcgtgccgtccctcaatcagcaaagtgtcgtccatcgttttcacctgaagttcctccgggcggaattggtaagtgtccatttcgactgcgaaacggttactgtcgttggtgatgttagtctgagagagaagaaaatggaggagtgagtcaatgaatcggcactttgtttactttgacgtcgatgccatctttaaagatgggctcggcccaacgcgggtacaaatcgcgccaaaaggggtcgtcacgccaattacggtcgaaacggtccaaatgtgaagaaaactgacaaagggacgagcgaatagggagagggaggggagcaatggacaagggatgggggggaagagatttgcaaggggaggagcaatccccccaggcgctgctaataccctcgttgcctccctcttctccccaattgcgcgtccccttccgtgcctcttcctcaaatggttttctcctcgtcctccacccttcggcattcactgcttcggtccctctcaggtgcggaaatgccctgtagaattcgtccgagaagaacttcccccgctcttcctccgcttcccatccgcttctcctccattcccttttttctcgctgttctttttccgtcttcgtccaaatttccgcttgtccgttttcccatctttcagcggggaactcttctaccaaagggtctttccacctcggactcggccgatttggtgcggaaaaagaggcggagggaattctcgaagaaactgatggctcgg

SEQ ID NO: 12701 - DNA, 4775 bp, Heterodera glycines
  misc_feature (25)..(25): n is a, c, g, or t
tttattattatatatgcattaccanttgcaaaaaacatacctctgttcaatgctttataacttcttttatacttaagttaaaaatttaggaaaattatattctgaaagagaacaattaaagctattgaatgataccacgaaatattaatttggttgaatttgagccaagctattaatttaattattttacccattttttgttttcaaacccattggcagttttaacaaacgcgcatgggtggcagttttaacaaacgcgcatgggtggcagtttttaacaaacgcgctagcaccaaaaaaattcatcgcaaaatatttgctttatgaataatttttatactataataaataaaattaaatgtaatatgaattttttataacttttttgtttcaaataatgttttttacaattaattgactgtttcaaaagcgttatgaatgattacagaaatattttcatacatttgcataatttctcttattcatttatttacttgtgtttttacgttgctattttgagtgaatgtttttaaataaataaaaaagtttaacatttattttattatatattaacgccatccttttaaaaattggggtcttttcattcattttattatttaggtatcaataaattgtatgatttatttaaacttatatttattttattttcacgatgagatgcgtagatgatttgtcatctgtcgtggtaagcgttttcttattactaaatgcatttttaatttctctcttccctaataattatttgcaaatataaatttacttttatttaatgtttttgttacaattttatttagtcattagcgaaaattaaatttaaaattcgttcaattttgttttctatatattcaacaattgctaaaaattaaagaatattattaaaagaattgaattttttgaaacataaaatatttttttgatttcaaatcgatttgcaaaataattttttctcgttttttttcatttattttaagagtatttaattttttaaattattacaataatattttgctctattatttaaattataaatgaactttttgttatgttatattttgtttactgagatcttttattaggtttattatcttatttttataaaagtaattcattttttgttgaatttgttggtgttgttgaactgctagcaaactctgcgatgccctggctgatatttgccgcctttgcgttatttttgtgctttttccgttgatatgtgtcgaataattgcgttttttcctgctgctccgagtgagatgtccacattgcatgaaatacaatgaaattcgtcagcatttttggcacgtttaataacgaagatttatttaaattatttgctggtttattcctccattttcttttccctccctattcttgccacttttcacttaattatggtggaaaagtgtatgcttaatggaggaaaattgtttgttcgagaaaccttcggtgtccggccattttcccctggctgtgcttccatcctctgtctcgaagacagtttaatttcatttttaaatgttttttccttgtaatattcatttttgaccgtaaaatcgttgctttctctcccagtctgtttgacctgtgccgccggtcggaatggcttcggatgtgagcagagttgccccaaggcattttggggcgtcggctgttcagaaaagtgcctttgtgatgcgaatggtggcttttgtaaccccaacgatggcacatgcggtaggtaaaactgccgattcgattgcctaaaattccgtgtctgacagagtgtgcgctcggattcaccggcaaaaattgtgaccaaagtgaataaatttttaatacacaaattgcataaacaatgtattttttactaataatgtcaattttaaatttcccacttaataatgcgtcgttttgttttctttttcagaatgtcctttgggcacttggggtttcaattgttcccaaaattgtcgcctttgtttgaacggtagtttgaatttccaaattttgctattctttcattttcggtacctttttttcagtgacggccaatgcaaatgtccgcctggctttgaaggcgatttgtgccagcgtcgctgttcggaatggacgtggggcgtttcgtgcatgaacaattgcacgtgcagcagcggccgaaagatttgcgacgcgtcgacgggactttgtgaatgcgcgtcgggtaaaaaagcaaaattttatcatttgggggggggggggggagggagccgagccagttttttacgaaccgatttataaacgtagtttgggttcaatttaggactgaaaggcgacaaatgcgacgagtattgcgatgacggattttgggggcctgactgtgtgaagaaatgctcttgtcgagaagggacttctgcttgccaatcagtcacagggcaatggtaaggacagaaggcagtgaatgctttacaatttgagcaatttcagtgtttgcaacaccggatatttggggaaacgctgcgagagaagtattttcaattttcaatgctttcgagtacaaagcgaaacgcgccttttgttcagcatgtcctgctgggacctttggcaaggagtgcaaacaaacatgttcaaagtgttccgagggtcaaatctgtgacccggcggtcggctgctgctctctcaactcgggactttgcggcattgcctgtacattttgatttattattccatttggcaaatgactgttcaaataacactttttcagatgctgaacagcaaggcgtccaacgctcctccgtctccgcttatcttttgccgggccttttgcttttactggttacttccgtcactttgatcgcttttgcgctttattatcgccacaaataccaaagggcgcgcgaccctccgcttccgactgttaggtaaaaatcagtccaaaaaataaagtggaaatgtgaaaatccgacagttacaatggcggagattacgcatcggtgaacgatgccaacacaaataaagacggaaatggccacacagaaccgaaaaaccaattcgaaaatcgactctttgatgagcccgactttgaagataatttggcaattaatcctcacaaagaaaaggcactgttcagaaatgtgccgacgcgaacagaaagtgatttccaagccaaaaagggattaaatcggatttgattgatcctcacaatcagatgaatttaatataattaattttatatttataaaattctgttcattgtaaatatattgtatgtttgttgtttgatagataaattttactttatattttaagtaataaaattataaatagaataatttcaaatataatttgtgcattatcattttttagaaatgtactaaaattataaaattttatttttatttttcttgatatctacgaaatattcagttccatcctgcatagactaataatatattaatttcttagctaattagttactgcttgattatatattttatttcgtatataattgagtaaatattgttttcattagcctaagaaaaaaagttaaatttgatttaaatttcattgagaatcatttctggtttatttaatttaatgtagaaacataaaaacttatttaaagaagtgaatattttttaaatatttatttataattattttttcattttaaattgtttgccttttaaaatcgtattttgcgaaaacttgcattgagacatttagttagaaattttcttttttttataatatttgattacatattgaaatcaagtatgaattagcaaagttttttttggttattacaaatttaaattttatttatttttgactgtaattcggcatatagtattattttttataattttatatttttatttttgttaatataatagttgcatgatttttttcttacccccgaggggtcggggagcataaataaaaatttcttttatatttattttatgttatcacaattttgtatgctatttcgcagtttttcatgcccaaaatcgcggctttaaatattataaatttatttttattttataagtgaataattatataaatgattaattagctttttctttctttaattagtaatcaataaaaatttaaagaaaataatgtttgtatactttatttattaaatttattttattataatttttatttgtaactataaataacaatttaaaataactaaaataatatttattgtttttgaaataaattttaaatttctctttgaattttaatacttttcaatagttttaaaaaatatttgtattttcaaaaatgtgttcgttaataaattaaataatttttgctatttacatctttgtaccattaccaattattttttattttacatttcacttcatttcctctttttttacattcatataaataaattaatttttaataaattaataaataattaatatagcgttaaaatcatacgaaaataatttcagtagaattttttatgtgaatatttgtgtattttcaccgttaaatttaaatttttgttttaattatttgaattaggtcttggctatattttcatttagcaacaagcgtaaaggaaatatattacatgtaataatacacaataatttagtttttttcaattgttctcgttattgaaaatgagtatgatgcctccatggtaagattaaataatgtaaaatttctttttagtttttttcattatttatttctatttatgtattttttaaatattatatattttctatagtttgttcatttaatttttacaatttttataaatccat

SEQ ID NO: 12702 - DNA, 4583 bp, Heterodera glycines
cgcgacgctctattcaaattagtaatgctaacagtcccacctgaattcgtcccatcactgtcttgttccaacatatcaactctttcggttaaggtctcgaattggactttcagagtctcaaagttggcatttgtattggccacgacatctttcacccaattgactttttggttcaaggaacgattcaggcagcgaaaagctctgttcactccatcttctaatttccccatatcattttgagctttttctaaatcagagatttttatcgtggtctttccttgccaaagtttcctatcaatagccgaaatcgaggactcatcatcctttccactcaaaaacatctttgtttcctgcccgaaggcttgggatgtaccaaaggggaactcatttgacgagccccctgatgtagacattcgaagtcgttcagttgtaataagattttgttttattttgctaaaaaaaattatttggtaatcccattatgcattaattgagagaaaaaaaataatgaatgacagcgggtaatcgaatgaatgcgagtgccttccaggaatgactttatctgctccatctccgcttaaactccgcctaacgagagcaattaacaattctcaagcgccgcaaaaatgtgtaaagtgaatgatctcgcccaatgaaaaaaaaaacggcggcacgtgattacgtgaatatttttatggcgtaaaaaaaaaggaattgataaagtgaactttggaactctaaaactgtagctcatacggtaaacaaaatgatagggcctaattctcatgttttagttggtccctctttttagttagctaaaatagcgcccctttgattggttatcagcccgggcctttttactctcctcaaaaaaaaaattgttctatatttttttgtctcacttcttctctctctctctcttttttttttgcttcacattcgttcaaatatttttataaattagtccttattcgtttgttaccaggacttttttttggttatttttggcttccttcactctcttttcttattctctctctcttacaaataattgttagatttgtcaattttcggtgcagtcagcccctttagcatttagactagcccgggcaaatttcattcttctttttttttgcgtttttaaaatccctttagcttttcgctagcccggacaaatgttctcacctcttttctcttcgtctttaatgtccctttagttttcgactagcccggacagattttctcacctcttctctttttaatgtccctttagtcttcgactagcccggacagaaatttaaaatgtcagacttctttacttgcgtgtacacgtctttgtttcaggccctcaggccagggagatctcccacaaacttctgccggcttacccaattctcagcttcgtcgtcaatgatgggtcgtcgtttcccaaaatgggaaccatccggtgctaccagtgagggatgcgcactgtgcccccagaccaactatgcaccgtttatcccggatggagtttgggagggaatggggaaaagccaaggcgcctttgaccaagccccgaacccccaaacgactcattgactgttaaagatgtatttattcattcgatgttggatttaaacgaagcgagaaatcggaataataattgaagtctgttccatcacaactgacttgactgatcactggggaaagagaaatgtgaagagaatgggcggagaaacattacaatgtgaaaaggaaaaacgtgtgaaaaggataaatgtgattgaattgataatggccaatgggaaataattaaatgagggaaatgcgtcgaataatccttacactttttcaaaatatcgcattttcttgatgattagtcaattttttttttgattaatatggaatttggactaaataataaaaaatgtaaggccaaatcaattggacggaataaatcattggacaatgagatgagaaaatgtgataaatgcagcaaaagcaaaataaatgaatgcataaataaatgaataaattaacaaatgacagacaaaaaaaacttttaaatgacaaaatgaattaatgaaagcgaccgaattagagcggacggacaaacaaacaaatcgacggtgtcttaaaaaaatgcatttccatcaccaaaaatttaaatttaatttattatttttgccaacccaacggttgcccattctttgttaaaatgatccgtcctgctaagagagaagtagagagagagagagagagaggagataaaggagaagagaaatgatattggaaagaaaataaagaggaaagaagagagagaaaagaagagagagagagagagaggaaaggcgagagagaaaagaagagagcgagagaggaaaggagaggatagaataaaaaaggataaactacgagagagagaggagagaagagaggaaacgataaaataagagagaagagaagagaggaaacgatagagagagagattgaggagaggagagattagaggagagattagaggatagagagcgaggagggagagagaaaagatgaggagaggagagatgagaggaaacgacagagagagagagagagtgaggagagaatagaggaaaggataaagagtgagagaggagaggagagaataaaaaaacggttaaactgagagagcaagagagagaaagagaggtgagatacagagaaacgagaggaaagaagagagagtgaggagaggcgagagtgaggaattaaaagaaatgtaaagtgagagagcaatagagagagagagagagagagagagattgaggagaggagagattagaggagagagagagagagagagtggggagagaatagaggaaaggataaagagtgagagaggagaggagagaataaaaaaacggttaaactgagagagcaagagagagaaagagaggtgagatacagagaaacgagaggaaagaagagagagtgaggagaggcgagagtgaggaattaaaagaaatgtaaagtgagagagcaatagagagagagagagagagagattgaggagaggagagattagaggagagagagagagagagagagtggggagagaatagaggaaaggataaagagtgagagaggagaggagagaagaaagtaaaggagagcgagagatagaggaaaggagagaatagaagaaaggataaagagtaagagagttaatgtgaagaggacaggataaagagagagagagagaaagaggaggagagcggatggccaaccgctcgttcatatctatcggttataatagatttaaatgggccgccaaaacacagccgtcgaaacacagatgaccgaaacacagccggcagaaacacagccgctatatatttataccgaataaaaatagttccctaatacagtacacattgacatacagtaagcctgttacctctttatgaggtggagttaaagcgattagaaggcttaaaactttaaataaatcaaagtctgttgtcgaagattttgagtaaattttttttaattgtttaatttttctgaatttatacaattttaaaatatgaaatttataggcataaaactaaaaacaacaaattgatcattgatcagctttgtaaatatgtcttcctcatcagagagttgtcaaatcaaatttgaaatttggcccaaagtctgcctcacttttctcatcaaaattgcaccaactaacgaatggatgcaaagaatcatcagcaaaacgtggagcaacaaaaagtcattaaatgaatctatgtggaaataaaagggattttcgaaaattgaaacataaaaatcccttaaataaaataggcaattaataaattacattttaaaattcatttaattgtttatttaccaacccaaacgaagatcattttttgtgaaatgatctgcgagtggcgaattgacgccaattcctacggtatcaccaacaccgttagaatgttcggcatttattccctttctttgtttattaatcaaaatttcgccatcattttcatatgcataagtgccaatattttcaattatccaatccaattttatatgctgtttgaaggcgaatccgaagaagacccaactgaaaaattaataataaaggattaagtattaataattataataataatttaattttctgataatttggtctcaaaaataaagtttcttacccttttttattttttaccgaaatttcatagtaaaaaatgttggacgaattattatccagcaaaatcggatgttttgcaaagacggaagaccaatcttttgaggaaaaaaaatgattaataacaaattgttcgaaaataccataatcctttcccttgtgatggacagtccaacttttgtcgtcaatgatttcgagattcttatgacaaacattggcatcccaataattttgtcggaaaaaaaatcctttaatcattttgcacttttcagaattgttccgaagttgctgaaattaatttttaaaattaaaaatggaaaatttaattaaattaaaaatattcataactcatgtaattaatttcttctacaaaaataatttaaaagaaataatttattcttcgcttaaa

SEQ ID NO: 12703 - DNA, 1235 bp, Heterodera glycines
tgccgataggcgccgtcggtggtaaaatagaaaatttaagtgcaatttgttaacattgttaacagattttatccctaaattaacaaattttgcaattttaatcggtctaaaaagtcaaaaaacgatgaaaatgcaaattataggtgcacatgcatttttcgcataattctgaacgttttctcaattgatgccgataatttttaaatggttttagtttgggaaatagaagaaatatttactccatttttaagaaaaataggggttttggtggaaaatttttgaaagtttgtgggatttaattaattttgcacaaaataactttatttcgagcgagtttttaaataaatttaatggggttatccttgaaaagctactttttatttgcttttcacacaatattggtagttgactttgttcaaaaaagtttcaggataggggagggggccggcggtgccgataggcgccgccggggaaatttagaaaattttgctctgtttcttaacaaactttgcccaaaaaaatttcaaaaaattgtaattttgaaagttttttaagacattttgggcatttacactcaagaaaataaaaatgtatgtttttaaaaatcgaattaattcaaatattcgcttcaaaaaatgataattcaaaaagtctttcaaattttacaagaggaaaaaataacagtgaaataaatcattaagcacaaaaaaatctaaaagttaggggaagcctgaaaataagaaaaatcttagaaacaagaacattttcagtttctaagacctggcccctccaaataaggacaaatcttagaaataaggacacttgcgaactctgtatataagagattcacaaaaataccttgatgaatctttcgcaaaagtgccgaagatttgtaaatgtgccaataaacctttataagcaaaaaatgtaagtctaaagtttttattcactaatcgacagataaattttggtcaaaattttcctgaaatgttaatttaaaacttttcactttgattgttatcgcaaattaattgccataattataagaaacgaacaaaaaaaaagtgaattttgtaattggaaagggataaattcgtttctattatagtaacaaaatgtttcaaaataaactggaatgaaggtgggcaagaaatacaacagagccaacgcctaattaggcaaagcgcgggaaatgggcaaaagtgaggggccgagcagagacagtagtcgattac

SEQ ID NO: 12704 - DNA, 2281 bp, Heterodera glycines
tctcgctctcaattctcgagctgaaattgctcggcttttgaagaaaattaaattgacatgaaatcttaaaaaatataaaagcactctctaaaaaaattttgctggccacaattttcatttggaactttattatacgattatttaattgatagataaaacgtgtccccagacaaacaatttttcttttatgtttttgatcttaacattttctgttgcgtattttattatttaatataaatattattttattacaatttagaaatgtattctttttatacaaaaaaaattattaattaatcatactgaaattttataatttaaaataaatttaaattttataatttaattagaaacatatgataaaaaggtattttaaggttttaagataaccccaaaaatactcttcattattttcatttttgttaattttttttttatttgaggcgccaaagattactctaaaatttctttgtaattttccattgatttattatgctagagaattttaatattatagctttctattaatttatgctattgcgaaatttataaatttttagtcttttcttggtcttataatttttacggcattgtttatacataaaaaaccataacaacttactaatatcattatattggttcacggatttttaatctgattgtggaattgggaattttacaaaaaaaaagaaaaaacaaatttcaaatctgatgccaattaaaggctgaccgagattctcgaaatctctggattaattctcgctctcgattctcgagccgaaaatggctcggatttactttctcgttagcatgttcggaaaattttaactctcaagcagccttattaaatttagtaaattttctaaaattaaaatttgttttgtaagtttatttcttatttaagcgattcaaatgatgcctatgtttttctttttcgtcttcatttttaattgtttctttaacaacaatggcacttttggtggggtttgcgtttcaaaatacgacccaatgataagtgagcaaatgccatcgaaaaaatatcagtcgaccaattccatgccaagaatggataacaattctcacatcaacattaatggtatttgtatattttaaaattaaatccaattattgcaaaggcttaaaatagcaaatttggaattcacgagattctcgaaatagaaatgagtgagctttggccatgatgtgtttgaccattaaacccggaatattgaaaatttagtttttaattattcaaaattcaatataattcaaatggcaaattttaaaaataattttcaaattaaaattatttaattttcttatttgaaataaaaattcagtttcattttcagatgcagttaattacgctaaaaaaaccaacacaccgggatatcaatcaccatattatacaccgacgcgaagccctattaaggttttctctcttaaaatatttgaataaataaataaataaataatttttgttaaaaaaatatttttagaatggttttccattcaatcacagagaagatttgggacaggtaaaagctaaaattacataataaaaaataatagaagatttttaattaagcagctgacaaatgattcgcttttttgaagttttaaaataaaaataaatgttttagttttttgattttatgaataattacaaaaatattttctaattgataagtgattttacatcgaacacccaaacaccaaaaatttctgaaaatgctcgtgaaaaacttttaaatattgtatttaattattcaaaatacaaatttaattttagcgtgactcattcacaccaaatgacaaagaaaaagtaaaagaggtaatttaaaaaaaatcataaaatatttctgcttcgttgggtcgtttaaacttgaatatttatttgctattatatgtacaataatcggtctacgtcagttgggcgccagcatgtttttggactataacttttttctttatcaaccaaatccaacattattggtatcattcgaaagcccttcagatgctctattagtctgcaaatttccaaaaaatttcgtcaattttgaacaaatttatggccataaaagttggaaaatctggttttttgagttgttctggccataatttttttgaaacttaacgaaatttttcaaaattttgcaggctaatagaagacacttagggctttcgaatgttaccaacaatgttgaatttggttgacaaagaaaaaagttatagctgaaaaggtgctggcgcccaaacgtgtcggcgcccaaactgacgg

SEQ ID NO: 12705 - DNA, 1459 bp, Heterodera glycines
  misc_feature (29)..(29): n is a, c, g, or t
  misc_feature (241)..(241): n is a, c, g, or t
  misc_feature (276)..(276): n is a, c, g, or t
acaaaaaatgttgctgtttgccggtaaanaatggggaaatggataaatttgtgaaaaatataattgaattaatatttttttaaatctctcccatataattttgaattgtcaactcccaaatagtgaacattttttaattattttaaatgtaaatgaagtttcatttggattataaaatgtataaaattaaaaggattaaaaaaaatactcccatattttacattaaccaaactcccaaatntagaaaattaaaaaaaaaaattttcatttcccatntaaaaaagcctaaaaaagcattaggtttacagttggtacaaatttttaaaaagataaaatttcgatttttttttccacggcgacgacgactgtcgacagaaggcctgggctgggctaagctcggctttgcactcgaaatcaaagctcaaaagataaacttaatttttgaaagtcgaagttcgaaagctcaaaatatgaaattttaaagtttgatgctctgggttatcaaaacatttttccataaaattaagcgcttcgtaaaatagggagcaatttctcgaggattattcatgatgttttttttttgaaattataaaaaaatttaccaattcattggcaatgtgtaatttatgggagttcgcaacaaataaattttacaaaatttgaattatttagcaggcaaaaaaagctcttaacgccaacaatgctaatgagatgagcttaagccattcgggcaagtttaacagtgaacagccagaagagtcgagacaagaatcagaagaggaagaagaagaaacatcttcatctttggacgccaaaaaggtgagcaaaatttgccaaaaaataagcccaaattaagccatttgaaaaataatattcgaatttttcgaaataaaattattaaaaagggaaagttcgaaattgaaaaaatcaaggttttgaatttcaatcatgctgatcaaaatggacagtataaagagaagaacactgtgctggacagaacgaaagaagtgacaaatttacactacaaattacaaattcaatttattcgatataatgaaaaggtgtcatggcaactcgtaaactgttatacaacgataactcttacaattgcttaggtaggcctaggctttaagcttaggcttaagctttaggctaggcataggcttgcttgggcttagacttaggctttattttgtaaaatacgagttgccttttgtacgagtttattgttataaattaatattttttttatcattttaggattgcttaaccctcgactccccagctgtttttgagaagatatttgttgatgaaagaatgacggatgttagaaagaaatgattaaatttgtgatgaagatagaattggagttttttaagtgtcgatatggaaacaaatttactacgatccctctatagaaggttttttatggatttaagtatttttttaaaaattttat

SEQ ID NO: 12706 - DNA, 3706 bp, Heterodera glycines
  misc_feature (15)..(15): n is a, c, g, or t
tttccatattacccngtggtgttttaaattttaataacatatatgattttcaggcacaaacctacatcggtgaccaacattctcagaccgttggtcgacgagtacatcagcctgttcaacgaaacgtttgatgcggaaaagaacgcaaaatttctcgacaatctgaacgtaaggcagcaaaaaaatatatttttttaaattttaaattcgcagcaaaaatctaaaaaaaactttttcgatgtctaactaatttttttttgtctagaactgctttaacatgcaccgttttgccgaccttgtccagctgattgtcaagtccagcactcgcgcacttaacaaatttgccaccaacgacgctgacgaaacgcggcggcatcgacgcgaccattggacgcggttgttgcagcgaacgcgccggcttgccaagtgcttccggcacagtggcgacgacgcggcctggcgccgtcggctgctgtttgtgcatgtcaaaggcgtgctgacggaggcggccgaacgtggcgattggttgctggtggacgaaatcaatttggcacccgtcgaatgcatggacgcactcatcgaggtttaatcagattttggtgataagtacggtgcgtgcagctcgcgcctccttcgatttgttttggaatttatctaaatttcagattcttacgattagaggtttctctagttaaaataaaactaaaaaattcgattttttaaatttacaacaagttttttaattggttttctttgcaaattgtaatagtaaaaaaaaaaatctattccctcaaaaaacagaattaaaatttctcattaaaaaaattaagagtaaaaaaaaaattcttatccccaaaaacagactttaaattttcatttttaaaatttttttcggcgtggcgatgaaaagctgctccttggtatttcaagagggataattatgccccatcattgtcaagctgttcgacccatcctctgacttcattgtccatgccgactttcgtctgttcgcctgtatgaacagtgccaacgatgtgggcaagcgtctgttgccgttgggcattcgttcggcattcactgaattttttgttgccgaaacgagcgccgctgaccaactgcggttgatcatccgtggccaaatttctacaatgggcgaacaattggtggaatccgttctccaattttacaccgatgttcgggcacaattccctggcaaattcaagtgggttgaattttatgtataattttttcgcaaatttttaaatatatattttttgtcatggatgacgccaaccctccaaataatttagggcatccaataagaattccgctatcttaactttattggtattacaccactttactaccacgccaaacttaccgggttcaaaattcgagtccgattgtccaccgtaccaagctgtagccagaaaaaaaaattcggatggttgaatccaaagattactaatttttgccattttaggatcaatttaaaaaaacgaaaattctttgacgacttgacttattgcctgactaaaatttttttgtaagttgtatttttttttagtttacgcacattgagccgcgcactggcggttgcgaatgatcagctacagcaacgtcactacggcactgctcgacattgtctttgccgtgcatgttcagttgcatttgtctctcaattggacattgaacaacgcaaccgaatgcaattggtggtgaccaaatggcttggcgctgtgccgtccactgcgcgcaatggcaaactgagcgaggacgatgcgcgaaaatttgtgtaagcaatttgttgagttcgattcaagaaaaaccttgacatggatttcctgggcataaatccaggcctgggttcaggtcctggtcgaactctagcattttggtacaaaaccagttccatttcatttttttaaattgtcatgcatatatattcccttttttacataattttttttgaaaaattgccaattctattatttttttagtttaatcgaaggccacaaaattcctcgtggccccctgcctgtgctcacaaatgatgacaatgaacagcaacaaaaacaacaatacattttcacgcagtctgtccgtgccaacatggctcttttggccagcgtggtggccaccgggcattttcccgtgctgatggagggcgaaacatcggctggcaaaacatccatggtgatgcagttggccaaaatgagtggcaaccagtgctttcgaatcaacaaccatgagcacactgatgtccaggttttgattttttgatcttatctctcacctcaaagaaagtaactcgacaattaaaaaataactggaccaacaccctaacaaagagtactaaaaaatcgccggaaatttagaaaaaaaatttacaataaatttcaaatatcaaaaaaaaaccttcgggaaggaaatgatatcggggggggggggagagaagaagcttctcctattatagttaagcataaaataaggcattttatgtcagtatctgctatactcttaaacaaatacatattttaggaatacattggcagttatgcgccagatgcgtctggtcgtctcgaatttgtggaaggcgttctgttgcgtgcggtccgcaacggtgattggattatcctggacgagttgaacttggcgccaagcgcagtgcttgaagcactcaaccgggtaatgctttcggggtgcacactttaaaaccttgaaaattattaaaaaaaaattgggcgattttttggaaatcctttgaaaacttagaaatcatcataaagttgagaaaatcgctgaattttcttctggttgcataaaaacaattattaagttgcttgacgacaaccgcgagctgtttgtgtccgagttgaacattactgtgcgagcccatccccggtttcgtctgttcgccacccaaaacccggtcggcacgtacgcgggccgtaagcgtctgtcgcgcgccttcctctcccgcttcatgtgcctgcaatgggacgcgttgccacacgccgagttgcccaacattgtgcagcgacggtgcggcgtgtcgccccgtatggccgaactgatggccgccgtgcttgccgagctgaaagtgcggcgtgcaattggtggcatttttgcttcgtcggacggtttaatgactctgaggtatgtattagggacaacagaaatagaatttttttttttttggtaatatagttatagtttttgtattttccacatttagaaaaaatttcctatataaaaattatctattttttttactcataaccaagatttttacgtattaattaaattgggttttagtcatttttgcgattagtgactcttaaaaacctcgagaatatgtttagatgatcattgtaagcaaaaaaaatttgctaaaaggggcgatgtagaaataagatgttagctaagttttaaataaatatttttctcttacggcgattgggccaaagctaatttaaattccctcaaaatttgctaaaatttaatagtttaaaaaaataattgacttacaatcagagaagcaactcggggactgagaattgcactcgtaataggcaacttaccattgcagggatctgttccgttggggccatcgcatgtcgtcggcactggaggatggccatgcaacggcctgattggcgtcaagcgctcgctgaccaaggctattttgtgctgggcactcgct

SEQ ID NO: 12707 - DNA, 2172 bp, Heterodera glycines
gtttcaaccatctgtaagggtaatttgtttattttatttcattttttataaacgaattaataatttaatgtatggactttaattttcgtcaaaatttaattttcttacataatcttaggtttttttttatcaaattccgctttcattttacaattttttaaaatatattttttcagattttcattttccacgcgtgatttggtcactttgtccgaactgcttgcaaagttttacttcaccgttggcattccattgccaatggctttgttccatgcaattgaggcaaatgtgtttgatgcggtgggtgtgctgccatcgcggctgtcatttgaccgacgtgccgtgattgatgcttgcattaaacaggtatacatgaagtccaacggtgtatggattttacactaaattcctttttgtcggcgaatttctttcggttttaaattgcaaaaaattaaattgaattccaaacactcacaaaaaaatattttgcttttttctgtgcaattaaaaattccagtttcattcattgatctccgagttggcattggacacagatgatggtcaagtaccgttcaacattgacattggcagtgagcagcaacttgaaatggacgcacacgcacttcgcattggccctttcagcattgaaagtaaaaatagtgggtagttagttatttggttttgtttttaactgctactattgtattgtaccaagaaactgatatttaccaagattttacgggagagggggggggggggggaaggtgccaatttttgaacatgtaataatcgattaaaagatattaatttaaaaaaaatcagattttgttgatgtccatcgactccccgtcggcttttctctgaacgcgcccgccactcgtcgtaatgcgttgcgtgtggcgcgtgcgcttgcctcaaccaaaccggtcatgttggaaggcagccccggggcgggcaagtcaagtctgattgttgcgctggctgccgccactgggcacaagttggttcggctgaatttgtcggaacaaacggtacgattttttttaattcaaattcttttttctaccttatgctcaaagtcaaaatttctaaaaaaaaatttttttggtatttctatcgtttaaatttttaaaatatcattgaaagatcttttttaattactgttatgatttattgtatttacctattttcattgatcaggatttgcatgatttgtttggcggtgatatgccggtgacgggtccggatggttcagcatcgttcacttggcgtgatggtccagtgcttaaggcgatcaaggaaggctgtgggatactgcttgatgaggttggggaggggaaatgtttcacttcactcttccctctgaaatttttttggaaaagaaatttttcaaaatatttcgttaggaaaaagttttataagaaatttcaagaaattaattttgaaaaaattttacgtgattttttggaaaaagttcgtaattcatcacaaaaaaaaatggaaaaacgctagaaaaatctttcaaaaacttttttttagaaatttttattttttccctcttgtttaagatgaatttggcatcccaatcggtgcttgaggggctcaactcgtgctttgatgtccgcaaacaaatttacattgctgaacttgaccgcacattcacgctggactgttcccgctgcaaattttttgcttgtcaaaatccacaccaacagggcggtgaccggcgagcgttgccaaaatcgtttctgaaccgattcatttcggtagcatttttttttttttggctttttggtcaaacaatcttcggttaattcatatttgtccaccctttttatttaaaaatcgatgtaaaaaagaaaaatttcccaaggaaaatccaccaccattgtttgaacggcagatgggcatgccaatgaaaaaattcagttcaaaattctgtcattttgtttattgatgggtggagagcagctcgtccttctccccccaaaaaatagaattttttttgtcattttataggttaaaaaattaatttttctagcctttttttcaaaaacaaaaacgttcttctttgtgtctgattctgtatatgttcgttttcacagatttttgttgaagagatgccccctatgaagacttcatctacattttatgtgaattctgcaaagccag

SEQ ID NO: 12708 - DNA, 2183 bp, Heterodera glycines
  misc_feature (2021)..(2021): n is a, c, g, or t
  misc_feature (2060)..(2060): n is a, c, g, or t
  misc_feature (2155)..(2155): n is a, c, g, or t
  misc_feature (2161)..(2161): n is a, c, g, or t
cctatcagaaagtggacaaaattctctaccgaattgcctttcgcatgactggtctacgacctatactcgcagggcaccatagagtgtcaaaattgactaccataaaaatgatggcgctatatgaaaagttggtgtttttgaaaattttttcaaaagggtggacccttttgttttgcaaaatttttttgtgatagtcataaaaatttattctctggggtttttggggtccccggtcacgaatctttcaattattttgatcaattacgatttcctaatctaaatttgaacaaaaaatcataatttgaaaaattcaaaatttcgatttttattcgagttcgggttagggattagaaattagtcaaaatacatgtcagattcgtgattagcgacctttaaaaccccggataacaaattatcatggttttttatcacaaaaaattttgcaaaacaaaagggtccctcctccatttcagcaactgatccgaactatggaacgcttaagaatttggacgccgacatcctcacgaagaacgcgccagcaaaaccggcagcggcaccaaaggcgggaccggcgccacatggaggaggcggacaggcactgacaccaagtgaaaaaaatggcgaacattttcaaattttaattcctttttcatccccttttcagcgaccgatccgaactacgggacgcttcagaacttggacgcggaaatttttgtgaagaaatagtgccatcgacagcgaacaccccggcaaggcgtatagttttagaaaaaatcttatttttggggtccaaatcttagttttagcctcgtttgtccttattttgaaaaaaaaacttggccaccctgctgtattgcttattgtaatctgttgttgccgtatattcgctgttgtacatatgcatgtatattgtatattgtgttgtacacactgtaatgttctcatcatactataaatgttttggtctgtaaaaatgttcaaaatttcgactttttgcaatttatgttatgacttttatgataattgtctaatcaccagacaatagcatagaattagcttctaaacatgttaagcttcagaatgataccaagatttaacatgtttttttcggaaaatgcccaaattgatcaaccgagttttcaatatgcaagcactgtttttgataatcaaatgcagattatgacaaaattcatttaaaaaaaagcccactcaattttctatttccctgccggcgacgccctataaaaggaggcattttccaccgaccgacccacacatttccctcatttgtcacaagtacatttattgtgcctaattttattcgtgacgtcggcatttgtacatattacgacagttcgtcgtcgactgctgcatattattatttgttgtcttcaccacacactcgtcaagctgctggttgagcgcaatgtccaagagacggcttcgacaggtgtcactcatttggggatgacgttgtttttcaatttgaaaaagtcattcttggcggcatctcatgaatctaatcaaaatccgatcaaatccaataaaaatgcaaattttttcggagtttatgcaactgccaaaaagcgaaatttttcggaaattgtaattccgaggcccaaaaattccctggaaatctgttcttccagggcaggactgtctgtcatccaatgctgatttcttttttccttttccaggaactcaaggacatggagaagaacccactgcctgagggatgcactgcacggccacttgatcaacggaccatgaccccctggacggttaccatccgaggccgggccggcacaccgtacgaaaacggcaacttccaactgagcatggcatttccgagggactacccgttcaaagcgccgcaagtcacgttcaccacgcgcatcttccacccgaacatcgacacacggggcaaagtgtgtctggacattctgcaaacgtactgggcaccgacgctgaccatcgaaaaaggtggcgtggatttggtggtggatttgatcatgttttanatggattgatcactttaatgctcttaacttttttcaggngcattaagatccgctatttttgtgtttgattagcaaatttcaaagatttcattgcgcttcatcagagttagcgaaaaagcgaatttttggaattnatggtnctaatcgggcatgaatttgatg

SEQ ID NO: 12709 - DNA, 3502 bp, Heterodera glycines
agaaatcgttaatttgtttctctgtctttacagttgtcgtctccatcatcgttctgctgaatgacccgaacccggacaactcgcctctcaatgcggaagctgccaatttgtaccggactgaccgcgcggagttcaacagacgcgcccgtgagatgacgctcgcctatgcacgacgatgagatgatcagcacgtctttctgattccactaccaattatgtattactcattcattgtatatattattgtactgtatgctgtaccatatttatttgtgtgcactactgtgtgtctatttttgtgttgtatttgtgtgcattttcaaagccggtaaagaattttgtgctttttctattggcgtatccaaccttcaggaattttttttcgaaaactttccttgaaaatgggctctcccgcttgaaattcaccctataaatgagctgatcactgatgaatgtcagtcaactcagattttgtgaaactttcgctaacattaagcattcattacacatgcacaaaattcggtggggattctttcaaaaagatttagcaaattctgcatgagtccatcgttaaaattatgtaattacttaatttcccgtccaattatattcattagtcgcagaaatttgaattgaatgaatgacatgttctcattcattcactgacatataacaatcgattggggtcatctcacagtgtaaatgtttttgaactaacaaggaggatgtgatgatgatgatgatgatgatgagtgagtgacaattgcaaatgtcacggctcagaaatggctgtgaagcgtggaccaccgacgcctcccccttcccccccccttcccccacgcctttcactcaattcaaatcattatccgttcactccctctcattacctcacaaatcattggattcaaaaaacattccattttctctcactcaactcatcattccgtgttcgttgagtgaccgttcatttttgtctcatttttgactgggattttccgggaccattttttatttctgttttgtacttcatattcctggttttagaattcattttctaacctgttaacatcagcaccgtataggtaatggatgaacaccagcagcagcaggtaaaccacccgttatttaattaaattccttgaatttttggtcgggttttcaagaccaacagtaaaatttggttgtatgcaaatatgagtcccgaataggcctaatcaacaagccaaatgccgaaaataaatgttcggtgttgaagtctttaaattgaaaaattcacaattttctccttttggcataatgcacgtgttccgtttcccaccattctcgaactcattcccatgcataaattgtcccctgccaatatcctttggccaaatccataaaaagtgccaaaaaattattccctaaaatggccccgacgaccaaaaaaaaatgtaaacgcctgccactagagcttttgtatgagacggttctttacgtatatcccaagccggatttgtcgaatcttttcaattcttcttcgatactcagaaaatttatgagtttccgagtccaaagatgggaggaaatacggaaattagtatgttaattcaaatttggaaatgtttaattgtccggcaatttccctactatttccattaagaaacgagcaattcttgaagcactttatgagtgttttcgagaacgtaggccatggagaaccttcgaatcgtacacagcaaacgaccaaaatgcccaaagtttccttgtttcgctcacagaatttttggtgagcacaatttaagaaatgtcatgtttaaatgtttatgtgaatattcagagtccgtatgcggaaattgaccaggacaaggctgaagtgtcgcctgaagaagtgagttgttgttgctcagctgtagcaattggataatgttttcttttccatttatattttttaagcttcgggctgcttttgtccgttgcggtggagtcaacgcacatgcatggcgtgttttggttttgttggcggagggcgacaacgagacgaccaaattcattggcaaactgttggatttcctcacggcagaagtactcgagatttgcattctttttaatcggattaacgaccacaaatttcagggaacttctgctcctccgactaattgtccaccggctgctgcgccgcccaattatcagttggccaacccccctttgcaacatcaagccgggacttctcaggtttcttatgatgaagcagtagtttgctctcgtgctcgctctttttttagcgaaatcattttttgtttaacttttaggcctcgcaatttccattctccgccgccatccattctcagtcgggcctcacgtgtcgtcaggttatctttgtgactaaaactttggtcgttgcaaaatttaagtagtcttttattcaggaggttgttagaggtatcgctggcctgaaaactcccccggatcgcatttacgacactatttcgtcatcctcgtccgccgatgattcccattcgccgcataagaaggtttaaatgagaattttttcaggaaatgcatgcttatatttagttgagcactcccccgggtcacatttaccatactgtcatgtcgacctcgtccaccgatggttcgaagcgctcttctgtcatttacgacgttcctccgactcctccaccaccggtgccgcaacatacggttttgttcagggttaatttaggttcaaaatgtgcaatttactcgcttttctcgatttcttcagggggggggagaactttttggattcattttttgaaaaggtcgcacctttttaccctactaccccaaacagcaaaatgtgtgatgagagaagttttttttgtggttttgacaatagacaatcaaattttatccggcctcgaaatgctcggacgcgaaaaaaggtcgtaattttggagacgaactgatttttgaaataaaataaaattgttcgtttttagcgcaaagagacgccgaagaaggacagcgatggaaagaattgaaggcgttcatccatttaacaactcacaaataacatcattttttttgttcactttggacgtttaatttttttgttttgttttaatttcggcatttgattcgagtattttgcccttttcatttgcattttatgtttttagttgctgaagataaaaaggctgttttattgtactgatttatgcataccattaaggtttcccaaatgctaaattgctctaaaatctgttacaggaataagcaatcccaatcagcagaaagtaccatttttaataaaatgccaactccaagttctatagagcgctttatcaatagacggaccaattcgaaaaattaaaatatacaaaactgtaaaaaagctctgattaatccgttcatttctctctcccctcatttttcattcatttttgttgccaaaaaagcatttgacaatgccacaacggttcgccacggcgatcacttgtcggattgcctccagcgagaaaaagtcgcgcaaccgata

SEQ ID NO: 12710 - DNA, 3621 bp, Heterodera glycines
ccaacaaattattgctcaattaattagcattgtcatccctccctggtgcccctttccccatttccgggactggctgtctcagctcaaaattcacgcctacacagaggtcagtttcatagaaaaaaaaggacttgatgttgttgggctctgatttatatttcccaaaaaatcgctttgatcaaacgtgatcgatcggggcatttcggctccgtccatttcggcactgcgcggcattttaatgtttgttggtgctcaattgaatgcccttttacgtaattttcttgcttatttgagtgtctcaataatcaaaaaggaaatttaattgaaaaatttatggcgaatagcgccaaaatggcgccagaaaagccgaattttttgcggaattgtttttggcccttataagttataaccgaaatttgaaattttgtaggattaaaattgtacatacctacctagattggtcaaaactttcgaacaaaatattaatttgtcatcaaaaaacaaaacaaaattaagcttgtggcgctgaattgggcagcgccgaattgggctcctcctccccactttctgaattttttggtgccgaaatttggtccgacctccctggtaaataaaatgtttaacttcaacacagacgcccgacatcattttgtgtggcaacaaatcggacctggaaaatcggcgccaagtgaggtaaagtaaagttggtaccgtaaaaataccgtcgtattccctaaaaagagcgaaggatttcatttcaagaaaatacggtacaaaatgattttttttttaaatcccatttaagcaccgcacgtgccaaacagctcgccgatcagttggggtaagtaagattttttggtctcttctgatcggccagtggtgatcgaacaatttttgaccatttggccaattgttcagactgccctactttgagacgtccgcttgcacctcctcaagtgggttcttctgctgattagtgaaaatgttcaagaaaattttctcgctttttgtcacgagaaaaattgtaaaatgaaatcgaaaagcactgaaaataactcaatgaatttttaatttatgttttttagcaatttccgaaaataaaaaataatatatatattttaatattccgccaatttcaaagataaaaccaaataacttttatttttttctctctttctttttatatagtaaattgactaatttttaattgatttttcagcaattgcaaaaaaataaaaaaccatatttactgtatttgagcccgcccccctgaaatagagcccccccccccttttgaagggggttgaaaaatagagccctcgggggttctatttcattaaatttctttctgtatatatttttttcaaaatttcagtaaattaaaaaataaatttaatttagacgtcgaaaaatcagttgactgcctactcgacttggtgatgcaacggtgagaaaaattttaaatttacaattgccataataaaatttaacggtggcattcaattttttaaggatacaaatgtccgtcgatggggacaatttgcctacggaatacatgggtgctgggagccgaattacgctggatgaagaggtcacaaatcgggcaaccggcgcttcgtattactgcgcaaattgctgatcagaggcgccaatcggatcgattgatcacaatttggtcactaattagccgagaaaagagagggaagagagagagagtgggggagagagcgagagaggagaggagggagagagagaaagagagagtgggggagagagcccgtgagtgagaggagggagagagaaaaaaagagagcgagagagaaagaggcaaaagccatataaaaaatgattaatgattcattttcctattattatatttaaaaatgcttgccgcaaacacataaaagagaaaaattgttctaatgaaattttaaatgaataaacaattaaacgttttaaatgggttaattagagcaaataaaaagtttaattaattaaccggtataaatgaaaacaacagcagaaaatgaacagaaaagggaagaacgccgatgaagtcatatcgtcaaaaatgcatttgggtacaattataaagcaatttaaatttaaaaaccaaaacaaaagctaaacaatgaataatgaatgatcaacatgccgtaaccagtttgggcagggactcgaaaagctttttttgttccaaatttttccattttttttaaattaagacgtcgcagaaaaacaaattaaatttgaaaaattctaagccctttttaagatgatggataaaaagtttcaaaacttttaggagaggggaatgaattcccactggttacgacaggcaaaaatttgtcctaataaaaaaaaataaaggcaagggagaaaagggaagatgaagatgggggatatcatggaaaaaaaaacaaggtaattaaagctgatcaggaaccgaaaatctcccgaatcctgattttttagtgtcagaaaaattcatttgcaggcatgcggatttgaaccgccagcaacaccaaacaaatttgggtggtgtggtggtccgcgcgctctgggaacctgtagcaaagggttcgagtccgcgtggctgcaaaattattatttcgattccaaaaaagatacaaaatttcaattgtttcatttcaattggtttgttggtccccaaatgatcatatacctattcgtcattgaaggaataggtttgcctaaaaataaatttttagaaaattttgtcgattttcggtccgtaacaatacatacaataattaattatcccggatttaatcatcacaaccaatggaactttgggtacaaaaaagccctaactgtttaaaagtgatcaaaaaaaaaacaatcacggggattataattgatgatcaaaaaatcacaaaatgaaaaaaaatggacggaaaaaacaaaaatttatatgaaaaaaccctgtgcatagaaaggaaggaattaagctgaacaaaaacagaaaatgggggagagagagagagagagttaaatcacaaaatttgcattatcattttatcaaatgggcaatgcgctggtcggccgatgtttgtgccggagggaatagtgacggaatgccaacagttcgaccgtgccaagcagcaacgggatgacgaacagcacacgggccatgcacacgcggagttggtcctatataatgtgtgtgggaattggaatgggaaatgaatgaatgtgaaatggggtatttgaaattaattattttgtaaattggatttaaattaaaactaaaaaaaactgaccgaaatgtgacctttgctccggtacagctcgtagccattcctggaatacaattcattgtgaaagtattaattaaaacaaattgggtaaaaacttattatgagtgaattttgtttccattataaaaagagagagagagaggaagtgaggggatgaaagaaaggaaatagactttgaaagaaatagagaagggagaaagaaagcgcgtttggaaagacaaagagagagagagggatggagagaaagagagagagagatggttgaaaatagagaaagagagaggcgagagagagagagaacgaaagaaagaaaaggagacagacatggcaaaggccttcc

SEQ ID NO: 12711 - DNA, 1536 bp, Heterodera glycines
gggaaatttttttttatgaattttgttagaaattagccatattttcagaaatttccctcttttggataaaaatacgccccaaaatcagaacattcctagaaataaaaacataaagaatccctgtattatcagataaaaataaataaaaatgaaagtcaaccggaattgaaccatataaataattatgttagtgttgaagcactaccactaggccacaaatatattggaaattatgagcaaaatttattttattacataaaaatttgtcagagtgttagaaaaaaaattcaaaattgtataaatttttgcatttaagacccttacggggccccgggaccgggactcccgttttaaacgggactcccggtcccggtggtttgcccaaaaaacccgggaccgggggtcccggtaaaatcccggcggggccccggtcccgtccgggctctaataatcacacactttctggcatagcgttgcttgtcatcttctataaattcggagaacaaaatgttgaacagcggggcaatggcgtggacagtgacactgaattcattggatttccagaaaatgtttttaattaaaaaaatgagaaaaattttttttgagcagattttttgaagggtcgtcatcccttctgtgctaattgtaagtcatttctctccctcccaaacttgaaaatttgaaagaaatccaatttttcaaaataaaataattaaatgaaatttgtgagtgcgctaccttggcgttaaaaaattttttttttttaaatttaggtttttatctagtgcaaaagtagtttacctatatatttttttaatttttaaaaaatctgtattttttattattttttttaattgtaaaaagggagagtggaatggaattaaaacctattttgaacaaaaaatcactcaaaataacgcaaaagaaattttgaaaaatttaaaattcatatttgaaaatttttttcgcggttgggggaggagggaaagttgtgcagcatcgcccccccccccctcccttctggtgtctgctgctgttcggtgtgtacctgtcgaggaccatgaacagaatgatcaccaacggactggcggagagcgcgtacagaaaggcggaacaaacggaggccaacagaccgtacatcaccacacggtaggtgcccttgcgcaacaggaatttgtcgttggtgatcacaatgaactgtgacagacagagaatgaattaggcacggggatggacaaaaaaagggcattttttgaaattctgtcaattaaaaaaaaaaaaaaattccgtcaattttttttttaattaaccgaacattcttcagagtaaaaaaaagtgcgcgcattcaaaagttatgccaaaaataagtcgtaatcgaaggcgaataaatttctctgacgataaaactccgaattttgaaaatttaaaaataaaacgaattttgggtttaaaaaaccgctcaaacttggcccattttctaaggcaaaaaaaatctgaaaatgccgaatttttctcctcccaacggcacataaatta

SEQ ID NO: 12712 - DNA, 2404 bp, Heterodera glycines
ttatggaagacagcgaggaggaggagtaggagatgtgttgaggtttttatggagagcacttttactaaaattaaaatctgctggtacattattgggtagagaggcattagacactggaacacgtgtattggatacaatagagaaagctgaaacaccaaataaacaagcaataattaatgaagtaaagaagggaatggataatgtaaccgaaaagggaggggttggtcgtcaattcggaacgggaagaaaaaagagtattaaaaggaaaagaattattggaaaaactgtacctaagacagtaataaaaaggcgaaaaagatcagacgtatttggaaaattattttaaaatggtcttcaagaaaattgacaaggaatcggtaaattctataacttcagctttgtcaatatttactcttccaccaactaatgtgtcagtgagtagttcttcagtgcgggaatatttaccgctcaatcctttaacggacattccttttcattttaaaattctccctaccgccagtttctttgatttgaacaaatgttacatcttaaccgaaatgtcaattaaaaagctggattttgacacaaataaatatgttaatttgaaagtgaatgagcaagcggcaacaattaatatgattggtgcgacttggataaagaatttaaaaatcactgtgcagggacgtgagatttatgactctaactcactttatgcttataaagcatacttggatgccgaactttcttattccaaaaacgtaaaggagtcagacctacaggcgagcgggtattatgtggacagtgagaatcaggacggcacggatattactcagcagggttttgaactgagaagaaaattgttttcacaaagtcaaactgcacaatttattacaaaattggatgcagatatttttaatcaggacagatatatggtgaatggagttgagattgatatacaacttacccctaatgacaatgagtttatggtaatggcagcggccgacgataaatatagaatagaaattaccgcttgtaaattatatgttaaaactcttgaagttgttgatggttttgcattagacatacagaaaaaacttgaaaacaaagaagcaaaatatgcccatagattaactatgatcaaatccatatttataagcgagaatcgaactgaatacaatggaacgctatttacgggtcaattacctaaacgagtcattctcggaatggtggagaacgctgcatacgtaggcaaccaaaagaaaagcccatttaattttaaaccatttgatattcgatccgtcacattgatagcaaacgggaaacaatggcccgcagcgccatttgagcttaatttcagtaaaaacttatatacccgggcattccacgaaatgaatgaggcattaggtatggccagttcaacagacagtaacggaatttctcttgagaagtatagaaagggttggacaatttttgcgtttaatatgactaatagcatggaggacaacgagggtattgatcttattacagaagggacgactaccgtgtgcattcaatttagatcacctgtcccatcgggtgggatcaccctaatagccatgagtgaaatggactctattttgatattggataaaaatcgaacagtaatgaccgatacaaccatttaatgtatttaaagtgatttattatttatattttataattttttaaaatgtttattttgtttgttttatttttgataaatttttcttcgagttataatagccctattctctaccctgaacgatccagggacaccgaaatgactgacatttattataaaatagcctcctttgaccattcctacttgaataaaatgaatcaatctgaattattctcaatgattgatgaaattgttgaaaagtttcaactttgtaatgttgaagaaacgaggtcattatcgagatgggtatactgtatgcttttggttttgttgtggatagctattgttatgacaggaattttcctctattttaattcattaattagaaatttatgtaagcttatgcatatatgtagagacgaaaatggacacaacgacgataaatcggattctagcgggaaacacaaagaccagagaacactacttgggatgcttcccttgcgacaagctcccaagcaaaatcaaccagtttccttcagcgttggtagcgaacaatgatccttcgaataaggaaggatcgcattggatcgcaattttcatcaccgataattctactgcctactactttgacagttttgggcgtactccgaacagatgtattagccactttttgcggaattatgaaaaagtgatttcgaataagccaactatccaatcaatattcagtgaaaattgtggatattactgcatttattttgtttattg

SEQ ID NO: 12713 - DNA, 2679 bp, Heterodera glycines
  misc_feature (57)..(57): n is a, c, g, or t
cttatgcatatatgtagagacggaaatggacacaatgacgataagtcagattctagncgggaaacacaaagaccagagaacactacttgggatgcttcccttgcgacaaactcccaaacataatcaacaagtacccttcaacattggtggcgaataatgacccatcgaataaggaaggaacgcattggatagcaatgttcatcgttgacgataggaccgtctactattttgatagttttggtaggaaaccgaacagatgtatcagccagtttttacggaattatgaaaaagtgatttcgaataagccagctattcagtcagtgtttagtgagaattgcggctactattgcatttattttgttcattgtatgtgctcattaggaggaagaaattatgagagtaattttgaaaaaatgacaaaaaagttgataggagaagataatccagatttgtttgtcgtgaattttgttaagaaactgataaaaagtatttaaaggaatttttcattaactcatttataaaaatggaccgtttagacacaataattgcttctcttctgaattgtcccgcacgtaacttgtgcgaccgcttaaatcacccggatgagatacaaaaagtagaaaaatacctcaaagggaaaactctacagacaacatacaaaaatcaactagatgaatacaaagattttgagtacggtggaattacaagagaaagtgcacgtaagcaaatggcttacaatggtttcaagaatgtgaccgttgaccagcatttttatgtacggcaccgcatttgtcttcgctattcaagcaatccttgcgtgatcgaaaaacacaagaatggcaatgaacgtttctacccacttgaacttgtgaaagtgaaggacaatgatataatttatttagggcaaaattttcctaaacctttaattcgtgatgataatatgtttattgatgatcaacaatatttgaattggtaacttaatgtttaaaattacataataatgaataaaatttgttaaatacagaatctatttctgtctttgatttacttccggttatattcaattttccactcgagaaaacaatgatggagactttggggcttttattccgatagacaagaccggggaatagttcaggagtgaaggaacaatatttggcgcctagaaagtcggacagaggtccgagttgaatgtgaaatcccgcatcagctgtcgcaatcaaattcttcaccgcaaattcgtggattcgtgcctcgtagtacccacattgccttattcgttcggtgacttgctccgcagcttgcctacattctttctcattagctgctcctgtacatacgaattttccagttgagaaaattagggcggtagcatttggattatacactttcataattacagcatgaattttacgtggattatattttgtagatggcgctattaaataaattttttcaatatcaaggggtattttgaggtctacaacagcaacgcaatttttgattattggaaaaaacattttaaatgaataatgggagaaaatttttaggtatttatactaaaataaattgaatttagttatattttaactttaactttattataattcatttttaattttaaattctttatttaatcattgactcacagctgaaagtcaaccggcaattgagcagctgtctcaagcacagaatatctgatgttgggttttgcataggcacaactgtcacaattaatcattgactcacagcttgacctctatttccagtggtatattaccgacacttccgtgggcattatacagtcaaaatgcgtccaaggggttattaatgaccattccattggttttgactcggtcagaaatgcacaaaaagaattcccaagggataattaatgaccactagcttcgattggacagacatgttcacaaaagaatggttaatggcgttcagttgacttttagtacaacagacttcacatttcctaaggggatatttatgacacattcggaggcatttgttagaaatgcactcaaaggaatgattaatggaccttcgaagtgttaggtcttggcaaagaggcgatcaaaagatataaaaataaacatagttggaatgagccctggaccacatacttttcaaatttagagttacctgtcacttttgaagcatggcggaatccatcggtaaaattaataattcacaatgcaagtcgacgccgctctatccaatggtatatagcttatatacattttcccactcacagctcggaatgttcccttgttaacaaaaccgataaaattctcaaaactttctccgaataacttttaatttgctattttttcaattggacggaaaaataaatgagtaataaattataaaaagtaaaaacctgaaccatgcgacataaatcaacagaagcgaaatgcttgcgaagattgaaacgcctcggattgcttcgaatctgaaaaataatgcaaataagagtaaatctttgaaagctgtagtggaattagcaaggttcagactttttagttttttaaaaggcacttcatcgttttttggagccccaatatttgcgtctcggaaacgaagggataagagagagaggcgacttcgtaaaggcggagagaatttaaataatttaacaaaattctttaaaatttaatcaatttcgta

SEQ ID NO: 12714 - DNA, 3328 bp, Heterodera glycines
  misc_feature (46)..(46): n is a, c, g, or t
  misc_feature (3321)..(3321): n is a, c, g, or t
cagagcaaagatggcaacggcatggaaggccaagaagcagccgacncaatcggaacggaagctaaaattcaaataagaaaatatcaatttcaaaaaatgattaaaattgccgattgtccacgaggggcggctttttgctcgaatttggctgctcaattgggccaccatctgccgagggttccttatgaagctccatcgcctcaaggtcctggtaatcggatgccgactcgaagatataaatgaaccgattgatgagagtgctggcactgaacaaacggaccaaaattgaaaaattaaggaaaaattcaaaaaaaatctgtgggaaaagaagcgataaggtaaatgtaagcctttttggcggcattggaccttagaaattccaaatctttatttcgaagatttgctttatttcagcatatttctcttgtttaaaaagaattccttattttgatcaaaaagtttattctgaccaattaagattttttaaatataatatatttaaaaattttcacttttttagattacgattacctttaattttttaattgatatataaattaaattgataaaattaccccatgaaatatttccactaatataaaatggttttaaaagcgtaagataatcttttacttaattagaaagtcccaaggcggttggttgtaaatgcgcaatttggtgagagcaagcacacaaaaggtgcacattatggaaatcacattaagcacgacaccaagctcgagaatttgcactgaaaattacaattaaaaagtattttaataatttaatttaatatttaataattactaattgtcggcgtatttgctgttgagcctaaaacggcagatggaaagcggtttggtaaaaatttctaatttttacccatttgaggcgaaactctattggtgaagagaagaagggtgaagaattggagcaacagaagaaagagtttggtgatcagctgaatgcgaatgtttgtgaagatgggcacaaaaaggaacagaatgccacaggaccaagcctaaaaaggcatttcgaattttaaaattcatttttttataaaaaaaaaatgaccggaattctcagctcagttttcagtgaggaagaagaacgctgcagatttaagcagaaattcaactaaaaatgttttgtttagctaaattatttatttttaattaattaattttacttgtgtgacattcgatgggtccatgtaaacgagtgggacagtgccggacaaagaccagccgtagtcgcggaaatatttgggatcagtgaacaccggttggccgtcgcttatgagacgcacaattgactaaattaaaaattaagaaatatttaaagaaaataggaaaaatttaattttttgtttaccctttgattcatcggttccaaatagaaacaacatctgaaaaaggagaaattattaatgataaataatcataatttaattattaacattgacctgtaaatatcgtcaggaaagtgcttaaagtccgtgtcgtcacaaaaggtcgtaaatttgaagccgagaattgccgtcacattgcccgagtttcgtacgtcaacccgacgcacctccatgttctcgtaatcgttgcgcagagctgtttcatatccctaaaaaacacaatttgaatgtattaatttaatttaacacaattaatttaaattcgacagtaaaatattttgtaaattctttaaattatttatattttaaaggtttttaaaactgacttgacccgtcagaaatggaacccataaatggttggcggacgcgattttaatttgctgcactttgaactgttgcgagtcccatgtcaaccgttcgtcgtgccagcggagctccaaatagccggcaatgttcaaatcgcgcataaactcattctggaaaggcatttttaatttgacatttttcaaatttgaaattttattttaccaaatgaaaatgttgaattgttattttgctgaccgacaaacgcagctgagacggaggaaaattaaataagcaaagatcaaattttaattattgtcattatttttattcataaattagaaaaatgccatattataattaaatcgggcaatcgttatttattttagtttattatttaaatatttgtccctattgttctttttttacgtcattgtatgtgggcggcattgaggcgattggatgaattgaggctccgaaatggaagccctgagagccggcttgttgttgggcacggtttgccaagaaataaaagacacaatgctcaaacacggcgaattcgtggtggttgagactttcaacatctgtttggaaaaattttgattttaattcaaaaacatttaaattttaataaaataatttcagtaaaaacctgtaacattttcgaagaattttttgcactcaatggcattgattccgctgttcagcccaaaaagtgagcttggcccaaccaagtggaaaaaaggctgcgcagagcaaaaatgagcaaagaaaaacagcgaaggcacaattagaaaagccaattgcattttgctcttaaaaatgccaacaattaaaaattgacatttaatccgagagattttctgatgtaaatttgtctatattttttattggattttttgtcaatataaattaactcaaaatgggataatgagtaattattacgtaaattggaccaaaactctctttttatgtattgcgttcagtggtgacgtcaccccgggccgatcacattcactaagaaagaagcgacccaattttgggacacataaataaacgggctttctgctgatcagcggcaaggataagcaacccctttgtgctgcttatatatacaaatgagcggacaaatttagttttatatgggaaaggataaagccaaagggataaagcccacaacaaaagcacggccgagcaagttttgtgggggcaaaccagtcaatttgatttgtcaattcattaattaatcggctggccgtcgtccgggtaaaaagttccaaatgctagaaaaggtgatttgtcgcaattgattaaaattcaatgagtgcgcataatggacaaacacatacatacaattaatgctaatgtacaaaaagcaatttccgatttattgttttttattaataaaatagtaaatataatatttaaatgaaatgaaaagaaaattaaatttttttttttttgaatttgactattatgatcagcatgaaaaaaaacagcagcaattccagttatttggtatgcatttaattaggacaaccagttcaaatgagctgctaatgcctccccaaccgaccgcgtgatctgttgatctgtccaacgttctnatttaag

SEQ ID NO: 12715 - DNA, 1263 bp, Heterodera glycines
  misc_feature (116)..(116): n is a, c, g, or t
attagctgcccaaatgctagtaaaagtgctgaggttaattgtgacaagagaatgagcagatctattcacagttgcagggaacaacaacagcctattgggcattggtgcagaaattnaattggcaataataataataatagtaaaaaaaaaaaaattttttttttatattgtaatatttcagtttttaatttttcttcatcagaaatttttttatagcgtttttaactattttcataaaatgaaaaacactgaaaacatatacatttattgatatcatatatgaatacgagtgatattagccacaaaatgaacactgaatgaatgggtgccatcattttccatggtgatgatgcgaaggattgcctccgaactgccttttgaagtttcgtcccatccctttgaactgattgatcatgccgccaaaactgctacccatattggcaaagttgcgcgaattggccgccattccgttcatcaaattggcgccgccattggcacctccaaagccgttcagcaaactgccaaattgaccaaattgcgctccaacagcggaagtgtaaatgattattaaaatggcaataaaaacgggagaaaaagaagccatgatttctgaaaatttttaatttaatttaatctcttgaatataattttcacaggtctcaaaatttttgaataaaattccgtatgaaaatgcattaaataaaaacgagactaatcgactgaatcaaatgggagaaaaacaagcgcactttttccttttattgtttaattagtttaagaactaaggttttcaagatagagaattgattttattatataattgatcattttaaggctcaatctgtcaaaacataagaagaagttttgtttgacaaacaaaacttacgttctaatttaattaaaaaatataagtttatcagttcagttaaagaaatgcaccaacactgctgtatttataaatttaagaaaattcatttattcaaaaaaaaataaaaataaccaaaagaaaggcatttttaggggttttagaagaggaaaaattttttaaattttttttgagtaaaatttttagagaaagtttgagggatattttatttgaagaaattgttggaggtctggtagaactatttgttgaaaagatgagggtattgttttttgagcgattgaatttggtgaacaattttgtcggtgggtggaaatgagtttagtgcttcataacagacgaggattgtttggtcaaaaacctccggcggttggaaatgt

SEQ ID NO: 12716 - DNA, 1572 bp, Heterodera glycines
catttaatagccaattagcacaaaaatagcattttgtgaaatgcgagtgattctctctctgaatttgtttcgcttttcattatttttcgaaaagtcgtagaaattgcttatcatttcagcgaaaatgaatacacctcgagggaattgctgggcccaatttaaagaaatgaaacaaattttaaattggctcaaagtttggcctggcggacgtatttctaaaccgtttaggcactaatttccttttattaatcaaatttttctcaaactgctgcctttaccctcacaattagcacttccccttcttgcccccccttctccaaattttgcctttccctcctccaaatttcattattttttgccgcgcacatttattggccaattgttctttatttttgttggctaggaaacgtaacgcccgacaaagtctgggcaattggaaaattgacaattggagagaaaagtctgtgacaaacagtttccgctttggaggagcattatcggccttggttctgcaacacaaaatgaaaagaatagaaaaaatattttatggcaaaaatgaacaaatttaaaaaaataataacagcaaattgcgaatcacagccaaccaaaacatttgatttaagaagctttgctgaagcgatctatcaggtggtaaggtgcttcttcaaaaattacgttctagaaaccggaaatttcaaatttgcgtgtcccgctgcgggattgaaattcaaaatttttttacgggacgaaaacccgagggattaatcccacaatttcaataaaaatgtgggattgcggactgggaaaccgcaaaatctcacgcgggaccgtcccccccccccctcagggctcttttcgttttgtccaaaaggtggtcaattttttcggggccaatttaatacggggagtcagatccacgtgatcagtccgggagggattggcaaaatgtgccattgggcctttctctccgtgggttcagtcggcaaacagcaaattgtccattgtccgatcggtcgcgtttggtgtctctccgtccgtcgtcgccttcctttccatgccctttgtcgtctccgtgcccctcccgcctttggtgccgaataatccctcaaagtcgaagacgccgccctccccctttttggcgagcagcggacgcaaatcggtgacaatcgttgacagcggaaactcgtcgtgcgtttgtgacagcgagcggagttcggccagaaattcgacgagtttggcacgtttctctgtaatttgttggagcaattgttgcattttcacaaaagcaattcttaattgctttcactaattataccccgagaaagtaacaattgcgcataaacgacagtcaaaaggcgaaactcttcccacgaggccaattcgcgcgtctgtcaggcaaaaattgatgaaaaacgaaatgtgccaacaattggtcaactgaccattctcaacaacatttccatttcactttcttctttggcctctgccatttccgccctttgccggggaaacgaattggacgacgacgctttttcaactcttaaaaataaagtccccgttttttaaaaatgc

SEQ ID NO: 12717 - DNA, 4278 bp, Heterodera glycines
gaaagagagggacggataaagcggcagagggacggaaaagcggatgagcactgaccacgactgaagggacggggagaaggcgaaggcgtcgccgttgctcagcacaatgacaggcaatcccttggcactgacaaaagtgtgcacaattcgggggatatctgaagcaaacgaaggagtgaagcggacaaattatggaaacgcacccgaggaaacgccgaaaagggagcgaattgaagtgcgaaaaagagactgggacagttgcaaatccctgaaaagcaacggataaagggaaagcgccactttagggggaccaaagctgtgccgtggcatctgtgccaattgcgaggcaaaagtggtcgcggagttcgagcagtgacagcaccgcgggggtgagcagggagcaggagacacggccggactgggagaggaggacgacgagcgaactgtcctcgaggcacaaaacggtccaaacgctgcacaaaaagggggggggggtaatttaatgggaaattacggaggaaattaattgaaaataatgaaaatgaatgacaattaagggcagaagatattttcatccgttagaagatttttaaaaaataaaatcattttttaaatttaagacaagttaatatattttctggattttctcgtaatcaaaaatttaattcaaattttttcactgaccgattcgagcggatcagcagcacgggactgggcacaatgtgctgccatttggtgtcccggccgaactttgccacgactcgcgcccctttcagcgtccgtttgttactcaacgaattttgcacaacaattcggtcaatttgtgctgatggtccctggggaaattgaacattgaaataattttatgaaatttacaaacggattttggccaaaaatggtgcattttgaccatttttaaggttaaaattgaaaattaaaaaaattaaggtccatgggttctcccgttaaatgccaaccaatttgagtcgaaactccaactctttttgcgcttgtggggacggcaattccaaccctttggtggcattctgttgcaaatggcacatttggggcacgggtcgcagttcggcaccactctccaaattgagctcgggcaacggctggtgctcttcgccattcttaaaaagtaatttgcattaataatttttgattcgtttttgcattaatttgcaatttgtcgccatttttcatgcaaaatgcctttgtcccactcatttggccctttttccatggcggagcccaatggcactcgtggggagagtacgtacctcgcgtaccaccccttgggaccgtccttcgttatgggtaggcccccgactgtccaatgccttctccgattattttgtcgatgacacccgccccttttccccttcccccccccccccgcgccctttcccaccgctgcggtggtcgcacttccgttgagtgagcagttgccctcctccaagctgagctgcgagtggttgttgttgttattcatcagtagtgccgtttcgccctcattttcgcccgtcgttgtgccattggtcgcccatttcgaagaatgtccgttttgatcctcgccaatttcgcgttcggttcgtcgttcgtccgaccgatgacgacaaatgggcgacagaacgcgatggattggcgagaattgagcattcgttggtggcgggacggaggagggaatggtggggtcaactgaagaaagtgccaatggcggagggggcgcactggcggaagagttggcatttctaaagggaataaaaatggactaattgtaagacgactaatttaacacctttatttttgaatcgaaagaaaatcagaacaaagagaacgaaaggcattcggaaaatgcttcttttttaatcgaatttgtcaccttaatgtgtctgatgatgtcagtgacgccgactgattgaaagaaccgagaaaaattgtttgtattttgcgtttcttcggcttgacaactccaaaaagttcagacatttaacacaattttttggtgtgatgtacaaaaaaagaataaatacctacaaacaaaaaacagaaaagtaagtcaaaagttctaaaattcatataataatgcaattgttgtaaatacaatttgattagaacccattacatcaaatggtatttattgtacagaatgttataggatcagaattttaatttataaatcaaaaaataattaaaaataaacaatttgtgaagtgtcctcttttttgtcattactcgtgttttctgtgttgaactttgtgccaacattgcgcaaatccgtcgtaaaatgcaaatgagccgaccatcacaaaaagggaggcaaatgcatgggacaacccgaaatcattgtcgaagatgagtacggaaaaaagaatgttcaagaatttgcggagtgccaaagtcatcgaaacttgcagagaagtcgtctcggcggccagccgataaacggaacggacacaaaacaatctaaaattaaaaaataataaataaaatttaaaaaatggattgaacaaactgcaagaaaagtgtggcagagagtgagagaaaggggagaacgtagggaaaagttgacgaagtgtcggaataaacggaaaggtccgaccgaatttcaccggcgacaaacgcaaagagtggcagagagagaaagtgctaaatgcaaagccaaattggttagttaaatggccgaaatctgtccattttcgaggtaatccggcaaatgataaacaaatggaaaagcggagaaaaattaccacaaaaaacatcatttcctcgggatgctttccgtagcgcaaaacactttctcctgcacaattcccaaataggccgaagcaaaggaagaacagctgaggaagaaaacacctaaaaagcaaaaagggggagattaagtaacgaatttaaaaaccatacgaaatttattttgagtaaacaaacgaatgaatgaaaaatgaatgtgtttgccctttttggtaatactgtgccgcccccccccttttcaaaaaaattttttcgcgtatagagaatggaatttttagtcaggaccgagattaataaaaatgaatccgaaccggttcagattgacagatttggatgtctttttcgaaacaacccgggtcatgcatattcaaggccgggaaaaccctgtcaggaccctgctcccgtccggtctcgtttagcacccaagcaggacaaaccaagcgcaaagcggacaatgtgtccctgctgttgctgatgtccgtccaaaaattggtcgtcgctcttttgtccattccctgcgccgccttcgcccgtggcacttttgcggctgaacagcgtaaaaagcgcaatgccaacgctaaccaacaaaacggagaaaagtcgggcgggggaaaaggtgcgattttgcaacagccaactgagcagaacatttgcgagaagagtgctctgaacaaataaagaaaagctatcattgggagaagcatttaaaagaggacgaataaatgggtaattggcgaaaagaaagggcaaaccgatcgaaaaacgatgatcagagggaagggcaggccgaagccgagcacgcggttgttcagcaaactgaccacgaagaaaatgccaacaatttgaagataggcactgaaaaacactaacaatacatctctgatttgtcaaatattagggaccccacactcttttggattgttcaaatttagataaacccgtcgatttccattccacatttaattatttccttcctatgggtttctcaccgcaagggaatccttctcctccgaaggaattcgggatgttcagccaaagtcacgagggccatgaacacaaaagaagcgaatgaaaacaacgaaaaggaagagccaatcctaaaaaagaaattaaaaatcgaaatgtcgagaatatgaatattgttcgaaatctcagcgattaattgtcgaccccctgacacacacttgtttgctgtgcatttcgacaccgattgtgctgcaggaacagctcgtcaacgtccaaaggatggacgacattggaattgggcgttaatgcgttaatccggcgaagccacagaattaattgaattcaatttaatttcaatttttttccatatttctttttctctccttttggcgtactattttcatgtctctaacacatgaaaaatgatggaattcaaatgctaatagttttggttataagggcacaaaggcaatttgggcatttagaatcattaaaaaatgattagttttcgcattttggaagaaaacagcagtttaggacttgagttataat

SEQ ID NO: 12718 - DNA, 3739 bp, Heterodera glycines
  misc_feature (850)..(850): n is a, c, g, or t
tcgttaataaaataattttatttagcctattttgtgctatttgggttatctgtacctattttcgaatattttgcacccatttaattaaaattttcctcacctgaaatctccgccctagaaattactatcaatttggtttttatttaaaacttattgaaaatttattaaaaaagctttaaatttaaatttaaaaatttttttcaataatatattaattattattaaattttaaaattatcgcatctactatattatatgatttttgtaagtaagaaattcatttaagtaaatatagagttataatatacatatttttaaaaatattattaagaaaattcaaaataaatttattttgtttttattgaaaaattgaaacaaaatattttaattttgccaccctttggcgttgtgtaagccattcactcgctctcgttcatgtccgaccctttgaccagcagctgtcaacaacaattttatgctttttcggcactttttgcacaacaagagtgcggttggcgggtgtccattttgacagatgctttaccattttgcggaattttctccccagggaaagatgcaaaaatgcggcaagtgcaaaatttgtgggagaattttatagaatcaatttaaattttggagaaaaatttaaggaaatttaataatttatttgagaaaaagtaaaaatatgtattgttttaaaaaagaaaaaataataattaaaaaaaaaatttctttaaatattaaaattttttaattgagttaaaaagaaaatatatttaaatatttgaaaataaattaatgaaataattgatttaaaataaaaatgcaaaatgagatttaaataaaattntgattgttgaaaacaaaaccaggaaaagaataatatgttaaacaaattataattcaaaaaataatataatatcaaataatgaaaatatttttttttaattataaaagtgtattaaaaaaatcttaaaaatttttcaaaacaatttaaaagaaactgaaaattaaatgtaaataaattttaaaataagtacaaacgaaaccaaaaaaaaagaataattgtttcaaaaagtgaaaatttaggagctgcaacataaaaaaaccagttcaacaacactaacatattctccaaacaaaacgccacacacacaaacacacaaaagcatggacaatggacaaaaatagggtctgaaaaataattttaggggggcggggaggagggtgcgaattacaaagaaaattgtcttcgttggtggcggtggtggtcaatgggggatgaccatgagccaacccatccgcgcgcgaaagacggacgaccacaaaatccgctggggcgggcgggcggttgatgcgcaaatatataacaattattccccgtttttttgtgtgggattttgggggataggatttgtggagaattttcctttttttgtgggggcggaggataaagatgggatttgtgcggtaaaaatatgtgggtttggggaaaggcgaaatgggattttgtggggaggaacaaaataacagcaaaaacaacaacatccaaatttggtgcacaaatttgtgggctgaagaaatagcgcacctaacatataaataaatctaccggttttgagcaaaaatggatttttgaaaaaaagctttttatttgatcgaaaatattcgaaaaatttttaatatttacccaaattattatttaaatttagaatattaaaaaaaaaaattctgttattacaatacaaaataattgtaaatgttatgtcggattatttataataaagactataaatttgagtaacattttaaagcacggaaaaaaataaaagcaaaattttctattttgtgtttattttcaaaaaatgctatctcctatgaaataattatgataactcaaatggcttttaaaattttatttattttttcccccaaaaattatgtacatataaaaaatatacagggagtttgattttttaaaataaaaaacgaagatttaaagttctttaaatgaattaagaaacattaattattaaatcaaaaattattaaaaaaagaagttaacttttataacatttaaaaaattaaaaaaggaaaattaaaatgaaaattttttttatattttgggttattttcaaattaaaaataacattttaaaatttaaatttacaaaatctcatgggaattggaatttttttttgttcctggaaaggctgtcaataacatttatttggtttacccgccgaataagtgtggcggcggtcatcggccaactcagcaagaaatattttctcaacaagctgtgtgtcgtgctcaattgtgatggtgtgagaaaattattggtctctggggaaaatgtgaaaatcttgaagagtccgaaggttattttcatcctaaaataccaataaaaaatttttgtggcaatacaaataaaaagccaaaattagaagatgaaaaatttaaaaaaaatttaaatttaatttaaactgcacaaaattcgagaaattgtccctcaattaaacgattttaataaaaaattttaaaacaaattttgaaataatgaagaaaatgaatttcatatataaaaaaaattccaaattttcagtgtttccaatcaaatcctggcgaaatttttttatcacaatttaatagaaaaaataaattgaagaaatttaaaattttaaaaatatttccatttgaaattttcagtaattaattaaatttattttcccaaagactatttatcattttgttcagcatataaaattttaattaaataaattcgtccaattaatttaaatataaaaaacaatttttatataaaagaggcatttatttgttcaagaaaaaatatgtgtaaataataaatttttatttgttcacaaaacaataaaagaaattttcattaaatttattatagaaaaaaagcaaagaaattgaacaattttcaaagaaaatatttgccgacttgcccaacgactttccaatgtgaaaatcaaatgtttttgaccttcatttggcggagcaggaaccgctgcaagattggattttttcagtgaaattgggcttaaaaaattggcgcataaaacgaatggtgagaaagatttccggaaattttttgctgagttttaaaacatttttttttatgccaaaaaaatatggaatataagtgttgaactatgaataaaataattaaacattaaattatcagtgtcatcaaaagtgatcaaaacacgaaagaatgcgctgagaaaaaattgggaatttttgcaagttaattagtaaattttagttgaatttttaaattattattgacgataaaaacatttggcaatgatgggacaaaaaaagagagaaaaaaatggtaaaaatggaatgaataaaataaaaagtcagcagttgatcaaacagtgaagaaaatgcaaatgtctaaataatcgaataggcgtttcgtaaattgcccttttagggttttttcgagaaaaactcgtataactttggttaagcatgaccaaattaaataatcttaaatatcatatgatacctcttctaaaaaattggcgaagaaaaatgaatggtgagaaagacttccgaaattttttgctgagttttaaaacattttttatgccaaaaaaaacaatgagtgaattattattgaataaataaaataaaatatgtaatcatattttcgtattcaaatacatattttctaataataaatgatttattaatcaaacgc

SEQ ID NO: 12719 - DNA, 1041 bp, Heterodera glycines
agattttggatgtcaatcactttttttcacatcaatgatggatcagcattacattaaccacaagtgatatgcatcgaaaacagaattgtgcattgatcccaacccattcattaattcatcatttcattttggagagacaatttatttaattaataaaaaataaaataaattataaaaacgatttaaaataaaaaaaaatttcatttgtttttaaaaaagctaagaaacatcctttaaatgaagctcatccttctgatcattgtcttaattgagtgtttttcgagcggtaattattcattaatgaaggattattaatttttaatcttttttaaatgttcttatatttttttttcattttcaaatgttttcaatttttttaatatttagcccattttctcatttgccgtgcgggagcgttcggcaccgttgatcaaccctttgttcgaaaaaagcccacaaatttttcgggtatttgtgatccaccgtttaaattttgtgggaaagaagtctgcttccgagatggcaaaggtattaattataataaagaacacacgaaaagagcatacaaattccattaaaaaagaacattgaattaaagtttttggatttttagtagcaaaaaatatcaaaaagtaattaattaatagtcggattttttgatcttagaaaattctcatttgaaaggcaagaaatttgcatttaccataaaaatcatcatttttaaattcatcattacataacatcatttgttttccagccgaagattatttgaccaattatacatgcgccattgaaacggcatttgcagcattgtgccctttttggcaatgcagtagtgcaaagcaaaaggcaacggaaacgaagaagactgtaaagaggagataaacaacaataaggacacttttatcaaaaaatacggcaattaccggtgcgaacagtgccaattaggcaaagaaaatgaagacaatggcaacgcgaatttcccggtatacaagccaaaaggtagagataataaaattttaatatgttttttagtcattt

SEQ ID NO: 12720 - DNA, 2813 bp, Heterodera glycines
ccccttcgtccgtttgtttgccttctgtagtcccttcttctgctgcttgtgttgcggaattgaaaatggccttagtgctcggaaatgcttcgattttgtatgcattggtggtgttgcggagggcggacgtacggctcggaaaggcggcgtggcggacggaggatgcgccgcttggccaccgcttggcgatggcacttctttttctgccgatgactgatgcattgacttttgtccatttatcggcgcctttgtcgcttcttccgacggcggacgtactgcttgagcatgttgaggcgcattttccagttctgttgttgctgtttcttgtgccactcgctttgggggtgtttgcagtgcttttaccaatgctattgtttcagtttgtgctttttgttcatgttgttgttgttgttgctcttctctgactttcggttgtgatgtttcttcttcaaccgatggttgtgttgctggtactgtttgctgtccctgttgtccgtcgctttgttccgctacttcctctgcatttggctcttcaatttgctgtttttgctgtcctttttcctctacattttgctcctcctccgtttttggcacaattaaatgtgccgttttcgtcgtctccgttcttttctcttctttttgcaattcttcatcaatgttctgttgttcttcttcttcttcttctctttgttcttcttcccttctttggtcaatttgcgtctgttcgtccgtagcaaaatgcaaagtgtgcactgtttgaatgagtgccgtcgttggcactgcgaccgttggaatttgtgctttatttggcaccacaattgttggcattcccgtcgtcggcacttctatcatttgtctttgtgccattgttctcatttccagcgttgacaccattatttttggcatttccgtcgttggcacttccatcttcggcaccgcaattattggcatttccatcgttggcacttccatcatttgcctttgtgccattgttgtcatttccatcgttggcatttgttttggtgttgccgtttcgtcacttctttttaaattgttctcttcgccttcgtcgctatcgtcgtaatcgacgggtgtttcaatggatacatttcttaaatttggaaagttaaatattaaaatatttgccttctcacttttcttgtgccgtaatatcttcgaagaaatgggggaaaagcagcgtttgtttcggcggctgattgatcggaacgattggcattggcaatgccgttgaaaaatttggcactttaacaaagaaaaaatgacagaaaatataaaaaatgccaactttttccgatacattttgtcgtcaaaattaattaaaaaacaattctttcgaaagcactctgatcacttaccttcagccttttcagcagcaatcatttgccgcttttttctcagttttggccccaaattcggcacaaacaatcgatggtgaaaaggcaacggaaatgggaataagaaatacgttattttaataatttccaatttaattgcatattattaatcagtttaatgctactttcaattggccattaaatgtgccgagaatggacggtgagaaaatgtcggaatcgaaaaacaaagtagtcggataagtggagagggaaaaagcgagctgatcagaagaagcagaggtagcagtactcagttgggcggactgatcagggccgggcacatttggcacccctttttcggcaatttaaatttcaatttgaaaactgttggcggcgtacctctgagttttgcactttctttgaagcgacaaatgcccgacatggcaatgtcctgctcccacccctccgcgcattcgcaacggcccaaatcacaaaattggccctccgtaaaggcacagtccaaatcggtatcacaggctaacaaaagcaacaatggcatttcaattttacatatttgcactggcattcattaacaacatcattacccttcgaaatccacagacattggcaactttggcacccgtcttcgtcgatgaaaatgccgcaatttctgaggcacaccggcggatttggacaatctttggaggcattagaaatgaaaaatgaatttcccaaacaaatccattccaatcaaataataaatgacttcgtttcgtcgtcctttgcgttgtgtcggtgctctctctttgttctgttgttgccgtcgtttcgcttattctcttttggcttttcgctgttgtcaatttcagtggtggcctattaaatcccttttcccatttgtttttcaatttgcttaattatttaattaccaatatttggtctcttttcctccgtctcttttttcctcttcgtctccctttttccgtccacttttcttcccttctctttccctcttttcttcttccctttcactcttttcttctccattttcttcctcttcttccccctctctttcttcttcttcccctgctaatcctttgcttgtccgttccattttcgctgttggtgttgtcgttgtactgcttgaactcgtcgcaattggactaaagcctaaaaagggcaaaattaaattatttggccattattttgactttttagtgattattttgttgtttgacccggtggctggggactgatccctggaggttccctctcttcggtttgtgccgtcgcagtcgttggcaccttcgcttttgccgtcgttgtgtccgccgtttgtctgctgacttttctcattttggccgttgtccccttttcctcctcctctttctcttccccctgctgtttctgcaacagttccatcgatgtgctcattgtcagtgtcatcggaacgcggcg

SEQ ID NO: 12721 - DNA, 3054 bp, Heterodera glycines
attattttttccgtttgacgcacatccgaccaaactgacaaattattgtagaagatactagccgcaagaaataaaaaaattaaaaagtcaagaaatttgtccgaattcgggttcgggattcgaaacatggatgttttgcacaaatccgaccaatttcagtcctaaacaggtactcacgcgaaaacgtaccccacgcgaaaacggccacgcgaaaacgtccccacgagaaaacggccacgcgaaaatggccacgcgaaaacggccacgcgaaaatggccacgcgaaaatggccacgcgaaaacggccacgcgaaaacgaccccgaccgacataaaaagagtcaaaatgtcgccaagctaaaaattagtgaaaatgtagaaaactatatatttttttaatttgaaaatactaacaaagttcattaacagtttatcagaatcgtataaagaacaacaaaacaaaaaaaaccgacagagaaaacaatgtaatatttctaattattcgaaggaatgacaaaaaaatatataacttcgaatgaacaattttaaggaacatgcacggcttgctgacacggcattcattcggcttgtcgcaattgactaaaacaaagcagttttgcatgaaatattgcttaactttagtgtgtgaaatttggtggttaacgcttgtaaagaaaataaaatgtgaaacgatcattaagagtgtatgggtgtattgctaaattgacaataggtataatagtgtattaaaactaataattgtataatttttcgacctttttcagtaattttttcggtgctgttagttttcgacactggtgatctcgacagtgttggtttcgacagtgattgatttcgacagtaaagcttattttttaaaaacttgctcataatggtatgagtctagttaaattttgaaaagtaaaatgataagcacaggttcacacattgcagagtggtttgcaattttcgaattcttctacaagagcctgcagatttgcatcttggcactcaaacccggcattagttagcagatgttcgcacacgatttcgagaatcttatatataagaaatttttttgtcttttggactatagtcagcacgagatgtttgtacagaaaaagtgaagcgataaatcttttgacaaaaataatcatacaagtcctaatttattttgcttcaattataaattttgtatatgcaattgtatgttataatattaattcataggttcaataaattatgtaaaaagtaattaaaaagtactgtcgaaaccaatcactgtcgaaaacacctggtacgattttttcaacattttgactcattttagcctgggcgacatttcgacgcagcgacattttgacgggcagcggcaccgcccgaccccccccccccccctccccccactcaccggccttgtatatgtgcagtcatttcaaaaataaacccttcaaaatggaaaactgggcatccttttgttgcaaattaataggcccgaccatttttttcaaaatttatataaaagacaaagaaaattaacaatgactaccattcacgacgatattaaaatgtgttttcttgtgaatgttctacaacttaatgtcgtcccctctttttttttaaattcttcatgttttttgaagaaaaataagccaattcaactggaaagtgccaaaaactatcgttaataatttgccacaaaaaaatgtcagacaattgcaaagaagttgaggaaaagatggcaaaagcaatgtaaaataattaaaattaaaatgccaattttcaatttctaattttaatttgttttcccttttttcagtttcatctccgccgactgttggctttgtgtgttcgatttgcttacgccttcacaacttggcctcggaatttcaatgattagccaccgatttgacttttacgtggacgaacatttcaaatcgcgcaaatggtcattggactccatggcaatttggcgcacaattggagagaatggcacaaacgaaatggaaattttcaattccgatggaaaaccattgccaattccgcaagttcaaatgccacgcaaagtcatcggattcgaacgcatcgacatttggttaaattggcaattgtgtaaaaatttttgacaacttttacccattgatttttagtttcatcaaccgaaatgccatcgcttttctccaccgttttcgtcaacttttcgccgcctgccaaattaatttgaccatccatccgacaagtgatcgaatttcggagttcattttgcgcaatatttggccaatcttcggagaaaacatttgtggcatttttttgctttcggatgtttttcgccgtttgcgcaaattggtcccatcatttctctacgattttccgtcacttcgcgttgtcaatttatgtgacgccgatctcttcattgaatttccggccgatgacaatgccatggcgtcggatggacaagcggtggccaaatggcttttcactcctcgaccggacaatgtgccaaaggtgttcacatgtctgtttcacgaggattatggaaattggtcatcgaagattgaagccttcaaagcggtgcttactaattgatttaatctttggttgtcatttattacttaaccaattttctcgcattttaggcttttgcctcggcttcatctctcttcaatttcattgttgtcatttttgttagttcgtcttttgcttcctccgttgtcccctttaatctgaccaacgaattgactcgagaacaattgacgctaaaaagggcaaaaaatagctatctgctgatccgttgtccaattgcgcgagatgcgaacaaatgggcaaaatgggagaaggaagcgattgactggcgaattcataatcaatggaacaaaattagcattcacattaataatgaggacaaaatcgacgggtcagcgtgtttactcagaaattcaaatttatttgtgtttctaattttagtattctcgacgcacctcctggccaaagtgatcagcagcagaagtgaatgaatgaatgatttgttgagaagtgatcgatcaattttgaattga

SEQ ID NO: 12722 - DNA, 3081 bp, Heterodera glycines
tttagccctcattgacctatcaaaaaaccacactaccctggatatgagtgaataagtgtgataagttatagcttattagcacctctgtgacggagtgttgtcattcgtaatttggtttctgtaatccattgccgatgtatcaaatgtcttatgtgcttttgtcccacaatccttctcacgttcgctaattaaatttttaaagtctgacaatgcgtcactgattgggtctatcaggtcaaactcaaaacggtgcaaaagtgccgtgccaagatggacaaaagcgcagtcagttttgctcagtgttcgtacattcttaaagggccattgaagcaaaatttaaaatgagtttgtttttttacatctttttaaaattttattttaaaaactttggaccaacacaatgtcaacaaatcaggcaaaatttttcaattttcttgatgcttttgcctccatccccgacatttcatccccgaagacggggagaaagccaaatctttaaaatctattaaaattttaatggatttcatttttggacaaattgattctggcttttttgtatgccagattaatcatttaaaaattcctgcttctcaccatgcttttgctgctgtctcttaatttgctgttaaaatattgctccatgaaagtgtaaaattcggccgaatgttctccattttgataagatgaatttccattgtttgacaatcgtgttaaaattctttccaacactttgtaaacatcgtaatatgacaatgtgaattcagagagtttgagcatgaagttgaaattttcttaaatattatggaagtgaaaaatgtaatgttttttcataatctcgaaaaataaaaaatggttaatttttcaaaaaatcttttagatatttaaaatatttctttctatttaacccaaattatatattatttgtaattttgttgttttgcttttattcctttatttaattcaaaatttaaattccattttttatcccaccaataaattgcggttctctcgcgctgtccgaatcaatttcactcaaaaaatgttttttctcttccgaatcaatttcactcaaaaaatgttttttctcttccgaatcaatttcactcaaaaaatgttttttctcttccgaatcaatttcactccaaaaatgttttttctcttccgaatcaatgcgaatgatttgaaagggaaatattctagaaaataataaaagttattataaaatgtaagaatattttacccattttcgttggtgccgtctctttgtgccgacaaagttttaaatgccgacaaaagttgttccaattgccacccgccgacatcacgaaaattcgtgaaataattctcataactagggaaggaaaatatttgaaaaaagtgcaaacaaattgtgtggcccaagactttaaaagggtaaaattaaaaataaataattatttgatatttcaattcaaactcacatcacagagagcacaatacgaatggccaatgaaaaagtcagttgtaaaatttggttgaccactttcttggaaatttggtctttgtcggcacaaaacactgtttcgttgtacgctttggcaatgtgatggcccaatttttggtcatagtgcaaaaggccgaggaattcgttcacggcgtcatctgctctgatcacattcaaatttggcattgcttcgccctctccgattatgttgtccaacacctaaaaagggaccaaccgggggaacatttttggcgtaatctttggctccatgacaatccgccagtctaattcaatgaccgacccacccgaaaagttgcgatttccgccgcatatttcacaaatgtcaaattgaaaatgatccgtttttgttccacagaatagtcctgtcctgtgtgatcataatcagtgtaaatgtcgttgatgaattggacgaatttgtgcacattttggactgaatcggccgagtcccattgataagacggaatgccaatggatttatcagccaaaaattggaagaaaatttggataaaaaataatggtaaaagtggacattgcagtttcatttctaaaaaaatgggatttattaaaaaaatattatttttataaatataattcattatgaataataataatatttaattgaatagaatggcaaaaaaatacgcatttatgacgacaaaagtaaaaatacaacttttatttatttaattccaatgattttaatcgtgcaatcattcgccttttattctgattttttctattataaccaatttttcactctaagcattaataattataattcatacattatcacccatggattttgtcaatcaatttttcactctaagcattaataattataattcatacattatcacccatggattttgtcaatcaatttttcactctaagcattaataattataattcatacattatcacccatggattttgtcaatcaatttttcactctaagcattaataattataattcatacattatcacccatggatttaccaatcaatttttcactctaagcattaataattataattcatacattatcacccatggattttgtcaatcaatttttcactctaagcattaataattataattcatacattatcacccatggatttaccaatcaatttttcactctaagcattaataattataattcttactttagcacccatggattttgtcaatcaatttttcactctaagcattaataattataattcatacattatcacccatggattttaccaatcaatttttcactctaagcattaataattataattcatacattatcacccatggattttgtcaatcaatttttcactctaagcattaataattataattcatacattatcacccatggattttgtcaatcaatttttcactctaagcattaataattataattcatacattatcacccatggatttaccaatcaatttttcactctaagcattaataattataattcatacattatcacccatggattttgtcaatcaatttttcactctaagcattaataattataattcatacattatcacccatggatttaccaatcaa

SEQ ID NO: 12723 - DNA, 1641 bp, Heterodera glycines
  misc_feature (1504)..(1504): n is a, c, g, or t
  misc_feature (1515)..(1515): n is a, c, g, or t
  misc_feature (1528)..(1528): n is a, c, g, or t
ataattcatacattatcacccatggattttaccaatcaatttttcactctaagcattaataattataattcatacattatcacccatggattttgtcaatcaatttttcactctaagcattaataattataattcatacattatcacccatggattttgtcaatcaatttttcactctaagcattaataattataattcatacattatcacccatggatttaccaatcaatttttcactctaagcattaataattataattcatacattatcacccatggattttgtcaatcaatttttcactctaagcattaataattataattcatacattatcacccatggatttaccaatcaatttttcactctaagcattaataattataattcttactttagcacccatggattttgccaatcaatttttcactctaagcattaataattataattcatacattatcacccatggatttaccaatcaatttttcactctaagcattaataattataattcttactttagcacccatggattttgccaatcaatttttcactctaagcattaataattataattcatacattatcacccatggattttgccaatcaatttttcactctaagcattaataattataattcttactttagcacccatggattttgccaatcaatttttcactctaagcattaataattataattcatacattatcacccatggattttgccaatcaatttttcactctaagcattcataaattataattcttactttagcacccatggattttgccaatcaaaacacatatgatgtgcagcagggatggcacggaatgccgaattccgaaattttcggtaaaaagtcggaaaatttttggaattttttttcaaaaaaaatttgctcaaagcgctatgatgggaagagaaatttgtaagacggcactttcactttacgatattttaatccgataattgaccaattagatatttttagtgtgttcttggtacggtcattctccccactgaacattttctacggtttccacagctcattttgtatataaagaaaaagtcaaataaattttaagcgaaatttgaataatttaaagaacaaatagaaatatggaatagtgcttattcgtggaaagaatgaacaatcgacggaagaaaagaacaacacattttcgtaacagttgagagcttaattcaattaaaaatattacgggaaaacatttatttatttatttgtacattgaaaatcatttttaataaaatatttaaaaaactaaataaatgcatatgatgaaagtcatttcaaaatttgctgaaaatttcggcagtcaaataatcggcctctaattaactttaatatattttgtgatgattttcatctttcagtggaaaatttgtcttcagcacaattttttttttttttgctttgtacttaccaatccttagttgcaaatttaatttgttgacgaaatttgaaatgaaaaagnagataaaattncaaatataaatcnaaatatggaccgttactaaataatttaattgccatgcctcattttgtttcctccttttaaatttatttactatgtgagatttattttcccctatttttctgtctatcaaatgc

SEQ ID NO: 12724 - DNA, 5289 bp, Heterodera glycines
agtcagttaatgcagtgcttttaatccagcaacgttcactctaacacaaaaacattctgaatttgatatttgtgtcggtttgtgagggggaaattcagtgaatgggcgattaatgaattgaaaaatttttcgtaggcgggcggttcgctgtgttcgatgtgactaattttgactgatttcttttcgcatttttcagttccttttcctttcaccttaatcatattcaactccatgttctgcgttgccattggatttgattgttgatttgaatcgaactgggttctatttgcgctgatcgcctcgattttatgatcattgacgtcttgttggtgatcggaattttggttttgaaaatggacaaaacgttgacttggccgggaatttgggttgctctcataaaaaatatcgttttgaaagccattttgtgggtcggatacccattgatttttcgggccataagtttgataagggaccaaattttggttttgaaaatgatcaaaattcttattggggcaataatttcggttttcctgttggaaggtttggtttttgaaaccactttgtcggtttggcctgaaattattttgcgctcccatcccaaaatttggaaaatttctttcaaaacgttgtccgtaatttgggttttgaaatgggactgtacggttttgctgtgggccggtttgctgaaactgaacaggaattccaactgattcgtttcgttctcggttttttccgtcctcaataagactcaaacggttggccatcatcaaaagctcatcaaaggtttggtttgctttggtctggcattccaaaaatctggccaaattcacatcatttatgtttgaaatgaagtgcttttttgacacctcatccaactggttttcgtccagaccaatgtatgagcaattaaccaaccgttgaattcgctcaccaaactttataatgtcttcatttggttttcttttaccattctgtgtcaattcggaaaatgcgtttgcctctttgtagtctgtctctctcaaaatggacattatttcggtttttagaatgccaaatgtcgcctcatttccaaatttgttcagcgcaatatgatacgctttcaaagctttccctttcaactttgtctgtagcaactctttttgcttttctggtctccactctccggcacacatttgaacatttaggaagaaatccttaattttgtcccgaccttccgttccgtataggttcggaatttctcggagcgtatttgcgtattggtttgacagagtaactttatgtaattccattacaatatcaggaatttgattttgttggaaattttgctgagggacaaactcgaaattttgaacgttcggaaagtgattgggttgtggtgccaaattttcaaaatttggattcggtcgctgttgataatttggttgattgatattccgaaccggatgaaaattttgaaaattgggtccatttccaaaatctcttgtattctgaattgggtgattcaccccaatttctcgaccataatttggatttggaaagttttggttttgctcaccaagcatttcttcatatccgaaattatgagcatgccgaaccggttgtgctcttaattcccgattttgttcaaaatttagtgcggaaaactgatggttgttcgtcatttgtgagttgacgaaaattcgagggttttggcggcgatgaaattgcatattttgtccatgaatctcattaccaaatcggttcgcatccggattccgattttggttttgctcgaaattttgttgtcccccattgtatgaaatgtgtggtgaaccattttgaggggttgaatgagcccggggatttccgaaactttgggcaacattttggttgggaggtcggaacactgcgagctgcatttgttcttcgacattttgttgcactcccacttgctgagggatactgttttcgaaatttcgcggaaatggatttgggttttgcacattgtccaaaatgttttgaggggccaaattcaaaccattgttttgttcagtgccatttcgtcggctgtggcgagaatgcgacgattcctcttgttccatataatttatcggccggcgcactcggaaattatatctttgctgaaaaccggttgactccatacatttctaaactttgaaatgaaaaggagaaagaaaaaattcaaaacaaaaatcctccaaaattagtgttgaccaaatttccaatgtcgcttgcacacaatcggtttgcaattcggcgtcgaaaggttggattttacgtcgcttttgcaggagcgccacgttggagaaagggcgtatattcggggagggactttgggatttgctggggttcgggttgagattttggggtcaaggaaagatttacttaattttcaacaccactttactgacaaggaattagagaataaggcaaattgcaattaggaactcaaataacagtaccaattaagcctttgggcgtttgttgttgttgaatgaaagtccacggggaaaagcaccaaattttgtagttttattacaataattcaaaagcacaaaatataaaaaacttgagagaacacgaagaacgaaaacgaagacaacaatcaaaaggaaaattaaatgaaggatgcaaaaatattttaaattaacgcgaaaaacaatcgttgcaaaaaacaataaaataaggataaatcattatttatcctacgagtgtcgcattttcttgaaatgaacaactttctctcggtgtctaatttttcgacggtatcgcattttccagtgtcgtatttaccggtgtcggattttcagggagccgtctgagctatcaagccatcccattcaccctacccttttttgggtcttttgcctccgctttaagcgttttggccgtccgctgtgctcagtcctatacggtatttaaaaaataactgtagctttaagtgttgtatgtagcacaaacggtcataaattgtttaagaatctcgttttgaattggtcaaaaagttcgaaaactaagataaaacaaccaacatactgttattggattattattataagtttgttcccaaatttttataaaattcaattgagatttatccatgaatattgcttttttgaaaagtttagaagaaaaattttaaaataaatttatttaataattatttctatagttaacattattattttttaatttttcaaattgcatatcttttttttttgtccactaaaaaaaaattattttaacttttttcgattgtttggtccaaaaatgtggccccaccatcaaaacgaaacatttcattatcaccattatgaaaatagtaatacttaattaaatgaattcctttttcattagttttttgggcaatttttgtaccgcaaaaaatgctttgtaagcaaaaattgaataaaatcagcaacaaaattattggccccgacaaatggactttgaattttggtgataagaaaatgacataaaaatgcaaagagcagcagaagcaaaatgagtgaaagagccacagttcaatcgaaatatttaattatttaattaatcaattttgatttaccgtatttattgggaccccccccccccacttcttaaataaagccaccgtgggctctatttcggtaaatacgattattaatgacgatttcaataaagcaattagtgcttgatcgatcatccattgtcagtgatccagtttatatttcatttttcagttttttaaataaaacaaaaacaaaaaagtttttccccttttttgggttaaatgactcctttattttattttttacttctcaatgatttcccgacatcaattccaaccatgcaatggatttaggtgtcggtattatacccctcacatgagggtaattcaaaccaaaaagagcgtaattaactgtaattattaaatctttgaaaatattaggctcaaaaaactcataagacttattgggaaaaccgtctgccccctttaatggaaataaattactggtgttattgtattttgaaaattacagtacttgaaatataaaacaatactttatgagaaaataaggcaaattcctcgtgaattgaaatcctaaaatctaagaaaggttagatttgtcgacgacaattaggcgtcctttatttacaaaattttgatctcttaaattgtttgtacaaactgttcgagtagtacccattaattttaattatttctctaatcacaaaaaataaaaaacgaattaaaaccgttcaattattttgacagacaattttcccccgatgttggagaccaaagataataatcctcatcataacattttcatttgttgataatgatgatggcgataattaatcgctccagcaaattatcattatgatgaggctaatgatgatgggtgatgaccgacaaaaagcacccaaccaaaacccatgggcccttaggcgccgacgccaaaaatcgtacaaattatgtttttctttcccctttctttcatttaatcattgctgataagtcgagagtgataacctatctctctctctctctctctctctctgctcttgattgtgtatgataaggggttcgaatgtgtacccattcccatcgtcttttgtgtgctgcacttgggcaggaattttggcgttttgtttgtgtacaaatttttatgcgcccgaaaaaaaaccatcgaaatttgagagaatggaggggacaaagaccagctcctcgtcggcccattgatattggcaaacattggagaacaaattttcagttccaaatggccctgagcctcagtcatggcggaacaatggtgccaagcacgtgaattttgtatgaatgagaataatttttgttcatatgcaatgaaagtatcggtgtcaagacaactcgtacaaaaacttagactaggcctaagcttagggttaggcttaggcctaagctttaggctacggctatgcttaggcttgcttgggcctaagcctaggcttaagcttcggttttattttatcaaaatttttattttgcgagttgccattgactcatttcttggttatggatcaacaggtgaccaacgtagatatctgaggtcggatgaatcccgagtcaaggtctaaatgaaatgcaataaatccaggagattttaaaaaaagaccagaaggtatcccgaatccgttgacatgccgatcccgatcaatctgatcccagatatagcaaaattgaaaaacagcaaggttgtggcatttaaataggcggcaaaaccaaatctttcggcgccgaactgtggaaccaatcagttaaaa

SEQ ID NO: 12725 - DNA, 3753 bp, Heterodera glycines
  misc_feature (8)..(8): n is a, c, g, or t
aaagcaantcggtagcaaattctgtgctctttccagtgagcttgtccattttctctagaaaaaattttccagccccctagggatttcgaaaatttcccgattttcagtgtattttgggtgtcccggtcactaggaaggagtgatctgatcaagttggtgtaagagactttttgatcagcaccgaaagttgtgcaagcatgaattatttcaagtttttaaatgaactataagatagtttttcaggtttttttgtggcactgtatttctctcacaaaaatgcaatttgtttgggaaatattaaaataataatcgaaattataattatggtcaacaaatctaattaatagattaaacatttaaataattaattgatcattagaacaactcttccgtactgaaatgacccgccctctccgatcaccccacactcatactttttttgcttcgtcatagcaccgatcagcaccatctaagtgtccaaaaacctagaaaaacaaaaaaaatcataaaattcgccttcggacttaaccaattgaaaacgccgataagttgtggcaaaaagttaaccataactttactgaaaagcaacaaaaattttttaatgctcgatatcattcgatattcaaaaaagttatgactatgttagttgaatcgttctgcttgttcggaacaaagctcttttggaagaaaaagtttaaaaattgaacccatattcaacaaaactgaccaaattaatatattttttagtttgcagaaaataattttaaaaatttagcagtccatttaagaatcaattaattaaaaatagaagaagtgatcggtatttatcagttcttatgccaccctatttttcgtagtaatttggggctgtacccgctacaatttccgagttgttggcgaatttttacatttggcccaattgcaggggtgcgatcgaaaatttttcaaaatcagaacattgggctcaaaaaatcagattttggggtcaaaaatcaggacattttgctttattgcttaaaacagatatttttacaatttattcgatcaaaaaatatattaaatattatatttttcacctcacatgatcatttttaaagagagtccggtggcgccgagaggcgccgccgggaaaaattttgtaattttaatgcgatttataaaatttctaagagcatcgaatgatatcaagataacttacttttgttggttctaagaaagtcttgaccagaatttttgatgatcaatcttattttatgtcgaatgaaaattgtttaggttttttattttcttgataacaatcaatagcaatagtgtttcggattagtttgcaaaatttcaaaaatttttgttaaggtttcaaaaaagttatgactatagtatgtcagtcgaatcgttctacaaaattgaatgtttagcgaaaacggaacaataaaataatttttgtttatcaattttgagaaaatttttcaatacttagtggagtgtattttttgaaattttttcaagtgattttttagggagtgtattttcccgattttattgcattttaaatctttcgaaaaaaatgctaaaaaaggaaccaaaacggcaaaatgccaaaaagaattaaacgcttaaattatttttgtgtttaaaaaataaattaaatagttgattaattacaaaatcaaaaatcaacaacaaaatttctgtaccaacacagtttttcatatgggataattttgaaatgtttaagaaatgcaccaaacatcgtgaaggcattaaaattaagatttttaaaaatcatttaatttttatcaaatttgaacaaattaacaaatttatggccaaaacagctatttaatgatactaacaatgttggatttggatgacaaagaaaaaaagttatagccaaaaacttgccgggcccaaacgttggggcccaattgagctgctccgtattaattaaatggaaaattcgaataaaattatggtcgccatttagagaacaggaaaacacaaattcaataaaacagaaaattttttaaattaaaattaggaaaaattaaataaaatattttgattccttttaaatgtgctattcatccgaaagttcttcactgaactggtcaaatttattccaaaagcgatggaagtggtaaattttgaaaattttaatgaattttatttaacaaattagttattttcgtgtttaaattgaacatcaattttaaaagcatttgatttcctgcagtttatccgccagcattttgttagttcgacaagaaaatcattaatgcaaaaaaagtttgcttaagtgaatgatctctaatattttttttcacaaataataatttttaattttcagatttgctcaattggattaaccaaagcgatgccattggacggatggacaaaaacgatggcaattttcgacaaatgagtgtgaaaatggacaactgaatttttcttgtaatcggtgtggcattaattttaccactcaacggataattttgacaaagaatggccaagttggactattccgagtttctacaaatattaaataataaaaagtaaaacaaatttaaaaaaaacaaatttataaaagtacatttaaaagaacaaaataatacaagaatgatcgataaaagtgatcacttgtgaatatttcaccatttagagagcatccaaatcaaatttgaaattggacccaaaattcgcttcaattttttcgacaattaaaacaaaacaaaaaaaccaattaacatgaaaatggtaatttaaaaattatatttaataaattatatagttatttgacaacccaaacgaagtccatttttggtgaaaatgatctgccgagtggccgaactgtcgccaattcctacagtatcaccttcaccgtaggaatattcacgatttgttccttttcttttccattaatccagattttgccatcactatcaaatgcataagtgcccttttcatttcgaattgttccatccaatttgttctgctgtttgactgcaaatccgaagctcattctcttataatggacattgagacttttgttgccaattattttgagattctcatgacaaacattggcatcccaataattttgtcggaaatttgaagatgccttaaaataattcatttgtaaataaattgattaaatatacaattaatgaaaataatatttaaaaatatatttctaccccttaatttacctttctttgctttggttcttgctctaatgcactaattttttccccaattttcttctgatcattttgtatttttgaaaattgatccgcagtgcttaaaaatcaaattaatttttaaatataaaaggaaacatttaaaattgataaatttaattttcgttttaatttctcatcgccttttgactatacttctcgctgcttctccatttcactgattttttccaaaattttcttctgatcattttgtaattgcgagagattttcctcgccagcttaaaaacataaatgaattatttattaaaatggacggaaaataatatttaatccgttataagaattttaatgccgaacaaatggtggacagtgtttttcagattgaatctgttggtaccctaatcaatttcaaatatttaggacaattttactcagggctcccagattaaaattttcaaaagcctcatttttgatcaaaaagcttcataaaaatttattcaaaacacgtcttcaaatgtttaaacgttatatttttgattgtgcacccagggacggt

SEQ ID NO: 12726 - DNA, 3137 bp, Heterodera glycines
  misc_feature (158)..(158): n is a, c, g, or t
atttatttgtttaattattgaaattaattattattaataaataataattaattgtaataatggttgcccatggcatgtatcacattacctgactgcaataaagcaactgaaaattaaaattttaaaattatatcactttgagaaaatttcagtctatntaatgagactaagtttttaaaaaattgattaaataaaataacataaaagggaatatttttaaaaaaatgattagaaaaatatttaaaaagctggattaaaatattaatgaacaaaattactctgttcgtagtaatgcggcaattcattagctgaaaaagatgtaaatataattgttccaacactatctaatgcgggtatattatatgttttttgaatttgaataatctttagtattaaggattaagttctagctaatttcgtgaaaaaaagcaaaaatgggtcatttcacaaatacaaaactgaattaaaatttaaaaaaatagagaagaaccccatggtccatttttgcgtttttaatcaaaattcctaaatctttgtagtttcgcgaaatgacccagcactctcaaaaatagattactacaggaaaaatttgaaattatgttccaatcaaaataaaatttatttttattttaaaatgtttattttaaaatattttgaattaaaaaaaattactattggattctaacaaccaattcacgaacgatgatatgccctgactaaaagctgatgcaaccccatataattggtctaaaaaacaatttattttaatacacacctaattctcaaattatgaaaattgacagtgaatttaattgtcccataatgattaaatttaatttttatgataattaagaaaatttaaccaggtagcgttgattcatcaggaaattgtatggattgtccatcatttcttgatgctccacccttcaaattaaatagcacttatatttaaaaaatatttcaaataaatttaattaatttaaaaaaaaataaattttgaaatttgtaaaattcaatttaaaaaaattgtatggaaagttcatcatttcttgatgatccagcacttaagaataaaatagcacttatatttgaaaaactattcgatgtaccaaataattttaattaattaaaaaataaaatattaaatttgtttaaaattaaaaaagattgcatgaatgttcatcatttcttgatgctccaagcgcttatatttgaaaaactattcgttgtttcaaataatttaattaatttcaaaaaataaaaattaaaatttgaaagtttaaaattttacttgtgatgattggcccacatcgttgacagcactaacaggtgcacgacaaatgggacaattttttctcgtatttagcctgggggttatggcaataattttccgaattaattattattaatgatacctaccaaacattgatgcagtcgcggtggaacaaatgctgtatgtggtttagtgatttttaagctatataagaaaattgtattggggcctcgggtatacgaaaatttcatgaatttgtacagcaaaatttcaacgattaatgttcgatttatctctggactgagtaactttcgaaagccttaagtgccctctattagcttgcaatattttgaaaaattcgttaaggttcaaaaaagttatggccagaagaattcaaaaaaccaaattttccaacctttttggccataaattgttcaaaactgaggaattttttttggaattttgcaggctaatagatcatctgaagggctctcgaatgataccaaggttgttagatttggttaatcaagaaaaaaagttatagtccaaaaacatgctggggcccaaaagtgccggggtccaactgagatggaccgtcacaaattggatcgcaattttaattatgtgaaattttataaaaaagggttcttacaatttttgtcacgaaatttttatttgaaaattaaaaaagtcagattcatttatttcataatgttgcatatttttgccgttttattacgattttggcccaaaaactaaaatgaattattattattttttaattatttttgtctaaaactcgaactcgtatactatatattatattattaagcagcattttttgctcacattgcatggaattgccgttttcacagagcccttttcatttccatcagaaagacttgacaaacaaattgcacaatcgtcatcattttgttcagttgagatgctttccaatgactcgcttgaattttggcttccagttcgatgttcatctttaattttattttagaaaataacagcaaaaaatcaattaaatttttaaaaattggaaaatttaccaattctggcttccagaatcggattttttgaacaggaaaataacgcttttgaattgttttaaagaaatttgtgatttctttttttataaagaaatccttaagcaaccggtccctatatgtcgggatccctaaatgcgatatccccgtgtccctatatttcgggatccctaaatgcgatatccccgtgtccctatatgtcgggatccctaaatgtgatattcccgtgcccctatatgtcgggatccctaaatgcgatatccccgtgtccctatatgtcgggatccctaaatgtgatatcaccgtgcccctatatgtcgggatccctaaatgtgatatctccgtgcccctatatgtcgggatccctaaatgtgatatctccgtgtccctatatgtcgggatccctaaatgcgatatccccgtgtccctatatttcgggatccctaaatgcgatatccccgtgtccctatatgtcgggatccctaaatgtgatatccccgtgcccctatatgtcgggatccctaaatgcgatatccccgtgtccctatatgtcgggatccctaaatgtgatatcaccgtgcccctatatgtcgggatccctaaatgtgatatctccgtgtccctatatgtcgggatccctaaatatgatatccccgtgcccctatatgtcgggatccctaaatgtgatatctccgtgtccctatatgtcgggatccctaaatgtgatatccccgtgcccctatatgtcgggatccctaaatgtgatatctccgtgtccctatatgtcgggatccctaaatatgata

SEQ ID NO: 12727 - DNA, 1530 bp, Heterodera glycines
cgaattcattatccctcttccatattcctcctcttgtatcgcgcgtgcactttctaaacaaaattactacattttatacatacattttatatacagattaatatatatatttcgggttgttccaaagccatatctgagtattgcgaacatcttgggtcgaggtgtgtgaatttaaatgagcaatttggactgaattaattccaagtttttgtgtgtgtttttttttaatttgtaagttcctagaaacaccgaaaatttttcaatctttttttcgatctttgaaaattatattttttttaattttctccaaccatccctagacaaatttggacatgatgtttggtatctcttgatcacgtgtcattttcccccaaaaggtcagagaaactaaataatgccaaatcggtcagagaaattaaaatgtgtttaaaatgattcggttttaaaaaaccattcttgaacctaatgaatttaattccgcagcctggtcttcctgttcttgtgttcggcgtgcaaatccttcgtctcgtaatcgcatttgctgcttcattttaatgtgtaattgtagcgctaataaccgatccagttcggcggcatcttagaggattattttttatatatttatattgaataaaagtgtcacaattaatgaaattactggaatgtgcactgtgcgactgatgacctaaagggttttaaattaattagtatgatgaatgataatattttattttctattttaatattaatagtataattaaatgaataaagtattttttgtatatttttgtaacgatatatcatttacttgagttcaattcatttatatttgaagtgctcgcaggccattgttgattaggatttcgttgcaccacttgacctaaagggtttaaaatcaattagtatgatgaatggtatttttatttttatattttaatattaatagtataattaaatgaataaagtattttttgtatatttttgtaatgatatatcacttacttgagttcaattcatttatatttgaagtgctcgcaggccattgttgattatggtttcgtcgcaccactttacaggttccaaattaattagtatgatgaatgataatttttatttttatattttaatattaatagtataattaaattaataagtattttttctatatttttgaagcatatatcattttacttgaattccttgtattcgtatttgccgtgttcgattgggcaaccctcttcgcctgttgtcgagccgaattttgtctaacctggcctaaaaatttaaatttgatttagtttgattttctttaatttttatcaaattatatcatttatttatcggtaaatttattattattctaataaaattagaccagcagatggattttgagaaggtcgctggggtaggtcagaattagttcgtgtgattgagtcttaaaattgtattattatgaactcctaatctttatgatcattggtaaaatcgagaatttagctttaaaaaaactgtttagttgaatttttttaa

SEQ ID NO: 12728 - DNA, 2639 bp, Heterodera glycines
cctcatccattatatcgtgagaggccgagaattcgaattcaactcacagacgaaaaagggagaatataaatttgatgggcaaaaaaagagtgaatactcctaaaatccgacctaataaaaagcctaacactcggaggggacaaatcgcggcggaaataacgacaataaccaccacaactgctattccacctattattagccctagcacaactgttattccaccgaccgctcgcaccatcaccactgctattccaccgacaactcgcaccatcaccactgctatgccacctattactcgcccaagcacaacggttattccaccgacaactcgcaccatcaccactgctatgccacctattactcgcccaagcacaacggttattccaccgacaactcgcaccatcaccactgctatgccacctattactcgcccaagcacaacggttattccaccgacaactcgcaccatcaccactgctattccacctattactcgcccaagcacaacggttattccaccgacaactcgcaccatcaccactgctattccacctattactcgcccaagcacaacggttattccaccgacaactcgcaccatcaccactgctattccacctattactcgcccaagcacaactgttattccaccgacaactcgcaccagcaccactgctattccacctattactcgcccaagcacaactgttattccaccgacaactcgtaccaccaccactgctattccaccaattattagccctagcacaactactattccaccggttactcggcctagcacaaccgttattccaccaattactcgcgtaaagaccgaagaaatccccaatatcacgattgaaaccattgagaagctcatcaagagacttgagaaaatgacaggaatacgggagaaccgtgtgaaaccaactccatttttgatgccggaggacgttgaagaagaaagtccgaccacagtagtgagcaaaagggacgctccggaagaagattcagagaaatggtggcaacagcgaaatctggatcatgaaaactcacggctgaattatcttggatggcgcagtcatttaactaatttacaaaattcgcgggacaaatggttcagcgactgcaatgaaagaaaaaacgcccttgcggtggcaaaggctttggcacgacaaatgcctgaagatgcagcgcggtctttgtacagaagagatgatatcacagctttttgggcaaagtcgacagcattgaatccaatgtggacaattactttatgcaagcaaatcaaagcagaaaatattttgtgggaccaaaaagttggcaacaaatgttaccgggaattgcccataatagcgtccaaggaagttttgtttgtgaaagtcggcacaagagacttaaagaaggaaggaaaagaaatacagtgcaacaatgatggaagtaatccttgggcttcgaattttaatgtaaccacagagggactacaaccatcgatggaacatcgtttcgctcctgaacaattcacaaatcggcaaaatccatttctattcttcacaaaagggtccattttcgagtcggaacaattacgactcgaacagagcttaaaagacatgtccaatcggatgacacgacccgaattagatttcactgacgttggactaatgaacataaatataactgaggaacacggggattcagtggccggaattttttcaattggtgaaattctggtagaaaatgcgcaagtcgaaggagaaaaactgagaaagaaagccgaagaaacaattgaaagaggaaaagcatggattgaggatcccattggaatcataaagtacattaaatggaccggcattacgatcgtcactatttaattcttgttggagtcgcggttctctttgtcaaaattaaaatctatacaacagcactcatggcaccgttgcgaattattcgttccatattcaattcaatcatcgggtgttttaccacggggaaggaattaaccgatcgaataagacaccccgtggtgatggaagtcgagctggaggagagggtcacaccatcagcacccactgaggaatgcatgctggaacagaaggcatatgtgttaaattatatgcctaaaatataccaagttcatcaaactgaacgaaaaaggaagagatgctatgtgaatttaaccataaacgggaaggacgtaagggcattatttgacactggcgcggatgtaacttatgttgggaattcgacggcaaataagtgccttctcaatgttcgccgaggggacttcccacaagcgagggcagccaataaaacagccataagattttttgggtcggccttggcacaaattaaaatcggaggtttcgagggaaagtttccgctgctcgtaagcgaggacgagtgttgtccatgtgccgccataattggaaccgacttaatggattacattacagaacaaggagaagaagaaattgggttaaatttcaaaagagactcagtccgaattggacactttcatcttcctatggtcgccgctgttaatatcgagaagaaaccaattgagataaggcttactaacatgcagaccctcccgccttttactgataccttcgttttgggtcaaataaaccgaagcttga

SEQ ID NO: 12729 - DNA, 1322 bp, Heterodera glycines
  misc_feature (459)..(459): n is a, c, g, or t
ttaaaaactagagatcggaattttgagaaaatacggatcaggatcgggattacggactaggcacacatacggattacggacttacggactaaaaatccggaaaatccgtagtccgtaaaaatccgtatccaggaaaaatacggatccgtatacggttacggatttttttaaatttgtttcgtacaaattttgaatatttaaagctaaaagatttataataaatttattgtaaattctaggcaataaaattcaaaaaatactcaaatttgataacagactttcaccaaaaaaaagcaaacttgcgatttttaaccatttcatgaatttcgttgacaaatattcataaaaaatatctataattttgaaaaatttacaaaaccaagttcgtaaaaaatttaagaaatagaaaaacgaaattcatttcttgaaaaaatttacaaattggaaaaaaaaattaanatagaatttcgtaaaggttcaactaatgcaattcaataacgtaaggattttgagttttttgcacaaaaattttgcttttttccattttttcgatttttgccaaaaattttacgaaatagacccgccaattccaaagtattggcgaattgactgcacaaaatttaaaaatataatccatttcactttaaaaaagccaaaaaaaaaatccctaatccgtatcaagaattgtacggatcaggatcgggattacggactaggcacccatacggattacggatttacggattaaaaatccgtaaaatccgtagtccgtaaaaaatccgtattggccgaaaaaaatacggattacggactacggatccgtaaaaatccgtatacggatcccgtccgtatccgatctctattaaaaacagtaattcacataaatgcgagtttttgaaattataataaaatataaaaataaattcaacaaaaatacaaaaagattttgtgaccgacatttgggaaattcaaacaataaatacgagcttttttcatgttttaacggaaaagtgacttttaaaaggaaacaaaaaacgacaaaattaaatggataaataggagaaaggaatgtttgctgatatttacggataatttccgcggaaaaaaaccaatttaagatttatctacactgattaatgatcaattactagttaatggtctttcatttccagattctcagtatgaacagacagcacggggaattggactatgttggccaacatttggccaattttcaaaacaaaatctctctgacaatgtccaatgtgccaatgcatgaagctgtgctcgcggcacgcgttctgagcagcgtacaaacggta

SEQ ID NO: 12730 - DNA, 2724 bp, Heterodera glycines
caccgccggcagaaaatttcgaaattttgactatttcacatcactaaatttttcaaaaaattgagttttacccgaagaggagggaactgaaattagtgtatcataattagggctgcaattttatgtaaatacatattttttcttggattctccatgctctgaatagtaggaaaaacactttcttttttgtttttgcgaacaaaaatagggacttttatttacatattttgggatttttctacatattacatatgtacatatttttatacatattttggactttttcgcattttttcgtacataccgtattttctctaattaaggccccggggggattatttttcaacctctttagaaagggggacataattggagacagggcctttaatggagacggggggattatttttcaacagatttttaatgactagggccgcgacttttagtgatgaaaaatctcgaaatagttaataaaataatgtagagtagagcgggactgggaattttgagcaaaaccgggaccgggacctgagcttttcaaaatccgggaccgggaacagggacctcggatgaccgggaattcccggcccggtcccggtcccgctctactctaaaataatgacataaagccaaaattttttaatattttgctgacaaagtctgatttttaatgacgcatagtgacttcagaatcgaaaatttcaatacagaaatgcttttttgagctcctttcttcaaaataaaagcaaaaaaagttttcttgttatgaatttttaaatgtatgcatatttttagcgccctttcagaaaatttttatggggtgtaaaccagggttgccgcgggtcgagaaaaaatatcgggtcgggtttcgggtcgagaaaaatgtcgggtttcgggtaacccgcggcaactctggtgtaaactgtacaagtacctaaaaaaataaaccgcagccaagcggactcgaaccccagacccccgtctcataagacccctagggattaataattaaatttcaaaaaattgaaaacacatagcaccggggtgggttagattcggacttgagtaaagtaagtgatttttctgtattattttttcatgtttattaaacatttaaatgaatttcaatttagaattcattaaaattaatttttattaaaaataagatttaaaaaataataataattccatttatcccccggggggataaatagagacggggcgattatttttcaacatcctcagaaagggggacataattggagacagggcctttaatggagacagggccttaattagagaaaatacggtattttaattgaaattttaattaaaaaaaatattccaactttttctttcattttaagcatcctaaaaacccaaaaattaatcaattggtctttttttacaaattctgttaacaaatcgcattaaaaaatacaaaatttttcccggcggcgcctatcgcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtaccggtggaaaaagttggtaccggtaccggtaccggtttttgcattaccggtcagtaccggtaccggttttttaacaattaccgattaccgagcaactctaatataaagttaaattaaattaaatggacgcttcgcgaaaaagttgttgtgaggtcgggcgataatttgcattttgtcaccactcccccctcccaccgaaaatcccttcattccactaattgccttaattaaggacaatttcaatgaattgtacgcctttttgggaacccacaaattcgcacgacaaacgcatccaaaactgcagaaaatttggtgggacgttcatttttttgaggtcgaaaaaacgcaggggaacaggtgaaaatgaggaaaattagcgataaaaacatgaaaattcgaaatttaagctgggttttaagcccacttagcgcattggaaaagtacaaagtgcgcgaaaagtatccgttgccgccgacaatttgggacggacaacggaaaaatggcttctttagcgaaaatacggtgaaaatgaaccgatgaaaagcattggtatatttgggacacaatatcccatccccccatttcgcagatgacactgcttaatgagcaattcgcggaaagtcaatacttgcccccgcccgatatatgggcacttgcggaagccacaggcctttcggagacgcaaggtaattaataattaatgagttgatcaattaacacagtaattactgaatttattagtataagtaataaattaaaatagtactgggtaacagggatgttgcaaagagaaaaatgaaaagcgaaaccaaaataaaaagcgaaaaggcgaaagcgaaatgcccaaaaaagcgaaaaggcgaaattttttttcaaaaa

SEQ ID NO: 12731 - DNA, 3701 bp, Heterodera glycines
  misc_feature (14)..(14): n is a, c, g, or t
  misc_feature (3672)..(3672): n is a, c, g, or t
agttggtagcatcnggcagaacaaatttaacaggcaaatcgctatttgagagtttcaagaaataacgcaaaattgaagaatttgccggttaccattggattttttaaattaattttgtaaattttcagaaagatccagaatggaaatggggcgaaatccccaaatccaacgggaaagggtcgaacaaagcggacggaagtgcatcgaggaaaaaggtggtggagaaaaacgcaataatttatcaatcgttaatatatcaaaaatggtcgttatcagagtcgatgggactattggtttggccgttggtcccgccaaaacaaagagaaggaaacggagggacggaccggcggtggcgaaaatggtctttcgttggaggacatcggcaacaacccggtcaaattcggcctttacatcggcccaagcaaaaccgaggccatttggtacggaaaatgaaatttttctttaatgggttggaagatttctctttctggaagtttgaatcatttaggctttttaattagagttccctttctaattgtagcatttcctcaaaaagttcggacagcggaaatggaccttctcttggcaccagccccacaatgtcattctcgccggtgcttacaattagcgaagagaatttggcctccgaattcgcaaaaggcaacgtaacaattgcggacagacgcccttcgaatgcaatgtgaatttttgagatgttaaaaaagttaaccaggaaattacaggatttccaaaaaatgctatcttttctttatggattgtttgacgcatttattatacacaaatatttagggacttcgaactgtttgaggagaaggcaaaagagaagcggtcgttgcgtctctcccgtgaccaattggacctgttgaacttgaactacgggtcgaacgacgcgcggttcagcatcacaacaaaatatcaggcaaaaattaagggggtgattagggattcaactgataaattcaaaaatgggattcaattcaatgcgcacagaaaggggtcatttttaattatgcattttgttttagggaactgcttggtgttcttgtcacatttatttgctcaaatggtatgacaaattggtcatctcggatatcgacggcacaatcacaaagagcgacgtgcttggccatgtcattccagcaattggtggcacttgggcccattccggggttgcagagctgtatactggcatcaaaaagaacgggtagaacattaaaaaaacaattgtttttagctagaataccgtcattcgccttttaagatatcaaatggtttatttgtcttcgcgtgccattggacagtcccactacacgaaaacgtacctgcagaacttcgcccaggggtccaggactttgcccgacggacccgtccttctctcgccttcttccgttctgatggcattcagaaagtactgtctcattatttacttacatttcacattgaattgtatatccagggaggtcattgaacggaaacccgaggagttcaaaatcgcatgtctcaccgacctgaaatcgctgttccccgtaggacagccattctttgccggatttggcaatcgcgaaacggtcggcagtttgacaaagggactaaactcactcactcccccctcccctttcaggacgttaaatcgtatcttgcggtccaaattcccccggaaaggatcatgattattgacccgcaagggtcgctcagaagggcggacaacaaagcgggtggttacgtgtccgattacccaaccttggccatggacagtgtcgactacgtgttcccgcctcgggtggacatggacggcatcgacattaggacgaaagaggacggcattttgaggtgggcaaatttccttcgtccggcttatctttttgagccttcaattacaccccctgatgaattcttttctcgtgcagtgaattcgtcgcatggcgaactgacgctgaacaattcgatgcgctggtggacgcggaattggaacagtacgaagaaaggagcaaacgagcgaaagcaattgtcgcggggacgacggatggacgaggggcggacggaaagaagaaaatgtataggaacggaagacgggcaaagtgatcagagcaaaattatggatgattaattgacgaccataataggcggaatgcgggagaccaaccactcttttgtttggtttatgtaattaactagcctttgtgtcaactgttcaaatggatttgtctcatatcattaaaatttaattgatgaagtcggtgcagcaattccaatatttgttcggtccctttcacttttgtgtttcatggaccattatttattatttttgaaattcatttattcaaaatatttgggttgtttttgttttgaccagtctcaaatggattgttgcgacttcacttcgtcacaaagtctccatcaaatgttgttttctcagtcaaagtccgaatggcttctcccgtgctgtcagaagcacaaatgtacaatttttctcatggaataataagttggaccaattaatttctctgattagcctttttgaccgaccattgcatttgcctcgtcgtcgatgagtccctccgttgttcagctgatgcgcctcgtgtcctccgttgctcaacgcttctcacccggatcagttcggttttgctgtacgttttcaatcccttttcaaacccacatttcgttgcccccttttcagcgagtttcgtgccttcccttccgactccgttctgtccctttgcctttcccattgcctccgctttttcgactttccctccgccgagtccattggctatcagtgcgtcgcccttttggtcaatttggtcgaattgcattccccaaattgcggtgtgtcccttaatttcgactttttcttctcctaattcgactgctttttcagtccattgccaaaatgtcgacaaaaactgcgcatggcttctctctgtcggccattcgttgtgcggtgcgcacaacgaaatgttcagcaaaatgcgcatcaaagcattggtattgccatttgctacactcattattggcacttaatttcctctctgttaaatttttaaattaaaatctttccgaaaatgccctcgccattctttttggggtcgttaaattcctgtccatactttgatctattttcggtacttttccattttgatgccacacccttcaaaaaagcaataaagctgttcaggatgcttataactagacttattttagggccataaatgcctaaagtgtgggttgggttcgaaattcgaatgggagaacaaatatctctccgtctttctgttttgaatttaatatgcatttcttacggctttgttgctctttttttttaatggggtgtggcatccatcaaaacggaaacgtaccggcgtttgtttggatgtttgacatttcccacattgatttgtgtccccttttctcagcactctctgctccattgcgcctccattgagggctctcttccgttccgcgaccgtttgttcaccgatttgttcgtttcgcgtctctttctccaaattggtcacgccccgctgaagcatttcggtcccaaattcacaaccattcatttcatttccctcaattatcttttcagatttccaaactgatcggttgacgattgtgccatttccgttcgcctgatcggacaggaaaggctanacttgcacatgaaatggatcgagcgacag

SEQ ID NO: 12732 - DNA, 2272 bp, Heterodera glycines
  misc_feature (2249)..(2249): n is a, c, g, or t
ctaagtttggagctcgttgaagcatttgaggaagatgatgacaaaagcgccgaaaacgatggaaatgtgagtttagtgttaatattttgccacgggacagtacgcctcccaaaaagacaaaaaattcattaaaaaaattaaaggaattttagagatttgaaaggatttctgaaaaaatatttttcaaattttgtctctcttttttccaataaaaccctaaaaagagtaattccactgaatttactaattaatatatttaatttgccaaagtccttctttcagttgatggacttttcttctcgtattttcgcccttttgcttctttcgctgattcattcgtccgaattttgcggtatttttgggagtttctccccttcccccgcattttttgttaccattttcatattttcgactttcttctgtccaattgaaatgcaatgctctggtcgcttcgttggatgaccaatttgagctgtgtcaggcatggaaaatttatagaaccaaaattggaatttgaatgaattcaggacacagcgctcaaacttcttgaccaagttttctccgacccatttcaggacggaattgcatttgtttgtctttttatttttttctcattttcatataattttttagggctttgccgcttttttggaaagcacaaaaagggatttgctgttcgtcaatccgcacactccgcggcaccaattggctgtggaatatcggtcggttttgtcctatctcactcattctttgtgttttttctgattgctctttcttggcactttttgcatttctttacctttaattaggcaattagctagctaatcgctttgctcatttttcagtttacgttttgttctgccccgtctctccgccaatgttcgcctctctctcttcgccgaccttatcaaattgggggccaatgtctgtgaccaaatgttccacaattgcgacgatggaaatggcaccgaaaataatgttcctttttttaattcgcaattcttttttaaatgtttattcattttgtcttcagcccgaccttttccttctgctccaaattcggcctcaacttcacgccgttctttccgcacttttcgtcgcacttccgcacattttgtgtgacgaaaaggcaacaaaaaacaccgaaagtattgcatttttgaaaatatttaaaatgaatttatatttattctcaggtgtgccttcctcagtggacgctctcctctctctgtgccatcgctgtgtccgtgtggtgtcgccggtggtccattccctttcccccgagggctttttgccgtcttccgccgcccaattcaatgccaattttgaaggacgaccaaccgaagacagtaatcattttgaaattaatatttatttaaattctattttaagccttcagaaatgttcagctgttgtccaagacttgttggcgttcccacaaattcatttctcacattttttcccgaatcatcgaatgggtgggaaattaaaacatcattttctctctaaattcactgtccatttatttccccgtcagatgccctctcccaattcgctgtctaatgaccaactgaccaaaattggcgactatttttggcttcagctcaccgaatgccgccactgcggcgcttttgaagtcggataattaatcatttaaatgggcaatttgattgaccggtcacaaatcccgtctcttttaggccgctgccaatgcctttcgctctgtctgcgtgcgtttttggaaattttctttggactccgatcgttttccgtgttcacccgcccaatggctccaacaaattgtggacgctttgaccgggaaatgtttgcgcattcgctaattgggggtgtttaatttcgctaatgtcagtttgtgcccgccatttgtgtccctcccggcgaagtgcgggccttccccatttggtcaatgctttgctttgttcggagccgtccctgtgcccgaacagtcgccgatttgtgcactttgaccgcactttgagcacacttttggactgccgtgggttggccgaccgccgcttggagtcggcgccacggcactctatcggattgttttgtttttttttcaggttccattgtgtcaacgtgctccgtttgctgttctcccaagcccagcttgaagagcgcattttccctttcgtggaggaggcctttcggctgagcatcggcggatgctccgacgaattttggccggtgatgatttttttgttgtaaattggcatttttccaanatttgtttcccagttatccttca

SEQ ID NO: 12733 - DNA, 1045 bp, Heterodera glycines
  misc_feature (1039)..(1039): n is a, c, g, or t
tattttaagtttacaaattaaacaacttcgctttaagaaagtccgttatcgaagccggctttgaatatttaagaaacattttcatggcgggcttttgttcctcaccagcaactgcttcatttgtttgggttggcttttttcatttaattaattccacttcctataaaaacacagcaaatcaaatgaccttcaattttaatttatattcaattaaaaataaataaataaaacaaaggaaagaaatttcgaaggttttgttgtttatttattttcttccaatgcttttaaatggtttcaaattttcaccgaaaattgtgccggaagatttttcctcctacagtaaccgaatgcccaaatatggtcatttggtttataaacttatcttttttggttggaccaactcaacttggaccaactcaacaagtaaagccaacttttaaaggcgtgccatttttctggccattttcagtgctttttcacttgcacggattattataatttaaaaatataaaagtatacatatgcgttcaacagaattaatgaattaattgtggcattgacaattttacgggggaggtaattattaaaataaaaatgaatatatatataataattccatggcttttcatgcattattttttgtttgtttttacatatatttttatttataatgtttgctagaatatactcacatatgcatatattacatataacatgttaatatacaaaaacttaaagcgtggctaccaccaagcaaatgaattaatagattaatgaactaattaaatgggtaatttgttttatttttttggtttgcgctgcatttccttgtgataatcgcccacctcacttaaaataaacggaaatataatacctaaatattttatataaatattttgtatgtttttatgtcactcaaataaattcatgtgaaattcatccttaggaatatttttgaattggcgccgctggaaaattttcaaaattttagcgagatttatgaacaaatgacttttaatattttttaaagtataataanatattt

SEQ ID NO: 12734 - DNA, 2438 bp, Heterodera glycines
  misc_feature (2266)..(2266): n is a, c, g, or t
tgtgccaagaggacaaattggatttatttgtgacaagaaatggcattcaaattcgaagcttttgagggggcgtggcggcggcggactttttgccgaagccgccgctttttcctccattttctattaattccatcctcaaaaatattattatatatttttgagtccatttgttggccattatcttattgtcaaattttaagcgatttaaaagcgaaaagacgaagaaacgattaacattaatgagactcattttaaattaaatattcaattattttttgttaattttaatattcttcttaattgtttttgccttcacggaatagcaattctataaaaactgtgaaaacatttacctgctgttgtcccattgttttcacttttccgtccgacaaaaagtccttttttccaaaggcattcttttggccaatattttttgtcacttatcgactgctttttttctcaaaaatattttctttactgtaaaaatttattgtaactacaattttttatttttcgcataaaaatactcaaaaataaaattaaaaattgcaatttttttgttaaaaatttattaccaaattcctcttaaatttcaatgattttcccggcgggcatttcgccactgccggacccttacccattcagattttttttaaatacgataaaaattaaataattaatggacttgtgaactcaaattaatatttccacgaaaaaggaaaaaattcgcacaaatttattttaattttaatgtcaaatgctcactttcactgccaaatttgtaatggctgatcgagaatagctgtgggagctgaaaatgctgtgcgagcaatttacgtaaggggccaaatgaaggaaagggtggcaccaaaacaacaatcatccctccattggggttgtggtctagtggctaacaaataagacaacggatccacgtaaagggccccgagcggcggttcaaatccggccttccacaccaatttttcgtctaaataatacatacaaaaaaaaaattgggctaaaaaaaattgccggttttctgctgaaatttttagaaaattttgccgttttttgaactcgtgtgccggttttttgcattgcatcccttggcctttcccgcagcattccccctcttttccctcattttgtccctcttaatgatccatcataacttatgcatctgtcaatgccaatatgttttagtttttacattaaatctttttaccttattttgttttggcattttgcctcttttttcgtccttggttcgtcgcatatttttcgggagtctttccgcgtctccaacccaaaaattggattttgtgggcgacagacgtcggcgcccccgggggaagggaaggaatgctcaaatgcttatgcatattaagcgaactgctgggaatcagaagagggacaattgaaagagtggtgagcgaagaagaagctgatggaccaactcacagtcaaaattcaaaaaagtgatttttagttggaaagccaacttcttttaaactaattgactttcaaatgaatgaatattttgagatttttttaaatttaattttgaatgaaaagcaactgaataataaataataccaggggatctaatttgtacttttttatccatttggtttgaacttctatgatcaattttcaatgcctatttttgcctattttgccttttttagaaactattttcaggatttttggaaatatccttaataaaatgcaataaaaatgagaaatacaccccaaagaaataactgaaaaattttcagaaaatgctctaagaattgaaaaattttcttgataaaaagtcgttaatttaaaaaccttaaaatattttaattatttcatttaaattaatttgttgtttaagttttttatgtgttttgctacctaaaaggtttaataaaatgttttatttgcctatttttaagcctttttaatgccattttgcgattttttgtgcctaaaaatggaatccaaataaataaattaccaaatggacaaaagtcttttctgaaaaagcaattaaaagcaaaaattacgaaaataattattaaattttattcaatttaatataaatgtcaatttgttggaataacacaaaaagcgaaaaaataaatggtaaatggtttaagtaaaagttgatcaatttttttataaaagtttattattaaaaggagaaaaaaccgattgagttgaaaaactgaaataacaaaaacaaaaaaacaaatgttttttttctaaatttattgaatanaaaattgaaaattgaaatttgatttttttattacctagatatttgcttatcattattttttatgacgaacagcaatgccatcctttagaaaagctgtgtaaatttgcagcaaaattaatttcagttttgtttcaaattcacttccaattttaaacaaaagaaatgaataaat

SEQ ID NO: 12735 - DNA, 1939 bp, Heterodera glycines
ttatgatttagaaagattttgcttgtgcttcctttatttccctctttgcataaattaattaatttattgtcttccgcctaccgtagtaagtgatgttgtacagtcatgttactctgctgatgcttcgcgtggtcgacgtaattaccaaaacgtcggtgcaacagtccgccaaaatgttggtgggcgaaatgccaggagacattcaaattggcgcacttttcccaatgcatcgccaaattgccggctccgaggggtgcggtgccatttgggaacagtacggtaggtgtattagcggtatttgtaaattcaaaattcgaatttccatcgcagtgctgttaatattgggcggctcttttaggaattcaacgagccgaaattgccatgctaacggtgcagcagctgaacaaagtgttgccgtttcggcttgggattagcatccgcgactcgtgctggacagaacgaatcgccatggagcaggtcaccgctgttttcgctgccaagagcagaatcatttttaaaatgccaaaattaaaatggaaaaacattttttaaaatataaaatgtttccctgcagaccatcgcctttctgcgcgagggggtcacccaatgttcgtgctgccaaatggccggctgtcagaagaagtcgagccccgtagtggccatcgtcgggccggcgaagtcgtccacaacaattgcggtgcagaatctgctccaggtgttccgcattccgcagattggctactcggcaacgaccacggatttgagtgacaaggagcagttcggatactatctgaggtgcaaaatgctcgaattttcatgacaaatcccaaaaagatgggttttggaaagcattagttgaaaggatgggattatatctattggggagacataaatattgaacaaattaattcataaaagtgaatttttggttacgaaaaaagcaaatacctgtgcaggtacgtacagaggtcaagcgaggaattcagcatgtcaaatgcagccttttttttcaaaatgacgaccgaactttaaaaaaagtcattattagtgatgtaattttttgaatataattatttgtttaataattacaaataattattcagagttgttccatctgatgcttggcaagcaatggcaattaatcagttgctaatgcacttcaattggacatacatcgccgttgtgtacagtgccggtgaaaaattattattgaaactgtctaattacctttaattacacttcaaaattttaaggaaattatggagagaagggttttgaagcgatggaacgtctgacgcgcaacggcggaagcgaagtttgtattgcgcacgcacagaaagtgaagagtttaggggagccgacggagtacagaaacgcacttttggcactgaatcggctaactccacgcccccaagtggtgggcacggcaaaattggagaaactgggagggaaaagcacaaaattaacaaaaattaagggataaagcacagtttaaatgccaaaaatgaaataattaatgtttacagattgtgtgtttttgcgaagggatggcactgaaaagaatgtttttggcacaaaaggcacttcgccaagaagcggcgaccgaagcagcggaagggacggaaaacggaaataacacaacgaaaagccgagtgaaaggacgccgaaaactgagacagcagcagcaacaacaacagtaccatcatcagaatgtgaatgcattccaatggatcggaagcgacggatgggccgaccgattggacgtggtacggtaggacacggttgggtaacagtcggacagttttgggttactgttggactggctttaagcagacattaagtatttgcccaattgaatgttcggataaattttttccctttaatgtggcaacgaatctagtcacttctcggatcaaacattcaatgccgccgacttaaa

SEQ ID NO: 12736 - DNA, 4740 bp, Heterodera glycines
  misc_feature (94)..(94): n is a, c, g, or t
  misc_feature (174)..(174): n is a, c, g, or t
  misc_feature (274)..(274): n is a, c, g, or t
  misc_feature (302)..(302): n is a, c, g, or t
  misc_feature (333)..(333): n is a, c, g, or t
ttttcatttcatttttagaggggaaataaattaagacttaaggtcacctcccttccacggggaaacgttttatttgatttattattacaaacancgaaaatctatgaataatgttatagttgaccccccatttgttaatagtgaccataatgcattcaattcagcataaattancaggttaatagaaatgcttcaaaaaaattttataattcaaaaaagcaaattatttgaaaataaatgccatactctcaatggttgattggaatttattttnttctgattgccctgatatcgagcttatntacctaaaatttatgtttttcctaaataatntgataaggaattatgtacccatacaaacaacaaataaagttgaaaaactgcccgaacatgttttgaaattaatcatttatcgtaaacagctttggaaggaccttcataaagaccatataaaaatcaaatttttagaagtttcaaaaaaaatcgatgtagaaataaataaattttataaaaatcgtgaaaataagtttttgcggaccttagactctaaaaaacattttcaatttataaattctttccttaaaattaaaaatactatgatacctgcatttactgataaaaatggtctgatcctcttctcagataaggaaaagtcgaatgcattagcgcaacaatttttttccgtttttacagatcaaaatttagaacaatttcaatgcctagaaaatactgaaaaaaacatcgaatattttaacataaccccatatgaaatttatttctctctttccaaactttcaaatgctaacaacacttgtattgatggaattcccaacatttttttgaaaaattgtaaagaaaatttagtccgaccacttttccatatttttagtttctcattgatgactgcccaaattccagaaatatggaaaaagtcaattatttgccctgtcccaaaaattcaaaatccggtaaacccagtcgactttcgtccgatttctctgctttgttctgtttccaaaattttggaagaaaatatagcaggaaaaataaaaaattttgttgaaaaaaataatttgttaccaaattgccaacatggttttcgtaaagcacattctgttaccactcaacttcttgaagtggtggatgattttagttttgctttagaaaataaaaaatcaattgatgtaatttattttgatttagctaaagcattcgacacggttccacataaccggctaatatctaagctaaaaagcattggtataaataattccttattaaaatggattcaaaattacttagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcgatactgtaaattaaacggccttaaaatcgcttcaaataaatgtttaactttacatttaggacacaaaaaccaaaaaataaattattttattgatgactttcaaattcctaaaaatcccggaaacgaaccagtcagagaccttggcatttattttactaatgatttgaaatgggcacaacatattgacattatctcgaaaaaagcattacgatctgctttcgctatactaaagtcaatcaaaactcgtgatacgaaaatacttgtaaatttgtttaatatttattgcagaccaattttagaattcggatctccaattttcaatccttatttaaaaaaggatatagaaaaattggagaatgttcaaaaaacttttttgagagtaatatttagacgtaacaattatactgttgatttacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaacccctgtaaaaaatgaattcattataagaacagcttattgctcaaccaatgttagatacaactcgttctttattcgaacctctcgtctctatagacttttacctaaagagacgagattactaaatccaaatgagtttgccaaacttcttgaaagatctgatcttaatttgttgatttctttgccaccccaactccaaaagtgaccaattgattgttttgatattattatttcattatttctttatttttcggcgtcacgcttttgcgtataaatgattgattgattgattgatagttaaatttgattaatttttttttaaattaatatttttaagttatttgaattaagcccgttcttttaattgttttactttcacaacatttgacgccacatatatcatcattttgacaaaaattgcctaaggacaaaacgccaaaaaaccccactaatttaaaaattttgccgagattttcccttgtaaaaatggaagagccgatctcgagttagaaaatatactttcaaaaaacaaaatagaattcgatagatggggtcaaaaaactagcctaggcaaaatttcaagaaaatctgacccgaggaaaatttttttgaccctagtgaaaatttcaataaatttctatcatttttaagctaaaaatggtcttgacgcgcaaaaaaagcgaaaatttaaagagtatgagcaattctggtgtagacgcaagacgaaaacggaaggaatggcgccgggatctgggtcgcagtgttggttcaacaccaaaaagtggcgaaattttgataaaaatttcatttcaattaaaaatcaaatttttacaggtccacgacaaaccacaaaagctccatcaacaaccggagagggaacatcgaccgagacaatgccatcgacttcgaatgccgagccccgtaagtgcaaaaatcacaatttttgagataattttcattttaaggccaacggccaagtccacggccactttcaacaacgccgatcaggcgtcatgtccgcacgcggccaacaactaccgaccaaacaaccggcaccgattttcgagcaacagtccagtcaacccaaacggttttagaaaccgccgatggtgccacccagacagaaacaggtaaaatcagtgatcagattttctaataaattttatcccccataatttcattttcagagcaagggccaattcaaaggctgtgcacggagctgaacaaggcgaaacgcagaattgggacgctggaacgacagctgcagaagaaaactgaagaggtgaacctgctcaaaaagcgaccagcagtggaaaacaagggcaaactcaagagggtcagttcattggacgatttgtcaagacgaagccgcacaaaacgtgctaaggaaatagcgcggaacctcagccatctcttccgacccggtcgattacttcctaattcttatttttataatatgtttgattagatttgatcagttgggaataaaagatttttgaatttggcgccttcgtttcaatactcattttttttataatgatacgcatttttattaaaaatgatgttatatgccgcaatttgttaacggattttgaaataaaatcgcttcaataaatttttttaaatcgcgcggtcgcggatcgcgtcccagctctgtcattaacgtttttaattttaataattagactttctttgtttaaaacaacctttatcaatatcattttaaaacctttatcaatatcatcacaataaaattaacgatttagcaaagagttgtgttcggaatttttcgaaataacagtaaaaaaatactaaaaccttttggagagtatttgtaaaaaaaaactatagatattttccatgaaaaattcctaatcacaactcatacaattttaaatttaattttaacatttcatctgaacagaatatgtgtcaccttaacagttcgtctcaacagactatgtcatctcctctcctcccttaaatcacgcttctacactacacatcgtcgtttgccttgtcaacttctattcaaaatggaaggtaatataatttatcaactcagaagcaatactatcgatagtaggatttttgaaaaaataataataaaaatttcgggataagcttgatttaggggttttcagggacaggaaaacagattctgacatatatttcggcccaatcgaactccgaaagcggatttgaacaaaatttcgaaaatttttaaattcaaatttaccctaaaattgcttcaaatgttcaaaagagaaacaaaatctacgtcatacaattagctatgaattttttgaaaaaataaatttcatttttttgtttgaatccggttctgggttcgatttgggccgaaatggatttcaggctttccgaccctggaaatcccataaacgagttaaattttttaataaaacaaagggttcacctttggtttttaacaggggccggcaatggtaaagttttgtggtttcctcggaaaataaatttaaaaatttaagaagaacgttttctaaatttgttacgaaaattaattataaaatccaaacattttgtttgggggggattgaaaagtttttccattattcgctggaaaattttttgaaagtttcatttcggagggggggggg

SEQ ID NO: 12737 - DNA, 3428 bp, Heterodera glycines
tgtcgcttcgcttcctcttttgacgcaacaacagcgtttgtattattattgcgagcggcgaaacagccatgcctgcacgaaatcaatgtaagttcatgttagcttttcaagtgagaatatttttaattgtttttttaagccgggcaaaacgactcgggcatggccaattcgaagtttgtatgcgccaacatcatactaaccatttctgaggtaaaccattcattatgattggtgagagggttgtcgccgctggcgactgaacgcgtagaaattggaggacagcccggaggaccgctcggaggaaagaaataaggaagtccagaagaggaccggaagaacattctcgaatgttccctcgtgactctcatctttgcatttccataatattatttcgtcctttgattgtgcgctattccgacaaataaactacttgtctaagaagttttttgttccgaaggtgttcctttttctctacggtctcgacattccaggaactcagagttccatgtttgcagttgtctaaactattgtcccgaagtccaccaggacagtccaactaagtctaaaggggctgtccattccacaagtcccattccaagagcggaaaccacgtcaagcgtagccagacagtgcactatttcctttctttttctcaccccttccctttcccacaaacaatgctgctgtacagctagcgcacggctgcttactgtctgcccttccacccgccgcagcctcacgtagacagataagtacactatttcttccttctctctagtggctatgcggaagaatccgggaagaatctgcctgctggctacgctttgaaaaatttcgacccaaaagggggacccaaacccgactagtaccggtgagagcgattctctaccactaattccttcagattaaaattgtctcacaaaaatactacaagttggctaatgttgattaaaaaaaattcaaactttggccccaaaacggaaaagtaccgaatttttaactaaaaacaacgtgaaaaatgaacttgcgctttttaagtgccgaggggcaaagggaaggatgggaaactcataggggggagaggggggggggcactccctaagagcgcaaatgaccaactcgaaatggcatttaaaaagatggaaatcacagagatatgaaggaaaacataaaaatcatctccatatttcgcgattttattttttgtttccatattttggtacccctatttattaattataatgcatccctatgagttcaaattggacgcgatactcggaaaatcggagttacccattgagaaaatagaaaatcacgcgtggaatccggaggaccggtcgttgaatttgtacgtgacgtgctgacgatgcaccgacatccggtggcccaaagcacagacggaatgcgggaaaaagtgagggagggacaaagggacaaaaacgccggggaagaaacagtcattttgatggataattagttaactaatagttaattaaatattaatgggaaatgaaacggaaaccaaaaaagggaaagtggggatcgaaccattaatagcggtcactttcaaattggtgcctttgtaccctctcggctctgccaatgctttcgtctcttaaggttggctacacgcgcggcttccacgtctggcagctgaattggccggtcaaccaacgcggcacccacgcggtcgtcggcgtggccaccaaagacgcgccgctgcacgccccgggctatgtgtcactgattggggcggacgcggagggcttcggctggaacattggtgggcaaattgcgcaatttgtgccacaaaaacgctgaaaatgccaattccgtcgccagtggagaacaaatgctaccacgacgcacagaacacaaagccatggtccttcccttatgagcagccattcgtcgcgccggagaagcttttctgcgtgttggacatggacgagggccaattggccttcgccaccgactccaaatatttgggcgtcgccttccgcggcctcaaaggcaaaaaactgtacccggccgtcagtgcggtgtggggacactgcgaaatcactctcagatatttgggcggattggaccgtaagtccacaaggattaaatttattggcaaaaaatacaatttaaatctttttagcagaaccacgacagttgatggatatctgtcggagatcgatacgactaagtgttggaaaagcaagaatcgaacgcatttctgagcttaacctaccaccaagccttagacattacctcttgtacaaataatttggcattttatacaacaaaaaaattcacccgtaaaatatctatcaatgggaaaagcaaatgcgaaaaaagccaatattgtgtataaacaaagatatcaacaacaacaatataaaattatggtgttttaatccgtcgcttgcgttgttcaaggcggtgcagtctgttccgcgctctctccgcacgtcggccttcctcggcgcgtttgtaggaaccgaaccaatccccgtagccgaagaagctggtgatgtattcggcgaactcgaagagcatcgaaatctgaaaagggaatagaaagaaagagagaggagagagagagccaatattacctggccaacaatgggaatgagtttgacgaaagaaagggccaaataaaagagccaaatgaaagtgattggaaacagcgagagaacggacaaagcggaaccgattgggaggagaacgacgaacagacagatcttctgacaatgagagtgagtgaacaatgattaaggggtggaataaatggcctattacgactaaaacggagtttatctgtgtgcgtttggcgaaatatgccggcactccaaaattgacactcaacgggagaaacacctaaaagaggagaaattggaggggaaatgagggaatgttcggatgaaactcaaataaagaatgaggaacatcgacggagtgatgaacaaagtggtaatagctcccatcatcacgaagaacttcaacggatagagggccttcaggatatcctcgtagccgggcttgcatctttttactaaaattgggcagtcggaattatttccaaatcgatgagtgactccgttcacccagaaaatgcatccagctgatgtcgtccttgccgcaaccccaacagaaccacgtgttgcattgcaaattgggacagcgtacatagttacagccaattttctgcgcgtagatttcctgcaatgggaagggattttacaaaaatggtattccctcgttcgattcgttttttttactccgcagcccgggcattgtctcgcgttcttttcttcaaagtcagcgccaaaagctttgataattaaatccgcttcttcctccaaattggtaattgtctcattctcaacactgacgacggaagtcaattcattcaaattcgatccatttcccatcgtaga

SEQ ID NO: 12738 - DNA, 1358 bp, Heterodera glycines
  misc_feature (1283)..(1283): n is a, c, g, or t
agattattatcatgtgaagagaatttctgtccctttatgttcggatggattaacatttaccttttcttccacaccgccttttcgttgtgagttggggaaggccattctgatttatttgagtgtaaactgaactgaagaggtatttttagctagattttccttatttgtgatattaacttgaattcttcaaattggagtttagcggtataccgacatcgcgttttattttaaaaaccaaaacctttttaaatatctttcaagtcggaaacgttaaattgaaatatgtgtttgtttttcattctaagagttattaaacattttataaaggttaatttcatcttcaaattttcagttcttcaaataaaatcatacataagattagtttgataatttgttcaaattctttagataaatttgaaaagtacgtatacaaagttacccgtgaacgatttggcaaaatgaaggcttacattgacaatgaattgaaggaagccatcgagttccgcaaggttagcaagtttattacaaagccataaacgctcacaacaaactgttaaaaacaaacattgtcgtgcgaaatttttgctgcagcattaagaaaccgagcaaaaataaatggtaaattttaagacttcaaaggagcaggccgactcgttgaaagcagtgcatgaaaactttcccacaattttccaagagaatttggcgctgcaacttgaagcgacctaccgaaaaaatgtggactacgcctggcaagagatgaagcgtcggttggattacctgcaggaagtgcaagcaatcaaagaccgattcagcaaggaaatgatggtcaaactgatcactgatggcgtaagtaccgacattcttactacaaatcccccccccccccccccctctttgcttaattttcattctttatttttttaaatcatagattggttttaagcttttaattttgaaaacaaactcatgtccccgattgaatcgaattcctttaggtacgaaaacaaattgaaatgaatgagggcggaattcgcgacaaatatttggaccaatgtatcgaacaacttcgcgttctgtcagcgaaataggatttaatttggatactttaattataatagaaagagaaagacagccatttctatgcacaatttgttgtaatagggaaaattcatttgtttggtttgactatgactataaagccgaccgattaaaattgcttcttttgtttagattgattgctctctgattgataattaatacatataaaaaatataatgaaatgngtacttttcggctatgcatattcgaaggaaaattttcagctttctgtactttttgattcaatatatagctcatta

SEQ ID NO: 12739 - DNA, 3383 bp, Heterodera glycines
tgcccctcaagatcgttccatacttctcgatggttggaatgccgtgctgaacgagtctttgctgccgttattcaatcagaaaatgaatatggccgagacgtccgacagcaaacggttcaaacaattgcgcgaccttttgtccggcaaaatttcggagaatggccgttgcgatgtcattcttgctcaagcaaaggcattcttcgattttgaaaaatgggcaatcctactgaagaatgggtttttctaatgcaacattttttgatttcggctcaaaatcatttttgccgggatttttgagggtgttgattactaattcggaactcggatttgctcattcgaacccctggcccgaattcaaacaaaaaaaaaagagaaataattgaagcattgttttgcacctaaataaaaaaattgttaaacaaattcgaagccacttttctgcacaaaaatgcatctttgaggaaaaattttcaacttttttgttcgaattccggtccggggttcggacttggacaaatccgagtttcggttcgtgatccgcgctcacgaaaaatacccaaatactcattttaagctcaaaaaaaaaattaaataagaaacccccattcttcgggattgccgaaaaatgtttcaacaattttaaaacccccatttcgtaggaccatttgaatgaatttctcttcggcgttttggacggcaacggcggcggcaaaccctgtgaagatgaggcggagcttatgcgtcaaattgagcaattagaggaggaaatcatccgtctgagggctactcttgagacttagcagcgtcgatcattggaaataaattgttttaggggttaccagggtcggagtatccgattctgacatcaattttcgatcaatttcgaaccacagaaccggattcgaacaagattcaaattcacaaatttttttattcaaaaaagggaggggggtaccctcgacagtattaccatggtctcagttcaaaaatattgccgcttttgtaatttttatttcatttttcttttccgattgcatcataattgtctcctttccctccgagtgccaccgatatcttcagttcttctggatgtcattgacaaattaataaaacatttaaagcgaacccaatttatttaatttgtgttgcattcatctcttaattatctacaagcaaaatttaagaaatttttttccccataactttttttagtctattactttttgaaattttgtatatggatagagaataattggggctattgaataataccaagaacgttcataatgtttatcaaaaacatgacacacataattgtgtcacactaaactcaaataacaaacactaatgtttatcaaaaacatgacacacataattgtgtcacactaaactcaaattaacgaacactaatgtttatcaaaaacatgacacacataattgtgtcacactaaactcaaataacgaacactaatgtttatcaaaaacatgacacacataattgtgtcacactaaactcaaataacgaacactaatgttttatcaaagacatgacacacataattgtgtcacactaaactcaaacaacaaacactaatgttttatcaaagacatgacacactaaagtcacagaactgacactaattcgctaaaatattaaacaaattctgatcataacgcttcccaacccacttacaaatgatcgaccatccaaagctgaaatagtgcattcctcgagagtaagaaaaaagtcaatggcttccaaaactacgcaatgaaatcacatccaattgtaatccaacacgttcatacaataagtcctttcttcatctattggatttcttttcagtctgagcatgctgttgaatgatggctgacctgcagtcatcacaaaaaaaaaaatattgccgaagcggcagaatagctaaattacaaaaattatacaacaacagaaaacaatgcatgtaaatagacaaataacaacatcaacttcttctttcatgcaaagaatacaaaactaaaaaaccaaacaaacgaagactaaaaataacaaccatacaatcatatccgaaaattagaaaaactaaaacaaaaagctacgctgttcttttccttaatcttttacataaacagaaacaaaaacttttcatatgctaataacaaaacaatagaaactatgaatataagaaacaaaaaaaaaaagaaatttttaactgtgcttttgcaaaaatcaaaaactgacaaaacaaatatgtaaaaacgaaaaccaaacatttctttttttcaaattcatttataacgcaaaacaattacaaaacgccacgccaattcaaagcatggcggatacagacactcaactttattaaataggatatttttaaactatttttttattattcaaatattaaaaaatcttggtaaataaaatctcgctggattacaaagattaaaattatttctatttaaaattattttctattattttatattaattttgcctaaattcttattcagataaattagtcgacattgacaaaagttagatattttttttgtcgaaaaacagtacaagtcggtgcagtatgagttggttataaaatttgtattaaaatttaaagaaatttcctgttcacgcacgtgaacggattcggaattggttgactgttaaataggtcaatgtggctttttttttgaaatgagtttttgaggcatttttaattttgataaattggcattatgtttttgacaatcattcaacttttctccgcgctaacaaaaatctttaattttcttttcttccaacaaaattttgtttttttttcatggaaaatgaattatgtattttatgtttgtattagagaccgagatttccaaaagtgccggaccggaccggtctgatattttcagaagcaaccggtttccgggcccggcctccgaaaaaccggtgaaacaggaattttccctaaaatcgccgaaccggtttccgggcccggtaaaaaccgggccaggtccggctcggtctctagtttttatgcacaaattttgttttgtttcatttttggggtgatttgtgcatttaattataaaaccttttattaagataaaaattgttttcatctcttatttatttccgcctcgccctccataaaaatggaattaacgccagaatcagacaaaaacagtgaaaaagaaaaactcaaaaagtccaagttggcagaactccaatttgaggagttcggattcacttgcaatggactgaccaaaatgtgtaagaaaaattcagttcttttcggctctaaatgcacttaaagtctattataggttttcatggtcgcagaatacgaatgtgacaccgattttgacccgtttcgaatccctgacctgaa

SEQ ID NO: 12740 - DNA, 3441 bp, Heterodera glycines
caatcagacaaaacaaacgaatataataaaaatgcttaaacaaagcgctttataaatccaaaatagccgtaaaataataaagccaaaagtactaattttaaattaaatgtaattattcttcatataaaaaacaaaaaacaattatttatagagtaattttaaaaggaatattaattcaaattcatcataaattttagtgtacacagaatattaatttttattttgtacgagaaatgattattaatttaaatgaaataaaaaatatgattacaattaatacacggtcgaaccatgaccaaaaaatctttaataattaataaggaaattaaatttaatgagacgcctgaatttaaatatgtaataaagcgcgattgaatacaatcaaatcattacgcgaccaattgacgatagaaattacacaagatttaaaaaataaaatatttaatatggccattaacaagaaacattataaaaactcaaaaagtattttattaataataaacatttaaaattgttttatttatttaaattttctgtttcttagcacaaagctatattccttataatttaatcatacataatactattggcctttgctagacttttaataatacatatttgggaaataattgaaaccaagtaaaataaaaaaagctaattattagtaaacatatcgacttatatatattcattatccattattaataaattttataaaattctcaatctgaaaaatattgagcaacgatttaattaattttacaatgtgttaatcaacttaagataatctataccactaatttatgtacaaattctattttattaaataaatgaactttcaaaaataataaaatcacataaatttttgtgtctaaaaattaacaaaattatatacatgtttaatagattaaattccggcaattcctaagacctttttcattaaatttttttaaacaaaaataaaattaaagcatattttcaaactagataaaataaaaataaatattttacgaataaacatatcattttgctatacaataggaattcgttaatcatttaatgcacgattgattatcgatttaatgatcttaaagatataataaataattaaacaataccaataatatcaaaggaaaatatcgcgcattatttaaaataaaaactggttagctttattaatacattaaattttgtaaagatgtaatattatcatagttaatttaaaaacaatcataaacattgtaatgttgacaaaaactgcataaggaaataatataaattaatattaaaaaaagaatttgaacattttcaaactatttagaacaactaaatcgctccaacagacatttatgtgcgttaatttatgacaattaaaacatatgtatttatatgaaataatttgaatttatagcgaaaattaattaaaggtaaattgcttaaattaaaatatttaaaataaatgattcgaaaaactaaaatattaaacaaatgtattaaattaatggaaaatagtagaaattaatttttgaaaaaataaaattttaatttgccaataatataagtgcatttcattaaaatatatcattcagttttttgcgtgaaaaagaatctaattaacattttttcagaagttaaaaaaggaaataaacataatacaattaaaacaaaataaaaaaacaaataatacaaaacttaaacgaaattttataaaatatttgaaaaatttgtttcagctttattattaaaagttgaaataaattaataatttatttataattttaaaagatcctatacatccattcctaaacggaaacgggagaacggccgagaattaaaaaaaaattaatagattaaatgatgataaagcattaaataaatatacaatataaaggaaataattattttatttgcaaaatgtcaaaaagttagtatattttatttttaatataataatttatttaataataattagtacaaattcgacttttttatgaaaataagaaatcatgaaatatatttttttttaaaataaatcaaatttaaaacaagaaggttaattaaattttcaaaaaataatataaattaaaaatcgtgatgagatatttgcgccgcgccatttgcgccgcacagcaaaagtggacacttgcgccgctcagcaaagtcgacacttgcgccacgtcatttgcgccgcagacagttgcgccgcggatatctgcgccgctccatttgcgccgcgaaatttgcgccgcccagcaaaaatggacttttgcgccgcgctgtcaaaaatattatattcacaaaaattccactattatcaataagttttactaaaactataaaccatcgacaaaaataactaattgaaaattcgaaaaaattactagtcacaaagattgacattcaatttttaaccattaaaatcttaacattgaataggttcatcaaaaaagatatattccatataatttaataatcattattggcatgaaatttgatttttagtataaatttatttcttaaaaaatataaatttatattttataattgaaaacgcaattaattcttaaataataagttaaaaattattttgtcatttactagttacaaatcaacataaaattaattaaataataattttttataaatttctatggaaaattttatttattttttctctaatatatgccagtctccattaatctgccagaaattatctacccctttcgcactaggttgaaaaataatctctcagtctctatttatctacgttgaaaaataatgtaccatggcatataattagaaaaatacggtataccttataaagaaaatattaattaagtaaatattttaaatcacacttaaatatcaaagtcaaatttattagacattttattatcaaataaatagttgttttccccttaatgactacttgatcttttttccttgatttaattacgataataaacaaaagtttatcttaagttaaatttaaaaaatgataaaaagcattaaaaactaattttgtaatgggcaatgatttaaaaggaactgctatcaacaagtgaattagaatattaatacaacatataaaataagttaaataatttagtcaagaaataaaattttcaaatatttaaataaatttgagacaagaaaggataaaaacaacaaacacatttatataagaaaatttatatatgtaaaataaataaaaagtttataggtaattaaagagaattaaataatgacctcgaaaaatcaaaagtaaaaaaatgtatataccataaatttttaaaatatgttttatgtaaaaatcaaaatcacagcttaacatggttcgtgcgtctttacacaaatacttttgcattattaacaactggggacggccaagaaggcgatcattgcccgtgcaaacgaagatccaattatataaatattata

SEQ ID NO: 12741 - DNA, 1128 bp, Heterodera glycines
ctattttagtgtaaataatacaacgagatagttggccacccccgataaaattgtggaaaatttgaataattctgtaaatcggaccacgggggtgaaaccaagtgcagtgacattcaaaaaggcaccgccactgtggcacaggttatataaggaagccgatatacccaattcatcaactacctcctcaattaaacgagcaaaaaataacaacaacaacaaatataaactgggcgacactgtacgcataagcaaggagaaaggagagtttacaaaaggctattaccccaactttattgacgagctattcaaaattgtccaggttaaaccaaccaatcctccctcatagaattcgcgatttacaaggtgaagagattaagggtgtcttttacaaacaggagttggtaaaaaccagtgagaaggacaaacccaccgggttgaagtgttaaaatcgcggacccgaaaaggattaaagaacaccttgtccgctggatagggcattccgatcagcataaaaagtggattcgggacgctgatcttgtaaaagagcgcaaagctaaataaaaaatggatgaattttatgtggtactacgatccaattcacctggaccagggaactcgacctcaaaattcactgtcaggcttccacacacgcttgagctggacgcaaactggatggtggcactttcatcaattatatacccatattcatttccatccgtcggaattgatgatgacgacttcattagcattaaacttgtaaatccaaattttacattcgcggatgacaaacgttttgtggatattgaactaaaaataccgagcatgcaattctctagtgttggccatttaaggcaaacattaaatgacataatcaaggatgcatataaacaacggtttgggctctcaccacagaaggccgccggaacaacggttaaagcgaaacgccaaattgacgttacggaccttttttttcacgatcaccctggtgattattgggaaaaaattgaagagttggaaaaaaagttggctgaattaaaagaggagattgcgacgaaggagagggaacatggtgccaaaggtacagagcagaaaagaaaaaggaacttgaaggtgagttgcaaattttaa

SEQ ID NO: 12742 - DNA, 2713 bp, Heterodera glycines
  misc_feature (1381)..(1381): n is a, c, g, or t
acactgaaattcataattagtattttttactaaatccttttaaaaaatctttaattataaaatcatcatacaaaatacctttcattgcgcgccataaataccggaactcaccgcctgaattcattatttttagaaagtccaaattaatttataaatactttaatcatttaaaataaatttaagtgaatacttattggaataattgctttgagttttgcaatttttatattcataaaactcatggttcgactttggaaactgaatagaaaaaattgagaaaaactaaaaatcctttcaagtaagttctaagaaaaaatatcaaaaataaatttattaaatataaatttgcaaataattcgaaataaataaaaataatagcaaaaattcaaataattcattgttttttgcattagaaatagttattaacacaaaaacggctcccggacttttcgacagaggacttttcgacagaggacttttcgacagaaggacttttcgacagcaaaggacatttcgacagtaaaggacttttcgacagaaacacaaaaaatagtggacttttcgacagtaaacataaaaacaaataatttttattaaaataaattatattgcttgttagttttactaaatttcttttaaattaacatactataatatgtattgctaaatcattattactagggctaatatttttaggttttaacctaattttttcctgactctcattgacctgaaacgcacgaaaaaatgtttttttttggttgttgttaagcaatttttcgatttcttagcatctattttctagatttttattttttagaactttaaattaataaatttttgcaaaaaacttatgaatcaaaaggtaataaaaacgaaaaagacaccccctaaaagtcgatcaaaaatttcaaaaaatacatcttaagaaatggaatattttaaaaaaatcatctccatttatttgtttacattcttgaaaagaatttttgaatttaaaaattatgtatctcaataattatttgacttaatttgttgcttttggataaaattttaagattttacacccctaaatttgaaacttaattacattttactgtcgaaaagtccactgtcgaaaagtcccctccttaaatttaaaatatttctgtcgaaaagtcctttgctgtcgaaaagtccttctgtcgaaaagtccggcgcccaattaatcactctccctaactgttcatctcttcctctctatttctcttctctttatgtagcctctctctcctcgagctgtccctctcacttgttcaaatactttctgtatatttccattttactattttatgtatgctttcagaaattaatgcataaaaatgttcatggcatcggtttntttccgcccgttcgcggtccaataatgttacctgcattattagacccccagggcacccaacgaggagggtggcagtggaaaaaccggaaaaaccatgtgccccacttacctgggtcgcccgatgaacttccgacaggcaagtcgaagagcctctttataggagcgttctttgcagtgagcctgcgaaaaagaaagaacccccccccccacctcccacccacgaaggacccttccaatatccgccacaccgacctgacattttcagtcccgatgtggcggagcacctgcccgtgccgctcagggcgccttctgccccatcagctcctccaacagcgccacatccccatccgacacgtccaccgacggccccatctcctgcagcatctccgcctgcgcggccgccaactcctcttcactcatcaaaccctccagccctcccgtctccaactcctcctcccccacggcggccgcagcctcctccaacgcctcctcaatgcccaccagtggctcccactgccgcgtccctcctggggcctccgccagctggccctgcgggcccgccggccgtcgatgccgaggagctcggcccttcctcgttccggatgaccaccttcaccttaatggtggtcccccccctttaccaccccacccccatcccgcacctggcaaatcaggcgctgggccttcttctttatgctctccacgctcctgggggaccaccccttcttcttgccttcggcaacgaacacgaccgccagcttggccagccgggccttatcctggccgaactccccgccaatcgtcttctagtgcaaattaagtaaggaaccgatgcttcttcacgcacaaactttagaaacccctcctcctcgcccgtccaacgcgtcccgcacaggccgccgcccgtacttggcacaaatcgggctgtggtcgggctttgctcaccttttttgggcattttatagaattgctataagtcatgattaagtaaggaaccgatgttcatgcaacgagctatttccaagcctatacttatgcacaaacccctcaccagtccgcagaagcatcaccccggattgttggggtgataagtcattcaaacgtgcgtgtttctcaagttcacgtttttccatacatacgccattaagttaggaaccgatgttcatgcaacgagctatatgggggttagcgaggctgctgagcacgaatctggcatcctttttgccatctgttcgaccattgtaagacttttagacttttggtctaaaagtcgaacatgtgtctaaatggatgccagattcgtgtcctgcacccccacacacccccaaatac

SEQ ID NO: 12743 - DNA, 214 bp, Heterodera glycines
aatttgggtaatagtagggtttgtcccccccccccattttcaaaaaaaaataatttttttttttgaaattcatcaaaaggtctttcctggggttttcggggtcgctgatcacgaatatgacattcatttcgaccaatttcgaatcccggacccaaattcgaacaaatagtcaaaatttcatttttcaacaaaattcacatttatcttccaaaat

SEQ ID NO: 12744 - DNA, 2368 bp, Heterodera glycines
attttgccaacgttgcccggttatgtgcgcaaaagtgttatggtcaagcataacgggaagaacagcggtaagtgcttgtgagagagagagagaagaaaagaaagggagagagagaatgagaagagaggaaaagagagagagagagagagaaagatcagagtgagagagagaaagagagagagagtcaatcccgggttttcaactcgagaatttctcgacctttttaaaatttgcctattctcgactgagataagcaagcgaaattgagttgcacgattggttaaatgagctttgggccatgggtccaaatcagcctgcctgcaagttttaaaaaaatgtttctcgggcttttttgggccgctgatcacgtatttgacaatcaatagatttttttcatttaatttttcaaatatttttgtatatgttttttgattttattttagttgaattgaatcatatttttattctataataaatatatgttttgattggtttaatttcatttttttaggcttttgttctgtgtttggcaaaatgtcaattccaaatggatcatttttctattacgaggttactattctgcacaaacattatgagtaagttaatatttaataattaatttacattagttattcttaataaaatatgaaagggcctcaaagcgcattgccgcgccttaaaactggcaagaagccaattgcacaccgaaatgttcctctgatacaaaaagcttgactcttatttaaatcagagttcccaagtgtcctttttttaaagattgtcctttattttaggcttccccaaattttaaatttttttgtgcttaattatttatttcgctgataaaaatgctacaaaaactcccaatttcaaaaaattttcccggcggcgcctttcggcaccgccggcccccaaaaacttattttttgtttttttaagaaaatggcttaaagccgtaaaaattggtcatttttggtgaaaaattgttaacaaatagtgtaactgcccaaacacaattttacaattttctgaaattttttttcctaaaaaatcacaaaatttggacaatttttgggcaaaatctgttaactaattgcttcaaatttttctaaaaaaatttcccggcggcgcctatcggcactgccttcccccccccctatctccaaaagtttttttaagaaaagcgcgcctcaaaaaaagcgttttttaaaaacaaaaaaaggcgtctactggctaaaaatcgcaaaatttgtcattttttagacaaaatctgttagcaaatcgcatttaaatattacaaaaatttctcggcagcgcctatcggcaccgccggcctcatatactctactttcttttttggaaagaacgcgcagcaaaaaaaaacatttttattgattttttaaattttgagtaaaattttccaaaattattttttgtcggcaaaatgctgattttgaaaattttcagttgacaggcaatgtttttacgctaataaaatgttgttttaaatcgattttcatgtattttattgcgtttctttcgcgctaatattagttttagaaaaaaatctttttttgagggtccaaatcttagttttagtatcgtttgtcctttttttgaaaaaaaaacttgggaactctggataatcttacccaaagttcaaaatccaatttctcttgtgtcttccctttgaaggattctttcaaattcccgaattttattcagaaaaatatgctgtacgaattgtttgggattgtgcacagtttccgttcacatttgaacaaactctttttggagtgtgttttagttggcgaagtgccaaaaaattggagtgacaattccctttttgcattgtttggcgctgcattgaacggacagattgaaacccttaaaattctggtaattgcattcagttttagcttaaaaaataacaaaataatttattttattaagtcggaaagcaacgacgtaaatctgagaatgggccaactgaaaaccgctggaggcacaatcggtgattaaatacaatagcaagatctggacttgctggccggatccattcctaaatttttctctgaatttttttccaaaaaatataggtccagatcagtctgaaaacagaatttagacatgaaaaatctgtgttatttttcattgtccagctttgtctaattctgaagtcactttattggatataaattgtgtgtttagacggcgtctcattgctttggattgcatctgccgccggtcattttgaaattgtcaaatttttggtaaaataaataatcaatttaaaatattaaaacttaattttttagcaccaaaagggcgacgatgttaatggaaatggatcagtgacatttgggga

SEQ ID NO: 12745 - DNA, 3632 bp, Heterodera glycines
  misc_feature (3542)..(3542): n is a, c, g, or t
tttcggacaaatcatttgaagccagcccacttggcggtcgtaccagaaaagggctacgacagctgtggcgataatcaaagcgacttggcgctcaattttatgcagtggtatgccgacaaatacggagttcacattcaaaatgccttttccgctgaaggagagaaaaggtaatttcttgaacaaataaaggattaaattttgctaaaagggttggaaatttccgccttgacggatggatcgagactcaaaagaaagggcttgagatccatgtgcttttttcgacagttctaataaataatttagctcaacgcagcattagaagaggggtaccgagtaacagagcttttgcgtgtacttgagtacagtaaaagcgacaatgaattattccgcccgtacatgagcgaatttgttgtccaaaagctgcacgcttcgggatttgatcagaacatccgtgggaatcttgaagccgaggagcaatttattgcagaatgttgtgaacaattcggaatgaaaatttatcgcaacaaaatgatgccaaataagggaaagagagcccttgccaaattggcagtcaataatttgtgtatgttttttttaaatttttttcatctccccttaatttagggggtcgtttttccctacgcaactatagactctcccaaacgctcattaccgacgacccgtcggagttaggcaactacttggacaacaagaaaatcgatgtcacagggcttgacatgttgaccccggaccgaattttgatcagctaccaacagaaaaaagattgggttaggaacacccttgctcgaatgttgtcgtctcactttttaccacttctgcagctcggcttcatttgttaaaagcaatgcaaaaggtcgttcgaacacccggctgtgtccttttatatacaggtaagaataaaatttctatccaaaatatttgcaatttcagataccgattctttaatatatgctcacccaactggcaaaaaccctcttagtacagggccccatttgggtcagttcactgatgaattccccgaggttagtttaaaaatattaatttttctcttaaaaatatttttagcatgacatattggaatttgtgagcggcggctcaaagtaatatggattgaagctcaggcggaaagggactgaaaaaattgagcacatgctgaagctcagagggattacactcaattatgatgtcaccgaaaaccaagggcttcgatttgatacgttcaaagaaaaagttttacaatttgcccttaccggaaatgttgagccaatcaaagcagtttacccaaatttcctccgtcctacagtaaacgctggcagcgttatctccgccccccttcaaaagatatacaaaccatatgttagtaaaggaattgtttgctctcgtgactttcgtgtgatcgattttggatatgttgcacagtaaaattgtattttaattaccgaacaaataaaaaatgtaaaataaagtgtaataactgatatttttgtggtatgagtaatgcaaatatcaaaagagaagatacactttttaaaaaattaaggttaagaagtcaattttggctgggaaaatgaaaaattaatgaataggagatacaattttgagaatattagtagataagttttatacatttgaactacctacctaccataaagaataaccgtcgctttggctacattcttggcgtccgcttgatattagtgatgtctcagtgcttgcattttcgtctgtgttaatgttgttattgttgtcacttccggtttcagtaaaaatacgtcctagccaacccggttcaatctgtccagcattaattttgcatagctcaagcgggtagaaccgatcctcctgaccctcgggaaatctctcgattacacagtgcaggaatgggtgtcgaagtttaatgcggtggcgaacgtaaaaatgcgctgtcacattcacattgaagggtcttcccaatcgcccgtaagccatagttgttgatgctccttgcggtgttatgccaccaaacgcaaagctctttgtgaaaccgtttcgatccttgtatgttgtttgtacgtgacaccccttcaatgctttaacgacatgttcaaaatctgaaggatgattaagccgatcgcggagctcagacacacgacaattcaaaatttgggcgattttctcagtaagaagcataattaatcaaattcaaaagctaaaatattgtaaaaattaatgaagaaaagatgtaaatttagggagaaaaagagcagaattaacgaagtgaagaataaaactgaaaaatataagtgtgcatcaactatttataacaatcttggttttgtttttctgggttaaacaaacatcaatctgtataaaaacggtgaacaagatcactttattcaatcctttattctaatatatttaatttattaaaataaataatcctagctaataatgccgactcctcctcatgacaacaaaatttacaaaaaatctgaatatttaaaaggtatttttgtctcattatttattaataatattcaaaaaattagtcgatgatgctgatgaagtggatacggacccctctcctgaagaagttgagaaatggacgcccgagcaagtgattgaatgggaccagcgtagttatggaaaaatgcctgccgaggaagagatttggcaagaattcctcgacaaaggagaagcgaatgtcagtgatatttatccattttaatgtttaaattaaaactttaggttctgcgtgagttctttggcggagagggggctcttaaagttgagaaaagtcttcgcgaatatgccaagaagaaagaacagcgagatgaaattctgatgcgaaagcggaaagaatatgaagaaaaaatggaaaacaacaaaggcgaaaattaaacactcctttgtattattattgttattgattcaaatttggattaataaatcttttatcaatgttcaaaaaacgacttcttgaattgggttaggttaaacaaatattaggagctataaaatcaaaaaaattcgtgatattatcgtccattcattcattcattcattattaacatatcccaccagcccattcattatctcaatgctccaaaacgaagattcctgcatgaatgagccaaaacaagaagtcaacatttcatcaccaaaagttcaatcctggaaactttttcgtccaaaatacatgttgacttaccgcttgtgcgactgtaagtttatcaaattagcaaaaatatttgactttgtggtttaagtatgtctttcggctctttggtccaacaaaaacaaattcacgaataacgaagaacgatcagtgatcagttttgaactctgtgagaagtgcaccattgacaattgccgagctactgatgttttggccccgtacagaccaaagaaataactcttcataagaatgcaatagttagggacaaatcaatatttttcattcagtacatcattaaatttgttatttaatttctcaaataaaatgtcaatattcggaattccctctcaattattttccccgnattaatcggcacctttcagtcttccattgctctcgagttccttaatgtttacagaaatattgccgagaaaattttcctctccgcgattag

SEQ ID NO: 12746 - DNA, 969 bp, Heterodera glycines
  misc_feature (940)..(940): n is a, c, g, or t
atatttcgcgatttatgtccatatttccatatttgtcctccatttgtgggatttttatccatatttatgtccatatttttgcatttttccaaaaaaacctctattagaacggccctagagctaaattgaccttttggacaacaaaaaccggaaaaattttcaaaaaaatcatttaattagcaaaattttcacgaaaatattgatgaaatataaattttcttaaaaattggttaatttatgtcaaaataaacaaaaaagcgaaaatttcgcttttcaggttgattttttgctaaattagaaaataagcccgggggatctattacaataaatacgataaacaacagcatatccgtgaatttttgtctacattttttgattaaatttgttttttggtggaggggaggggtcgaacaaccgaaaacattccgttttatttataaaagacaattttatttttagtttaatttactgacaatttcttttaaatttattcaatcatcaattcaattatgatttttgccatgttaattgtgctttttgctctcgtctttctcattattagaaactttaaaaagggccaacggtgagaaatttataaaattagaaaaacaatcaaattaattaaaatgaaattgcattaaaaaattgaataaatcactttcaactaaataaatctttctgagcactaaaatttctaaaaaattattcaaaattttgggcaaattggcccaaattttgccccattttcattttcagtagcctcttcgaaccgatcacattgtccgtctctcaacatgttcgttgcattgaacttcaaacaatgtctgcagaatttggcaaattttttacgttggcaccgaaaatggtgagggcggcacgcaatttgtcacatcggacccggcagtggccaacgaaatattcgtggcaaaatttcaaattntagcgacagaaaggtaaaaaacgaaaagg

SEQ ID NO: 12747 - DNA, 3237 bp, Heterodera glycines
  misc_feature (46)..(46): n is a, c, g, or t
  misc_feature (53)..(54): n is a, c, g, or t
  misc_feature (71)..(71): n is a, c, g, or t
gcgacagaaaggtaaaaaaacgaaaaggatttatttatggttttgnatcattnntaaaaaattgtcgaatntaaggacttttcttccaaaactggccacgtgttcatcgcttccggcgaccattggaagacattgaggcacaacgtgtccgtcttctcaaacttaaatgtgaaggcggtgagttttttgtccgttacacagttatcgtaattgctctaatggggctaccgtagacattctttcccctcaaatgtggcagttatttattggagagcggcacataataaaggggggggcaattagtgcaaaaattaaattggaagatggctttttcttctcagttcactccgttgctaaatgctgccgtggactcaatgctgcgcacaattgcagcgaatgagggcaaagcaattgattttcacaagtgagtctcatttttttaaaaattacatatttaatgttatgcgactcttctcaaactcgagattttctcgcattttcctgaaataaatgtaaggaaaaaagctatgagtaggtataatgcggaaagtagaaaatgctcgcttatttgttagctcagtggttaatcgttgccctcgactgtgggtggaggcgtgggttcgattccattcgagaccaaacctttttgtccatttcttccatcatttccttgaagttcactaattaatccggccataattagtcgatttacttttttttctccctatcattagcacttcgttgcatttggtcgcggccattttggcacgcatcgcattttgctgtgtccatcagcgtgatcatccggcacagttttgcgacacgtacaccgcttacgccgagcagttgctgctgctgaaggaaaatgcgcgcctttttcgcgcattgcctccggcgaaaattgggcaaaatgcgcagcaacaaaacggcgccaacttcgacatgttcacggagctgtacaagcacattttgaggatggaattgcagaagaatcacgaacagaagcagcaacagaaaaacagaatgatggaacacgtaattaattaataataataattaattgattgattaatagtaaaataagtccaataactaattatttttaaaaattttaattttcttgagcaaaacaacagccccggtgattatgatgcgtatgacgaggattgccatctgtttgcttgcactttggggaacttctttttggaaaatgccatgaaaagtgtggggtcagtgccgaaattattaaattctgatttcaatttctctcccatcattagcatcgacacaattggccattgtcttgccctcgtcgtccatttcatggcccatcgtccgtttgttcagcaccgactccgtgaagagctgacggcgaatgtggtcgatgatgaagtgaagctgctgcccaagctggtgaaggccgtcatcaaggagacgcttcgtttgtgcccaattgtttcattgtgcgcaaaaatttaattttttaatttttgctcttatttttggtgatcatagatgggattttatgtagtagcgaatcgaattcgttgtatgtttttgaaggttttcgaaggtccattctaatggatgcattttttattttaacgcatttttggtatgaaattttcaaaaattgcgaaataatggttgatggcgttaagtccgacacattctggttcgggggggggggtggggtagtgctgttcgagaccgaaaatttcccgagaccgagacttgaccccgagaccgattccgagacttgaccccgagactcgagaccgagacccaaaaaacccgagacttttctcgagtcgagactcgagaccgagactttttccaacaatttttctagttctcacttaaaaatcgattaaaaatcaatcttttgaggtttttctcacaattttgctttttaccttatttaagctaccatccatttttccttttgatatgattgacgttttacaccatttttttgttggtgctcttttttcaaaaaactttttgggaacagaggtctggcggtgccgataggcgccgccgggaaaatttttaaaatttgagtgcaattttttaacaggttatgtccaaaaatatccaaaatttttgcggttttgagccaattttttaagaaaaataggggttttgggtgccgggggtgccgataggcgccgccggggaaaattttgagctttttagtgtaatttgtgaaaaaaagtccaaaaatgacatattttacgattttaattgttaaaattgtgattgaattcccatcgaaaaacattaattttgaaaaatgagaagaaaaaataaataattggaggggaactgatccaacgcaaaaaaaggaacaaaaccaagaacacaacccactggaccacgcatatattaacaaaattggacaaaaaaggatctaaaatttataaaaatataagtttaccaagagccaatcattaggggtgtaaaaaagtctcggtctcgaagaccaagaccgagactgaaaacccgagactcgagaccgagaccaaaaaaaccgagacttttctcgagtcgagactcgggaccgagagtctcgagcagcactagtaaatgtcccaaaaaaaaattccaaaataatgtaaaattacgtaaaaatattttgatgaaaattagagtgcgccgggaccgggaattttgggcaaaaccgggaccgggacttgccgggacctgagaagccgggaccgggacctcgatttttgttcgggaccgggaccaggaaccgggaccaaccgggaatttttaaaaattcagaaattcaaattttaatttatttcaagtgaaaatattaaataattaaattttattttggtttttattttataaaatccaaaagttaaagctatttaaattaataaaaattttcaaacaaattttcttcaattatttcaaccaacaatcattttgggctttaaatgatcgaatattaatataaattcagatttacatacttttcacatcactttttttcggcgcgctttttccagaaaacttttggggaaatatgtgtgtccgcggtgccgataggcgccgccggggaaaatttttaaaatttgagtgtgatttgttaacaaatttcaacaaaaaaaggctgctttttgagattactaggctcaatttgacggatcttctttaaaaaatgataaaatatgtatcaattaaaaactgtgaggaatcatattttgtcgataggaaagccat

SEQ ID NO: 12748 - DNA, 923 bp, Heterodera glycines
gttttctgtagtataaaaagttataagaacctagttctgaattcgtcagtttgttcccatataaatcagggtgaccaagtgtcctggtttttcagatttgtcctgaattttgaggtctctggtaaaagtataaaaaggcgatattttgtaacaaattcattaaaaatcccaaaatttttcccctacggcgcttatcggcaccaccggctcaaaatattacatatttaatttttttaatttaaaaaaaagtggatgtattaatttatacatggaaaatgtcaatgagataaaaagtcaaaggctgcgttgtcaaactcttaaaatctccaagttgttgttaaagcagatggaaatccactggtggaaattactggaccaatgtatttgacaaatctaaactttttgaatgaaattttaaagaacgatgtcagtctcttagacctccgattcagcagtatatgccaaaattggttcgtctcggttgaaatgattcatttgccatatcagagcttgcttgtcacttcctaagaacggaaaggaaatctttaaaagtgactttaatccatttttactattaaattttcagaaggccagataattttgttcaaaatgctttcccgacggcacccatcggtaccattggaccctaaaaatccttattttcttaaaaatggcgtataatcgaactattggtcattttttgggaaaacctcaaataattagtggagagggggcgggggaaggtaacccaatccaactaaattacttgttaaaatccaatttaaaacgaaaataactgaaactttttcgctgattcggcataaatttacgtgggcacagatagggaggggcatcaccatcaaaaataaactaacaagggaacattccgaactgtatgtgttcaaatcacttttaaacacttt

SEQ ID NO: 12749 - DNA, 2695 bp, Heterodera glycines
attttattagcgcagaaatcactcaattatgaaaagtgaaaaatacttaccggcagtgcacaaatggacggttgaatggggtgcccaagttattcctgtggttacgtttcgttgttagcagtgttattaaaacaaaatgtagtttaattaccatttattgcagctcggtgattaccaaatttggccataggtctgcacggtacccgaacgtcgagaatgacgacctgaacattttcatacttctgaagctgaagacacttattctccgttgacctctttagactcttgggcaaccgttgccaattttgtcgggtcccgcttattccaggagagatggttcagcattctcctttcggcatcttcgtacaaaatggttgagtgttgaagtgcccgcaaatcttcaaagaccaaagttaaagttgccgaaattacgactaaaccgaaaagtcggatgcttccatcggcgcctgaaagggaaagaaaagttaaaaaattaagcaaagtaaggaattcgaccggcggtggcgaattggtcccgtccgttgtccagtcgggtgaatgcaatgtcatgcacgggtttctcatgagcaatcagctgagtcttttgcagccctttgatggacggcgcctgcccaatcggctgattcgtcttgggaggaaaagcatttgcataattactcccagtgctaatttgccacctcaatgttccaaactgtgcaggtcgtgtcgatgctgcacgttgccacaagggaagggtccacttcattccaatccaaatttgtgagcggtgacgaataggcgctcgattttgtcttgaattatattttttttcaaaaggaatgccaaccccagaagtctgcccaaaaaataatttatttttacggaatgggacactaacggaccgaccgaaaacggaccaaaaagtcttgtaccccacaaggccactagcggaccaggcttatatttatcttttttaaaaccaatttttaaattttgtaggataatatataatatttatcaaaataatataaagattattatatttggtcgactattaaagaattatggaggaaattttggttcaataatgggcaggtccttacccatttttaagttttataactaaattatataccgcactcagttcgcattcttgggagatggaggcggaggacggatggtatcggaaaatccgcagacaattcgaagtggtagcaaataattctggttgggaaacgtcctaagatcgaacgaatgcttttagtctataaatgaatggccgccccctcaccgtatttggaatgaattgcgtggcagtgcatgggtacccgtgcaaaattccgaatcgtttgacaagttcgccgacattttcgtccagttcaatgatgtacatcttcaatttcaaaggttgtccctcgtcccctccccatcagggagttgccttgttgctgctgatgccctcttcgtccagcagcagagtaccgaccaccaatcggaagcgtttgtccgggtacaatttgttggaccacgcagcggcgtacaacgtgctcttcgcaagtgtaccgatagatttcctttctcatccgcagttgctgctgtcgtccgtgcatttgcagcgccgcggccgactccgccgcgggggctgccgcgtttgtgctaccgacggctgggttggagacggtggcagcgaacagttgcgggtccccaaacagcgacagttgcggctgaaatggtggaagaccgttcatttctgccgaaagtgaacagtccaaaggcaaaagcggagacacctaatgaatttgttgtataatttatttacaatcaactaaaacacgtcaaatttatttattaaaatacacattttctttggatgaaacccgtaaaagtaaatgtaaaattaatgtaaataaatggaaatgagcaaaattcaacaaaaaataaaaataaaatcggctgcctaatcggaggatcaaaataccgtccaggtgattcctatcttttcctctctttcttctccttctccggctctatcagcccattctccattttccactcgtacactatcctttcctgcgtcgcttccggcactggcgcatatcgactgtattccattgtgaattcacctttcccttgggtttccgttctcagttcggtgctgtatccgaacatatcattcagcggggccttaaagaacgtaaataacaaagccaatgccaaatatttgttatttagccttgaagaggtgctcacttcacattcaaatgtgacgaactcttcgctttgcgttgtccctgtcataatgccattccgtttggtgagagtgccggccaccttttccttaaagggaaaacaacgttaagaaaactcgcaaaagtgcacagacatgaaacatctttggcacagtgcaggacaccttcatgatcggttccaacagaatccatgccgcccggtcataggcctcgcgcatcatatttttcttaatattggacgaaaattataagacaaatcccatttctgtaccattgtagcttgcatagcgatgtccgtagaatcaaccacgtgcgtttgtccgtcttaatcaaatagaaagcctacaaatatagaagaaaaatataccgcaaatgatgacatttattccgcaaaccggggcttttatcagcggaccttcgcccgacatgtccaataagcccttaaa

SEQ ID NO: 12750 - DNA, 1447 bp, Heterodera glycines
tcttttcatatagtcgccaaataatttttatctttttttaaatttactattgttttggctgatttgcacataatgcaccatttttaggttttaataatgcgtcaaaaaacatatgtattggccaaagccattctagagagaaaggacattctctttgggtcaattgaaaatgtcgtcaagccgcaggcgatgaaggagaaggaggacgcctgggaaacagttcgtactgaaatgattgagcagggctttgtcaatttcgagcgaaagtcgtggcgcgatgtacgaaatcacgactggcaatacttaagacgttctgcggttgcaaaatacgaacacaatcagaaggcgggcgttgaaatgatccaatacaacgaggcatgtgccaagtttagaggacattcacaaagattagttggtgcaggtagacaaactcgtcttcgaaataatgggcaacgaagtgtcctccttcgacaacacaaacaacgattctgttttcttacacaattttccaaatgatgaaggacaacaaaatgaagtggccgacccgccgttctttccagccactaatgcattgcgaactccgaaattagaagaactgcagcaaatgaactccaacttaagccattccatttctgttggttcgtctcgcgacccaccggcacagacaaagggattttcggttgaaacaatcaaatttttggactttgcagaacaaaaaggtgggtacaacaaccatttaaaagttagtcttttttgacatgttttagcagtttttttcaaaaaaaaacgtcaaagattttctttaaatatatgaaaaaattttctaagatttttttctcttgaaaattttctaactttaaaagaatttcttttaaatttctgcggcgagattttgtcgcgtcccccacctgcgccgcctggtgtgcatctttttcgtaagagcgctaagaatccattggcgtgcggaatttttacagacattttttattaataaaaaaaattgtttttttattccaatgaacaattattgcacatattcgaaaaaaattactaaaacggaaaaaaatcaaatttgttccaaatacaaatttacgttttttgaattgcatttcgttaaaaaaattttactagcaataagttagatttcagaaatttttaaaattattttgtcacctttcagattctcctccttgtggcgaaattcagtccgaccttttgcacagtctcatttcgtcatcctctctaatcaacgcctccgatcgcaaagagaccatcccaactcatcccccaatttctcgacctttgatcaactcatcttcagacagaaagcgtcctctttcgtgctcatcggcgtctgtgaaatcgacggaggacgaagtgaccgaggcaaaactgcgccttgttatgatgaaaatcagaaaagaggagataatgatgcagcaggaga

SEQ ID NO: 12751 - DNA, 2090 bp, Heterodera glycines
ctgcttgggttgtgtgcttgcgcgctgttttgtccaagtcggggctaacctccgcagaggccaagtccgtgtcgcttcccttctgaaatgaatggcatcgcaattcttgctgatttatgatttacaaggcccacaaaagaagtcagaggggcaggggtcattatctccctccccaccccacccctctttctctcccatcccataaccctccactatctctccttttcctttcttccccttccacccctctctatctctcacatcccataaccctccactacctccccttttcctttccctctctcccccctcccctctcctcctctacgtccacaatatctcctctcatcctcccgttttcttccgccccccccccctcccaccatttgcccacctttctttgctgctgcctccatcccttcggtggcgcgtttccgctgtgccatgtgtggttgctgttgtagttttggtcgttcattccgctgttgtgatgcctatgatgtttggccgacaccggcgccgatcccgcgcctccaggcactgagccgttgcgctggccatttctgccgagattttgcagttcagagccacgagactcgataattcgattgaaggacaaatcactgcgcaacatataagtggtggatggggtggagccgagacatttggaagccttaagaaatgccaaacaaagcaaaaagatgccgaaacggacgacggactgaccacgggaatgtcaggctcaacgcgccaaattttgaatttgcgcacgaaccaaatgaacggtacagaagccatcgaagtaacgacgaggccaaaagcgatgaacagagcccaagtggggtaggggacattgtgctgatgggtctgacaaatgagaggaaaaagggaaataaaaggggaaatggaggggggcggggacaaacggtggtcgagtcgtaggcggagtatttgggcacatcggagaacgatttgaagaccgaagcgacgaaaatgacggccataataacgggggagatgaagcgccaagtgattgtctgcagggaaaagcgtttgtgcgagaattacactaactaattggaagcaaaagccatgccaattgagcaaggaccacaaaaacacccgcgggcattctcaagaaaagtgtcccccgaggcaaagccaaattgagagagtccccaaatggttaaccaatcatgaatttgttgcggtgcctttgctggtcatttcgcttcatttctcacccaatacggccccacactttcgtcggtcatgtactgaatgtcgcgcacaaatcgatcacagccgtacacataaatgacggcgattatttcgaagaaggcgacacacatcaaagcgtaagaaccggcgaattggtcgaacagagacacccaatactgaacagggaaaaggaagttgggggacgaaatgcgcaaattggacgacctgtccggcctgagtggtgaacaccaatccgacaatgcatgccgaagtgcaaaggatggcggccaacatgggcttactgagcgggatcattttggcatcgttcagcgaagtgatgacgccctcaagcatgccgaacatggagccaaggccgagcatcagcaacatcatgaagaacagaacggcccagaggggcgggaacggaaattggaggatcgcttctgtgaacaccacgaaggccaagcccgtcccttcagccgccttcaaaggaaaagcatcgaattgagggaaaatgaaaagcaaagcgaagaataccgacagacctgggcaatgatttggccgagttcgcacttttgataggacggatgatgaatgatgtcggggaatttggactcccgaaagtcataacgcatgtaagaggcgaatctgatggagatgagtacgaaagtgagcaaagggaatttcggactcactcttcgatggaaacgttcgcgcgaaggtcgtccaagtcgcggaaaagcgtcgggtgcactttgagaatcaaagccatgtccctgggcattaattaaggcaattagtgttgtcggagaatgaaatgagtttggcacaaatgaatggggggcatttgtgctttttgtgtgattgct

SEQ ID NO: 12752 - DNA, 1944 bp, Heterodera glycines
  misc_feature (49)..(49): n is a, c, g, or t
  misc_feature (61)..(61): n is a, c, g, or t
agatgacgaaggccgtgtacagtgaagtgagcatctcctacgccgacantcttgatcacantccttcttcacgttgcccttcagcggattgtacgaggcaaaagcgatgagacctgcaggaagagtttggttggcggggaaagcacccgcgcccgggggcgacggactcaatcgaccggactccttcggaccccaaaattaagcgcggaaatggcgcccgcctttggccgtgccatttcacatttggccttctcttccgcagtcactttgacacttttcctttgcccgaccttcgcgcctttctcgacataaaactttacctccaaagccgagacccatggagtagaaaatttgagttgcggcatcgagccaaacttcgggctcagaaagacgagaaagctgaagagattttggggatcagtgaaggactcggaaggacccggccaaaaatccgcaaaatgtccaaaaaaggggcgaatttgacgggtcgagtggcacaactgtttgcgaattggtttaaagaatttaaattgctaaaatttgagtgccattcccgacccaaacaattgttttgtccaccactttggcatgaaaacaaaaaataaaaataatatggcataagcaaatttaaaggggaagggaagagggaataaataaagcaaagacaaagggagagagagaggagaagagataaagccgaaacaaagcgaaacaatgggaaaatgataagtggacaaatggacaaacaaaaaattccaagtgaaaattaaaataaaaaaagggaaaaacggacgaaagggggggggggagtaattaatggcaatattggggacattggcgggacaaaaagtggcattacaaattgagacggagggagtcaaacaatggaaaatgcaaaaatggcaaagacaaatgctacaaaagcagaacgccaaagtgatcagtgaaggaaagagaggtggaacaaatttagtcagatgtggtggtcatttaagaaagtaatttcaaatgcattgcccgacggaattgggcaaatgctctccaaagcacgcaaaggtttcaaacactttgccaaatggccaattttcgctaaaatggtctcattaaattcctgtcccttttccctttccgatgtttttgcccatttttgccccgtcattctcggcactttcagcttacattcggagtgatcatgtaacgaagtccggcggttgctccgtccagcattatcgaacggaacagaaacaaagtcatcaccacgtatgggaaggtggccgtcacgtacatcaccttgggatgggaagaggagagaatgattgactgatcagacgaagcgatcggaagccgaagaacggacgaaactcactttgccactgcttttaatgcccttcatcacacacagataaattaagaaccaagagaacaccaaatagccagtcattttccaattgaagccgccgaagtcgccaatcgaactgaaacaaattgggaagtggaagaacaaaaaggcaaagacaagtcaaggaaacgaaacgaaacgcactctgtggtgtcaattgcttggcgattccaaaagtaattagtgggagaagttgaattggcacattccaaaacgggggtaatgccatcgctgagagtgggacaactctaaaagaggggaggcactgatgggaagggcattttgaagacgaaaaacgcacactccagggaagttcgaagcggaaggactggaacaagtagtagatgacccaggtgaggatcacgttgtaataaagcgccacgaaataggacacgacagtggcggcaacgccaacgccgcccaaatgcgggtgaatggcattccaaacgccgacagagccctcaaaaatgccattgaacatcaaaagggttgaatggcctatgggacaagtgggcactgttcaacaggggtccccggcccactct

SEQ ID NO: 12753 - DNA, 2883 bp, Heterodera glycines
cgataatttttcgaaaaatctccatttttaattgagatcttgaattttaaattaaaaaatattgtcatttgctaattttcttaaaaatcttcacagttctccaaaattccattaaaattttcaaaatttgacgcaaaagttgaccattttgtgacttttttctttcaaaaaaagaattatcaaattttattttttatattaggtagtttcatggcacaacgatttctaagaattttgtccgaaaaatcataataaaattgatgtctacgtatttttcttcgatgcctatcgacaccgccagacataaaaacccattattttcttataaattagttaaaaatcacaaaatatggacagttttaggataaattctgttaacaaattacatttcaaattcaaaattttcccggcggcgcctatcggcaccgccggcctccccctgttcccctagtttttgaaaaattcactgtcgaaacaaattcttgattttcgatcccgatgcagtttacgattttctaattcccttaaaattgtttaaaatgataataggaggcgaaaatacaaaaattgacattaattgattaaattgtaaaaaaatacttaaagctatgttgataaatgttctaatttttgaccctacagtctgactttttaggcatgatattctaattttggaaaaaaaattctataaaaacctaatataattaccatccctatttttcacaatcgaattgatcaattataaatattagataaacatttcaacaaaacttagcacaaaactaaaaattaaaaagccaataaaaaaaattgggttttagcaaatcccgataatcccgcgggatcccgaaaaaaaatcttcgggattcatcgggatcgggattcggttgggatcccgactcgggatccgtctcgatcgtttttctaaaatgttcgggattgatcgggatcgggattcagtcggtatcccgactcgggatccgtctcgatcgtttttctaaaatgttcgggattgatcgggatcgggattcagtcggtatcccgactcgggatccctccgaccccagttgtccggtctctactgcaaaagcacgcagcaatggacataaactcaaaccctatgtgttggtcaacagaaagcgaccggtgccgcaaattatcaaccaatttgctggaaaattgttttttttcagaaaaaattagtgccaaacaatgttctcaaaattctatttatcccccatggggggtaaatggagactgggtgattattttttaaactcctcagaaaggggggggggataattggagactgcggtattaatagagactgggctataattagagcatatacggtattatcaagctatatgcattgagattgtaaattaaaataagtattttaaattgcgttaatttttgaagacattaaatatttaatgaacttttatttttaaaaaattgatccatattagagttattatttttagatttattaaaaaatatttttttaaatattgacacaagtttttgctattttttacattattttggcatcaattaatataaaaattgaaaaggtaaatctgtatttaaatattaatttcttattttaatatatataattttaagcgtcatatggttttaataaaatatggattactattttaattaattttatttataaatatgacgaaatactctgtcaacattcatacttttttggtatgttaatataaagtttgtttgacttgcaatattcaatatgataaaaattaatggatcataaaatatattttttacttttttaaacaaacaaattaattcgaaaattttttgtttctttgcttttttgttacaggattcgaaattgggtctaatagagatagaccgtaattagtgacccttaaaataacgtgcagaacttttatgatttattacaaaaaacgcaacccaaaactttgagtatttcattttgtacaattatttttttggtactgaagtgtatattttagtgaaattgatttgtccacacaatactcgaataacttcgattcaatttcatcgattaatttctaaaaactcatctgatctttcgaatgatacaaaaatttgttaaaaaatttttattcaaagtctgcatcggcttatttttgtgacaattttttgatttaaaccggtttgaaagcgacattttattgccgcttttggattgcttggaagttttttaagttattttagagtatggtacttataattgaaaattgtcaaatttttatttttcatcattttaattattatttcttaatttaaccaaaaattgtcaaaacgatgaaaggaatgacagaatttctgtcttcagttgactatatgctagagtgcagcgggaccgggaccggccgggaattcccggtcatccgaggtcccgtcccggttcccggtcccgggttttaaaaattctcaggtcccggtcccggtagggcaaccgggaaccgggaaaaacaagcactggtaagaatgggggtctgagtgaaaaattagtgaagaaaatttgagtgaaaggaaaaaattttgaaaaaataattaaatatattcgagaaaagtagcactaccaactgtgaaaatggcctagtggctagtctccttgactttcccttcatccttcccctggttcaatcccattacagaatctaaaatactttgaatttactttttatatattcatgggtttcctatcgacaaaatatgattcctcaattgttttaattgtattttatcattttttaaagaaaatcagtacaaaatgagcctattaatcccaaaaatcagcattttttgttgaaaatctgttaacaaattgcactcaaattttcaaaatttcccccg

SEQ ID NO: 12754 - DNA, 1171 bp, Heterodera glycines
tttgagcctatttttaataaaaatgggggcggggtaggcgtcgccgggcgggtgaaaaaaatgcgaatttggggcctatatattaaaaatctacacttacgtcatatatttaaaatgttaatttttgaaaaatttaaaaaaacaaatacttggaggggaactgatctaacgaaaaataaggaacggatccaaaagcataacccactggactaccaatgcaatgccgattgcaaagcaaaaagttataatgagatttaaatttaaatttaccataagccaatcattaagggtgtattttcactttgaaaactcaatctttagggggtgtatttttctcgaagtttcgagcattttcacgaagctcgaagtttgaagcccaaaaaacgcgaagttttcaaagctcgaagtttcgcccacccctgatcggcaccgctggaccccctttctttcccaaaagttttttggaagaagcacgccgaaataaagtgatgtgaaaagcaaatctgaatttctattaatagctttacttttggattttattaaataaaaaacaaaattaaaatttaattttgtattattttctattgaaataaattaaaattaaattttttaagattttttaaaaatttttaaaaattttttgaatttttgaattttcaccggttggtcccggttcccggtcccgaacaaaaatcgaggtcccggcttctcaggtcccggcaagtcccggtcccggttttgcccaaaattcccggtcccgctgcactctactatatgctactgctgctctcattgaatggtgggcgtccacaaacgcgtcgctttgataaggctcagagatatgaaagattgatgtgagaacgagtgaaaagacatgcaaagaaagagagagaattaaagaaacagtgagataataagacagagatagaaaaaaaatcagataagacaacgagagagagagagagagagtgagagagaaaaagtggagaagagaatgagggcgagaaagaacgagagagagagagagagtttccaatgcattttgatgggaattttttggcaaggaaaaattaattgatttaatgaccttaattaatttccaaaaaactttacaaaatcataaacaaataaggtctgaatcttaactctgaaacttttgactcgtcgctgt

SEQ ID NO: 12755 - DNA, 839 bp, Heterodera glycines
tttttcaacaatttgctctggtgacttctgatcccacatgtctcttcaattccgtccgttctcaaccaaaacgtaataaaattccccgaggcgttttacctccgttttccgggggcgaaaatttttcccttttcacaaaaaggccaacgggtgagtaggtggacggaccgacgggcatcaccgcccccgagggccgaatggccatcgtcccctccccccttccttccccccccccccatttcttccgcctctcagcggcggcctccgtccatttttcaaagacggtgagtcgggaagatatgtccgtcccttggaggtggtgatgagacgacgaacacccaatggggaagggtccgtcctttctcgactttggcgatgagcctacgactcactctcgattgagagagaggggcggaagagggattggccatccaattcagcgggaccattgaaggtgttgagggaggagacactctgctggaggagaaaatatggggattctctgctggaagagaaggaagagattgataagggaagaaaggaaatggaaagaaaacggaagaggaaaaggaagaggaaaagaaaaacggaagaggaaaagggaagaggaaaagttaacggaagaggaaaaggaagaggaaccgccggggaggcgaaattcagccccaagggatgtgaccagcggaagagtcagctgagagcagcagcagcatgccaatgtgaaatgcattgcaaaatgaatcatatgcgaagtgggaggtgggggagcgggtgactcgattagggggggggggaaaagagggggtaatgggggtgtggacgagggggggggggggttg

SEQ ID NO: 12756 - DNA, 3139 bp, Heterodera glycines
  misc_feature (1616)..(1616): n is a, c, g, or t
aaagaaaatccatgagatccctttttggggagaataatcgcaagttttcatggcactccgatgccccccccccaaacattctctcatcgtcggctaaccaacgccaaatatggacacaacgtcaaatacggacggacgacggccaagccaaagggaagagtggtcgagacccactcgagaatgaattggaggggtggcgagagcggaagaggaagtgtgggaaaaggggaggggaggaagacggagagaagggagaaggcggcgaaaggcggagagcggcgaggggcagaggggaagtgggacatggacggacgggcggctggtgtggggacgtcgccgtttttttttggtccgccgaagggaagagaaagtgcgccatggcgggaggagggagcgatgatggtcattccctagccaccgcaccacaaaaaggaatgaatgagaatgaataggccgtgaatggaaagaattggagatgaaaaagtgggagagggagagaaaaggggaaaagcacaaagggacacaaaaagaatgggacagctggggagagggggggggggggatatctgaaagagggaggagagggggaggaaatgccttaaataatttaggagggggggggggcaaattataggtccctaaccgacgaaaagagggggagtcaacattagcttaaatgcttattagtaaatatgaagcgaagtgcctaaggtaaaatttactcaaatggacaccgaccgacgacggggacattcgtttgggggaacgaaagctaagggatggcaccgcaaggccatccaaccttggggacagccgtctaccgccgatggtcatccaagtgccagccgaggcaaagaacggcaaagcgcgaatggggacgaagccggggggggggaacatccccagagggacaaacattcctttgccgccgcccccctccactcactctttcccgccgcttttcctccccctcccacccctactctctctcccctttctctctctctctcttttcacttttttctcttcccatcacttttcatcttttttagtttcattaaattttccgaaaatagcctgaagcaaatcagctggcaccggccaaacggcgagtgttggacaaacaatcaaaaaatgggaggagggaaggaactacgaattgtaatggttaaactgtcacaaattggcaccgttcagacaaattctgaaaaagatacgaaatgaatttttttaaatgaaatggcatttttagaaactaatggatgggccaacatttgacaagaaataattatccgaaattaacggaaaaaaagacaaaaggaatcaaatgagaggaaaaatgaaagttaaaacaaatcgccagaaaagatgaacgaatgaccgacccttaaaaagggagaaaagccacaggcaatttgggagtgggggagagaaaaggggaaaaaaggtaagggatgtaaatcaatggcaaataattcgattgaacaataaaataatggggtggggggacgaggaagtcacctcaacccaatccaacccaacccatccatcccttgcctttcttctctatctgctccataagaaagaaagtctctaattggagcacacccatccanaaatacccttccctccccccccccccccgagagatttggcatttgtggcatttgaagtgaatttgctgggaaggtggtgggcatggattgaacctgtggaaaatgtgtcctaaaaagtctcgtgatggaaaatgtgcgcttgggcacgcagcaaaaatggagaagaaaagcaaaggaatcgcaattgttgccaaagtgaacattcattgattatgaaaattgaataacacgcggatgggtgctcttctgcctctgatcggcggtgtaacttttgtcttttgttggattggcattggcatggggcaacggcacacccccccccccccctaattaattaatttttgagccaatttaggactaattaaccccttctctccaatcttacccaccactttctgtcaaaatgtgcaaattgattgtcgcgccaatcaaaacaaaaataatccccgcaaaataacccaaattttctttgggtttttggcagtgaattgtgtgctgttggcgggtccctttgctgctgatgatggccatttcctttaaaatattcgtcgtcttaagtcactcccccgttttaaactcgttccccaccaattttccttttctgcaaaaactcaactcttaatttacccaaggggtgaaaagttaaatggaaaattgaaaggggcggggggggggggacggaacgccaatgatagcctaaggcattaaaatggcgaaaaaggtggtgtccagaaaaaaggaaggcatatgaggacggacggagcagcacaaaacgtcgccagccgaaattacgccgtacgaatttttggacaaaaactttttttgaaagttagcaattttttttagaattttgcagaataataataataatataattataataataataatagaaaccgaacaagacaaaatgcttaactttgctccccttctttccccctcttcccttcccccttcgctcccttctttccccctccttcatctcccgctgcccggtcattcatccggcaatcacttctctgacattatttggtcaatccacctgacttttgtccgatcattcacttctccaaaccccgccccttctccctctccccccccattccatcccatctgatgatcgctccatttttcctttcccaaatggccgggcgggccgattagaacggaccatttcacatgcatgtagtaggggaataatattccatcaggcacccctaatttgaagctaatatccattgatcagcaatccgatcaacagattggtgtgaattggggaaggaatagggcgcaaaaaatgtaagagagcgaagggggaaaatgaaggtattgcttaatgtggaaattttgtgaatgaaggaaagttgaatgatcaaaaagagagacgaagggaggaagagataaaaagagataaagagagaggtagattgagagagagagtgagaagagagagagaagagggaacagagagtgataggaggagagagagaggagagggatagagatagagaggagagagagag

SEQ ID NO: 12757 - DNA, 2471 bp, Heterodera glycines
  misc_feature (2356)..(2356): n is a, c, g, or t
tttcctcctcccccgttttatttggcaattttaaggactttttcctcgacatcttcagaacagtcggagaaagcagcttcttggaactgtccaaaaaacttgaccgatttatcagcggagtgcgccgaagagcaaactgcccaaggggcacaggcggacgacgcggccaaaacaacggcggaatgggaagcgaaccagaacaaaatggggcaaaagggaaaaaatggccagcattttcgggaagagaaaatatggaagaaggcgaatgaagagaggggaagaagaggtggaagaaatcggaagacggatgggagagggggaaggaggagaagaggagaaggaaggggaaaatgggagggaagaggaggggaggcaaatgggagagatagcgcaaagggagcacccgaaaaggaggggaggaaacagtaaaataccgaaatgtccacacgggttcagaccaatgaattaccccggaactcagtggacatttttggagtgtgtgatggatgaagaattgaagttgatgaagaggaggaagaagacaaagagaaggaagcaaaaggacaaaaggaggaggagtaagaggaagaaaagaagggggaacaaggaatgggaagatgaggtggaagaggaagaagcagaggagcagcaaaaaggaagcgacggcataataatcagcaaagtgaaggggacgcggaggacgagtggcagacagaaagggaggaagagacagtccagcacaaaagaaaaatcggcggtctgtcagtgttagagcattcagatcaggagtgggacgcgaccgcgattcgcggaatttttttccgcgattcgcgaccttggcaatttgaatccgcgaccgcgggattttttttttttgcggcgcgccgcggatttttttggcaaaactttataaagaaaattttttgtagttttaacaagctctattaacttagaaaaaatcaaaaaatttgactttttgctattttcatgttataagttttttgataattgtctaatcgcgaagcgatatcgcttctaaatatgttgagcatgaatgatctccttttcatctatttttttgcggatagcatatgctgagataagcgcaaaaaacacattttcttcgatcacttttccatttaagcgatttttagcaactattttcaactatttttgcttatgaaaatttttaacaactattttggcttgtgaaatttttaaaaaactttttttttaactatttctgtttttcaataaaaaattattatgaaaaatgcaataaaaaaacaaaaatgcaccccggaaaggaaaatattttttttcaaaaaatacacctctaagaatcgatttttcaaaaagcaaaaatcctggctgtgatttggcggacgaccgaaaactttttacacttgaaaatcttcaaatgtatttgatttacaattgcgcaaccgaaaagaataaagatgaggaaatttttgaaaattcacacatttattgacatgtttttccaatttttgcaactttttaacaactattttggcgtttttcagttttttcgcaactatttaggtacctatttcgcgatttttagcacctaaaaatccgttctctgataccaacaatgtggattttgttgataaagaaaaaagttgagtccaaaaaatgcagtggccaaacttgtggggctcaactgacgtagaccgttcatattagtatttcaatattttgggggttttgtcaaagttttgtaaatatttgatattttcaaaattttactgtaagattcataaattctataacaaaaatgcaataacaaataatctttttgacgcatgacattttttggcgacatgttcaagaaatttcaaaaatttctcattaataaatcagtcgaaaaataatccccctgtctctctccatttgtgcccccgtatctaattatcccccccctttctgaagaggttgaaaaataatcccccaaggggctataattagagaatatacggtaaatcccgttatttgttcattcatttatgtcattttggctttgtaattagaggcgaattttcataaattatttaaaaaatgaaaggaaataagtttatccataatcagcatcaatagcatttattatcatctatgaattagcagtaacagagggcactctgtgtggcaacggtcgggtttgattttggtggagaactgtagaagaaatcgtagtgtcttcttcgggtccaactccatcgggtcagtgctatcgctggcggacgatggaatttctgaaaattggataaaatttaaaaaatgaacaccgcgtattctctagttatccccccgtctccattaatccccccggcgngatggataaatggaatttttattttttgaaaaaatgaatttctaagacatctcgaaaattttataatgccgggtgttgtttgatatctctattcccgtccccctcacacaaagga

SEQ ID NO: 12758 - DNA, 2179 bp, Heterodera glycines
aaaacaaaaaggttggtcaaattacacggctttaattggttgacccccccccccccttcttttccatgtatgattgtgggtgacccattgtgatcggaaagaagggacctgagcaagttagttaaaaatttcaattacctgaagatagtaaaatttgtcgataaaaaattcacggctgaagtactgtagaagcaacggtacactgtccaacataaggcgccgcagatagcaactcgaatggtggccaatgtcatggacgaaggtttgccgggcgcgacttgtcgcgaactcgcgcatcatcaacaacaatatttgggcagcagcaatttgacaaagtaaggcacgctgaaaaaaatatcgtaaattattttaaaaaatatatattctatttaaaaaagccgaaaaatttctttttggaaaaaaggatttatatttctttaaattttataaagatatgtatgaagaaataaaattaaaaaataatttgttaattaagacatttttaatgataaatttttttaagcacgagtaattatttttgtatttcttattgaaaaaaacgatttaattgggtactcaattaataaataatttatttggcaattaccgcggttagcacttcctgcttgagcaatggcacaaagttggacagcaaatccttggtgctgaccaaatttcgcaacactgcaatgccattcaaatacgcctcgtgggctcgccatgagccggtggaccctttcatcaaattgttgcaactgaccaaaatgcgatccaatttagcaaatatcaaatgctaaaaaggggaaataattaaataaaatggaaaaaatatttgaaagaaaagaatttcaattgtaataaatggcaaaaaatttaatttctctcaaaaatacgttaattaatggtcgaaatcgaacaatattttttccttcctttatctttatcattattttttagttccgttcaccttttttattttttgattttgggttctgttaatcgcttcctttcagtttttaaaaaaatttaatggtatcattttgccaatatatttttatttgaatattttgtccacctccgtctccatgtgttgcgatatgcttgtggtggtagccgaacggcacaggcgaccgcccatctgctggtggttgttaggtctggcaccgtttccgaccacagtgccaagccaacagtcctcctcgaagaagatgccgctttcgggcgagcctatcgcatcgctcccggttactgtatgctcagtactgtactgctggcccgcctcagcctcatcagtttcgtccgtggattcctcatgctcggtccacagtcgcttttcctcggccaatttggcacggtttgcacggcactccttcttgtccatttctgtcctcgacagttcacaagcgaactgaaacaggacgaaaatggaattgaatatgataagcatttttggatcggaggttatcacgaattttccaccgaaattattaaaaaaaagagtcaattttagcccacctgttggatgagttgtcgtgaaagtgcgttctgttcggatgccagcaattcgcgcacaacacgctccaagttggacaacgactcgtcattgttcgggaacatcaaatactgcttgatcttcggcagtgtccggcacagttggagccttaaaattatggaaattaaaattagtaaaaaaaaaattacaaaaaaggtgtaataaagacaaaatacgaatgatggaggggggggggggaattttcactgaatattttttagcaatttgcatttttaaactaataaaaaagggaacaagcataaaatttcaaaagaatcaattatattattaattctaacagaatctaacatttttagtttttttaattttttttatttgtgtgctgtaaatgtacagtataccaaccgtatgtttgagattgggtcagcggacagtttgagcaccgcgggcaaaaatttgtcgataaaaaattcacggctgaagtactgtagaagcaacggtacaatgtccaacagaaggcgccggcgatagcaactcgaatggtggccaatgtcatggacgaaaaagtcgacgatggtttgccgggcgcgacttgtcgcgaactcgcgcatcatcaacaacaatgtttgggcagcagcaattcgacaaggtaaggcacgctgaaaa

SEQ ID NO: 12759 - DNA, 3235 bp, Heterodera glycines
  misc_feature (217)..(217): n is a, c, g, or t
gacggggctttttggcgcggagagaatatgatcaatggaaaagttagaggagcgttttcggggatgattgtccatttttttttattctgagagtggagtgaaaaggaatgagcaaaatctcggtatttatatgcgagcgccggcatggaaatggcgtgaaatggtgaatgaataataaatatttggacatggaaaaatttcaaaaaacttaaacaanactatggcctgaagagcagcacaccgccacccatgaagcacaagacgacagggcacctaaacgactcgggaaattagtcaagtcaagcgaaagacctcaagccctaaaaggcaaattgctgccaggataaacggtgctttttgtaattaaagcaaccgccctggttaacagcaaaaatatttattttaattatacggtcccaaaatcacaattaaatgatacggtccccataaagcacaggacaagtgaggaagaggagaggaaaacagcagatgtgcaaaaaaaaagtgaaaatttttaaaatgaatcgggaaaatgaccgggtgtacgatacgcgtactttggccacgcccacttgcgcaccaaaattattcccaacaagaaatcgaaatcattctttattcaaattttggaaaatgaaacgccccaatttcaacaatgctcttccaatgagtgagaaaaagcccaagcttcgtcgacggctcccggctgaattaaattgcgaattgatcagtttcgtgcctttggtctgcctatttgcaaatgtgaagcgggctccaattggccctgtttgctaccaattcgagtgtttccgtagtcggcgacaaaagaattttgaatatttggtaatttccctttttatttttcattttattaccaaaaatatttttagaagggtgttattgctttattcgatgtgatgtttgaggagaaaaggacaccgaagaagaagaaagtggggagactgcatctacaggaagaactgccgcatgacctcagccgaaatgagctcctgcactacctgtgctacggacgactgggaacgaatttgttcgagacttattttgtgatgagccaagcaacaaatgtaagcgaatttttaaatttttaatgacaacaaaatttttagtcaattgccattgggaatttgtttgggcttctgctcgattttgcaatgagctcaccaactccttggctcatgaaacgaccaatttgctgtggaattttctaccgtcaacatttgccgtggattctgcaacaaccgatgaacgtaatgctttctcatggcttttttccggaggtccgaagtgatggttttgaatttttttggctgttcaacccacacttgaaaaagtatgctgggtatgtcagaattctgcctgagcttagtcagcctgacaatttgcattttttccttagcattttctaagcattttacttgaccaatttattcatcattatcattacatacagatcggaatttgtcgatttttccattttctcaataaattgttgaaatgaatgaccttgtgacatatgatacacaaaaacaatacagtgtggggcacacgttgacactaattgggattgataggaacgaatattttttcttaggcccattggaaacttattcaggaatgatgacacaatgacagatggtattttttgggctaagctgtcataataaatcactggttcttccattcccttcgcataaattgcgcaccaatgagaccctcccttgtaatgtgggtcccggttcacaattagcgctgcgggatactgtagagtgaccggaggcggtaattgatcactggcgaagcagccccgaaagactcgtgcggtcccccggttttcgttcaagattaatgtgatttgcacgctgtccattcttcagccaaaaaatagagcaaagttgatggagaaccaggctgacaataagcatcaagtacaatgcaaacaccgcccagcaaatgacttgttgaaaaaaatttagtctttgcacaattggatgagtggcgtgagaccagctgacacttgctcttcaattaacttgtcactttttgggggagaggaggtggtggttgttgatgtgcttgttgtagacggaattgttttagttgttgtcgatgtaagcattgcctttcttcttatatattctgaatactcaggaatttcctctctacatgacactacgggaagagaaatccgaagaaggaataaaataacgccaacttttttggaatacatgtttattattgcaaaaaatgaaaacaaaagtgccttaaatagtgatgtcagtgctgatcgatcgatttttatccaacatcaccagcgagtcgcactcgcccatcaccaccaacattattcctccagcgggcaccgcctgattaaatttgatgctcactgctgtggtcccgttccttatcagatcaaaaagcgccgcttggtcgtctccactgctcgtcaagttgaacacgtaaatgcaatgcgtagtgccgaattgtgctagtgtaatcccgttgctttccgatgagttggcgaatcccaccgcttcgttcatgtcgttgaaggggcgcacatactttccgtttgggtagtccaagtcgtaggctgcttgagggtaggagcgcccattggcaattatagaaatttcacgcacattaaatggctgaaagttgaaggggctgcgtgaaacggtgccaacatagtcagcattggccaccaatcccattgtgatgcgccggggaatttgatccatgaacaaattagacgtaaattcaaaacgcccatgactgatgaacagcgacttcatcagcgttttcctcactgcatatcgtgccggcttcaactcaagctttcgcgcaatgtccaacgccaatccgtccatcagggacaccttcttcacatacattttcagaccgacaacttcgaaatggtagcgagtggctgcagcaacaccgggtggtgtgattaggacaaagtcgttgtcgttgggcaaaatttcaatgtccaactcacaaaagttgatcaagtagagaggctggttaaacaaatcggcgtcaattttggcaatgaattgtgctgttctgctgcctacaaacaggttgcgtcgtgcagtgcatccgtctcccacctcaagcacaccaccagtgtcacggtagtaacctgcagcattcaaatgcgagtctttcgcggtagtggaataggagagttcgtgtgaaaaatacgatttgt

SEQ ID NO: 12760 - DNA, 4089 bp, Heterodera glycines
ccaaaaatgctaaccatcgattctccaagccttgtgcagttttttctgcgtcctcctcataaacaaatttcacgtacacattgccaatctgtgaacaatggcaaattatttattgtgaacctgccaatttttaccatgtgttcgccaatgttttcacaaacctaaaagtaaaatttcgtaaattaagcgaaaattcgttcccaatttacgttcaattcttccacgggacctgaaaataaaaaattgtaatctcagaaaaaagcaattttgaattgccgaccataagtgcgttgaagttcggtgaatacttcctcgtaaaactcatcaaaatggcgctgctcaagctcatcctttttaccgacctctgaaaagttatgaaatttagtcacaaagaatcaatgaatgttttattaatagtccactagagtaaggaattttgaaatagtcggcatcaggaaaaaggtcgagatggggttaccaggaccaaatcccggattggccgggattgtcaggatcataggatcatcgaaaccgatcccgtctgggctcttcaagttaataatggaaaacggatggcgtaccgccggggacttcccggaaaagccatttttggggaaaacccagggactttgggccaataaaacgtgccaattttgcttggtttccccgttaccggaccgtcatcaaagcccggacctttcccactccaattttttcaaaattttggttccgaattgcttactgtcgaaagcgtccgcctgtgccgggttcacaatgggactctggtagaagtgcttgagcagcactgtatttgagaaggtaggtctgtggtgggcccgcaaacagttgtccccgtgtcgacaggcgccaatctaaaaaaaaccaaaaatttttttttggcattttaaaattgaaaaaatgttatcaaccttgaagaagaatgagcaattcactttgtccttttctgtgccgtaaatactggccaaatattcagctcctgacaggtcatcggtcgcatcataacgaggcatttttgcaaaaataggccaaggtaatcaacaaaaagcaaataagtgataaaattcaagaatacttaaacctcaccaaatctaacaaatgtaaatgatatatcattcgattcctcttggtatgtaatgcattaatccgaaagaatttttttgcggaaagcactttcatggacggtaaaaaaggaaaaaaagcggaaaaaaatcgttggcgtaaaaaacaaaacgccaatgcattcaaaacaatacaaagtcattgtcaacggaacgggccaactccgtctggccaactccgtgttttttacacaaactgacaaaagaaaaaaatgtaaaacaaaaacatttcatttttaacacaaaatcaattatgtatgcacggaattggaaagtgccgagaattcgctctaaaatggcggccgggtcggattccgagtccaacattgccaattttcacaaattctgcccagcaattgtcaaaatgtcatccaaatttgtttttttaggcggacgacaccgtggtgattgacattggcactggcaaagtgacggactacgtgaagtttgatgctggcaacatttgcatgatcactggtggacacaacattggtcgtgtgggcattgtcggacatcgcgagcgtcacccgggctcctttgacattgtgcacatcaaagactctgctggccatggccattcatttgccacacggtttgtttcttggggctggttttgcgtgtaaaacacatcctgaccaccaacacttttggtccctttttcggaaatttactcagactccgtaaattttggttttgattgttgcttatcttgaaaatgggcatcagttgtgcagccaaaccatgtgagacatggaaaattgggcggaaatgtctccgtttctgagtaatactcagtttttctagactataatccatctcttttaaagccggtatcagaatttgaatgagggaaaatgtttccgataatgagcaaaaaccgatcagtgataatcctctttttctgtccaggatgaccaacgttttcatcattggcaagggtgccactccgttgatcagtttgcccgcttccaagggcatccgtttgtccattgcggaggagcgtgaccgccgtcttgcgcagaagcagaaagtttgagcctgatcccgaagaacccatttttctgtcatggatgttattgttttgtttgttggcataaagaaaaagagtgttgctattttcacagagcccccaattaagggaggaaggcccgaaaatgatgaacattttttttgttacttttctgcacaaattagtgtggggggaggggggggggggcgttggcgagtgaaaacataatactttcttaaaaatgaaggccaaagttggaaacgcgacccatggcagaatgcatggcaccgaaattttaaatccgaccaaatctacttttgaattatactgacaatgagtgtacgtgtttgtttataaaagatcgaaatgacaaaaaaagaggagaaaaacaaagacaagagagagagggtggaggaaataacattccacacatttgcaaaacatccatcaaaaagaagtcatctcatcatatccatcacccaccaattgtaattaataaaattactgtgatttgtttgacatttatttgctgctgtgtttttgtttgtttgttgttgcttttccatgaccaaaaacataaaaaaggaacgaaaaaagtgggagaagaatattccatcatccatcaaatacaccatcatcatttatccatcaatcatatccatccattcacaaatcgtccgcttggtggtcagtcagtcggtggtcgtctgtcggtccctggcgctgtcccttgtctagaggaaatagtcgggcgtacggcgtgtcacgtgcggctcgccccgacgcggggccgggtcaaactgcaggaaggagtagttgagctcgtcgtccagctccaccatggccgcctggttgccgcaccggtagcaataattgggcgccgagaacacggtgaccacgttgcggtcatggcaccaattgtagcccttcggggagcaaataaaataaatttaaaaatgtaacggcagtttgcattttgtcaatatgaaacagtcgaaagcaattacgcgttttttcatgatacatttgctcaaattaacgttcggatcgaccaattcccaccactgtggtttttcatgaaaagtagttttttggtacccaatatttcaccatttagcaactttgtttttttaaatgcccccccccccccgaaatacgcacttccatgacgagctgatgtgctcgcgagattagcgaaatgccgttggcatggttgaacgtctcggagatgtcttggccaaaagtgtaaccggcaccacgcggcgaaatgccccaaccgccacgatcgtccgggtcggaccacagcaagtcgcacattgggcctaaacaaaatgaattgtcaccatcgttttgtaaacaaatggagtgttccccgttttggtggtgtttcatgtagaaaattaacaattaccttcatgtggcacttcctggagacgttccaatgatcgaatgtggtccaacgagtcgatggacggcgacagaccgccgtgaagacagaaaatttggccgtccaccaacgcagtcaacggaaaataatcgaacagatcggtgaaataattccacacctgaaaaacgggggaggggcaggaaattaccgacaggactagaaaaatttggacaaaaatattggaaacgaaaagcgcaaaatttttggatttctaattttcgaaaattgccgcccgtcagccaacttttctttccaattgtatccaaaaattgcgtatttgagtgacgcctcaccaaaaatttgtttgttgaaaaatggcgcttgacaaacaaatcaaccaaatgctaaaaaaacagacaaccttcgaattgccatatttgcgcaaacactcgtcatagaagccgtacacttgggtgatctgacgcgactcgtggttgccccgcaagatggtcacacgttcgggataccgtacctaattgtatagtaaaatgata

SEQ ID NO: 12761 - DNA, 4055 bp, Heterodera glycines
  misc_feature (3969)..(3969): n is a, c, g, or t
  misc_feature (3980)..(3980): n is a, c, g, or t
aaaaatgtcaatatttgctaagaaattattagaaacgaaatgtacctcatttgcaactgcaatcagtgaataaaaattatttttgctcaattgttggctaaaaagtatgtgaccattcgtcactattttggcactttttcctcactattttagttaacgatttcaggatttttcgtcactaaaagtagcgactctagaaattgtacataattttctgccaatttaaaaaatacgctttacctttactgtcaaaatctcaattagacataaagagtaagcgaaatagttcagtgtcgaaatcacctgacaccttttttctaacccatcattctgctgtaaaagacacaaaaatccagtcaaattaaatgcattcgaatgaacgaagcgacaaataaatgtgaggagcaattatccgatcactttccattcataatgattgatcatttctcatttcccaataattctttcactttttctttcgctgtccgctgggcccgggattcatttcaagaggaccttttacgttaatttggcccgattctggtggcgacaatgacctaaatgaagtgcgatttaaatatgacgagacaaataaaagcaaaagctgttgccactcacccaatgcaatttccataaagctcaaaagcgattttgttcaaattgtccgtctttttgtcctcccattgaattgtctctccaatttggcaccgctccaacacgcaattaatatatgtatattcatcatcgtcttctgccttcaccttcaatgtcagcttttctttagtccgttcgttcaccaattcaaactgcgtaattgaggtgtgagttttgaattggattatgtaactgacagaagtggtggcacggagaaatgcctaaaaaatgagaaatgaaaagcaaatgccaattaatccaaatattatgaaaatattggcacacctttttgaaattgttgacccattcattggtttctgacgtataatcatcacgaaattgtttcggctgcccattttttgtcggaatgtgtaaccatttggacagaatttggccagcagaatacgcatttggcccatcatcagcaattgcatcgagcaacaaataatcggaatcgattgaatccaattgaatgcaatcggtgagaattgtcggcgaaataagacgacgtaaatcgtccaaatgatggccaacgggaacggtcaaatggcgaatgtttggcgcaaaaatgggccaaatttcacgagcaaaatcattccacattggctggacaattccgttgtcgtcgtgcacatcatccaaatacaaatccatattgatgcctttgtcaaaaatttgcttgttgaacgaagaaattcgatgacggaatggtcaatgtatcagaaaagtaatcatttatcacttaacaattctttggattttgaattactcaattcgaaggttgttaaagcgaattttgatgggcaacgaattgctcttcgtaactacagatagaagttttgttccattcttggcaattctgatttgtctccaaattgtctcgcttttgccgtcaaaatgtttgtccaccaaagcattgaaacgtggcgaaatcagtgccattttttggccgagttgacgacgacgaaaaaggggcaaaatatccatcaaaatgtcgttgcacacccaactgaaattgtcaaaagttgagcgtttagcgcggtgttaaaaaatgaaatttcataatttttaactcaaaaaattttcacattttcttcaaaatccgattcgttttcattgccacgcgaacacttcgccgtattccaaatgtcacaaatgaacccaacggtttcttctgatgatttgtttcagttgcagaaattgggcggtgatttgcggaggaaagttttttcttttttttgacgggtgccatttagaaaataataagttagcctaaaataaggaaaaattttgaaaaaattagcaaaaataagcgtggaattgtttttcatccttttttatatacctattcatgtatagggcgaggatttttagtggcaaaaaaccccaaaataattaactaaatagtgacaaaaaaatggcaaaatagtgacaaaaataatgacgaaacgccaatagtgacaaataattattttagtggccaacttccaaaataattctttctagtgatgaatagtggcactaaaaacgaaaattttttgaaaaagaatgtgtttttcgtgcatttctcatcaaaataaagccgcagaaaaatagttaaaaaactagaaatcctcgccctattcatgtgaagtcaaaatttcggtaatactctagtttgtcgcccccccctttttgtgaaaattgttttttgtttttaaaagtcatgaaaacatgtttccaatggtttttggggttgctcatcacgaatccggcatctgtttcgaccaattccgaatcccggacccagttcgaacaaaaagcagaaaactcaaatttttcgaatttccatttttagtctaaaaatggtttaaatgatcttttattgaagcactaatgacttaacttcgttttcatgtatttaaacaaagtttgaaccaagaatgtgagattcaaaaaattttaatttttgactttttgttcgaatttgggtccagggtttaagaattggtcgaaatggatgccggattcgtgttcagcgaccccgaaaacacttagaaacatgttttcatgacttttgaaaacaaacaaaaaaattctccgaaaaatgggggcaaccatctacctaaactattaccccaaccccattttaccaaaaaaggtcgcgccacacactagcgcaggtttccgagccccaatcttggcacttacatcagctaatcctaatatgctatggctataacaaaagtattggatcggacaaatttaggaaaattatagttaactattattttttcttttggtttacatttacatatcaaatttaattttttcagctttttccaaattattttcattcaacaaaatgaaggaaggccaaaagccccgccagtcacgacacaagggacgactctcaaagaagacgcgcattgtgcgcgagcttgttcgcgaggttttgtgtactcaattttgtgtaacatcataatcataatccgtcgcaaatctgtttggttgggctcactgattggttgcaattttttacatttttggttactatcgaaaatttataaaagtttaatcaggaaactaaaaattttttttttgccaccctcaatgtgtatccttgatgaatttttgctttaacctttaaaccgggtcaattttaaagaaatctcacaattttaaggttgttggtttcgcgccgtatgaacgccgtgtgcaagagttgctcaaaatcaggtttttcttaacccattcatcataatggaaaaaaacaacaacaaaaaaaatttggggaaatcctggatacgccagcatttaaaattgatttcgtttggcaatccatttgatgaacttttcaacggattggcctttgaacccggacctgatgcatttctatgcgtcaaatcgatggccacctttttgtttcttagaccatggctttttttcttatcaaaatatacttgtcttgggctccatcgaaaactgttaaagtctcgggaatttataaatgcaagaaaagagcaaaaatcacattaagaaaaaatttatttcgatttgtaccaaatgaatgtaggtattgaccaattaagataaaaagttacggtctaaaatcaaaataatgctatcactatcatgttttatgataacgtggacttaaaaaactttaaacgtggcgtcgtttttgggcaaaggcgccaatgttgggagtggctcatttaagtttttcaaattgttcactcgtaaattcgtgaatgaggtatcccccccccgccccctataaccagaaagtgtaaccaaatttaattatgaaatttcatttcccatcacaataangcaaggacaanaaggcgctgaaagtcttgaagaagcgcatcggacagcacacgcgggccaagcgaaagcgtgacgaaatgcagcaa

SEQ ID NO: 12762 - DNA, 1286 bp, Heterodera glycines
ctccgtcgatgtgaaatgcggaggagagatggtcagacttatcggaatcggaattcaatgcttaacggaggacagaaaatgccaaacaaatcgactccatgccttcgaaatgccaattcggcagttccttacccgagttcaaaagtctgtccctcatgacagtggcaagttcaacgaatgcgtcgtcacagtttatgcccgtttttgcgctcacttcgtaaattgacacgccgattttctttgccaaactaaaaaaggagtgtaatacttaacaataaaaatgggtacttttcggttttgtgtatacacctctaaatttaaaaatatgtacaaagtttttttgatcgcacacagggaatagtttacccttaaaatggcaagaaaccttagattttttagagcaaattattccttttgtgccatcaaaaaaacttagtggatcttttgttggcatatttttgaaaattttagtgtgtacacaaaaccgaaaaatacctaaaaatgtataaaaattcctccgtttacttttcggcacggtcaaagtccaccttccgctcggagtccaagtcggctttgttgcccaccataaggaggacggcattttgtggcgcgtgttccttcacttgtcttagccaataattttccaaattttgaaatgacttttcgtttgtctaaattccatttagtaattagcattaaattacaatttgtgccaatgaaccgaccaagtcgtacacacacatcactccgtgggccgagtggtaatacgaattgtaaatggtccgatacctttccatgcctaacgataagcattttgatgcaaatgaaacggagagttaacacattgaaatacctgcagtgtcccttaaagctgacaattaaaaacgcaaggcaaagtaaaacccaccacaattccaaccgaattttgtcccgtccaattttgatggttttcaatttgaaatcgactccgagcgtactcacgtggtcagaacggaaggaattctcggaaaagcgcaacaaaatgcacgacttgccacagttgtggtcgccgacaacgacaattttgaacaaataattgtaactcatcggccaaaaggacagaaaatcaaagcaacatcaaaaagggaaaatacgaattgaaattggaaagtcattgaaaatcaaatcgtaagacgacgaaaataaatttaaaaaaacagaaacctatcaaatttattttatacataagaaatgtaaaataggtaacatattttattatcacaagaaaaaggaatttgtaccataat

SEQ ID NO: 12763 - DNA, 3784 bp, Heterodera glycines
tagaatatcaaaaatattttttttttcaattcctataaattaccggcaataaacgactccccaaaggtatgttctgaaccaattgttagttgcagaattcgcgatgtattttcggatgagtattgggtgagggacgggaagaagtccgacaagtgttccatgttggaggaatttcagaatttcactttcatcggtgagccctctgcaatggaaagggactgaataatgtgagtccattaacccttttagaatcccatttcggacttgtcaatgcaaattttctccacttgcggcaccaaaatctgcaagactcgcatgatcgtctgcagtggcaacttcttcttccacgactccacccattcacttgtcggtgtccattcctcctcaatggcaacagtttcgttcgtctgttgcccatttttggctccctcctcccgattttcgagctgttttagctgttcaacttcctgttgtgtttgattttgttcgctcgttcgtttgctttccaacgattcttccatcgttgtcattgcgccgattgccggcgtttgtgccagtgatgacgattttagctctgacaattaatgtgttattatttccagcccaatttcattggtaattattcctttccgaccaatttgttgctgtttcgcccgttctgtttgtccctccgtttcttcttctttctttgtctgttcctccacggcttgctgttgttcactgtcctcattcgccttcaaagtcgcgccttttttgcctttcttcaaattctgggcaattgaaacggaatcactgctcaaattggccaattggtagaagacttgtcgttttcgaatgattgtatataccaaatttgaattgcctaaatgtaaaaaaaaagtattttgaaaaaggtagaaaaaagtaccgtcaaactgatattggatgatgttgttgaacaattcaagcaaaaagaaaatcaaatggtgatttgttggagttgagaaaatgaaccaaggagtgctaaaggaaaatttgaatgtaaaaaaacaactgacaaattgggtggacctaaatgcttcaaccaaatgcactaatttattagcagtaaccatcgatagcgatttgagataaggagaaactgaaaaaacgaattgaaaataatgcaaaagcaaaagaaaactttaccattcacgacaattgtaagaagacaatcgaaaagtgactgcaatttgtgatttccgctggtgattaatttgtggaaaacctaaaacatttttgaataaataaaaacatgattaaaaataacaattatcagcaaatcggcatgagatccggtaaaaattggcacgtcaataagtcctcgggaagtgaaaggctaaaaatggagtaattaatataatttcaatcgtgttttatcagtcgaattttgacttgccttattcaatcggacaccgaaatttctttcaccactcaaaagaagaattaggaaaacgcccatatgaatcaaaccaatccgagcttaagaacaaaaattcaattaaaagggtacttagaagaataaaataaaacccgacttgggtccgtcctcgaatcattgagatggaacaaaattgggacgagaagttcaagcacatcgctgcttttcagcacataataaaggaatttctgtaacaatccgataaaatagtgaaaattgtagccaactgtaaaaaggacctggttgtactcacaacatttccatagcaaaacaagcagttcctggtgcagttcaaccttcttcgtggagttcggcagataagaagtttgcaactgactgttaagaagtcgggtgaacccctaaagagaaaaagattgaaattaataatttgacaaaattattcagattggaccttaagcataaactcaaagtcatcttcacggtgaatacgcgacaagtaattgacaaagtaattctcaacataaccgttctaaaaaggaagtgaaaatgaattaaggggaaagggacacttcgtcagagttcggctgcgagtcgcggtcgagacaaacgataagcaactgaagggcgacttccaccaaaggttcacgggagtcaccaaacaacaaataattgtacggcatgccaaacccaacggggtcataagcacagactgtgttcaacagagaagtgaacagcggaagctaaagttaaaacgtgtctttgggttagcggttgtgacgtgattccaggggaggtgggaagtcaattccgcatatcgcaagggaatcggaagcaaattcgcataattttcggcgaatcaataaaaaaattgagatgcaaaaaagttttccaatattgaaatggagtgaaatatagaagaaaaaaacacctttttcaccgtggcaaaaaaaaatcagaaaaaatatttgttttttcaattggaaagggattaagttgtaaaaggtagtgaagagcataatttaaaaaaaagtcaacaggaatttgttaatttcccaaaatttttgggctctgataggggaggagggaagtcaataggtcaaaaggagttcgaatcaacccacctcatccctcccccctttttaggggacgggacgaaatctcgccgccggaatctcgccggccgaaatctcgccgagacaaaatctcgccgccaaaatctcgccggctgaaatctcgccggccgaaatctcgccgcagaaatttcaaaaaaaaaaaattcaaacttagaaatttttcaaggaaaaaattttagaaaatttttttataagaaaattccaaaaaaaaactatttgctaagtttttttgaaaattaaaaaaaaaacagtaaattttcataaaatttcaaaaaaaattgctgaaaaattgctgaaaaatttttcaacaatttttttatttaaattttcttataaaaaaatttttctaagaattttttccttgaaaaatttctaagtttgaaatttttttttgaaatttctgcggcgagattccggcggcgagattttggcggcgagatttcggcggcgagattttgtctcggcgagattccggccggcgagattccggcggcgagattccggcggcgagatttcggcggcgagatttcggccggcgagattccggccggcgagattccggcggcgagatttcggcggcgagatttcggcggcgagattttggggtgcacccgaaaaaaggaccccaaaaacttaattttttcaatttgaaccaaaaatcacttgccatttggtataaaatcttaaaaaaaacatccgtatttttgacagattctctcattcatgcgccccgtaaaattgcttgaagggcaacaaaaaaatcacgaaattatgtagttggaaatttgtccccacttcgccttgcaaaaaatttccttttttatttttaatctatgaccctcgacaaaaggaaactctaaacccatatcggctctatttgtgtttaggcccataattttatttttagtttcaaaataaaaagctaaagcgtgaacaaaaaagggaaagtttgaattccgactttttgtttgaattcgtgaaatgaatgtcatatttgtgattgctcaatgaccccgaaagcaaaaaaaaaaaattatggggcctaaaccataaaatagccgcaatgtccctaatatcccgtgccccgccccctctcactcgaatacaatgccatgcatttgcgtagtctggcaccgctttgcccgactgcatcatcagccgccgtcggacggtgtccaacggataggaaaagagagcggccaaaaaagcgggacactcaaatcaaaaaaaa

SEQ ID NO: 12764 - DNA, 2383 bp, Heterodera glycines
gcaaagctcaacatgtcattgtgagggaacttgacctgattatgtatttggcttttgcctttctcttcatcggttatggtaatttttgctgtgtcttctgtaaggattcgctgttttatgagtcatcgcttggtccgccggttcgtggacccgaacttcgctgtgggccagcgaatggccccaatgtccggtggaggaattcgccgtcattttctcgctgattgaactgttcgttctgctcattggcattcgtttctgtaagcgattgaccaacaaatgcaatttaactgactttggtctttttaaggttataaggcacggaatagcaattggacagaacgctaccaattcactttggccataattctcgaagctgtcgtttcgttggtgctcaattgcattaggtgggcttttgatttgctttaattcttagttgatcatttccttattttgataattatacaatttttaatccttcacttttgttaggttttctttcaacgaagtcggctcccgagacgcgctttttttactgtccgttcttcagcttcatctgaccatttcagtgaacattgctacgatcataacaccaaaatttatggtcctattcgtttgaaaatccaaataaaatgaataaattgtctcagatttcttccgactcgcaccgacgcgcgttgggagacatcgccggaatgggcgtcagcggaagagcgcacccatcgctggccaaaatgcgcgagaatttgatcaatggaaccatcgactttcaggaagtgccgatcatcgacatgaaccccgaggacattcgggttagggggggggagagacttccatagtttgtccctttcgcttttacattctttccacaggctgagctgaagagagtctacacgcagttgaggatgtacaagctgaagaacgcgtaccaggacaacccgcacatcagcaaacggaaaggcggcggtgccgtaaagaaaagcgccgcgggcgatgcgactgtaagcggaagactgtcaagcggcgcgggccttagcggtgcgggactaccgaagggcgtccgcggaacggagggctattgtgccgtaaaacgcaattccatcccccgtgaggcgacaccgaatgctgttacatcgccaaaggtgcaaagaaacaaatgaaaaagtagtgaccgtgccgtgccattttattcttggcgcattctttgaattaatcgccttcaaataaatataaattcgaaagcgttaacgttcgcatttggtcttctgtgaaggtgagcaggacttctcccaatttaagcaattgcatggcgctgatcgcccgcctccgctcgtttttatggacgaagacaaaagcggcggcgatttgacggtggagtcggcgcctcataatgtccacctgctgaccagcagattggcaaggggaccgcctaccatcgcaactccgccagtaacctcaatgggcacggactgttcaattcgagtctaatcggacgacaggacgaagaatgcacattgaaaaaccaaaatagagcactatttcaaaagaatcagggacatttatttttcagctttcatttttgccagaaataaaattatataaggaaatcgtggaatatttgtaggtaggaatttttctgtcgctgactatgattaaaatatgaggaaagaacttttttgattaatattgcaattagttggctgataagttgatttgtcacagactcagagaatttcaacaacttttatcctttgacaaagacaaaaaacggtaacaacaaaacagcgaaggatgcatcttcggtcgcccactttaagttcgaatcgcttgcatcatcccaacgcctccggggcctaaaaggacggaatattgtgtatgagaagaaaacggaaataatggtgctttgtcccccccccttttcgaaaaaaatttttcaaaaattttaatgtcatacataaatagaaatcaacatttgcttgcttgtacaaggaccagggcgtggatccaggtcttgagaagcctgcatttattctggactgtatttttgtacagtaaatctacgtccaccatgtcacccaggcttttgcttttttcaaactactgagctaaaataaaatattaaattcaagatttctatgcttttttttttgattttccaaaattccctccattgaaagatcgtctgaatgaatgatgcacccatttgcccccgaaaagaagggaattagctatttaaaaatgactgatctttttgaacccctgatgggtttgattaattaatttttttgttggccattttttatatttgcaaaatttcccttcaaaatccaacaaaacccccaaaaaaacaattttttttttttggtcttgattaaacaaaaatttt

SEQ ID NO: 12765 - DNA, 1826 bp, Heterodera glycines
  misc_feature (64)..(64): n is a, c, g, or t
gatagagaaagaattctgcatctttctatagtgaattaattttgtctatggtcaaactcaaaangttgtaaataataataaaaacgtatttctttttcctctcattttggcgtactattttcaagtctctaacacatgaaaaaacatcaaattcgcaaattcctataattttggttatacgggtacaaattcactttggacatttagaaccaatagaaaaatgattagtttcgcattttggttgaaatcagcagtttaggacttgagttataacgtgataaaaatttgaaagtatcacaacttttttctgagatgtcaaattgcttagcattcgcttagaaaaagattctccttttcaaaaactttttttaaataccaaatttgttcagtttagttgggaatgaagcgagttatggcagatcaaaataaaaaatacaaaaaagacattttccagtgtaaattttgaattaacgcgcaaaaatttacgccaaatacgctatttggcgttatgagcaattttgtctaacactgggcttgacccatagtgacatacaatacttaaaattaaaaaaaacctttcaatataatttaaatatataacaaatacttttagaataccgtagtaacataaatttgaacgttctgctgatttttaggagcttccaattaatgaatggatctaatttttccaaattagggtagaatttttcaaatcattaaaaaacctttaaaatggctgaatatatttttaaaaatagtttcagcaaaaatgcaaatttgtattattcataattttaagcgaaaaaaggaggtaaaataattttcaacttttttgcttatttttggcataaatttaccaatgctaattaaattttttgtcacttggaatcatttttcatattgtctttgcctccggcagatttttaaattcaaaattgatgaaaactgcactttttgccatgaaaccatccacgagcaaagggattcgattgcgtgagagaattaattaatgaattaattatcatcggtcggcttttgtctctttttccgttcggttggacatttgtcgcagcagttgctgagccaaacacaaaaaaaaaaaatgcatttatcactttgtttttcattgtggttaattgactcgaacatatgatatccctcggggggggggggggacggaatttggaacattttcgaaggggggggggggagagaagaagcagatcgatgatatccatcaccacaagtagagggggaagcaagcaatgaaaaaaaggacatctgctgacggatccaatttcacccctaaaacgccggagggaatggcggccaaacgaatgcatttttatgtaaatccttccaaaagggagacaaaagcgtgtgatttccaattatttatgtaaatttgcaagtgccatcttccaacagctgccttttttccattttttgccatggcatttccttccgtcgagtggggggggggggagggcactcggagaagggcactctttcgctcttttctcagttcattttccttcgttcttcgacttgcctttttgcacctcataacgagttttcccgctgacaatttccactcataaaatgttttgttatggcactttcccacaacaaatgcttgccaaattcgttttcttacaaattcgaaattttccataaaataattgtttttgaatttcctctcacaccaaaaaaatggaagaggaggagaggaaaagcgggggaagtcgctggagacggaggcgaaggcgcggacgcattttcagaataagtgccgggggaatcgacctccgcttggccattttctc

SEQ ID NO: 12766 - DNA, 1157 bp, Heterodera glycines
tttcaagcgacgatacggtagccgtacatttcgtcctttgctttttaacggtgcttttcagggttttacattctccaggcttacgttccaacgtgggtcttctgctgaattattttttattccgcttttatttaagttatttgaccatcatcgtttcttgggtcggcttttgcatgggtctgtattttcttttttttgcaatttctctatttgtgcatttttattttttaaatcaattgtcattttagaaccgaaggcactcccggcacggacaacggtgtgtgccaattcccgcccccccccccccccttttgacatttcccttttctaaggtcggcgtttcctctctccttgcgcttactctgcaagtacgaaaatcaccagtcaaattgttaaactttgttgttctgttgctgttgtttcagttcggcaacattcacaaaaaccttccccgtgtttcttatgtgaaagcgatggatgtttggatgttgggatgcatttcctttgttttcggcacaatgatcgaattggccgtcgtctgttacatcaccaggcaattcactcttcttcttctcctgttggattttccattgttctcataattcaaataggcgtcaaaatataaaccgttcgagacttggggggccgcgaaggtcgtcgagtcgcggcgattccctctcggcgttctcccaaaatttggcccactccaatcgccgctctttcgctttcggcgacggaccatcgccgacgtgggaaagcaatcagcagaaatgtcagcgttaattggttgtttgtttgtttacattcgctttagtgagttgctgctctgaggcgactttattccgactgatgcccacgcaaaaggggggccaaccgaacactttgagaacgcacgcggtgcccttccgaaacggcacaattccgaacagtgccaacggcggcggaacggtgcggagacaaatgtccaactcatcaaattgtggtaggaagaaaaacgacaaagcaaaattaatgagaaaattggcaaaggaatgtttccaattgcgagacgaaggccaaagcggcgcagcgataatttcgacgagcgctttcaagcggaagacgaaccattgaataggccaatgcaaaacgatggcacgccaatggaggcggaggac

SEQ ID NO: 12767 - DNA, 2263 bp, Heterodera glycines
  misc_feature (511)..(511): n is a, c, g, or t
  misc_feature (1482)..(1482): n is a, c, g, or t
gcaataaatctttaaattttttggccatcggtcaaagcgaatcacagatttcctttccaaacgcttcaagacctactgaagggagtgggaaaatcccctggagttcatcttcgccaaatgcagggtgtattctgttgaggaacgttcagttgcggtgccatcgtgttggtgcgttgtgagccgactgactgtgtcgatgctttgctcacgccagtgcctttggttgtccccgttgttggattcacaatttgatccgtcaaagtcgtgatttgtgcctgtaaagttgaaatatttaaattaatatcagctgcattattattaattgcctcagtgttttgattagtgcgcctatttaatgtcctaactgctcggttcattccgtcttctaaccttaagacatccagatgggctctttcaacgtcattcactttcacttgggttttgccaacccaaaaattccgatcaatgaccgaaatgcttaggtcattttggtctccgccgcccccccccncccgccatttcgcagtctttcccccggttgatcccttctccgatgccaatgccttcggtcgatcgtcctccgcggccatcactgatcagcaagtggcgatcgatcggtgacgaggaggaaaatcgaccaatcattcagccggaaagcatcgacaagtgccttttgccaaatgcgttctgctgatttcgctcgctttcccttcagattttccattgtcgtcttccctttgactttcactcttttcaatgtgatcactgatcactcccccccttaaattactgccctttctctgttcagctgatctactggtgctattatttgtccctcggcggtcaattcgattggcaaagcaatggcactttaatggctcagcaaaatggtcatccgatcgagcattagcaccgatcagacaaagcgattagccccacttttacgatcgtatcttttagagttctaatcccaatcattttgcaattaattgttttgttttttcattatttattgaaacagtaaaatgcattaatcaatcagacattctgtaaattgatttatagacagcagaaagacaagcaaattaaaattgaattcaaatggaaatgcactaattacagtatcccgcttgccgtcgtttactgtttttagggcggtcgttgttttggtgcatgcggctgggaactggcaacattttgcagctgctgttgctcagtttgggctgtttgctcctccccaagcgatgccatcgtcgggagcggcacagtgcccgcttttgccaattggtagcatgaacaggagatgatggagacagtgtcattcggctgttgctgttgtgagttttgccccgccatataaaatggtgccagccgattggtgctggccccggccacggggtgccgacgacgccgtggcaacgacccatccaaagggtcgtcgtccgctgctccgcttggcgtcggagacggggaagaggaggngctggaggaagagtaggaggacgaggaacggcccttcagataatggcgccggccctggagactgtcgatgggcgcctgtgttgggacaacgacgcgtttggtcagctttatcttttgccgtcatttaccaatccctttgctgccagccgcgcctcccttttgtctctcctttcgtcttcggtgtttaaagtcagaaatcggagcaccaacagattcattgctgccgaaatcacctgtcattaacttttttatttacgcattttggcccaaaaattcatacggtaaggccaaaaacgatgaaaatcagtgagaaaatcacatattctggcctcttttcgagtgcaccgtccttttggagggcgacaaagtcgccaaaaccaatggtaaccaaagtgatgaagcagtaatagacggaatcgaagtaggacctaacaaattagcaaaagtaatgggggggggggggagagggactgacaaatgagtgaatggcaaaaatcaaaaacaaaaccaattttcatagtgcgaaaagacccaagcgccggtggcaatgcaagcggtgcttagcaaagagcaaacgacgattaaatccatgggggagacgagggggggacgacgaagcagcagcttaagccgtttgagcagaatggagcagaaagtgtttagacgttcaccgattgattggaacattaccaaaccctaaaaaaggggggggggaggaattgaaggaaatatttacaagattggacaaaggccgtctcttaaagtcttggctccattaatt

SEQ ID NO: 12768 - DNA, 1214 bp, Heterodera glycines
  misc_feature (1195)..(1195): n is a, c, g, or t
tgttttaggcgtattttcacgtgtcttctgcattcccctacttgttactattagattaacaataagatgtgttttcatcttttacacgtacgcttgttgtactaatatagtcacttgtttatgtttttatgtttcgccaacttatttattgaattttccagttttgtgaatttgcaatatcaattattttatatgtctatgtttacatgtatttttatcgtttcttttacgtgtttatttgttctatttgcacgtcttttttctgcgttcaatatgatttactacttgactaacaaaaaatgtgtatttactatgttttacacgtgcgctttgttatacaatactaacatgttttaacgtttttttttaaatttcatcttattcattttattattatatacggtatatgtattttgctcacatagttatttaaatattttctatacgtgaataaattttgtcattagtttacgtgtttgttccgcatacctatcttgttttcacgtgttgttatgcgttccaaagtattttacaattcagcataacatgtatttcacgtatttttactgcttgtttatttattatttgacgtctttcattcacaatgtttattgcactaacaaattttttcacacgtctttttctcacttgttttgcgtgtttgtctgcttaaatgtgttttccatgtcctcttttcaggtccccactatattaagttaataatatatattgtatatttgcgtatttttacttctgctcatatatttttaagtatcctctcattcaatgtattttacatgttcccccattctgtttttgcgtgtacttcattgcccaatgtttttacacaacacgtccgctgtcctatatatgtgtgttttatatgtttcccatttatgtgtagttccttctcaagtgtttttaccgtgtcccgacatttgcggaatgctagtgatttgagccacattgattaaatgatggtggattgggcagaaaattgtggaggggctgaacggcccagtacgaggccgcgaagcggccgagcgagtacctttgacgcaaaagttcaacagcccaaggaacacaaaaaggtagaaatgctaaagaaatttgctgaggttgagtcccagtgtttgtaatgccggagatttgagtcccagagattgaaatgctgctgggtttagtttctgtgacngcaatgttattgagagttg

SEQ ID NO: 12769 - DNA, 2691 bp, Heterodera glycines
  misc_feature (2643)..(2643): n is a, c, g, or t
ccgtcacatgcttcggccgttttgccaacggcacaaatgaacatcgcgcaaaatggcgccgccggattgtgtcaaatgctttgatgttccaccgcccggcttccatcattccttggcattggcaaatccgctatcgccatccctcttatcccagtcttggtcaattggtacaaatggaagactataaaaaacaatgatcagctttttaataatcaaaaatgggtcgttcaccttaaactatttttatttagcagcaatatcatcatcattatcatcatcataaccacattctttcggtgtcccccgcaaatggacggcacacaaacccatttcctttggtgcaaacgaacagacagaatcatgcctataaagttggttataattatgaaataaatgaaatttacattaatattttcttaattatttttatggccatctaaaaattaaaattggtttttttttgatttgcgatgcttttttgaatattgtccttgaatttcacaaatttgtcttgtttttcattgacaatgaaacctttttttattaggcggagataaatcgaattttttgactgatcaaaaaatgaaatcgtaaaaaaaaatcattggccaaaaataccttgaaaaatccccaatcattattttggaaaataaattaccagccactaattaatcatccacatttctttgtaacaattttccaggtgacggtccgactgagcaaagatggaactgagctcaccgcgcttggcccaacattgacgacggccaagcagaaggcggccactttggcactggcacatcttcgtcccgagttggagcagttgaaacgcttgttgaaggaggcggagggcacagcggaagaagaacaaattgtgccaaaattggtgaccaaaaatgatggcacagaacaacgcagcaacaaaggcaacatttgttggattgtgatgccgtaccaaaatgccatcgttcattttcatcatcaccgactgatcaaatggatcaacagcaacagtatgattcgcccctctccccctttctctctctctctccatctctctttctctttccttccgtctctctctctcaccatctctttctctctccccccctttctctttctctctctctctctctctctctctctttttctctctttatttcttcccctcttttctcctctttctctctctcccgccctctctttctctcttctctcgcgcactctctctctctctctttcttcccctctttcctcctctttctctctctctcatgccaattttcattcagccaatgccgcagccgggcaatcatcaatcatgaccactaccaatagcacggagaacaactacaataccaatgctgattttgcgctgccatcaacgcccgaaaatatgcaaatgccaatcatcgacatgtttgttgtgccacccgaggagcctgacatcgtcgaggctgacaacaatgacaatgctagccaatggaacaacaacaacagcaacaatccgatcatcaatcagtgccaaacaatattcatggaaaaacaatggcaccagcaggatgatgaggaggaggaggaacagaacggcagcatcgtcgctggccgtggtggggaatggcaccacaaagcaacggagcaattagcacaaatgccgcaaaaacagcgacaagcggttccaaaggcgttgggacgttcgccgacgtggagcagcagtgcttttcgtcaacaacaattgatgaacaacatcaacagtttatgcagcaacaacaacaacggtgtacccatgaggcggcacaacgggaaaacagcgacagcaccgacaaagtgttgttgaacaacgataatgattatcagcgcttaaattgggtcaatccgccgtacttggaagtatacaacaaaattgtttatttattaaaatatattttcaaatattaaaaaaattaactaattaagaataaaagtatatttgtaatgttaaattttatgtcgattttctctgagaattttattaaaaattctttaaaaaaaactaccatacttactgaaaattagaacccctggggttctattttccaacccccaaagggagggggtctaatccagtaattaggctatatcaaattgaaaaaatttattaaaaatttattttttttaaaatttgtttttgtaaatttattattttcttcaataccctgtagatggaagaggaacaagctgattctttgcatgggcaacatggttatgttacacaccaccttcagtgcgcgcgtgtccgccgcccggcgcgtcggagtccgccgactcggtggcgccgctgaagtccgaactgtgcacaaagcccaggcgtcgtctgcgaccgtctaggtgtgtgtgtgtgtgtgtcgcgtcgtggaaaatgccggaagcagctcgtttccttcccccacccccggttgtttcccctcatatcattcccccacccactcgaaaattaaaaacaaatttttcaaaaaatcgaaatttttttatgagagaatatcaagaaaaaaaattaaaaaatttttagcgatttcaacccaacattttccagcttaattttttataaatcttttttattttaaaaaaaaaaaagtttgaaatttcggtctggcagaatttcgnctgcgacaagaaccgctcttttagaaaaaaatagcaaattctatttca

SEQ ID NO: 12770 - DNA, 3332 bp, Heterodera glycines
ccctcctcttcctcctcctcatcctcctccggaacgtcctccattcctagtaccattgccacgcagaatgtttggacatggggtgggtcgtcgcgtcagctaattgtttttattttttaattatttgtttaaaatctgttttgtacaatttgttgactggtcccctgtaccattgatggatcaagcccattgacggctctcaccacccacccaccaccaccaccaccaccacttcgaccagaagtcgaaagtatgcccggagcagcttcttcctttattattattattattattattaatattattgataatacattttctccaattagcctaaacatatcatccgtttgctgagccggttggccctgttgtgtttgaagcacaggtggcggtgcttgtggcatttgaaccaaaaatgactcaaattgtgccgttggcatttgtacattcattggcaaagtttgctgctgggcagcgggctgaaccggtggctgtagctgaatttgctgttgctgctgttgatttggcacagtttgctggggggaggggggggggggggtactcaattcgtacaaaggctagtacatcggcaattctcagtgatcaaataccatacaaattttttttaaaatgtcttttttaaaaaaaaatttttgaaattggaaaataatcttttttaagaaaataaaaaaactgaaaattatactttaagaaaaaaattaaattaaattttttttgtgtaagagttgcctttgtacaagttgtcacaacattctactacaacaccatctgctgctggtgctgctgctgctgctgaaccggcaatgtgtgattcaacagaataggcattgtgttttgccacaccgtcgcttgctgctgtgttggttgctcctgctgaaccgaaacgggttgcagctgcgttggcatcgtttgctggaccgaaactggttgcagctgagctggcatagcctgctgaaccgaaactggttgcagctgagctggcatagcctgctgaaccgaaactggttgcagctgagcaccaatagagcgaatgaacaaaggcacctgctgctgctgctgctttttttttttttaatatcccaaaagttataatccgatttttttgtactgccccaaacctgtatttttggtgcgaaaaaagggttaaacaatattacgattgtaattagtttttttactaaaattttgaaaaccaaagcattagtactgttgaatttaaaaaaatggggggggggggttcaaagggcagtacagtattttaaacagttttactggaggccgctgtactggtgcgtttgcattgacttgatttcgctgtgtttgccttccccgccgccaaaaaaataaaaaatttatttattattatattttttttcttattcaatcatatttttttataagatatgtcagaaaaatattaattgtcttttagaatttaaatttaaaaatttttaaacaatttaaaatttttaaattaaaaaaaaataaatgaataaaaccaccgtcttgggagaaaatgtccatggcgaggatcaacaagatgaggcggaggtggaggaaattgtactgtccccaaatactgctggtgtacaaatggccatgggacttgaaattaaataaattttaaaaaaatcccgggcctcattaacttttcttagttagacttataattttttcattaattctctttatggggggggggggataataatttaaaacaccttgcgcacgctggataggacgatgtagacgctgaaatgagtccaaaaatgattattcaagaataaaaacaaaactatgaaaagaaacgaaaaataatttcaaaattattaattcgatcgagaaatttttaaaaaaattaatttgtgcttttttcacctgttgtgccctccactgccttctgctgatgctatttggcaattcatcacgccaataccatggcatttttaattaggaaaagacagccaatttttttttcattaattgagaattgtttattttttatttttaaattaattttattttcattattattatttttaaattaattttattttcattattataagtctttttttattaattgagaattgtttattttatttttttaatttatttttttcttcattattataagtcatttttttattaattgagaattgtaatgattaaaaattaaaattaaaatatttagcaatacaattataaaattatatttttattatttatttgcttcaattaaaatattattgcgaatcgcctaataataaaattggccagaatgatttcgctcctcaataaataaacaatttctgctgatttcgtttttttaattttttttttacttgatcatttcatcaatcccccccccctccctttcaccccgaaaattgtttatgccctccaaaaaatatcgtttatgttttcctctccctcatctcaatccccgcatttagtcaaatcaatgtatttaaaacatacgccaataatgaccccatatggccaagtggttagtgcagtggatttgaattttccatcgggatttagccctttagacgcggtggtatttttgaagaatttttaaaattcgaagatttttaaatttaaataaatttcaaatattttaaaatataaaaaataagacgtttaattcatgaaaaaaattctcgcgcaaagttcaataatagaatggaataacgaaaaagatccaaccggaatggggggggggggcaataggtttgggacatagccagtaccttttggcttggactcaatcaatcaaatgattgattgggaaaaatcgataatttaagtatgaatatattctacttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaaagcttctcaaacaattttagcgcttccaattccttctacaatcgcctttatacatcccattatgagcgc

SEQ ID NO: 12771 - DNA, 1652 bp, Heterodera glycines
  misc_feature (46)..(46): n is a, c, g, or t
  misc_feature (101)..(101): n is a, c, g, or t
  misc_feature (104)..(104): n is a, c, g, or t
  misc_feature (111)..(112): n is a, c, g, or t
  misc_feature (114)..(114): n is a, c, g, or t
  misc_feature (140)..(140): n is a, c, g, or t
  misc_feature (147)..(147): n is a, c, g, or t
  misc_feature (157)..(157): n is a, c, g, or t
  misc_feature (179)..(179): n is a, c, g, or t
  misc_feature (198)..(198): n is a, c, g, or t
cgcttacgaagattttttttgagtggaaaagttttaaaaaagtatnccaaaatatatgcattaatgttcccttaaaaaaaatattttttgttttttctgcncanaatgctnngnaatacgggcggatgcatttatagttntaagctntcttaattanagccatggatttaattcctttngaaaaggcgtgaaacaatntaaagctttttcaggctccctttttaagttcattttccgtccgcgtgcaagctatcccgacgggagtaaatcattcttttagtttccgagcgattaatgggtactgtaaatctgtagcctgcaaaccggtgaaaacgcacaaatttaagcttcacggaattaaaaatttgtcgcagcattgaaaaaaatttattgcattcactttaaataaggaaaattaaaatttttttcgacttttgtctgtaagtcctggtatttttttgttaaaaaattgaaaagtggcaatcgaaactgggtcgaaaaaggcctgtattttggacactttctataaattttgaaaatccaagattgtcatacaaattgaattttaataattagatagtaacgagaatggacctaacttttctaaaaaaatttattgaaactttatcaaaataattttttgaattggcgatgcacattccactttgaaatggcacagagacgattacagtggtatttagcgacgatgccatcgtctttgctcggggttgtgctatcgggagaaatatgttgattttattcagaaaagattgatcctttttcagtactatttgcatgttacatttcgcttacgaagattttttttggagtggaaagtttttaaaaagtatccaaaaatatatgcattaattgttccctttaaaaaaatatttttttgttttttctgcccaaaattgcttggaattacgggcggattgcattatagttttaagctttcttaattaaagccattggattaattccttttgaaaaggcgtgaaacaatttaaagctttttcaggctccctttttaagttcattttccgtccgcgtgcaagctatcccgacgggagtaaatcattcttttagtttccgagcgattactgggtactgtaaatctgtagcctgcaaaccggtgaaaacgcacaaatttaagcttcacggaattaaaaatttgtcgcagcattgaaaaaaaatttattgcattcactttaaataaggaaaattaaaatttttttcgacttttgtctgtaagtcctggtatttttttgttaaaaaattgaaaagtggcaatcgaaaacagggtcgaaaaaggcctgtattttggacactttctataaattttgaaaatccaagattgtcatacaaattgaattttaataattagatagtaacgagaatggacctaacttttctaaaaaaatttattgaaactttatcaaaataattttttgaattggcgatgcacattccactctgaaatggcacagagacgattacagtggtatttagcgacgatgccatcgtctttgctcggggttgtgctatcgggagaaatatgttgattttattcagaaaagattgatcctttttcagtactatttgcatgttacatttcgcttacgaagattttttttggagtggaaagtttt

SEQ ID NO: 12772 - DNA, 3552 bp, Heterodera glycines
tgaatgtgagccgctcgattatttgcgcacaattagccattacttaccgtattaattttttttacaaattcaacttttcaaaattaaattaagaaaaatattttcgattttttaaaaaattgcttcctggtgcccaaacttcccggtgcccaaacttcctggtgcccaaacttcccggtgcccaaaactactcaacatggaagaaaatatttttaattactttataggtgtagagaaaaacctaaactaacgacaagctttgagctattaagtcaatattaataaatatataatgaagaacccatggattaatttttgtaccatgcactaactcaatcctagatcaaagttgcatatgatactaatatttatccagcccatataaaatttactgacaaaatttttcccccaaaaaaaatcctgttgaaaaacctttgctttttggtctgaaggagatagttgttaaataaatataacaaataaaaatttagagaaattaatcttttataacaagaaagtaaaataaatgaatctttttgaataaataaaaatactaaccagcataaagattttatttaaaaaaagccaagtttctgattaataaatggaatacaaaaatagtcttcaaataatgagaaacaactaaatttataaattatatttaaatgaattattaagagcattaattaaaacttgaaataaaatttagatttaacataatcaaaaaatcaatcgtgctattaaaagaaatcaaatctaattcaaaatgcaaaggattaaagaaagaaattattatatacttaattaatgaaaaaacataaataaaaataatttttttcattaagacctttcattaatattaataatgctaatataaccttggtgattaataattttattgagactatttccctattcaagaaccagggccccaaggggcaatactgtctaatgttcggacgggtgttcggatgggtgttcagatgggcatgccaatgcggatatcggatggggtaaattcaccgatagtcggggaaaaggtgaaaactgaaatagtgtgagagggggtgcgaaagacatgcaaaattgtggagaaaatgttggcgaaagaagcaagagtgttggccaagagagtggcagtgccggtgcaggcaattccatcacccttgcctccttttcaacccatcacttttcttctccagttctccacttccttatatataaagcagcattgttttttacaaaacaattaccctcggacaggcacaccggatgccgccgacttgttccttttgccatcctcggctgactaaaaggagaagcagagcaaatacgggttatacatacataaatatacaagaccgtttgctgacttgtctgagggtacatttttttacatttttgcataaataaaaaatcagaattcactggtgttgctcgctgttctattttttcaattttttatactttttatttatgaaaaatttaaaaaatagaacagcaaacggcaccattgaattctgattcactgattccaatacccaacattgtgtgggcctccatcagctgctcctgatggaagcaccagcaccctggaaggctttcgccgcaccggtgccgccgcccgatatgcagaagacacatctcctttatatataagggaatgtgaattaggagaaaaaatgtgatgggttgaaaggggggaaaggaggagcgggcaatttcctccggcaatttcctcgcctccaaaggtatatattttagcctaatatttcagacttgttttcactcaaatcacacaaattgtttcgcagaaaaatttattgcataaaagaaacgacaaaaaaaccacccattctggtatatttaatttacattctcatggccctaaagagggccatttgggataaagggtaccctcctttttgagggaccctgggtttgtcaaaaaaatttttcaatgcccgtcccagtgggggacagccgcaagccaacaagcagtttgtggggtcaggatggatagtttaaaataaaaaaagaaaaacaaataaatgaaaaaacaaataaaatggttataaaatagttgaagatcagacgaaaatctaaataaaaaaacaaaaaaatgggagggggagaaagaatacaaccacccctcgacaacagccggcagcaaccgcccacggctagtagtggacgcaatcaacggctccggatccttggagagcttgccgttgttgtcctccgcccacaggctcgtgtccccatcggcattaggcccatagagctgattaaaaaaaccgaagggccggtagtcccatccggcaatgccgacgccgccaccgcaaccgcccgcaccgccgccactgtgcatggccatgcccacccaggcgcccctctggtggcgctgcacagttttgttcatggaactgtttttaaaaattagactttaaaaagtgaaaaaaaccaaaattccatgaattcggtccgaagcttcccaagtgggcagcggcgccactggtggccatcaccgcagacgaagcagaggaaccgcccgccgccgacctgctccgggaacaccggtgcctttcccaaataggcaaccgcccagtgtactaaagggaggttaattttaaaaaatattaaaaaaaaattctcgccacccactccccgttccctccccattcacactttcaccaagcacccagcaccatgcagctgtccgggcggtgcccaatgccatgacaagcatggcaggccactcgcttaacaataaatttcagtaatttatttattaaattttaaagcaaaaaaaaaccgtctcgccctggtcgtcaccaaaacggtacacaacgcattgcgagggcttgtgcccaggccatttgcaaagcccacaaagcatttggggacaaaaaggaagaagaagaatagcaaaaagcaaaagctattctaaaaaacaatttaaaaaatggaaaagcattaatttaatataacatacatgtaaaaaaatgtataaaacaaaaaaatatagaaaggaaattttataataaataattttttggcgttatgtttagttttcaaatttgttactaattttttggcgtctttttcaataataaatagaaaaacatataatactcgcattgtcctgggctgttgccatgcggttatttaccttcaccagccccattaatgaacaatttttagcgttaaaatggttcaaagcttctatttaacgaatctcatcaacgacttaatggctgactaggtccagaacaatctggaccggtacaatcagtacctgacggactctgagccgagaaaggcgcgagtcaacaagcgcaagatcggaagaaacctgaaggatggggatgtgcgcgactactccccagaatcccgggcggctgcggaatggttggtggcaaacccctggccaccagcggaagcattccgccacaaattgttcaaaacaagtaagctcaattaagtatgtgccaataaaggtatcaaatataccgtttaataagcttcaattcagtttggcactttgcaagg

SEQ ID NO: 12773 - DNA, 2906 bp, Heterodera glycines
  misc_feature (2873)..(2873): n is a, c, g, or t
tttattaattttaaagcaaaaaaaaccgtctcgccctggtcgtcaccaaaacggtacacaacgcattgcgagggcttgtgcccaggccatttgcaaagcccacaaagcatttggggacaaaaaggaagaagaagaatagcaaaaagcaaaagctattctaaaaaacaatttaaaaaatggaaaagcattaatttaatataacatacatgtaaaaaaatgtataaaacaaaaaaatatagaaaggaaattttataataaataattttttgacgttatgtttagttttcaaatttgttactaattttttggcgtctttttcaataataaatagaaaaacctataatactcgcattgtcctgggctgttgccatgaggttatttaccttcaccagccccattaatgaacaatttttagcgttaaaatggttcaaagcttctatttaacgaatctcatcaacgccttaatggctgactaggtccagtacaatctggaccggtacaatcagtacctgacggactctgagccgagaaaggcgcgagtcaacaagcgcaagatcggaagaaacctgaaggaaggggatgtgcgcgactactccccagaatcccgggcggctgcggaatgttggtggcaaacccctggccaccagcggaagcctgccgccacaaattgttcaaaacaagtaagctcaattaagtatgtgccaataaaggtatcaaatataccgtttaataagcttcaattcagtttggcactttgcaaggggcgccggcgtctacgcattaacataagattatttatagaaataatatcaaaagcgagaaatataaaaatttaattcttaacaagcaaattaacaattgaaaaatttaataaccaaaggaataaacaaaatggctcaggcatggtacgctgataaaattaggataaaataatacaattcggaatgaaaaaaggctaaaattattaagacaatttttaataattatggatatttaaatatcaaaatgttaatattatacagggacagaaaaacacagatgccataaatattaattacaaaatgataaatgaagaattattttagcaaagaaacattaaaacgaaaaatattttcgtgaatgacaagcaaaaactagaaactttgatcgagaggtgagctcgttgccattatatgcaaaaaaatattatacaaaaattttacgataacagaaaaaattttaaatattaataaagaatatgaattttgtcaaaagcatttttattgtcaaaattcgacaattggatgatgaaaaattatgaaatttatcccattcataaagaaaataaaagttaatgaatgaataagtaatgtgaataaatcttaataataagtaccatgagataaaaaaaagtactaaataatgaaaagtttatatttataaaaataaattcttttattctgttgattataaaaattatgtaaataatattttggttttatagtgtattgttttaaattattctaattaaaaatattgttttaaattttttcaattcaaaatgttataagatattcccaagaactgatattattcgtagttttgactgtataatcgtcataaatattataaaattaacaaaatacctttttataatagttaaaaaattatattttaggatataattatagttaatgttttttttatataatttttttaccttttcatatgtaataattcgcattgtattattttgaataattgtttttttattttatttatgattgaggaatgaaaatcttttaattgaccaattgaattttattttaaaatttcatccccatgttgtttttaaaattttattataataataatcgtaaattaggcacattacagataatttgtacagaatttgttataaatgctagaacattttttgtgttcattatattgaaaatgtttggaattgtttttcaattttaaaattttttttcctatattattcgcttattcattaatgcaaaaatggattgaccactaaattttctaaacttttaagaattgttgcgcattttaaaaagcattttttagatataattaataaatttattttatggttaataatgtattgcattttttggttaattaatattcaattaatcacatataccgattaaggcatatttcaaaatttgtttttttactatatcgatcacttatagttttacaatataacatttaattatttgttattaatttattttatttcttgcttcattagaagtgtccaatttttaaaattgcttttttccattttgaattttatcttatttattttttgggttatccgtataattatttgcgaaagttcaaatgaatattattattttaatttgtatatttagttagctaaaaggtaagattttttattatttagcttaaggtcaatgctttactttaatcttatcttttttaatcgtcaatggcatttccaagtcatttatcgctgccattcgtactatttaatatcagttttatgatttcttattatgtaaattaaattattaattttattatatatttttagattatgaccttatcttgtggcattcattgttttggaaattaactgataaatttcgtaaaacgaatttacaaatcaggcatttaataaatgataagcaaacaccaaattaggtaaactaggtgaaagttcattaagctaatgtttcgttttaatttcgtagatcagcgaaaattaacttttataaacaaaagctaattttaccaaatttgaaaaaaaaattccgacatcaccaatcaacatgtgaacaaattttcttaatttataaaaaatactcgtcaggtaagaagaatttgttttttaaacccanaaagttgatctttaagggtatattttaatagca

SEQ ID NO: 12774 - DNA, 2131 bp, Heterodera glycines
cccccgctaggtagtacgaatatgttatgaacaattccctacataggaaaggataattatgaaataaaaaggaatgacttcctttgaattgtgttcgtactgtcttgagcaacccaaagaacaacagatttttcgaacaaaatcaattctaatactatactaaatctaaatccaaagctagtctaacacattatctaatcactgttatctaatagctctctgtaaacaacattcttcacctttctctctaaattgccatcatctaatctaattctcaacttattccaagctcttgctctcgaaagagccacatacaattgtccatggctaaacacatctttcctaagatcaattccaacttgctcaagggtttgaccttgggccttattaattgtcattgcaaaagctaacaccaacgggaattggtgcctatgcaggtcaaaagggtaatcttcagaacaacaaagcgtgatccgaggaatgtacacagtctgacctgccttgtctccagtcaaaatcttacacacaatcaaattcggttgcatttgctcaacgttcattctcgcaccattacaaaggcccatttcgatattcaaattccgcattaacaaaacaatagcattcttcttaagtctcaatttatgccgtggaaaccccgaagggtttaaagcattcaaatactcatccaaatagtcatctgctctttgtctattctcatcttgagccaagtctatactcgtatatacaacttcttctccaggcaacatttctaaaactattattcattttactaacatcaacattctttggtgctaaaatggcacttttggccatttcattccaattttcagaaacaatactcaactttattatataggattatgaattcccgaatttatcatatcatatatactttcttaaccattattaatctagtaattgtaaagcttatggcgtcgaagttgttgtttcggcaagttggtccatgttctggtgaatgttttgccccaaaatgggttcagttcagttatttgaagcaaagtcattcacttacacctatttgctgggatgcacaaagacgagacaggctctggtcatcgatccagtgatcgaaacggttgagagggatgcctcagtacgtattttaattagaaaatttatctgttttatggcttaattattttcagttagtccacgagttgggactcgaccttaaatatgtggtcaacacacacatccatgcagaccatgtgacgggttctggcgaactcaagcgcaacaaatactttccaaaagcaatttcgattttatctggaaaagcgggtggaagggctgatttgcttgtcaaacactccgatttaattcgttggggggatggactcgaattggaagtcagagaaacgcccggacacacaaatggtaacaaagatttttaaagaatgggataaacaatctgatttcgaagttttgtcccaagtttgtctagatatgttatatttgtttttttggcgagttaaatttttctaatttgtaggacaaaccgaactgtaatcattattaattaatagccctgtttttaggctgtgttacttttgtatgccattccaaccaaatggcattcactggcgatgctcttttgatcagaggctgtggaaggactgactttcagcatgttgagtttgtgaatctgctcattgatatttgtgcaaataatttcaggaaacgctcggactcttttccgatctgtgaaatcgcaaattttcactcttccccccgattatcttatctatccggcgcatggtaaactaaattaatgttgaataaagtatctttttagattatgccggcagaatggtttcatcggtttgggaagaaaagaaattcaatccccgtcttacaaaatcggaggaagaatttgcggcgataatggaaaaccttgggttgccttatcccaaacaaatcggtacctttgtgtaaaatataggtcatttggtcaaaattccgacttctttatcttccacaaaatataacaaacaaattttaaaaaggactttttagagaaatctgagccggccaatttgctttgtgggatttccgaattgatggacgatgcgttgagaaggaaagtttt

SEQ ID NO: 12775 - DNA, 3027 bp, Heterodera glycines
atggtttgggtgttcgcaccgaaagagggtcatttaatcatgggcaactggagaacgtcgtagctattttgccatacattaattttactcaacttttattgttccaaactcatttttgagataaaaaatcaaaatcgaggtcaaatcgatgaagtgttagaggtttttggtctatttcaattcaggaattttattattttatggacatgaattacgaacttagaacaattcttaattttaattttttctaactcattttttacaaattttttctcgccgtatcgtcttttatttatcactttttgtaggtctttaaattttgccatcctacagcaaattccattccttctcgtcttttggtcatttgcatagaaaatgtcttataatttcgctgggcttaaggaggcattttcggctgtcgtgaaaagcactgcaacaataaacgaaaacgaaaaaacttcatcgtcgaaaaacgaaggagcagaagcggaggaaggggaggaggaggacagttttttggtgtgctatttttgccggtagagtccagccgattgattggagtccattcgatcgatccaaaattcacaaatgctttagtcttcttttgtttgtttaattaactgtgggatttctaatcttgtgggagtatgtatctcatcattttttcatcagcgtcgtcttcatttccattcggcccttctcagtgaaaatgtcgccgattctccgcctaacaatgatcatttttcggtgttttcatcctccactaattgtgtcagcgaatttgggactgtcacggccgaaaatggacagaaaatgcaaaagttctgcgattttgtcgtttttctttttactttttcaatttagcggttacgacaatcgaataacaattgaactttcgtctgcgtctgtcgccaaattgagtggacttttcggtgaaatctgttagctttttgagattataaattctccttttgctttaaggtgatggctcttcgtcgtccatcgaattcccttcatcggttgaagtgaatttgccgatttggctttgcgaatttctcttcaaagcaacgcaaaaaatgcctatttccaattcactgcgcgaaggtttgtgagagatgcgagggacggagagcgtttcaagacggtttcattcgcctctggtggaccccgaccactgaaaaatattattagagcccgtaatagaaccggatcatgtcaggttttttaggactcctgatcccgacccggataattttgaaatttgacccagatcaaagattctttagaatttgagcaacaaaatgattggctggcgtacgattttttgaattcaattcaaacgccgaataaaaattgtcagaaggaggcaaaaagtgtctctttgagacgcctttacgaaatgtttccgaagctgtcgaagaaagtcatcggtcgagtggccaaagaaatggagtgagtgccgacaatttgggggatggagacgaaatgcgagtcatccaattgtgaattttagcttcgactttgaacagactgcgatttatctgcttgactatcctgatgatcatccgactgacccatcaaatactgcggtaaaaccctcggtgattgtgccttcgcttcgtccccgagtgatttcggcagaggaacagcagcggacgaaagggacgacgaacgtggggaacaacagcaggaccaatttgctaatggtgtgaccaaagaggggggggggggatttgtattgtgaaacctaacgaaatatattgaaattatatcatacgaaaaggttacagattttgggacaatgtttaacatgacaaaaaagttcacaaaatcagacttgttgcaaaactcatttctcaccaattttagcttccccccgaaagttgggacactgaggtccaagacgtggagaaggaattgcgtaatatggcggcggaacagaaacactgcagagagatgcggaccaaatacgtcggcttcaaaaactccaacattttcggcttttactccgcacgggtaacaaattgtaatttgtgtaaatacaataaatgcaaaataaagtaccaattattctatggaaaaggcatgtcatcatctgctcttgtttaggccaatgaattggaattggccaaaaagacactgacgcaatattgggacagactgcgcatttggaggacatcgaacgaagaatgcatcgacctgcacgaaatgagtgcggaaagggcactttctgtggttgttgagaaaataaacatttgtcgaggcgagttaacgcaattttttggctttaaatccgtaaatatttctctgttttaacagaaaggcacccgaaccttggcaaactgtacgtgatcacgggttacggcaaaacgacgggaattgctgtgataaaaccaaaactgctcgcctttctcaacggcaaagggatcgagtgagtgccgtttatcggggggggggggagttggccacgcgaatttgttaatcgtacaaaattgtgggtagattgaacgtgtggaggggagggggtacgaaaaccgggcaaatctgtcattttaaacaacattttagggcacgagtgtctccgaaaaatgaaggcgttgtggagatcagtctcagaaatattttcagacgcatcgaataaccttaggccccggcaaagggaaaaacattggttgtattagtcgtacgattcgaattactcactttttctgtgccggtggtgcttttgccggggcctaaaattcaattccatccgattttgtgcccgtaacttttcttctactcatttggttgttgattttcgttagttaattaaaggccttccatttcttttttgcataaaaatcttagaatgaagatcaatttcttctttgaaaacccctggtaatgctcctttaaataaaccctaacccattatttcctcagttttccactcattccgtttacaattagtgtgatttgcctgagtttacttaaaatgtacaaattaaactgatcattcttttttttactatcttttctatcatt

SEQ ID NO: 12776 - DNA, 824 bp, Heterodera glycines
agtgatggaattgggatgacaatggcatatttttctctcccttgtggtgatcatcggcattgatcagacaagcgatccttggaaaccctgatcagtgccgaaatgcaaacggagtgatcaaaaacagtaggacaatggagtagagtcttaatttgaggaacttaaattaattagagttttaaattatttatttattttttttaacataattttggatttaaccgtttcaaaaagtaaacaaaaataattttttggaatttcactattataaaaaccatttgaaaatcgatcggctcttatgaaataattatgaaaatttgctatataaattaataattatttacacttccaattttataaaatgagattttgtttttaaaatttcctggcaaaattttctaaatccaaaatggggcattttagtaaaaaaaaaactttttacattttaatatcaaactaactacttaaaaataattttcaaaaatttttaaattaattacggggtcaattaaattttattacattattttatgcgctgtgcactggccaataaaaataatggtgatgatggttttgatgatgatgatatattcagcagacagcggacgggcgagcggaagaatggatggtcaatgaaggcatattatttcatgcaattagtagccaattaattaattgtccaccatttttggggcgggcgcgcgggcgaaatggccagccaaagtgtgtccaaatggggcgcgacgcggcgcggcgcggtggacaaacgcggcgcgccgccccgcattttattgttggcccccagcgccaaacgctaaagccaa

SEQ ID NO: 12777 - DNA, 3605 bp, Heterodera glycines
atgaattgtaatatgtgtagccatgctgagaaaacaaaatatctcaaatctctcagattttatgggataggattggattggattttgggagaggggataaaaaattgtagggacggaaaattaatttaccgcatttcctaaaatacagaccccccccccccacctaaattcgaacccaaccatgaaaataaagccgccaattctgagagggttgaaaaataaacccccgggggctctattttaggaaaaatgcgttataagggtaaattaactgtgaatttgagggtaattagttgatgaaatggatggggataaacaattaagagtttttatttgaggggcaaaggatggaaaattgagtcaaaactgtgaggaaaagtgtgccgccacaaatttgttacaaattacggtaattaaggatggaaaacaaattaattaattttatatgcgtaataataaggctaggatttatattaatgaaaaagcctgaaatatcgaaataagtcttttatggaaacttttggacaaaaaatagttcatcaccttgctgaagagtaaccaaaattgcaaatcttaataacatttgatatcccaaaatgttgtctaattagcctactgtaaaaccaaaaaaatggtaactttcaaaaatgttagggcagccagaataatacaaaaaatcagggattttcgaacttttcataacttttttttttcgaaacttaacgaaattttttgaattttggcaggataatagagcagaacatatttagggactatcaaaagatattaaaaattaaaaatttgttgattttagcaaaattataagcaaaaattttttattttggcggttttctgagtgacgtcataacaaatttcggttttgccattttcccatgttttttttttgtttgcctttacattctttttctctgatgaaatttgaaaatttctttgttatttttaccgttttccattttattttcaattatttaatttgtatgaatcatttctaattaattttttgtcgcttacattctgcgggaggagaagaagaagcagcaccactttttgtttgcttaacaatttatttatttaatttcttataaatataaaaatattttttccaaattaaaaaatgtattttattttatttatttattataaattttgctttaattaatgccttttttcatattttgttctttccgtttctaatttcggcatttttcgcgtttttgcaaattaaaatgaagttgcaaaaatatgccacatttactcaaatagagtcagtcgtccctcttaattactcaattagaccctcacccccagaaataaagcccccccccccccttttgagggggattgaaaaataaagtcccctggggctctattccagtaaatacggtataataaataaatataaattccggcattggtataaatttttgttgcgaatactcagcagaatttggaggaaaggagttgatgaaataaatgccaaggacaaaccattaaaaatttacacaaataaaattttttaaaactagaaaatggtgaaaaaatggcaaaaaaaataataatattggccgaaatgccaataatatttagaaaaattcgatttttaccaattttaattttctaaatttaattttcagatttaaaaactttgttcaagcatgaaaatgtgctgttatagctgctctagtaaatggatgtgctggtgcggctttcacgtgacaactgtgggccaaatattaattaattaataattaattaattaatgccaattaatgaatcattaacatttgattatattatttgtcatggctcattgcctaattgattaattaattaattttaattaattaattaagaaaatttgattaaattatttgtcatagttcactcgcctaattaattaaatcaaattaaaaaatgaatgaatgaattaattaatagctaattaatgactcattaaatttgcgtaagctctttgccagtgctgaccgcacgatttatttaattaattaatgcctacttaatgaatcactaaaatattgatttaattgtttgtcaagggctcacttgtcgtcgcgtggattaatgtgttggccggcatttatggctttctatctgccataaatttatttggttataacgttaacatattccacattattaatttgatttcggtaattcttattattttttttactaattttcttcaaataagaaaatctttaaaaaatttaatccctaaaaataaattaattaattaaatttgttttttcaaatatttcatttatccctttcttttaagagtattttgcttttgtgcggaagtgtgccgataattgttggcgaaatgcgtggaaaaagaaccagcaaaatgtatgactatttcttgtcattaccgtatgttttttttggcaatatttctggtcactaccgtatgttttttggcaataatttttaatttattaatttaatttaatattttcccctaaattttaggccatttctttggcattcatagcgcttgccgtaataattgctacagtaatactgtttacaatagaaacccgtaatttgaaattctgcaattaattattattaagtccatcaattaaagaattgtgccaaaagtttttatatattttttaaaaattttcgggaaaatttcgaaaataaattatacaatttttattaaccgccctaattattatatattttatatatatatattaataattaattaaagattattaggaataataattaccaaaatattataggtattcatgcttttgacttttattatttgtgggcttacagtttccccctaattatctcaatttggctttactcaattgtgtaccgggcgtacaaatttgttcaacaaaatgaggaacacaaaaacggtggacagtacggacagaatgtcaaacagtaccaacagaatgccaatgccaaagtgatttaatgattgaattttcaatttttaataaatttttgtggctcggtatgataaatgtttgattatgttatattaacatttatttttaataaattttattcaattttttattgttaaacttggcaacaaaaaattcaaattaaaattttggaatttttttgttatcaggttgacaaacggcactttaggtgtggaaaatttaacttaatttaaggaaatttagcaaagaaaacattttaaaaatctccgggatttgtgtaaattttcgcctagagataaaatgccaacaaaaaaaaatgtcaaacaattggttgaaggaatccaaaaataggatttaaattgaacactaaaattggaagaaaaataaataaaataaaatttgtattaatgcttcttagaactaaagaatcttaaaagaaggaaaaaaacggcaaaaaattaagacaaatattcgccgaaatgccaacaaatttaagtcgaaaaaactcaattttttttgccaggatttttttaaaagttggaatttaattactaaaaataaaaaataaatttttaatcatcccactcatttttctgtttgcaaaatttgttagaggacgtatttgtttgccttttttttctttccaaa

SEQ ID NO: 12778 - DNA, 2860 bp, Heterodera glycines
atattacacccctaagaataaggggatgaaattcccataaaattttcaaaatggacctataatttggctaattttcaatgaaaagctgtttaaaatgtcaaaatttccaatttttcgtccgacggcgcctatcggcaccgccgtgccccaaaaactcctatttttcttagaaaaatgacccaaaatagcaaaatttggtaatttttggtgaaaatcttataacaaattcgtgttaagacatttgcgacccggacatttgcgcctcagacattttcgcgtttttttgaaatttcgcctttcgcatttatttttatttcgtcttttctgctttcgcaaatttcgcgtttcgcattttatttttcgagttggcccatccctggtctttacagtatataagtatatagataatgtcacacacagtttccaatcagggctctaatattatccataaaaaacatttttttgacggttttttattcttttattccgtccgtgggcgagattataaaacgatggaactgaaaatacttgattttttaaaaatgatacaataaattgatttcttttttaaaaaagtactccataaatttaatttccttggcataaacccaaaattgatttttttttttttttaatagtttttaaatttaaatgtcctaatttgtaagcatatgcaatttatgttggtttttatgccatttggtgcaaattccatgcatttttgtccaaaaatgcctaataaaaattatttacattttttgcgatttttcttcccaataaatccgaacccaaatccgccgttgcattggtccacctgcttaataaaaaatgcttaataaatgtaataataaacagaattgttgccactatggatgagtctcgcgcggcttttttttgaaattgcatgaaatttgacaccatcgctaattgctaatgatgatgataatgatatgcgtggcaaaatgggctaagcattcgcgcatactaatttttttttttatatgatatgtgtgcattgtgataaacgccacgccaagaagcaaacgcccacaacaaaaaaatcgtgatggcgggacaccacccacccaccaattagccgccgggaaccaccactatttaccctcattagcggcagcggcaaaggataagatgtagcagaacgagtattttttgttgttcgtctcgtgtggttcccagtgattgttgcggtttcgtcggcgctctttgtccgcaccgcgccgcacgaatttaattgtgcgtgaaaaattgttggcgtttttctttgatgaaccaaccagttgttgactcttgagagagagagagaggagagttaattaccataattattgtatggaatgcggcgatttgttggcatcttcagcagcgggtggcgtatgagtttatcatgcacataaatgtgagcacagcagaggagagagcttgtttctcgactataaattaattagctgtgtgatggatgatgatcatccatcccggcgcaacaaaaaatacaattaaggaatgcacttagcggttcattagccacacaaatattgttgcaaagtggttgcttgctttttagtggtagggggtattttttcaaaaaattattaatttttacacagtatttattgaattagaacccccgggggctctatttttcaatccttctaattactcaggggggacttcatttttcaaactcctccgaaaggaggctttgtttcagggggggggggggggttctaattcagtaaatacggtattttaccgcggaggccaaaaaatagagcaatttatggcctcaagtttaataaaatttttacattggggcttttgacaaatgcttcgcaacaaaaattttttcaaaatttacaagaaaacagtgccagaggcgttgtcttgaaggccaaaaaaaatgacgacggatttgagggcatttgtaatttaaaaaacgctgagataattcaaatacataattagatttatttatttagtataaattttatacataactccaattaaacaattattattttttgatcagttattatgcatatttgtaacggcaaggacggattggcactttctctctctctcactctctctgatcaatcgatggatcgttccgctccctcgtcctccgcgcagctcattttgttggcacttttggtgggggctcactgaagatgttcgccgggctcggcttcacccatccgccaaatgtgcgttccaattcctgggccgccgcgatcagaagcgcctcgttgaatggcgcggccataagctggacgccctccggcatgttggttttccgattcttgtacattggcgcggccagcgcggggaagccgagcacattggcaatctaaggcggcactttgtttgaccaacaataatgccattatcttgtcttggccttggcacccgaaaaaattcacggtaaagaccaaagaagatattggaacacgttcaaggttttggtattggtccaaagtcttggccatggttttggtcttggtacacaaaaatgcccacatcgattcattgttggcaaattttgtacaaaatcatggccttggcgcctatggcctcctctaccatggtgtatttgatgttgaacacagcaaacggctcctggtgatggaatggcactgttgttggccaaaccgggctcaccaacagaccatttttgccaagcaaattggccacctgtttgcgcagcttctccttcttcagcaacacctaaatgcagcaggaaaaaaaaaattacgctggataattttttttttttttgtaattttccatttttcatcaattttttatataaggacgaattaaattttcgttaaatttttaa

SEQ ID NO: 12779 - DNA, 1763 bp, Heterodera glycines
gtgcccctgtcctgatttgaaaaattttcgatggaagccttgctttaaggacgaatttaattttttggtaaaaaaaattttagttattatccatttttcgtaaaaaatctctgattttagggtcgaatttaccgtgcaattaattaatttccatttttcattaattttatgttttacgtaatttttagttttaggcggggggacattttcattttcttccacgtaaaatgcaaattatttttgaaatattaattttttaaatgattttattttaatgtttaaaatgttgtttaaataaatggcattttaatttttaaatcctcacaaattcccgctcgttttctgatttcggcgcaacaaatcgcttcagcagctcaatttgcaggccgagatgggtggcattggccacacccgcttgaatgtcataataagtctgtcgcagctcttcgtaggactggagataaaattaagaaattttacaatttaaaaaattatttttatttttttgaaaattttgcacaattttcgtatcatatttcattaaatttcccccgccggacccaattttaacttattttttaaaattttaacccaaaattgcaaaaaatttaacatttattggcacaaacaaaatggctttttttgtttttttgcattctctggcgcttaaaatttaaaaaataacactagagaaaaaatttttggcccggagagcaaaaaaaaaaaaaatcttcggattcccccctccttaaatttctcctgagaatttttgaattgctaagaaaaaatgcatcaaaaaattttaaattaactaactcccgagccgagaattcttgagtcccgggttaattttaaaaaaaacatagaaatttttgccaagttaatgacaacaaattcatcggtttcaagtcgcgaaatttctcaggttttcgaatcaattcgcagccatcttgaaaatttctcgactctcgaggctgtcaattctcgacaaaaatccaaaatgctctcgacccgtcactggcacggcatcattgaaatgccatgctctcctcccatgcatcatttttcaccggaatgccttcgctccacgggtcggcatagaacagttcgaggaaccgtgacatcagtgggaactccactcgttggaccgtcacattgtgtttgaactcaaaataagatttgaccttaaacaattaggggattaatcaattaattgccgctccttaattagtgtcgtattaattgacgccgttccctaattaatagagcacgaaaaaatatgcaccaaaactgccaaaatatgcatatgaatttttccaaaaaatcttttcgttaaatctaagctaaaaatctcgaaaaaagctaaatatggtatgaaaaatcattttgacgaaaataaaaataaataaagctaaaatatattggtttgtaaaaaaaaattgagtaaaaaaccccgaaaatttttcattttgtgtacttatttatggcataaattacattttttatattaatattatcgagaaaaaaaatcaaaaaattatccttaaagctcaacagggcctctttaataaagggggccgtttaaataggggtttttgaaaaaatgccaaaatatgcatatatttcgagccttacaatttggtttcctaattgttttcccaccattttaacggcaaattgtaattaattaattattattaattgccactccctaattagtcatggttgttttcgcaccatttttaacggagaatagtaattag

SEQ ID NO: 12780 - DNA, 2667 bp, Heterodera glycines
  misc_feature (1494)..(1494): n is a, c, g, or t
aatagagttgagcgggaccgggccatccccgaaaaaccgggaccgggacttaccgggaccagaaaagtcgggaccgggaccaagtttttcgaccgggaccgggacagcgaaaaaacccgggaccgggaccaaccgggacttttcccaagtgaaaatttttttttgaaaaaaattgaaaatttaagtgcacttcgttacgaaaattgccaatattcaaaaatgcaccaataaaattttgtatttacgttttgggggatcgaggaaaatttttaaaaatttttttcaggggggggggggttcttggaattttctgagtcccaaaattctgtattttttaaaaataaatttacaatcttttaaattttttgcttttaaatcgctgtttttgtggcaatgttttttcaaaaaacttttttggaacagtgggagggggctggatccggcggtgccgataggcgccgtcggaagaattttgaaattttgagcgagatttgtgaacagaatttgtcaaaaaatgaccaaatatttggttaatttatggctttttaggctattaaaaatgaaaaaaataataattttaaattaaaatattttttattaattaattcaattaaaataatgttaaagaaaatataaaaaaatgttctgttccatcagggaattgatccgaagagacaaataatgaaagtaaaaaggtttagccacttgaccacttatacatatgcacacttgctataaatgaaaataaataatttaatttatttttatcaaaaatttctgatccctcaccaattcccttctcttttctcacccagacccccattcttaccagtgcttatttagtcctgccgggaccgggactggcaaaaccgggaccgggatttctgtttttccaaaaaccgggatcgggaccgggacctgaaaaacccgggatttcccgccccggtcccggtcccgctcaaccttacattaaagtgattcttgagtatttaagagaggttaggggattttttgtgtttttagcacggtgttttttttaaataaggcgcaaaaaattacccaaatggcgttatgaatcattttatgagttgtattttctcgggatcatggtcaggataggattacgaggattcaagtcacaattttttacagggtcctagtcccaggtgtcatttatgataatgtgatctgtcacccacaaatgaagttgggaaaattttaaaacttgttgattgagatttcctgcttctaaaactgacataaaatcataattattccagaaaccagtttatttgaaaactccgagattgaagtccatattttgtggaattccgaccctgaccgtttttcaaaaaaaaaaaagaatgggaccgggatccagtgaaaatcccgacgggacctcgatcccatccttgctctattacattttaatatttgctaatattttatctataattttaaactgccttaaatgtttttaatttttaatgactntaaagagcctttctattaacattgaagtggtagaaaacgaaaatcgtcataaatggcaggtgaagaagaagaagaaacagtggtggaacatcctttgccgaaaggctgggagaaacgaatgagtcgttcatccggtaagccaaagtggcgtattaaaaaacaaaaacttaaaaatggtttgagttattgtgacatcgtatttttgacaggtcgtgagtattacttcaatgtgttcagtcaaaaaagtcaatgggaacgtccgacgcgtgacgccgaagacacggcaaaaaaacccgaaactgtccactgttaccatattttggtcaaacacgaaagatcaaggaacccaaagtcgtggagaagtgacaaagtcacacgaagcaaggaggacgcgaccaaaacactcgaatgtccgttcaaactttgggcaccccaagcggaaaattaccatttgtattggaaaattaaaggagctagcattttaaaaatgcacaagaatgcgaactccaacttaagacctcccctattccaaataaaacatgagttgtttatctttggtgttaagcttatcatgccgaattggttgcattggacgttggcgaacgcttttcccgattcaagaaaattgcgcgggaattcagcgattgctcttcggccaaacgcagcggcgatttgggcccattcggtaggaataaaatgcagaagccattcgaggaagcatcttttgcactgaatgtggggcaaatgtcggatattgtggacaccgattcgggccttcatttgatctatcgtttcgcttaattttgaagacgagggtctgtttgctttcaacgtttaatataatttttccaataaaaattttcatacggaaataaatgacttctcaaaaaataattgcgttttatatgactataaaaccgggcagtcccaacaaaatgggcattttagcttaattgaacttttgatttttgtaattttaattgatattctatttggtagagttcaaaactacatggaaaaggggggtgggtcaaccgaagtttttgcgaaggggcccggccatgtaaatttacgatcttttttttactgttataaaacgtgtttgcggcgcgtttttcaaaaaatctttcggggaacggggggtccgcgccaggaaaatttgtctaaaaatag

SEQ ID NO: 12781 - DNA, 3349 bp, Heterodera glycines
tttgatctaaaattaggttaattagggtgaacaaaaaggccccaccaagagattacctgtggcatttcatgcatgccaattttcacatcattctttccaccgataagcttcactccaaaatgactcataaatgcacttgatgtgccggtcccgatttttctcacttccgcttcaatgtcggcgtaccgtttgctcggattagtcgtgtttgcctataatagtataagagaatgcgagggataaaaaaaaagatattttacactaagaagctcgcgcgaaataaattcggacatcttgtcgatggtcactcgctgaccaggcaagatgataacacacgacattgggaacaatgtctacaaccgataatgtggttaaaaacagttctaattttgttaaaaaaagaaaacctctcggtcctgttgctggcgaacggctggcaattgtccatttatcggaatgttcttcttagtacggaaaaagtcgaccatagacataggacgaccatcaacgtcaaaactagaaccaagttttaattaatccacaaaactctcaaaacctaatctcggacatcttccgttgactgatcgcatcaatgacaatgacgcgcgacggtgcataggtcaggtaaccgctaacgccgcgaaacaagtgattgaaatcggaccagaatcggtccatctgggaagcattgttgatgttgaaccgtcttttctgcaccatctccatgacgatttcctcaaggttacgacttgcgaagaatgcacaagtcttcactaaaaagaaaacttaagcactcaacaaacagaacaaagcaaaccgtcagcaaccaaagccgcctttggttcaccattggttgtcaatgacgcgaactcccttagcatggccctcgcgtgtgacaattccatcttcgagctctttgcagatctgacgcttaaaaagacgaccagcaccaatgatgtcatgggtcccactaagattaaacttgaaaaataattaaatactgctaattacgcattgagaaatggctgggaagtcagcatttcaaggaaagtgcgcaaagatctgtcagactgctcatcaggacggcgcgagatggaagaaaagacgtcgttgagatccagctcatgtttatcagtctgacagggtttgatctcaattttgaccgaagacccacgcaggaaatcgcgaacgattccttggactttttccgtgtcaatttccaatacctaaaattatataattacataattttaaaagacaaaaagcaaacaaattgttcgattcgcttgttcgtgaataagattttacggttgtcgtaaacaaattgtgcctaaaataaaggtaaatagtgaatgcgatttagagggaattaccgcttgtccaaatccctgcgtcgagtcgtgcacgaacttgatcaattcaaaacaaacgccgcggagcaatccatttttcccatcgtcgccaccgcccgaagtcaaacttttgtttctagtgagctgcaccatttcaacatcgtaacggaatgcaaaagcaccgccatgtgaagatggtcgagtttcgaacctaaataacttcagtgtctcaaaagcattaatttaactgcacacatacacataaacgcttgaaaacccttcgacaaatctgttacaaactgccggaggaggaatgttcttaaacaattacgaagactactgaacacaaatacattgagtcttacagcggcctgcttaactttcttgacctcctcggaaagagatgacatatttaatatttggtttcaaacaacgctctcaagatttcttcttaaattgttaaaaacaagctcaattaattgaaaacaaaaacagcaaataaagaaacaatttttgcaacatttatgtgtaaaactagggttggtcgggtccgggtaatcgggtcctgcagagcgtagtgatgctgttgatacgagattctgatcaggaatccatccatacgtattgtatggaatctaatcttagtggtatcatcgtgctctgcactacccgattttcgaccaaccctagctaaaactgtcgctgaataaagagttgtgaaaacgctgtaaactgaatgtagaaaaaagctttcggcgctagtctaaaagagtacttttgaaaattttttttcacttttttagtcaattttttgggtgaactgtagtgaacgccccgtgaaaaaaaagggtcaaatgatataccaatcgattcgtctcaaggagctaacaaataagcatcgaaaaatatgtctcgagttgcggaaatgccaaaaaaccggtttttgaaccggttcaaaactcgaaaaattgagagatttcgcactataactttttttttaaacgatcgaatccccacaaatttggtaccattcgaaagctcttgacgagctaagtcttaaaaacaattatataaagttgaaccgcgccatataaaaaccgacaagtatgtataaaccgatttttgaaccgattcaaatcttatagtgccaattcagtaccaaacgtaatttataattattgcgcatggaaactggtgcaaataggtcgtttttgttattgcgctaaaaaaccgccgcacactcgactacggcggccagtaggtagggcgagactacgggctacggaagaagtccgcgcgtgatccgcaggcgctcgtcagactgcttcctccgccctccgtctcgccccattacttgctccgtcttcgcatgctcccttttgcgaaagttagcttgtcaaattattttgttcatcctttatttctttggtactgaagtgtcacttttcactgggactcagtagtagtcaaagtgctcagatggcatcggttcgacttcatttccttatttttagattaagctcgtcaagagctttcgaatggtaccaaatttgtggggattcgatcgtttaaaaaaagttatagtgcgaaatctcacaatttttcgagttttgaaccggttcaaaaaccggttttttggcaactgagacatatttttccttgcttatctcctcgagatgaatcgattggtatatcatttgacccattttttcacggggcatttcctatagttcacccaaaatgtctatcacataataaaagatgattttttcaaattaattttgaacctccgttttaatttcagctgcaattcctatttttttctctttcaaattttaagcataagcatagttttttaaagaatatactttgaaatccgctaattgataaaattaaaatatttaatatgtagagtacattgttaaatattcaaatttacgccattttcggattactgtaattccactctatttactttctctcgttttcataaatac

SEQ ID NO: 12782 - DNA, 2434 bp, Heterodera glycines
  misc_feature (1000)..(1000): n is a, c, g, or t
  misc_feature (1020)..(1020): n is a, c, g, or t
taacataaaaggataaattgtttttgtattaatatatcccaacccgagatgaacaatttatgatttttcgcattattcgaccttttcgtcaattcttttgctctccgacggattgggcgccttttttgtgtctccgttttcgtccacaacagtcatctcaaaggagcattgctttgttttggcagtttccaggcttcgcccctttccccctcattcgtaaaaccaaattaaaaaagcgccagctaaattaatcagtcatttaaaagggatgggccacgaaaatcgaccatttagaaaaagttgggtcgaaagccccgccgcttttgtccacctgaaatttgggtgccgctgtatttccgttggttgtgttgctggccgtgctgccactgctcgccgcccctcccccgctgctccgtctccgcaattttcttcgatttgccccctttttccccgccgtcggcgcttctccggtggcgcttttgtgccgattagcgctggtcagcgacagaatggcgacgcatgagaacagcagggacagcgtggagccacccaaacatagcaatttgtgctgctcacccagcgcattgtaatcggcactctgtgcgaattttgagggaattgcaccaacggcatggggaaaaggaaaagccatagaattttacaatactatgatcactgattctgatcagtgatcattaaacattagcctaaatgcataagcaatcactaatcagtgatcacaaagggcaaggctgatcacaaactgatcaaactaattggcataattaccaaatcagttgcacgacaaatcattaaactgtctgtccattgtctgtcacctgaatggtcagtgatgagagaacggcggtgtaaagagaacgccaaaagctttcgggaattgcatttgtaaagagaagggcgctgaacagaagcagccaaagggagtgaaggccgagcagaagcaaagtgagaagcaaatggcgatgagccaacggacggnccaactgaaaaatgggcggngggaattttgatcaaaaaagtacgtctgggaagacggtatttacggtaatgagagtttgtgattacggtaatgagtaagcaccttttgctcaacaaaatggagcccaattcggcaaaggtcgatcagtcggtgggagacgacgagcaaagtgacgacgaaaaagggcacacccaacagacaataaaagagggcgaaaagctaatcaaaatagatgggatcaatttaaaaggatttcgacgatgcgattctctggtaatcccaactcccccctcccatccctttgccatttcccccgtccttcccaaagtgccaattccctccctcccccctttggcatcactcccatttacaaccacccctttttttactttcccacggcttcctcccaattttcacctccctgccccattaattaattaattgttcgtccatttgtcccacttgtcctccccgtgttttcggtgcccggtggccgtgtccgatggtcgtcagcagtccccacgcgtatgccaatgagttctccagcgtccactcgttcaggttgggcatccgaagcggcaattggagttcgtactgtgacagcagttggagcaggtcacgcttggacaattaattgggcaattaacaaattggcaatttttacggcactatcatttagtctgattgatcaaaaattaatcgtgaccggaaaatcggtcagtggaaaatgggtgtactcaaacaattattaaaaatttttagatttttattcatctccctttttgatagtgaaagcatctgaatgcctaaaataacttgtaaataaaattggtgcgtttcagagcagtttgtgaaaacatatttatgaattaattttgctaaaaaaatacaatagtgaagcttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaaattttaaaaacaacaagcgttggcattttttcaggttaagttagtccttttacatggagaaggcctgcaaaatttggagagattatatcggattttagtgcgctaggttcgatgaaactttttaaatataagcctaaactttttggctgtttaaaaaggaattaaaatttttaaaaattttattctctcccctttttga

SEQ ID NO: 12783 - DNA, 1962 bp, Heterodera glycines
  misc_feature (29)..(29): n is a, c, g, or t
tgtgccatttgctgtccgccctcgaccancctgtcatttgctgtgccattctttgtccaatgcttcgcaatgcgttcgccgcccgcggtcggtcgccccccgcggcaacgacccgacggatcagtgcctttgtccgccccgggggtcctttcgcattcgcttcgcctcccgtcgcatcattttgtccagttgtgccatcaatggctttgtccgtgtcgtcgtcctcctccatcgcgaaaggagtgaccacggcattttcatcgaaattttgcattcgaaggaaagcaaaaaaaaaaaaaaattttaaattaacaaataaatatttccagaaaatttcaaattgttacgaatttctcgagagagaatggctaatatttctgcaaaatgcaaatggtgccaaattgggagaagacggactgccaaatttattgaccgtttcctcacccgaatttgcccatcatttggcacttttattggaagtgccaaatttggaaatggaaatttaaaaaaataaaaaattttatgctttaacagcttggatttcggttttgactaaaaattcctttggtcattctcttttcccatccccaaaatctcacaaaatttgcttcgtcgcccgaggggaaaatgaatccgtccgccgccgctcccggcaaaatcctcttctattgggaccaatttgcaactctttttttggcatccgccggatgccttccttcgcttggccatgggctaaccgtcaaattcatttggccaaacttttcgtgccaaaatttgaagacacaatgaaatttgggccagcaaagtcaatacaaattcatttcaaagccgatattttcaacgaaacaaaaaaataacaattttatttatttatttttttaataatttatttaaccaaataaaaaaagacaatgctaacgccacataatgaatagagactttgtcgggtcaaaagccatggtcgagactctcgagcagcacaaggaaagagggaattaaatgaacaagcaaatgattatgccaaacagcagacagcccttaggcaaatgagccgggtccagcagcaactgatcacaatggcaacaattccaatggcccatttctttcccacggcactttcgcgccccgtgccgtttttattccgctcacttttgtcacttttgcgcttcactgctgcaccgccgtttctcgagtttctcgactggtgtagtcgctggtgggggtatgataattccttttggcctttggcggtgccgtctttgtccaccggttggcgtccgtacgccgtcgaaatgcccggcgggtgatttttacgcctccgggcgtgctgaatggcggaggcgcggttgggcaaggccaacccttcttcaagcagcgatttcctaaaatcaagcagtggcgagtcaattctacaaaacaagtttaattcttcgttttagcagattttgccccattgagttcgtctcctaattgccctgctctaatcagtgaggcgactgagacggctctgatcagtcatcgattacagtgatcgatcagtcaccgaaagaagggcgggagaattttttgtctgatcagcttagccacacatttagcccttcaatcgtttgattgtgcataattctctgatcggcacacataaaaatgatcactcgaaattgcctttttaattcttttccgatcattttatgctcaaattggctcgcctgtgctgtgtcgcctcgcaccaacacagctcttcctccgcttcgccctcctccgtcgcactccgttcgcatccctggcgccgattgagtgccgtcggcggcatttggcgcacggacatggcccggttcaactctttccgcgagcctacgcatcggctggacaccaaaaggccatcccctggaaaatacggatgccaattttgaaacttaaattgaattttgaaacggctaggcatttaaatgtttgcctcccccc

SEQ ID NO: 12784 - DNA, 1678 bp, Heterodera glycines
gcagggatgcaaaaaatatgcacgaaaagtggccaaaatatgcacataaatatgcaaataaagtcgtgaaatatgcaccaaatatgcacaaaaatcgtaaaatatgcataaaaaattgaaaattaggggtgcaaattcaattttaaaaaaaaattttttactagtgcacttgccaatgagctgctacatttcttttataaaattctctttagcaaatattgacattttttaaatcaaaaatcttgtcatgaaaaaaaaatttgggggaagaatttttgagaaaatttccaattcttaggggtgtgtttttttaaattttcggtcgattcttaggggtgtattttccgtttttattgcatttttgttaacaaattttccaaaaaatggcgaaatatgcataaatatgcacaaaaagccaaaatatgcaaaatgcaaataaaagtcccgatttttatacgcaaacacaaaaagagagtgtttttcctgctatttagagcatggagaagccaggaaaaaaaaatatgcatttgcatgttttttgcatccctgacaattagaaattatccgctttaaaatgctaattgccaatgcctttttgagaaaatgtcggatttttaaaatttttacagcatttttcgtttttatacatttacataatttttttttttttttttgctttaatttgattgtcaattccatgcgttccgtttgaccgcgaacattcggttcagcgactgcgagtcgagtcgcgaactctccgcgcgaatgcccaaaacgaattgccaacgcatcagcgcgcgctgcaaattgtcggcaatgcaaaggccgggacgcattgagcacatcgaaaaagcggcggattaaaacagaaaaaaccatggccaacggatttatgatgatcaaagattaccaatttggtgatccgattgatcgcctgcactcgcgtgatccgattgcaatgcatcaaataggcggccacaaaggcgggcccgcggtttcggcccctcagcgaatggatgagcacttttcttgaacaaaataatgatcaatgttggaaggggtgggcttttcctcgctttccaaatgccaaaatggcttttcttccctcgcccaatgcttaaaaaggtctgtcccgccaattccgacaaaaaaacgaacttttgcgaaatgcgcgccttgcgaatcaaatcgatcagagtttcgaagtagcgaatctgatcagaaatggtttgatgtgaaagtgccgtccaattttcgcccaattttacgatttgttctctctccgccagctgtgccttcgtttccgccgtcgacggacgcgtctctttggcgagcatttgctgctgcgagtcgtcccgcaatgtcatggccatggtcatgcgcgagtgtgccgtccgtcgagagcataagcacgggaactcggagcggggcctaagaagtgccaaaaatgggtcagagaaaaaagctggcacggttatctcgacaaaaaggacggacggattaatgacccatcaatgaaaatgtgccgaaaaagcgcgggaatggcacataaatggggactgattgtgagtgaattgaccggctgttcagctgcaacgggtcgtcctcctggccactcaagtcgacaatgtattcgatgttcagtcggcacagcaaattccgattttgcaccgcttcg

SEQ ID NO: 12785 - DNA, 1042 bp, Heterodera glycines
  misc_feature (988)..(988): n is a, c, g, or t
  misc_feature (1024)..(1024): n is a, c, g, or t
attcatcgcagattttaattgtaaatctcgctaaaaattcattgcaaaaataggcaattaaaaagagattaattgcaaatttatttaaaaaaatattaaaattgaaaatgtcggcaatttggcactgtttttggcctaagcaacggttctataaaaaatcactaataaacatggaatgcctcggcatggctttccctctccaaaaacactgaaatcctttggcactttccaccggtttttttttaaattaaaagttttattaacctatgcaattaataagtatcaattcgtaaatatttcaagtatattcaccgtttaaattaaaagatgtttgtgcagtataaaattggaaatagaatgactattcatttgacataattggcacgtaaactacgcaatactttttaaagagtattttatataacgaagattaattttattatttattttgaccatattatttatttaatatttattatatatcaataatgatttattttgctcttttccaaaagacatttttttgattgaaaaagtgtctatttgttttattcataacatttttgggttacctttatgtttatatgcagttagggaattatgatgtttgtgcaggagtaaaagtaaagacagacaggcagaaaatcaacacagtccaatagatttctattggccatataatatatataatataatatatcataaactacgcattctttctactgctggaatggaatttgaatatacatctatcattatataatattaaattcgatcaatatgcattaatattgtattttatattttgcttttcatactcattttccattttattgcctcttttaaaaactaacaaaagcttaccacggaaatttacaatcaaaattattttaaaataaatttaaaaattaaaaaatatattcgaaaaatggaaaagcgcacatcacataatcacacaacagcagaagcattggcaagagctgtccanatggagatggatttcatacaacgcattcttttgggnccacacggggcaatttga

SEQ ID NO: 12786 - DNA, 3490 bp, Heterodera glycines
ttttgagtttattttttttctgtcggtgaatttttttgctttttacaccgtctttttttctggtatgattttacaaaaaaaaattttggaaaaaggggtccagaggagccgatagacgctgccgcaaaaaattttgaaaatttgagtcttatttgtgcacagattttgtccaaaaaatgaccaaattttgcgaatttgagcaaattttttatgaaataataagtttttgggcccagcggtgccgataggcgccgccgggggtaaaattgaaaatttgagtgcaatttgttaaaattgttaacatattttatccctaaaattagcaaattttaatcggtctaaaaagtcaaaaaacgatgaaaaatgcaatttataggagcgcttgcatttttcaagttaaaaaaaaatcgggtactgaagtgtccattggcaagcgcgcccataatttgcatttttcgcataattgtgcacgttatcaattgattccgatcatttttaaatggttttgagtttgggagctatgagacatatttacccaatttttaagaaaaatgggggttttagtggaaaatttttgaaaatttgttgggatttattaactgattttgcccaaaatacctttatttcgagcgaatttttaaaagaaatttagagttttaatttaaattgggtcatccttgaaactctgctttttgtttgcacttttcgaataatattggtagatcataaactacgcattctttctactgctggaatggaatttgaatatacatctatcattatataatattaaattcgatcaatatgcattaatattgtattttatattttgcttttcatattcattttacattttatagcctcctttaaactaacaaaagcttaccacgaaaatttacaatcaaaattattttaaaataaatttaaaaattaaaaaatatattcgaaaaatggaaaagcgcacatcacataatcacacaacagcagaagcattggcaagagctgtccaaatggagatggatttcatacaacgcattcttttgggcccacaacggggcaatttgacggcaattgaatatttgaaggcacaaaatttaggaaaaagtttatcctcaacaaagccaaatgacggcacggaatggaaaaatggggaaaaagtgccaaaatttaacatcgaaaagcatgcaaaaggaaatgatggagcagaaaaagccaaatcgacggaggataaaagcgaaacgaacggaaagcacaaaattgggatgggacgaatgaaaagggaagtgggcgaatgcaaagtgtgcgcgaggccgagcctttactgctattacggggtcaaatgttgcgaaagtgagtgccaacacaagcaatgtctattttggcattttaattgtttttggtttttaccttataaactagagactggaaattgcaaatttgtgggattttctgtgggatttgaattcaaaaatttaaaaaatgacttaaattataataaagaccaaaagctgttcaaataaacaattcgtcattgagttaaaaaaggttcaggtcatattaacgcaatttttggtggtgaaaaaacaatgaaattgaaccaaatggttaaaccgattaaaaaataattatattttcatattgttggataatttacaaattattcatataatcgactaattaaggctgcaagcaattctttcgtcgtattgtttccatgcgaactttgttcaactgttttgaaggaaaacattgccaaattggcgaaggtaaaaaatgtaaatttattaaacatttatgaatttaaatatggtttttgttcttttctcagatggcatccgatgccgcggctgtcgcctcgacaaatgccttttggccggcatggatccgacaatgatcaaagctaatgcgaaggacggagaagcgttggcccaatatttggccaggttggagctgcggaagagaaatgctttagcgaggaacaattgcgcggaacgaaacaattgaatttcgattgaattttgtattaaattccttagaattgaatttcaaattgaattttaagttgaaaaattcacggttttcgtgaccttgaattgactccgtgaatcgtgaccgtaaccactatctaaaaacccgtgaaattcacggttttcgtgaccgtgaccgtgaattaactccgtgaatcgtgactatctaaaatttgtgaaattcacggttttcgtgaacgtgaccgtgatcttgaattgactccgtgaatcgtgaccgtaaccactatctaaaaacccgtgaaattcacggttttcgtgaccgtgaccgtgaattaactccgtaaatcgtgactatctaaaatttgtgaaattcacggttttcgtgaccatgaatcgtgatcttgaattgactccgtgagccttgatcggtgctttttgcgccttttggcattcttcacactgacggacaatccgttcaatttccgaatccatgccgggccaacatacgtgttggcgggcgagtgctttcatgcgcacaattccggggtgtgccatgtgcagggacttcagcattcggttgcgaagcgattgcgggacgacaacgcgattttggtagagcaaacagccctcgatttccaaaatgtccctttttggaaaatacggtgcgatgtccgggtcgctgcatttctttggccaattcgattgggtgaatgccaaaattttcgctaaaatctcatctttcggtgtcgcctctgcgatttcgtctgcagtgacgggaagttgttcggttttggtttgcagaatggtgctgatgtagcactcggtttcggtgcagatgttggcgatcaaaatatcctcctctggtcggggataattggcaatgaggcgcgagagaacgtcagcctggccaaatgatgcggtgttgatgtaccgtttcaaaatcgtaattggccatgattagggcccatctttggagccggctggcggcataaatggggatgcctttcttggagccgaagatggccagcaatggcttgtggtccgtgagcagtgtgaatttccgtccgaaaagcatccggtggaatttttggacttcgaacacaagcgccagagcttctttctcaatttggctgtagttctgctgcgcgttggtcagaactgttgaggcgtgctcgatgactttttcctttttgtccggaaaaatgtggctgattgtggcgccgatgccatcttttgacgcgtctgccgctacgacgatcggaactgtgaggtcgtagtgggtcagcagaagttctgaaaccataattgccttagcttgctcgaatgcggactgttggtcatctccccaactccaggattcatcctttcggaggagttggtccaatggcgccctaatttctcgcattggtttaacaaaacgtccgtaataattgagcgctcccaaaaatgaacggagggtcgttttgtcatgcggcgcaggcattttctggattgtctctgag

SEQ ID NO: 12787 - DNA, 3995 bp, Heterodera glycines
ctctattatttcttttttagcttttcagcacaagacttctttagaccatgcaattaattgaattttgggttatctcacgattagcaaaatgtcaccacaacgggcccattgcgagaagtcaattgcgttccaattgccgaaggattggatattggtatgcgaaaatttgttaaataagaagccatcatattgtttagatgcgatgtgcggggacttaaattttactaattatttcacacttaattatgttgacggtaagtgaaaaaaagaaattacaaaaaaactagagactacaattctttagcattgcctaaatgggttgtcattttttatgagttttttagacaacaaaatagcagttcattgtcaaaggaaagcacaacaaaaagcgcagattttcgacgacttttttgtgtttgccgaaggggtcgtcgttttttgggacgtcgagtgggttatgtttactacaaacatattcaacatttgttaaattttattcaagtcgcaatagtcagcagtccatcatcaatcttttgagaaaataccaacacaatcccttcaccgaccatttaaaagatgacgaagaagaaacgatgaccattgactttacaccgtttgtttattattatatactatacaaacaataaatgaatttttaatcccgaatttttaagtggtccatcgtacgccagcaatgatgtggtgttcctcaattctgaacgtcatcaaaatgctgaacattcgctgaatggatccaactcggaaatggagcaatttgctttttctcacgcgatggctgcctcagtgaaaatgggaatttgggagcagacacttgataagtgttttttgtacgtaattcaaatagagtaaatccctttcctttttaaaagacttagatgacaaagttcaactttgcattgaaggaatgaaggacaaaaatgggcgatggtggaacttgagaagaaatggcatcccatggacacacaaaaaagcactgcgaatgattggtaccacaattattgtatttatgagataattctgaatttgaattacaggaaactttgctgatttgaggtttggagaaagatattgaagcaaatataatgattgttgtgtatttttagacatgcagtcaattcgacagatttgctgtctaaagacgtttattggtcggtattttatgcaaaggatattcaatgaatgtcctagaaattctgcacttttcaaaaatgcaatgcttttaagggatttgcccgaagtcgagtctgtttatgggtcattggcgaggcgactttgtcttcaatcacgcagaaatttgatcaatgagcggtagaatgacaacaaaacatcaatagcatattatgaccttttaaggcttggtcattgtgaatacttttccaaaacaatttccgaggcactcaatattgaacacgtaactcgaaaaaaacagatattatcttcgtcaccgatattcagtcacatttcctcgaggtggttatcattttactcattgcgtttgagtgtgctcatgtcgcgacagattggcttggatttgggcacaaaaaccaacaaaggcaattggcttccactacgcaaaagaattaaattgctattttctcattttatttaaatttttatacatttgttgattttttgttcattcattatattggtaaactaacagaaaaaagaataagttggtatgaggcttatcattttactttgctattgtattttatgacgaagatcaatttgttcttctcgtatttgacaccattcgtttattggcttgaaacatgaaaatcgagttaaaaatttaatttaataaaatgaatttaagaaatattttcagaagcattaaaacgcataaaaagcacttaattcatgtcttttagaaggaaaaggataaataaatcaatgctaaacggacaaaatgttttggtgagcgatgtccattatccattccctaatgggaatgatgtgatgtatgttgatgaggaagaagaggcggaacatttcgcagaaggcacaagcacgcagcaccaaccaaatttgagaagcgatcaacaacgacgactctcatttattcaaacgactgcactaatcaaaggcaagcgaaatggccaattgtttttaaaagccaattagtaatggcacggacaatggtgaaattttgaatagtttttgccttgtgatttctaagtacgtagtaatgtaaagtgtcgtatgcctttcctttttcgtgagcttattttcggaagttttaagatgaacttcgcaaggcggagcaaggccaggcttccgggaacgccatcgaaatactgttcgaacaagtgcatcggagtaatgttgagattgacaatgtacgaccacgaaaccagagaaaatactaaatttatttggctgcccatttaggtggacaatttgcggacgttgtgcaggggaggtgagacgttggatcagctcatccaactttcggtcactcaggtggaggggatgaaggatgagacggcgcactgtctcgaccctgggaagcttgttgcgcgattggtcaacatcatttctaccattccccatttaaaagcgttaattaacagaaatcttttgcaatttctcatcggaagacgggcgatagcgatcacttcgccaccattggaagacattttaattttttgttgcggaagacgcccaatttttattatttgttagcatttattacttaaagttgattggctgttcccatttctctttcaggcgtccttgctacgagttaaaatcggatggtccgtttctccgtgagaaaacgcagcgaaaacggaccaatcaaaaaatgaaggaagaagcgcaagtggtgaagggaaaaacggttggtttgcccgatataattttataatgtttccttaaattttgtccttggcctcgtaaccatgaggggaattcctcccctttcttttgattcatttctataattttgtttgctttgtcattttcccttgccatttttcctatttgtttttctgccccatttcagttgtctcaaatgagtgaggccacttctgccactgcttctgaggatggcactggtgctggttcgtctacagctgtcaataaagagttggacaatgttcgtcgtcatttgaaacgcgtctacaagcagaacggcacggactctgtggactattaccgcttcgtgctccaccctgacagtttcggagagaccgtggagaacatgtttttcgtctcttttctgatccgtgacggccaagtgcggctcagagtcgacccaaacagcggactcgcctcaattggttagcattgtaaaaaattagtagtaattgcccttaatgaagcataaaatactaagtctatcggtcttcattattccatttcagttaaactgagccgtgaagaacgggaggaacgctgctctgcccgagagcgtccaaagacacagacagtgccgagattggactacacaacatggcatcggatggtgcaagagttgaacatcactgtatactccaatgttaattccgagaattgcataaataaatgtacactttgcagaagccatacattacgcgccgagcacaataatttcaacaaggacagaaatcaccgcaattttcgtgaagagaatgaatttttcgtatataatttttgacagcatgtccacgaataaaaacaaagcattcacctcgtttcgttctggcgttaatcgctgctttgtcctctccttaccttcaactgtttgattactttgaacctcaatgtttttgttgatttgccaatgttaaaacgaatatccgccccattgtttatctcatcaattcttcccttttcatgtctcatcactcacttttttgataacaaatgtttagccttcgttttcattacatattctgaccaaaagagaaatttcctgtcaattactgcgatttttgtgaaaatgagcaatgagataaattaaaaaatcaatgaatttccctcgatga

SEQ ID NO: 12788 - DNA, 1244 bp, Heterodera glycines
  misc_feature (1180)..(1180): n is a, c, g, or t
ttaattgcatgctcgttttgtttgttctgccagccccatccgatataccagctgatctcgcttttgtgcttctgcgcttgggtctctttgttgtcgccgctcccatttaccgtttgggttaagcattcaattttaaattaaatcctaaaaataatttattccaattagtattatgtgcttggcgatggccttcgtcaaatgaaccaatcggtggccatgtgccatttgtaccgcacctcaatggaagtgcttaattaaccttaattgatgttatgaaaaacacaccctgattgttcaggttatccctcatacaatggacactctcgtcacacttttctcggttttaatttattattttaattttaaaatatttatttagcaattcataattaatttatcgctacaaattaaaaataaaaatataatttttaaatttgaaaagtttatttcttaggttttgctcgctgttgcaaggttttccttaaattcaagaaaccaattttcactaaaaattctaagatttctcacgcaataccaccgaagcacattaaaacttcggacggtaacactctttcattttttcgttttcactttttttcaagattgagcgtttctcccgtgccattttgttcatcatcataattagcgttctcctcggcattttgcgcttctttgagcacgatgccgcactatacaggtgattttctttcaaaaataagcaagtataccaagtcaaatatgaattttcggattaattatcacctgactaattttgaaagggtttgtgatattttcatttttaactcaaaaatagtttttatttttgaaaaattaaagtttctgcatggacacggagccgggccctttctgggcccaacgctgtatgctaacggacgggtgggtgcgctgggtcagaaaatatgttaaaagcatcccctgctggcctcagcccactgatcagctttctccggctcggccgtcccttttggaaagtgttccttcccctggccgatctgttcgcgcagttccttttgcctggctcctgtctgatccttctccacatcggcttcaaccgagagcccgtgatcgaaatcggcaacgaaaatagtcacaaccgatttggacgatcattgcgtgaccaaacaaagtgagaaggaaagaccaaacgataaaacagcgnggaaacagacttttgggaagaaaaaactaaactttttttttgggggaaacgggtaattttttcc

SEQ ID NO: 12789 - DNA, 3355 bp, Heterodera glycines
tgctttctcatagttctgatctacgccatcagctgcgtctttttcgacgtgcagctgcccaccggggccgtcagctttatctgtttgaccgggactcacttcggcaccgaccgcgtgctgacactgctcgcccttctgttcggccatttgcagccgttgttctgccggttccacaatcacagcaaattggggctgcttgttgaccgcttattatgtgattgcgaaggacgacaatttgtgatatccataacaaaagcgaatgaccaacaaaagaaagagagggcacaatcattttacagatgttgaccagatgcatcggcgtcaagcacagagaacgaaggcattaacagccatttgctcagggaacagcgccaacagaggaggcccagtgcgtacaggtacgatcagagacacagcagtggaagggcaaaaaaacaaccggaaaaatgagcataagtggtcagagatgcaaaaatagtgatcagcagcagcagaagggcaaaaaagtgattggagaaagggggcaaaaggcagagagatcgggaaaaaatgggcaaaagtaaagtgatcagagacgcaaaaaaaagagtgatcacaagcaactgatttagtgaaaagcagagcgataggagaaaaatgactaaaagtgataagagaaaaattgaaacaagaaaaattgcaaaaaatgatcaaaaaagtgatcagaacccagaacagaaaggcaaaaagcagagtgaccaaggaaaatgagcaaaatcaaatgttacaagagaatggcatcagagaaaaatgaaaattatcagaatgctatatactcagaaacaaaagagtaccgggtaaattcagtgtttcaaaaacccacgcgcccatttaggaattatctgtcgacttctcggagcttcgacactgcttcgatgtccttttcccggcggggcagtgaatatccggagccgcttattcaccattgggtcactctttcgcctgtgccatcgccgatccgcggtgagccgtcatcttcctcataattgccattataaaacttcgctttttgtgtattttgttcgttaattgaacgtttaatatttatgtatattaattttaaataaacaaaataatcaaatgtttgtttttataagtaaatcctcacatggaaacaatggcacggaaaaaaggtgcaaaaataaacaagcaaatttaaataggtatttgtttttctcgtgcctttggggaataggcaattttcagtcattagcattaattaaacatcggatttttagtgatgaaagaggcggaaaatgagttttgtacaaggagggaaaggggagaatgataatggtggtcgggttttgcagatcaaacaatttcccgttgtgctgataaactttttcctagtcagaggatgaacagaataaggacattaacaaaagtcatttgcagggaaagaaccgacaaacgagcattaattatcaattgttaattggagatttaccaaattaaagggcagaaaaacaggggacctaatttgtaagtacaatgttgtctcagttgcgttcattttcggaggacaacttttgtgtatattaatcccacccaattaatgattcgccattatattttcatttgttaggaaaaaatgttaaattttacaatatatatatatagtcctattatggaatttaattcaattttcttcggtccaccagccgagcaccgcctgcacattggccatattttgagtccgcagccgatttggtgcggacaatgaaacggacaacggacctttaaatgggaggacaacagtttagggaatgattcgaatttttcagaacctttcgcgaaaaagccaggaaaagtgtggtcaaactgcggcgttctcctcatcagttcgtcttcgtcgttgcgctgctgttggaccacgaaaacggaggtgggcgacaggcgctgctgctgctggacgctgagcggactcgtcggagacaattcgaactttggggaattagcaaaagatgaggaacaataaagaaactaagccgagaaagattgtccccatatccccgctttgccatgggttggtcaccttggcattaccttctcctcaatgccgggatggttccgtatggtcacactttggcacttttccaccgacgcgtgcttggccaaggccagcattgtgcccgacagttccgacacaatggcaatggtcggtctgtccgttgtgctttgctgcttcggcttctgttgcgttttttggccctccgccgtccatccgcccgcggcaccgtcgctgctcaccttttccttgtcgccgttctcctcgttgattattgcgcttccgccgcctccattacgcgtgcgggaaccgcgtggaagcgattttagacgagagccccatacaaaacgttttgcctccttttttcaaatcatttataaagcaattaggcacttcctctgttattaattggttattttgcaagtgcttttcacctcgacaagctccgggatgctgctgctccgtcgtcgtttgtttgcttttctcgtcacttccgcaagtgaaagctgttagcaaataattccattaggactttgtgttttattttcatttccccgatttttccacttttatgatatcattttccattttgcttttaattttgtttctgtttttccgttttgctcttcacttgtggcattggcatgtgctgcttcttcgtctgttgcttcgcattgtttgccattccctccgccgcttagcttccgcttcggtctttccgtcttttcggcacggcccccagcttaatcggagtgcacacggcagacgatgccacggcggtggcggcggcgttggtcgcgcgaatttgggagaacaaatcggcaatatggggcatttcattgtcatgggcagtgttttgttgttgttttatgcgcctcaagcaactctccagccaagagcgaattgtctggcaattatcgaattaatcagccctttcaattggttaataaccaaaattgattacatgtttggctacttcctcctcaattaaatactccaattcctcacgctgcaccaattcttcaagttgaagcgacttgcgaatgtagacactacggtaggaaagcatactgtaaaagcacaattaattatctattccgagtttaaatgcaccaataaatattaaacaattaattaacaattccgaaatatttagattttaagctggagcattttttgaagcgataatctaagcaaattgacctgagaatgtcgtggaacgacacatcttcaccattgtttatccgttccatttcatggcactaaaaggcgaaatgaattaaatttgaagtcccgcccactcac

SEQ ID NO: 12790 - DNA, 6008 bp, Heterodera glycines
tgaattcagacgcaataaacatgcacacggccagacattccgtgcccaacggcgtctcggggctctcagtgaacgcaatcaaatctctgaattggcggatgaacttttcttatgtttacacgaagaaaaaaacaaatggtaacgccaaattacttgagtaagacggggttcgcaaatgttagcaaatcggagaagcatttcatgatcatggcggtgatgatgttccaacggaatagcaggaccagacgccagatcagtgagggaggcgacgtctttcgttttgaggaggacgacgagtggtcggattgagtggacccgtaattggccatcacctgctgaaattaaactgcattcaattaagaatctttttatccaaattcagacatcatgggtggttaaatcatcgccatgacgaatcagaggtgctaaatccgactcgggctcctgttgatgctgcacattcacatccccgtccgttacatttatgacggattcttttggtggttggcacagttcatcaggagattgcagtgagttcttcgagttatagtctaaaggaaacgtaagcactaggtccagcaattttgaaatgggcaggggccggggcgggatcccgagacctaaacgcccggtgcttttgtccaaaaaaaaattgggcttggagtcatggcaaaatcccagcgattcccaggtcccgcctagctctagtaaacaccattttttgaaaaaacaaattaatcttaattttaaataattcggaccagtaatagcgcgtttccatagtctttcccactgaggaacgagttcattgcaagtgtcatttggatttagtgcataaaggtcggacaattctaaaggtttccgacttcccaatgcacaaacggagttaaaccaccaaaagaattggcgattgacaaaggatgacaatttttctggagattttaacggccggaatgaatccatgccgaaatcttaattcaacatttacattattatcattaccaggcacaagcagttatatacatacataacttcaccttcttttttagcaaccaaacaggttcaacctcaaaaagctagtttttggcaattttcgaagttaaataaaaaaacaaaacaaaaatattgggtatgtaccataaacatatcaatcaaagataaaaattccaaatttcataaaatcaattttctaggtaaagtaaataaattagacaagtaaaaaattaacaaatttcaacgtaagctcaatgattaattgattaatcggttgtaatgggaagaaaaagaaaaattattttgcagctaagaaattgataagaaaacgacataataaacgaataaagattagtattattaattacacattatcggcaattttaatgagttagaaagaattaaatgtgaagagtggagaaaaataaataggacaaaaattaatgaactgattatttttccgcctaaaattttctactcggcgcctatcggccggtagaagtcagttctgtctgattcgctgacccacaaaatgtccaggccacgaaatgtccaagtctcgaaattgagttttttattattcggatgggcctaaggttaggcaaggggtaatataaaggctatattcgtattcagcgaccccgaaacccctaaaaaccccaaattagactcattttgtttttataaattttgaaaattttggacatttcgtgggtttttactcttttggacatttcgtggcttggacattttgtgggggcgccgtctgattgtgagccagttttatctagccagttccgtcttgggccagttcagtctcaatattctttgacctcatttctcaaatttacaaaaaaaaatggaaaaatttttttttatcctatacagtatataacaaaacaataagggtgcttttttaaattttattgcattttgttaaagcttttttgaaaatgccaaaatatacgaataaaaatttcgaaataatttctctcactccttttgctcattcatcccttcctctcatcatcttcctttctctcatcttcctcttcctttctctcatcctctccctccttttgctcataatagcctttctccttttcctccctttcttcctcttccttttgctcttcctgcatgcctttcttttcttcctcttccttttgctcttcctctatgcctcccttttctttctcttcctcgccctcctccttttcggcgtttggttcccttgtcacttccactcgtctcttcaccattcctcccatttcgatgctctctctcgcccccttcttccatgtctccagtccaatttcctgcatttgtcagtttggtttttttcttgttttgatcacttgcctcgttatttcgcggatcaaccacgcgcacggaaaagaatttctcttcggcggccatcggatcaagcattgaaactcgggtacccccaacattcaccgagtttttgtggtattcgaattttattggcaatgtcgcactgatttccttgaataagtgcatgtgaatctttgctcatcctttcgtcttacgttgatcagatcctgaccaattagcatatcggcaggacaatcgtaagcgattaaaagcggtgtaaagccatcgctgtgccacgggccgaactccaattggacgagagcctggccaaggaattcaatcggtgtcccttcactcgttgtgaccgttggtgcgtcgtttaagtcaatcacctgcggtttgatcgaattgtaaagaaagggaagcaaaatttgctgtagtcgttttggtcaaaatatgcaaagattggcaaaaactgacgtttagtttcagcgaattgacgatgcccgacccgcaaaatgaatgagtgaaatttgtggcaatcaccgctcgacaaggctgatcatttatcttgaccacaaccaaggacattttttagagactcggaaaaattgagaccgaaagggactcgaagtgatcgcttaaaacgattggctcagagggaatgttcgccatcaccacgctttggccatatgtttttttttgttcttttttcaaatattttatcctttttccttccttttcctccacagcatctgtcattggggaggatgaacacttggcgtaagaagcaaaaaagtgaattgaggtgacacaagcgaatgacgaaggaacacagagcaaagggaacaaatggggaggactgatcagtgcattaatggcaatgagagagaaagaactgatcagcccatccatggggacggactgatcagtgcattaatggcaatgtgagagagagaacagactgatctgacggactgaacagtcatttattggaaacgagagagaacgcagtgatcatcccacacatggggatgaattgatcagcgcattcattggcatagaaagagaaggatcgcaattcgtactgtaatttcctacgattttcgcttttttcaattctttcattgggattttttatctacttgtggtaaaaaaaagagagaagaaaatcattgctaaactgttactgctaattattcacagttacccatttccattcgtaaaagcaaaaactgtcgaaggaaagggtaaaaaagcgattggacttttgcgatggctttgccccccccccctataatggacatggctaacccaacagctcattgatattcaaccgatgcttccattcactccctttccgttctcctccaattactcctctccccccattctctgctcactttcattccagaaaatttctgttttcttgtcaattttccaatcactttggtctaatctaatcaattcaaaaaaagtccaatcaatcctacaaagtattcgggcattctgaagtgtttttcatgttggttgatgagtcatcgatgagacaatcaatatgtcagacacctcagagggcaaaagacactgaacaaatgtcgagattgaaagccacggtccaacatacgtaattagctcgaaatgatatgtattgcaagccaattattcaccaaaacatcgccacttttgttgttatgcgttgccgctgaacaaacatttgctcatttccaaaagtcgacatttccaatccttcagctttaaatttcggtgcatctgaaagtggtaaaagccatggaaaagccaagccaatctttttctaagctgagtaaatttattaaaccgtgaaaagtgatgacgaatgggcacataaaaatggaatggttaaaagtttccgatgaatcatttgaatctctcaaatgttcaaactgatgttttttttgcatctaatctcgacattccttctcttttcgcttatttctttgcctcgggggatgtcttcgtcccgtataaacttctttttccggaaatcctttccaaaatggccccactttttcgcctcctcttcgtccgattctccgctcgactcctcctcttcctcctccttttcctcctcttccccttcttcctcttcatcgtcaagcttcgaccaattagggcagaacgacttggacttaatcaagcagaaaaggcacatcggagacattcagcaattgtgggatgaggacgaaatgaacgggtgggggaggagaaagccgaacccaaaaaggaaaagcatttagtaaaatgcgaaatgccctcaagccgacctcatccaatcggtggacccaaattcgaagccatgatggcaaatttgtgatccctttcataatcagcggacagttcagtcagtttcacagtttcataacgtttttgctattgtgttcctcgaatttagcgatggaagaacgacagaaaatccaaaaagcaatggctgcgattgccaacaattcatgcgttgaatttcggccaaggaaattcaacgagttcgattatgtggacattcaaaaccgaaaagacgaggggtacctttaaagataaaatcgaattcgagatccaatttctggattgggctgtctgattttaaatgcagttgctacacgcaagttggccgagtgcggggccgccaagtgctaatgttggagtcggggtggagcaagccgtgcgggtccggctgcattcagagtgagttcatctcacatttgcgaggctccttccgatcggtccgtttcgttcagcgttccccggctgtgtcaaacacgcgacaattgtccacgaattgctgcacaaagtcggcctttggcatgagcacatgcgcttcgaccgcgacgatcacatcaaagtgcattttgagaacattccgccaggtcaaagcggcaaaaataaataaaaaccagcacattttctttcagatttccacgctcagtttcgcaaaattggccaatatgagagtacaacatacaacgtaccgtacgactacctcagcgtaatgcattacggtaaggagtccggtgcgcggaggaacggtttgacaacaatggagactatggacaaaagataccaggcaactgtttactcatgaatgcctgataactattttcaaaattgaaacccacagaatttgattggcactgtcaaagacgcttctccaagtgattaccgtaagatctgcgcaatttataagtgcacaaaatgcatggggagagaatttaagtacggcaatgcataaatcaaatactactttttcttagacttgaaaattacttttcaataataaattgaaaatgcttctttgttttaaaccgaaatattcgaattaatgggataattatttcgttttgtcagtgcgacctctgcaaattgggagtcgacctctgctggaaagaaaaggaaggagaacgaagacaacagcaaaaatagtagggagaaaaaacggcggagaatgccgtggccaccgaggggaaacgaccggcggaagaagtcaaaggccaactgcgaagaaagcgacttcctccgaccgagcaaaatgtgatcaaaaagacaaaggagcaccaaaaccaaacattccctcttaggtgttgctctttgattgatgcgaatgaattgcccaatctagggggattctttgctgctgaagcgatcat

SEQ ID NO: 12791 - DNA, 1707 bp, Heterodera glycines
cccgtaccaaaagaacgaggtaatgttacccgggtagacttacccgggtaacttaacccggttaactcacccccagcagctgcgggttaacccgtactaaatgaatgttaccgggctcgctgggctcacccgcagctgtgggtttggctacccgttacccgtttcttttagtatcactaccgatcttggtgaccaactctactttaatcacttaaaagaccagcattgcattttgaccagtgaaattaattttttagaagtgtaaaaatgagatattaggctttaaaaccaaaaaacaaattttatttgttttgaagtctccattccctattttcagaaattttttttttaatttttgcccgaaattgtccgcaaatgtccgtccgcaacaaattgtccgtccgcaaatgtccgtaaggcgttcgattatttactcattttttcccaatttttcttctgaatcaaataaatctacaatttgatgaatcataggcattttggctgatcagcaataactaccaatcaatcgatcattttgatcaaaatgtttcgaatcggtgcacaaatgacggcgcgttccggaaccgatttgcctcagtgcaggcgcgtctaatttgtttgttgacctgggccggcccgcagctgaacacgccgatctcggcaacttccgggtgccgactttgctgcaaaaatttgaagaacgagtcgaagttgggccgcccgaaatggttggtggcacgcagaccggtgaacatgctgatgccgctgttgtcaccgcggaagtgcttttcgcagatatactgttgaaaatgtgataaatatatacgttcaacaaattagagactaatgagcataattagcttagtgaatattacatctaaataatatattatattcgatcagtgatttattgtattgtaaaaggtgaagttgtttagtaaattggcactaaagttgttaatgaattcaaacttttggaaaacatattagccttgataaaattgtgaaaactgataaaatcaggtttctgtccctataattcaggcaaaagtgtggattatcgtattattttttcaaaaatgtatatgtatcagtgacgaattctccgatgactaattagggtgttgataaataagttcaaaatcggaattaagctgattctttttaatcaaatctgtcaaacaaagacaatctgcttaccaatacagttgttcgaagatcaaatttatggaagaattgtgtgacaaaaatgtgtatctcaaggatgccgtcctggtcatgccgttccacttgcttcagcacgtcgacaaaccattcaaaattcttatgcgtcggacaaatccacaggaaataaacctttaaaataaaataattatttaaaagtgccgaaaaataaaaataattcaattaatttcaaaataatgattaaaaagtgaattatgtaaaaaatggaattgattttgaataaaaataaattttctatcacacctttcggcactttatgccactatggttgcccgacgccctctccaacaccaaatccatcagcgtggaggcgtacggcgttatgccaatgccaccaccaacaaacacaacgacctgcaattgaaagatttcaaattaaatcaaggattaccctctctatcattatcaccctcctggtgtgccattcttgggtgccgtccccgaacggcccgctgagggtga

SEQ ID NO: 12792 - DNA, 1819 bp, Heterodera glycines
tttaaaattaccaaagtttgaaaatttctcaaagattctaaaatttgaaaaacacttttctgagtgttttcattttgggataaattttttattctttaaaaaaatggcgcttttatttttttcaaatttaattttaacatttcttttcaccttaatgaataactcaagagttggcgattgtggcgcggatgccaatgaaaaagcatgggactcgttgaaagtgcaggagaaggcggggcacgagatgcgcacccattggccagaacgaaatttgaacgaatgaggacgcttgaattggatgtagatgatatctgaacgggggcagataacgaaaagaaattggaaaataaattagacaaaacttaattataatcaattaaaaattaaatttgttgtagaaaattcgacctgatggtaaaatggcggcatcaacgattctcaactgtttgtagtgtttgcgcatgccaataatacgatcaataataaaaataatcaccgggccaagcacaatgtaccaaaatttgggtgactgaaaaccagaattttaattattatgtttttattcattaccgtatttattgtaatagagcccttggtggctctatttttcacaaaaggagggctttatttcagagggggggctctaattcaaggggggctcctgtatttgactctgtcaactcacgtccaacagtttgggaagcccgtggagtatggtaagagcatacagtaacacattgagcagatgcgttatgcgaaatgcatgataggctcgcttcatcacagcaggcgcagagaaaacgtaaattctaaaatttaatttataataataattttaatacattattaacaaaaacaatttcaataaaaatcacatcatacatggacatgacagcgacaagcaaaatgccggtgattccggtcaatgtgccgaagaaccaatatgagatggatggcaaaaagttggagccgaacaccgcctgggggggggggggggggggggataaggatggtaggtggatgagaactaattgatgagtaaaaattcaatttttaactcggtaaaaccctgtcggcatcccggacccccgaaaacacagttaaatcccacaaaattggtcatttttggagcatgattttcgccctccccatcgcaacattttggacatttatggtttcaaagtttttaatcttaattaaataatttgtgtacttcctgaaagaggcacgcgatgccctcctgactttgggtggccacatggtaaaagttgacgcaatgtccaattgtgtgaatggcagcgaaagtgccggcggtgatggccacaattttgtggaaagtaattgccgagtcgagcggtaaatactgtataaataaagcaaaaaccaaaataatttaaatttccgaattttcacttcgccaacaaatgtctcgcgaagcattgtcagcagatttcggcacacggtcagcaaaattaatgccagatcaacagacaatgccgcagccgcccctcgagtgatcgcaatgccaacgcccatcacgcggcgcaagtcgcggtgctcattttcgtagcgataatctgcaaaaagcattaatcggttctttatgtgtaaagtcttaagactcaaagcatttaaattatggacaaatatgaaatttaaaaatatcgtaataaaaataaatcaatacacccaaaaagcatcaaattaccgtgtttacggtatttgagcccctcggcgggggttctatttttcaacctcgaaggaaagggggttcgaattcgggggggggggggttcaaaggaggcaaatacggcaagct

SEQ ID NO: 12793 - DNA, 4602 bp, Heterodera glycines
  misc_feature (3106)..(3106): n is a, c, g, or t
  misc_feature (3118)..(3118): n is a, c, g, or t
tgaaaaaaaattggcggtgatttctaaaaaaaggaggataacaaaaggagggaggaggtgggatttctggataaagagagatgaaaatgagagagagagagaggagcgagaaaggaagagagggacaggaaagtgagaaagggggagagagacaagaaagtgagagggagaggggaaagagagagaggaggaaaaggagagaaagggtgatgaagttggagagaggagagagagagagagaaagagaaaccagcctgccttggtggttgtggtaattgatgtgattaatgatggaacgaacgacggatgcgacacgggacggagaaagagaagagctgcaacagcagcagcctatttggtggaacattctatcggcaacttattgcgtcgccttataaatcattcagcaaaagaattcttagccgaaatcaattaaatttcaaaaatcgaatttcagaaaattaaaatgttcaaagatctgttcccctcgctaggcttctgtcccttccatgcccttttgtgggtgctcaaaggctatttaatattccgttccatcaaattcttcgaaatctttgtgaggagtgtttggggtcattttttcacaagccctctaaatttggccccctacaaaaaaagttggacaggtataattaattaattaatcatcatttggacgttccttcgacaaattcacactttcagtggtgacgggctgcacggatggcattggcagggcgtatttggaggaattggtggccacaaaaggaattcgaaaattgtatctgatcgcgcgcaactcaactaaattggaagctttgtgctcatatcttcgtaaacaaatataaaaattccgattaattttggactttaagaggaaaattacgagggatgcgaaatcaaaagagcgatttttgattttgagaaggatgattttgaaaaattgccaaccgagctgcagtcattggaagtcggcattctgagtattcgcttttgctattgtttggcatttccatttgattgccttttgtcctcagttaattgtgccgggacgggccccgaccaagtggccaacttcgctaatttgccccccgggctttcgtctgtcattctgcgcgtgaaccttctctcttgtgttaaggtgggtatgcttttgccatttgataatcactaatcacttgtgtcctccccccacccaaatttccctctcatttctaatcaaaagatgatcgaactgatccttccgggaatgctgcaacgcgaccgaggcatcgtcgtcaacttctcctccattacggtgttttcccatcgctgagattcgaataatcagctgaccattaatccgttcagggatggcgtcccctcccttatatgtccacttatccggccaggtgaccgcgtaaatccgatcaaaaaaggcaatggcaaatcctttcaagcaaagcagcgatcagcttcttcaccgactctctgggagatgaatttgcccacaccaacgtcaaaattcaagtgcgtcgtttcttctcctaatttggccctttctctatttttgctcttttttcagtgtcttttcccacttttggtcgcaacgaaattaactcaatacgctgcagaagatgcaaatctgttagtgcttgatgccaaaagctacgcacgacaagcagtgaatataattggcaattatcgaatttccacgggatgttttatgcacgacatgcaggtgaaaatagagactgggtgagaagggaggtcgagaaaaagagagtagaaaaagagtgggagaaagagggaggatgagaatgtcatagagagagatagagataagtgaggaagagaaagagggagataagggagagagaggatgagatattaattaagatgacgagaggtcattagctaattataaattcagtaattcccaaacaaatttgtttttcttttttcagatagcatttggcagttttattgggttcaatttgttcaaacttttttacgttcccttcggcattctcggaattcacaaaagaagaatcgatgcatacaacagaaagaaattggcaaacgaaagaaaaagcggaggaaaaggagaaggaataaagtcggaatgaggacaaatggacaaagaaaagagccaacaaaagttaaaaagagaaagtgaaggcaaagaaaggcatttgctaaagcaattcaaatggaaatggaaatgatcattgaattgtgattgattgcttaacaaagcaaagggatttgaatggttttcatgacaaatttttgcttacttccaattagattggaaggttttcaaggccatcccactggtttttggaagagagatttgggcgatctccgacaaatcacccgaggcatcatccaaccactgttttatttgaattcttcaaattgccacgggcaatgtctcccccccccccctccacggcccctccccttcgaattccgcccgtttcccatttaaaccggggcatctcagctgcacagctcatttctcgtccaactttttcatcgttttgccttcaaatggtaagtcaccccttcttgttctgttgcatcagtcgctttgcctctcagttgaaacatttgctgcttttgtgccttttccccgtgctcactttgggctgtttcggcggcgcttctcttcccggccaattccccggccaagtgaactttgacagttacgcagcaccaccgagttacaaaagtgagaagagttcgctcaaaaaatgatcaaaatgaatgtttaagcagcaccaccagcagcagttgcgagtcccctttctgctccaacaattactttggaggctccgccccctcctcccgctcctattttccctcttcctgctcctcttcctcctccttccgctcctctcttccctcctcttcctcctcctcccgctcctctcttccctcctcttccccctcctcccgctcctcttttccctcctccccaattaccgcaactctttcaatcgcctctcaaatactcccagccctcttcctattcaagtaatgtttaagcattggcttttttgctatctcttctcccttcagttgctcctcctccgtcttatagcgtttcgcccccctcttctcnccagtacgggtncgtgatgttatgtttggctatgcaaattgttgtgctttagaggccacttacgcaactccgtccaccgttccccccacaattccccaattgtattcagtcgttcctccgcagtacaaagtaagtcccgaaaaacctttctccccaaaagctttgccttgtcaaggttgaagcccctcagcttcccgctttcccaactcttccgccagtcgttttccccgcattgccaaatctgtccccgccgcctcctcccgagccaattttcttcgctgggcccccgccaccaccgcccgtgaaagtctcaagctattgttcgtagtcacgtatccctttcgaattgatccgaatgtttcagctgttgggccacagcctccgccgccgccaccccccgccccgtcctattccatgtcgccctacgaagtgcctccccctggtaataaaaacgcaaattttaattccaatagaccaatgaatcatcgttttatatgccttcagcttataacccggctttcaaagtggcgaatccgacaaattctgtcgaattgactggaaatgagcagcaacaactttcacagaaccaaggacagatgcaatcagcagatgaacagcaaagcaaccgctcaaagcaagacgcaagtcaaagggacgaaaaggggacggacgacgcccgaggggaggcagcggaaaagcccaagcagttcggagttacccagcaacaggtgaggatggtggactaaggccatgaatggtcatattgtgtggattaaggcccagaagttggaccaaccatcggtgatcggaatgaatccactgcagatgagggaccacctgcggacacagctgaagaagaacagaaagccgtggaaccaaccttaggaagaaaaccattggaaacggagggaatggacaattttaaactctcagggaacgatgcgatgatacctcattaattacgaatgaaagcctttttttgcagaatttgagaagtgaataaacttagagacagataaatgaatacaacaagagctcagttccacaaaaatattcaatttggcaacctccccacaacagggaaagggatggcgctacttgcaaagagccctcttttgaattttatcaaaaactaggggggacccttttgttttgcaaaaaattttttgatagaaaaccatgaaaatttgttctacggagttttagtcgtcgctgatcacgaatctgacatttagattttttgttcaaatttaggtcaagaaataggaattggtcaaaaaactatatcaatttatctcttcgaacaatcgcctgaacaatgtgaaacataaaatttgtcacgaccaattttaaaattaaaaaatgtaatattaactcaattaggaggctaaaaattcccaacagtcataattgttaaattactcattgattgcccattgttttattgccgtttcttcgtgtaccagtcacaaagtattgaatgaaataaagtgaaa

SEQ ID NO: 12794 - DNA, 3019 bp, Heterodera glycines
ctttgtgaagttttcaaatgacacaaagattgttgctccacgggggacaattaaaaaagttataataaaaaaactagacctggcgacgcgcggaagagacacattcattccatcaatggcactaggcactagacagccggagaacaagatgaatttttaaaataaattttcgtattcagcttttttttattacctatgtaatatgaaaaattcggattacgattgctctcacaatcaaagggtcggagtcatttcggcggtggccaaaaagttattgagtgcaggtgtcatgacactcgtaaaaattcgttgtagccaactcgtatacaaattttaatcattgaaatttaagtttgtgttctatgtctaggattcgttttctcaaaactcattttggtacgagttggcattttgactcaaaaagtcagataaagtcaattttttgttttggccataaatctttcacactaatgaaacagtccgttttaccttaattaaaaacattttattagtgaagataaaagatgaaatgatttgttgtttcagctgcaaattgcaatgaaaaccaaaaacataaatttagcgagtaaattgctattatttaggcgaaaaattggggtagacgctcggggccccttacgtggatccgttgtcttagccactagaccacatccaccactggagggatgactgttgttatggggccatctttccttcattttggcccctgtcttttttgctcgcacagcaatttgagctcccacagctattttcgatcagccattacaaggggtaatgggggggggggaaggtatggagtgaatgatggcggcggtgtagacagagagagagtttaagcttaatgggggcggagaggaagctggcttgatcagcagtgtgtaaaagcggaatgatgatacgaaatttggaatgccccacccccccccccccgttttgattcggttgatcggttttgaaagcagcagaaggaacggcgccgtgtgcttttttgatcactttttcaaatcgggtgagagggagaaatagcgatgattgatcaagtggaatttttggagaggcaagagaatgggagcagttttgatcagtcgagaagcgaaaatcgaaagctttttgatcagctaagaatgggagttaatggtgattggagaggaagaaagacggagagaataatggtgggaattttggcttaatagtgatcaggggggtaattttgatcagtttgaaagcgggaatgaatcgcccgccaattgctgaagtgaaaacaatatttttattgttgtttgttaattaagggtgggtgatcccacgacaccaccggtgtgtccccgaatgccggagctttttgtggatactttccccgtctgcaattccccgacaattacaccgcgcccccgccctccccggaagggtcagggtgccgccgccgccacccaattgttttggtgttttcgccgcggggaatcgggggaagaggggatggcgttatttgcttcatcttcatcggtcggaggctatgtgagaagcggggaaacggcggcggggaaaatggaatatgccgcccagcaatacgcgatcagcacaggcagcgcgccagattgatgatcaccagcctgttagccgctccgccggtctgcccggtggggcgacgcgccaacacacacacacacacacacacacaccgatcgaccaaccgatcgaaacaaaatttgatcagcgccgtttgcgaatgagtgagtgcgtttttgccaaccgctttcaaccgcccacccccgcgccatgatggaagccgccaaatgcatcacatcaaatcttccactgaccctgctgtgcggagtgggcgaggatgtgtgaaaatgggggcagtgatgagccaggctggcagatcacttacaatttagtcacgcactcatcactctcattcattcactcactctcacacggaggcgcgtcggccggaggcaaacgcaaaaatgggactgacaggaaaagtgcgaggattagggatacagcgcgattttcccttatttttcgatcacttttatttaatgaatatcttggggccacaagcattgattggtgcaatgaatgagtgatcactgatcagtgatcagcagtagtgccagacggacgactgtctgtccatcgtccgatcactttgaagcgcactgtcgcatgagtgctgttgagcttatgtgacttttctgtctgcttctcatgttccctctcgctctctctctctcgttttctttgtctctcttctcgctctctcctctccctcttctccctcgctctctctctctctatcgttttttctctgtctctctctcattcatatgctctctcaccctctcttttttcctcatgcttatatgatctctcaccatctctctcctctctctctctctcccccctccctctctccctcttctctctcgctctctctctctctcatttatatgctctctcacactcttttttcctctcaacttatatgatctctcaccctctctctctctcccccaatttttcgctttgagcttttcaactgttttcagcagttcttttgttacattgttttgtttgcactacttacatatgcaacacattgcacatcataatcaaacaaaacagcagcagaaagcaacaaaaagcattttgggattttgggggatgggactgaattggagggacaggaattttggaaaactcagcaatattttatatccggctggtaatggataattacatttattaattaggtaattaaaatgttgatttgaaaaaaaggtaaggaacagggaaaagagcaaagggaaagtgcgaaagaaaaagggtgagagagagggaagagaagagagagagaagagagagagaagagagagagagagagagtgagagtggtcaaataaactgaagattgaacgccaaaagtgcactatagccagaaaaatggattaattaaagtggacggacaatcaaatcaaccacatcaaatagt

SEQ ID NO: 12795 - DNA, 1063 bp, Heterodera glycines
gaaaataggcaaataaaaaagtgctaatgcagtctcaaacattatttcgttgaaaattagtttgggcttggcattttgtaaatgatggttgcatatttgatgaatataagcgctttttcttgccattccttgcacctaatgccgtcctgtggtttatggcacaatcgatccaatgcggcgatggcattttcttatctttttgtgcatttactgtcggattatccactgtccgattgtccagtcacggtccattcccatttcgtcaagctctcgcggcacgaacagattgttgacgcaacaatatgtggctggtgggcagcattcgttgattgcttaaaaattgaaaattattttattcaaattaagctttttcagtcccagaaatgccattaaaaaatttccagaaaattctttcagatttttattgataatgtttttctgcgttttcgttttccgagagccagcctttcagaaatgggcttgatgatttctttcaacaaaaaaaaattcaaaagaatttttcaatgaattccccgattttaatatcttagttttaaaagttgtaatccaattttttacttgtgttgatcctccatcgctcttccgcatcgcttagctgctcccaccaaaacggcacatgagccatcgaaatggcacaaaaactgaatgcaatggtaatgatgatgaaggaagtcatagtagtgtggtaatgggatttttggacccaaattaatggataaattttggggattacaattgtccaattatgcggttgtcaatggcaccgtttggcacgcctgctggccttccgcccatcggcacttcacgtgatcatctgcacctaattatggcattttggtcaaaaatatggaaaaaagtttgagcttttgatttttggcaaaatttatcttaaatgttttttttctcctatttatctttgtaatgatcttgatgaaattgtttagagcccggaattttgaaatggccgggaccgggatcgggacttggaaaatggacccgggcgggatcccggcaccgggactcccggtcccggcggtttgcc

SEQ ID NO: 12796 - DNA, 4118 bp, Heterodera glycines
  misc_feature (4034)..(4034): n is a, c, g, or t
aacccggcatttgccgggttttgggggtccgtgccgggtttttgaaattgccgggtttttgccgggtttttgggttttttgccgggtttcctgtttccactcatttatttgaattttattaaacatttcgccaaaattaagaagcaaatatagtttttgttaattgttcaggtttattttattcatttttgatcttcattttctagtccgcagaatgtcccaaaaatctatttctgatttcatttccaaagttacatttcaacaatcatcttcaactcaaataatgggcggctattttcaaaaatcctaattttgtcctgctcaaatcactagtctctgcaattctgtcgatattcccttctaatgcattttgtgaatcagtcttttctgttctgaagaacatcaaaacggacgagagaaacagtattggcatgcctttgttaaactcgctaatttcaatcaaattcaatgcaaatatttcatgtcccaatgctcacaattactttctttcattgccaaattttgccgggttttcgagttttcgcgatggcacccctgtttgggaggtctgaaacgcacgaaaaacattttttagcttggtttgaagctgctaaattggcctttttggccccaaagaccggaaaatgtttccaaaaaaaaatcattttttagcaaaattttctcaaaaattgaatgaatttaaattatactccagctcactttacaaagtctaaaaatcaaatttcttgtcatttcttacaaatttgcaaaatttcttaatttatttcgaatgccgaaaatatccaaatcgaattcttaatcggtcattggatttcgaagttctctgctggattaaaagattaattttactttcaaacacatgaaatgtatttgatttgcgattatgcgtgaaaaaatgataaagaatgagattttgtggaatttttatgcaaaaatacccttgatttttccaattttatcacatacctattttggcatttttggggggtttttatcacataaaaatcccagctctagctatatgtatggcgaagcaaatgttcctaataaagaaaatattagattgtacgcaaaaaaaagagaaaaatagagaaaaaagggatttttgttttttttctctgcactctctttttattggtcatctctcattttgttcagactgtggaatgaaaagaagaatggtctttgttgtacatgtgaatgaattcaaatgtgtaggtgagggataaagagaagtaattgatttatttgctgatttttgtgtaacaaaacacttaccaaaggccattctttccattcattcccatcattttttaaaatcgttttactctactcattactaaaaccaaaccccgactttataaaaatccgaatccggattagggaatttgacccggaacggaattcaggattaaaaatccttttcaggagacctgatccggtaacaaaattagacatgaacactgactgacccggatcaggatttttccagaaaacaaatcttttttggtacttgtggtgtatcggtggttaattatgaaaatactacaaattttgctgtgtaatttttaatgaacttttgttaagatttgtttgaaagttagtaatttttatctccccattcgctggtgactcctaactccgctctggggtggctcttttggttttcccaagagcgccacatttcgcaccaatttggacgtgttttgcggcgtcagtccatcgccgccgccccggggcgctggcgacgggaccgctgctggcaaaacgacgggctacggcggctgcaaaaaacgaatatgtgacggcatcagcgtttacagtgccgacggcgattcggcacaaccactgcagaaatagcggaaaatgggacgaaaaacgatgacattgacggccgtagtggtgatggtgaaatctgcaaatataacgcactcggagtttggctcgagaaccgagcaagcttttcatttatcgtttaatgtatcatttttgttgctaggacccgcaaaatcttacaaaataatgcccagccctagtaatgattggagttttattgtaaaaaaattttcgctttttcacctccaccacttaattcatgaaaatttttttttcattcaggttccgccgacaattttttccaaattgctcgctgttccgacaagatcgtaaatcagaattaattcatgatttaacagtacttgaaaacttttcaacatccgatcacaaaatggtcggatttaaaataaaagaaaaattcagtaataaaaatcccagagtttatagaagagattttaaaaatattaattttgcaaaattaagtcgagcgatacttgaaaatagatttgatgtttctataaattcggtgtataccgttgaacaaaaatataacgaattcttaaataaagtactgaaattatatgatacttttatacccaacagacctctaaaatcgataataaaacaatcgtaccctcaaaaaataagagacttattttcagagaaattacggttacataagcttgtaaaaaaattcccggaaaaaagtgatctcatcttaaattacaaaattatttcaagggaaatgaagaaacaattaaaacaattcagaaatgaaaaagagtcaaaaattatttcccaggggcaaaattcagttaacaaatttatccgaaataagttatcaaaattttttgagattcctactctaattgataatgctggaaatatgttttccagcaatgtacaaaaatgtaaaatattagcagaaatatttcaaaagtcttttttaagaaaatcaattgttaatggtccacaaactcagtcaacacagaataagaccaagctttttgacattgaattgaacgctggcataatttggaacatattaagaagacttccccggcgtaattccacttcacctgataatatcccttatattttattaaaaaattgcgcagatccaatcacaaaaatattagcagatatatttaggctaattttggattccggtcaaattccggaaatatggcgaacatctttggtagtatcaattttcaaaagaggcgaaaaaactgatccattaaattacaggccggtttcattaaccagcactgtctgtagagcttttgaacgaattttgagtagtaaaattttagaatttctgaacagtacaagattctttgataaagaacaatttgggttcttaaaaaatagatcgactacaactcaaatattaaaaacgatggacgatatatataattctatacaaaagaatcaacaaattgacataaataatctatattgattttgtcaaggcgtttgattctgttccaattgatttattacttcaaaaaatcaaaaagattggaattgaaggaaaaatttataattttttaactaactttttaaaaaatcggagttttaaggttaaaatcggcgatcaattgtcagaaagtttcaaaatatttacgggagtgccccagggaagtgtcttagggccattactctttttaatttttataaatgatctgccgtcctttatttcaaataaagcatcatcagttggcataaaaatgtatgctgacgatgttaaattatattatgcccatgaaaacgatgaccattcaaatcagttggataaagcggttgaggctttggaaaaatggtcaaaaataaatgggttagaaatttcaactgaaaaatgttttgttctttatttagggaaaaataacaagaaaaaagaatattttattaactcaaaaaagatttcagaatcggaaagtgtacgtgacttgggaattataattgactcgaaacttaatttttcagaacatattagcaaaattatacgaaacgcatatcttagaattttccaaattttgagagtgttgaaaagcagggaaataaaaactctaacagcagcctataaaacttttgtacgacctcaattagaatacgctaccaaagtttggaaccctaatttaaaaaaagatatagataaaattgagcgtgttcanaaaatttttcacaagaaaagcacttagaaaatgtggttttgtgtacaaaaaatatggggaaagactaaaaatcacgggtttaca

SEQ ID NO: 12797 - DNA, 1114 bp, Heterodera glycines
attttgcaaagcatttgttcataaaagcattccacgtcaggtacattgaccactccgtcatcgcattttttcgttccaatcagccaatcttcgacaaaagaggcaccaatttgcgtctgtcgatttattcaccgtccaagtacttgcgcagtttacggaaccaaaattcacacaatatgtttaaaacccctcaattgcagcaaagctgaagtccagcggatttgggatgtttttgtcgatggaatttggcccatttttgcgccaaacattcgccatttgagccttgccagctatgaaattcattacgatatttatgagcataagccaacgccaattgagccatttgaattggtgaacgaacggaccaacgagaagctgacattgaaaaaagaagtcgcttccttttttgcaattagtcattgggtgttgaagcgatgtccaattcttggggagacggcggcggttcagcagcagcagcagaagaaagacgaaaatttgtgccgtttgaacaatgtctccgtttttatgctttgtaacactaattgcattgggtgaggagcaacaattttcctttttttttttgttgaaaacattcaaattgccttcaatttttaggcctttgtctccaccggcagaagcagcagcagaaagaacgggccaaagcagcgaaaagggcgccgtctgattatgtggaaatgaatttttggcacttgatagaaaacttacaaattaggtcgatcattttttgtatgaaattattgatttgccatattttaaagtttaaactcatatttatttttaaataaatacaataaaaattagtagattataaatgtttggcacacaaatgggcatcgctcaaatggctgggcgaaagaaattcaagtgccaattcattgacggaacattgcacttattcatcgccaaattagggtgatgctgagcaaccccagttctgagcgataaatccgcgactcctccccctctcctcgatcatttgaaataataaattctaagattttgtccaggaaatccacgttttttcgtgtttaacctgtacctgggttttaaaaactgggaaattttagcgaaaaaaaaacggaaaaagatactt

SEQ ID NO: 12798 - DNA, 2914 bp, Heterodera glycines
ttcactggtttacataaaattaaaacggggtgccccaccgtctggctttgattagccataaaaaagccaagcgggtttttcgtttgttgttttcagttacgggtgtaataaatcaacgcccaccctgcggcaagtcctgcttgttggcgaagatgaggatgagcgcgtcgcgcatctcccggtcgttgatgattttgtgcaactcctggcgtgcctcgtcaatcctggcccaattaataaaatgcattagcaaaattcaaaaaaaaaatgtttttttttggaaattttgacccatttaatttctttgtacagcaaatggccccaaatgtgagaacttagcacaaaatttttataaaaatgagaaaaatcgaggtgtttttgtgtcgggaaaacctgtctctgtcggccgaatcgacaacaaaaatcagtgcttgtgtgccgacgtaataatgccgccacagcggacgaattttctcctgaccgccgacatcctaaaaaggggaagcgaaatgaaccaaaagaaattcgaatttatggaagagatgggaaaactttatacaattgaggagttaaacgtaagtaaacaacttaaaatatgaacccgtggaagtaaacaatataaaacatgaacccgcgggtggttttagggtcccaaatcaccgcatggcatttatttctgctaaatcccgggttttttttcgactcggggctcagaaattaagcacgaaaatcactggatttggcgtgtctctgacatttttttgctgaaattcctctctcaaatccataaatttcttttctttttttttgctttactttttttcttacccaaacactgaatttgatattcctgtacacaaccgtctcgacattgaacccaacggttggaatggatttgatggactggcccaatttgagcctgtagagaatacctgtaaattttttggaatttttaatagcaaattagaacaaaaaggcaccaatttctttttagttgaccagacaggaaatgttatttttgatttgataaaataccagtccaaaaatgaaatttcaacaattaataagaggaaaattaaaaaatgtgaagtgccacaaacttgtctttccagccgcgtccaatccgagcattaatattcgaatttcctttttgccaaatagtttcgataggattttgcccatttaaattaatctataaatgacaaaacaaaataggtggcatttccaactgatgttttccaattgatgtctcgagcgttatttgcatttttctgcatttttgctatatgtaaaagaaactcaaaaatagaattttttgtgttacaatttttgtttgttttggttaaggccgtttattatgagaaaaataagtccagaaatgggaaatttcatttttctactactcatttcttcaaaattaatattagttttattttgaatttttttttctaaatttatttcataccatatttaatgcttaaatttaacgaattgaagaaattttgaaaatttgaagaacgctcgcaattgaacccgaatatgatgtccgtttcgacccatttcgaactccgaacccggattcgaacaattatcaaaattcaattttttttctttcaaaaatgctttcccacttcattgccgactaatttccttatcagcaaattgcttcctacctacgcccacacccttttccctcatttatttggtcaagagttgcaggtcatttttttgcgttatcaatgcgagaacaaacaaagtgggcatgcagaacgacaacggcaatataaatatgatttcttgcgatgataataatttttaggagaaaaaatgaaaaaaaaaattgaattttgataattgttcgaatccgggttcggagttcgaaatgggtcgaaacggacatcatattcgggttctacgaccccgaaaacccatggaaacgactttttaatttaaaatcaatttaacaaagagaaaaattttgttgacacaaaacccgaaagtaccccaaaacgacttgaatctaaggaccctgctctgcaaattattacggacactatgggcgagagcgcctctttcaaaggcattcccggtgggcggagttcggtgaaagctgacgaagcatacagcgatgttagtactccaacatcaatagagaaagaatgtgttactattgtcttactattagtactaagaaatataacgatttttaggaagacaaagatgtcaacaccaaaagcgaaaataattccacgttgggaaaaaagcgggtactgttgcagaattgcaaagaaatgttctggaactctcaatcgaaaatcagaaaaaaatgtcagatctcttgacaatttcaattcatttgtcatttattttgatcaattttagcatggatcaacatgtgatcaatggttaacgaagccagcagcttccgttgccgacaagatttttgacgaagatgatccgacttttattgttggtgataaaacatttcgaacattgtaataacagtgccgttttaacaaattaatgttatacattttggacatttatcacaatttatttttgaaattattcaaataaatgttaaacatttcttatgaagcatatgattaagttgttaaacccaatattttaacaagcatttcataatatttttgaaattatagccaatggcagaatttatggaaaacttagaacagaagaatagaaggggtgccaaaggattttacgttgaccctgtccttgaattacggtttttatctgcgggcgatcgaaacttcgaactgatcagacgataccgctttcctgatgaaggaattgatttcatttcaagtcttgtaaaggatgaccttcagccaaaacgatggcaataaaggaaatccaattcctgttaaactacaggtttaagttggttaaa

SEQ ID NO: 12799 - DNA, 1390 bp, Heterodera glycines
  misc_feature (50)..(50): n is a, c, g, or t
cgcgtgcggtgcggaaaacgatgggtggccgagtccttctaaggcgccgngcaatttgcccgcggcgtccttgacaacttctggaaaaatggaaattaaatttaaaaaattctttttttgttcaccaaaaaaatcatggccattttctaaataaattttttatgtagcagaaaatttgacattttttttactgttaaaaaagtaggtaatcaataaatttcagcaattaaaaaactgttattcgtagaaatcgaaaatttacaaaaattttcttccatttttaaagcggattaatttcaagaaattatatagaatttgtatgcaaaaaatagaaaatttctcagtttgctgaccgtccaattcgtcgtccgacacggtcgggtcaaagtcggcggtgtaatggcgcgcccggtcgcccgactccgctttggccaacacttcctcgtccagcgagaagacggggtctaaaaaacgaaaacataacaattaaaagacccatctatttgaaaatccccccaaaaatttcggggagggcacccgaagagcttcatttttttttgctcttcgggtcaaccatttgtttctccattgtttttattttctattttcagcgcaggggcgaaaaagcaggaatttttagcgatttgcgccaaaaataacaaatttttatcgtttaggggtcacatttcaaaaaaataatggtccaatggggtccggcggtgccgctaggcactgccgggaaacatttttggaaatttaatggcatacgataagaaaatgcacaaaatttcaaaaattttgcccattttttctggaatttatttttccggtggggtccggaattataaggtgctcctttctgcacaaaataaagaagaatttgatagacttttgtattatgcccaatcgctttgtgatcaaatcgccaatgaattcaaaaacgaaattttttcggcagaaaaacaattaagcaaaactgttgaaccaaataatgcagttgtctttctcatttgctgcacggattcttttaagtttttggtcggtatttattcaaatatataaataatagttattataaattattaaataaccttatttttcaattacatacaaattcatttttgcttattccatatcgggacagagcatcaatcgcataattaagaaggagaaactcgaaattcaacctgtaccaaatgctgggcagcccttggcaatctttgaatatttttgaaagttgaataatttaaaaataaataatattaattacttaattttacccagaaggtatgctcttggccatgctggaagaccccctttgtttccgattaacacatggaatcatcatgaaagcgttcttaatgacatgggacgtacaaacaacgttcca

SEQ ID NO: 12800 - DNA, 4239 bp, Heterodera glycines
  misc_feature (1542)..(1542): n is a, c, g, or t
aaatcacgcaaaaaattttgacaaattattaagtttggggtggaaaattttatggtcgtgtctttttcttaggtcgtgtgaactgcaatcgagccgtcaatggtcatgatttagataagccgatttttttttttgaaaactcattggaggtaccattaaaaaaaccgcccgtttcctcattccgcaatttaaagcgcttttaaaattagttgggtaattttttagtaaatgtttgaaaattgtcactgcccgacccctggaccaagccctccctctaaccctagaaaaataattttgaaaaaaaaacctgcaatttgtgctgctccgtcattttcgtgtcgtcgccgccgccaccgccgccggcgcctccgacagtgtttgaggtggtgctgctgttgttctcctcactttcgctgctcatcatcatcagcatggtctgctgggcggccaacgatggcaaaaatggatgatggttgaagcgatatctgaaaaagggatggatcaatggatcaaaggtaaataaatttcaaaaaatttgagggtatgcaagaattggaagcgggtgggggtgtgtgtatccgggaaatgccggcggaacccgatttccgatatttttgggctcgaaattccgatttccgacgttttggggctcgaaattccgatttccgacattttggggctcggacttccgatgccaaaaatttttgagccgttggtgccaatttccgattttttattttttgtgtgcattggcatatattcctaatgtgcatgccattttttgcacactgaacattagctgaatttcgtgaaaaagtaaattttggaccccaatttccagtccttcacctccgggcgaataaaactaaaatttcttcaaaaaattgaaatccgcccaaatatccaatgtatgaatttaaatttagcctaaaagtaaacaaaaacgccttttcctcccacatctgtttcttagttttttgaatttttttgaaaagcgttaatttttaaaatggcacggcattcattcaacaacactgtcctccctatcttcccctcccccctctcaatctcggcattttttttttggaattttcattttcatttttttgtgtgtgcctgctgaggttgttgtgcatttgaatgtgctgttgctgatgttgttgttgaccattgccgatgataatactgttgctgctactgtcactgcaattttctttgccaccgccgccgccggtggttttttggttgttgttgtccatgaatggcagtgaaaaattaagcggatgggaagagaaatgcggggggcggaagacaaaaatgaagatgaagaatgaatgaatgcactggatgaaatggcacactgtgtggtgatgatgatgatgaagatgatgcccttttacggagcgctgcccgttgcgaaaaaaaatgtggcgggtgaaaaagaagccagagaagaagggacgactaacacaaatgaactgctgaaaaatggggagaaatcaatttcggaaaaaactgaaaatcgaaattttccctcagtgngagcaaaagggatgacaattaaaaaacgattaattaagagaaagtgccatcagaatcatgtggcacaaaaaaacgtacttgtacatctttaaggctgtccttaatttgagacatgatttttgaaaaatttaaaaattcattttgaggttagaaaaattttgaatgttggatggcattatgcccattattgttattttcgcgtcactttaacttaatcaaatttttaaggagttaattattttttatggttaggtaggtatttgtaaaaataattgtatgaattttgtgatttggttcactttttcctgaaaaaagtgaattgaagggtaaaatgaaaataaaagaaaaaaaattctgaaaagatattttgcttttattaagaaaaatttaaaaaatgacaccaattcattcattttgcccgtggcctacgaggaaaacataaaattggtggtggaaaaaaagacatttacaggggcagtggtacgtacaacttcaattctttcctacaatatcatctcctatctccacttgcccatcatcaaagcaaatcaaaatcatcatcaaattttcgtagtaatattggaaaggtgtcgaaaggggtggaagaaaaatgatcaattttcttctaatcgcatcatcaatcagcagcagtaattgtgcaaaatgcttcaaaacaaaatcaaatcgatcgggcgtagcttaatactgatgctggtggataagtaagggggggggggggggggtaaatgaataatgcaattttcatactaaatgatggagatacctaacacaaacgaaaaattggcggaaagttgtgtggtgaaaaatgaaaaattgtataatacggtcgagaaattttcagggttttcatcaaacattttttcagtgttttcggttttcgccgataaaaaataatgatttgaatttgcacaaaggtagggacatatgccaaagtaggaatttccagcaaaatcattctctgaggacatgaaaccgagttgcaaaaatcaaattggtgtgtttgtacatgttttttcttgtcaactaaaatcctatttctctatttatgtatttaaaaaatggattggttattcatttttttagtgctgctcgagagtgtcggtcctcgcctcgagaaaagtctcgcgtttttgtgtctcgggaaatgttactgttatttttactaagcgttggcaaaacgaaaatttgtaaaattccctcccccctttcagccatcagcagagttgtataaaaataaaaagatgaaatttgttgccccatttataaacaaaaaaaaatttattattacaaatcgtaaatttattgttgagtctgctcattcattcctttcatcaccaccaaaatgcctctcaattttttttaaccaaacttttttgttagtctaaaaacattcaaaagatttttactcaaagtcgtaaaatcagacggagagttcgcccgcggcgcccataaatattttttttattttcaatattacatataaattcggctgaggtcgcctcaatcatcaagcaatgcaaataaaactgttttggaacataaaatttccaaaattgggagtccctaatgttgcgctgccacctgtcgtaaaatggcaatttcaaccaaaactctcgaggttggttggttgctccattgtatgtatttatgtaaccaatttctcgaaaatatgtaataatttttgttgaccataataaaactgcgagagttttctctccccccaagcagctcaagcgtggcttttgagttgtttggggcataaaacaaaatgtaacaataaacaataaataaggtacaaataatacatcattttctttcttctcaagatcaaatcccgtcaccccccgggggccaatgacaacagaaaacaaaaagaaaaatggtaaataaaaattaaaaatttgttgttgtgcactattttatggatggggtcacgtgcccaaatggataatttggagaagaaaatgagaaaattgtacacaccccaactcaatttttgggctcacagttcaaaaaatatttgtatgtatggcgaagtggtttttgtaaactagtaaagggacaaagggcggaggttcgagtccgttgtgctacatgaatatttatttttctccaacaattttcggaattttgaaggtttttgacaacaaaatttgacaatcttggtatcactcgaaagctttgataaggagaatctttttctaagcaaatgctaagcaatctgaaaagtttgaaaaaaatgagcgttcgaaattttgttctctgaacaattcataaaccatttgaaaagtcaattaaatcttaatattcatttcaaaataatagtttgaaatagaaagttaattttgccaaacccaaaaaattccaaaaattttttgcatttttaaattagatatttttttatctcctgaagggatgttctcgactggagaaaaatggaaattttcatattttctaatgaattaataacgaaagcagcttgacatagggtcccaaacgtgaatatttcatgaaaaatcagaacatacatatggcatccgtggcataaaaaaaaagattaaaaaaatttccattttacaaaacgccaaaatttctcaatgaaagcgcccgccaactttaaaaagcgaacaaacgcctaaatgctaaaaagaacttttcccgtcgggagagagagca

SEQ ID NO: 12801 - DNA, 1542 bp, Heterodera glycines
cctttgacttcatgatgggcctcagcgcccttggccattgacttcacgatggaccccagcgcccatggcctttgacttcacaatgggccccagcgcccttggcctttgacttcatgatgggccccagcgcccttggccattgacttcacgattggccccagcgcccatggcccttgacttcacgatgggccccagcgcccatggcctttgacttcacaatgggccccagcgcccttggcctttgacttcatgatgggccccagcgcccttggccattgacttcacgatgggccccagcgcccatggcctttgacttcacagatggcctcagccaggctcgtagtgtagaacataaagatttcgcccggtgggactcgaacccccgacctctccaaagcatgaagtgctctgtccaactgagctacgggcgccacttagtggttctccagtattgcgcctgtggtcgtctcagtttgcgccatcgttctgtttacgcttgtgttcaatctcagtctgcgccctcgctcagactcagtttgcgcctgcaattgatttgcgttcccatttgcgttcctcaatgtgcgttccaatttcgcctcaatttgcgcgctgtctttttgttcctgctcagacagtttgctcttccctttcgcctcgttttgagcttcctcaatttgcgcttcctctgataattttccattccgcctcggtctgcgcttcctcaatttgcgcttctcatttgcgcttctccaatttgcgcatctccaattgcgcttcaacaatttgcgctgctccaatgcgcttctccaatgcgctttctccaatttgcgcttcaacatgcgctgctccaatgcgcttcaacaatttgcgcagattaggctcactgccctctttgtgagctcggcacaatgccgccaatgagtgcgagataggctcgctgcctaagcgcatgaccattctttcctgaggggctgtggtgcggaaggcgaggcgccacgggccaaaaagagacccgaggggccgtatggcgcggaatggaaggcgccccgggtcacaaaagacccaagggaccatatggtgcggaatggaggcgccccgggttacaaaaaacccgggaggccaaacggtgcggaatgcaaggcgcgaaaaggcgaggtgctacgggtcacaaaagacccgaggggccctatggcgcggaatgcaggcgccttgggttacaaaaaacccaaggggccagaaacgcggaacgcaaaatggaatggcgctaatgccagacgccacaggttacgaaaaacctgtggggccggcatgctccccctacccctgctcacaaaccccaaaaccccaccaaaatccctgccagggtcgccacttgttgcggctcggcccacaagccgcaacgggacggttcgtcgtccattgttcggggtggggtgaaagcggagggagagggagaggggctgcccagactacccaagaaccccccaaaatggacggggtttttagtctttattttgtcgcaaagccatacgaaatgtacaa

SEQ ID NO: 12802 - DNA, 2022 bp, Heterodera glycines
  misc_feature (2015)..(2015): n is a, c, g, or t
ctgaatcagtgtttgcggaatgaccgagctgataatcgccaataatcttcgattacatttttcttggtcacctttttgaaattccaccatttcaactccttatcatctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaaccgatccttccggaacactgatgctgtttatatttagagcgtaatgagctgaaaatgtcagaattcaaaaagtggggtcgcgaaaatagtaaatctgaggttattgacgcttatcaacctgatccgtctgcaacacttaaacagtttatatttaaagcctaattagcagaaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttatgaagcggatcgcttcgggacgctttgcgtccattggttcgggggtgggtgaaagcggagggagagggagaggggctgcccagactacccaaccaagaaacccccaaaatggacgggtttttagtctttatttgtcgcaagccatcgaaatgtacaatttgtgttgcttatataggatcagaaaatgggcgggtacaataaaaatgatggggtgatcatttgggttgattggtcgttcttcttcttcgtcgtcgttgatcgctcgatcggctttttctgcccttaggcaccattcacatgcgcggcgggggctggtccgctttttcacttcttctttcttcccattcacatgcaaaagcccctcttgcggtcccccttttttctcattcttcgcccaatttcccgttctcctgttttttcctccttctccccccgcatttctttccattcgacaactgtccgatcatcggacagtcgcggctaaattcgagccgcgacattcccacgcttgaccaacgtgtgcacgtaatcgcccttggcctctgacttctgctgggcactctgccccttggcctttgacttcacgatgggccccagcgcccttggccattgacttcacgatgggccccagcgcccatggcctttgacttcatgatgggccccagcgcccttggcctttgacttcatgatgggccccagcgcccttggcctttgacttcacgattggccccagcgcccatggcccttgacttcacgatgggccccagcgcccatggcctttgacttcatgatgggccccagcgcccttggcctttgacttcatgatgggcctcagcgcccttggccattgacttcatgatgggccccagcgcccttggccattgacttcacgatgggccccagcgcccatggcctttgacttcacaatgggccccagcgcccttggcctttgacttcatgatgggccccagcgcccttggccattgacttcacgatgggccccagcgcccatggcctttgacttcatgatgggccccagcgcccttggccattgacttcacgattggccccagcgcccatggcccttgacttcacgatgggccccagcgcccatggcctttgacttcatgatgggccccagcgcccttggcctttgacttcatgatgggcctcagcgcccttggccattgacttcacgatggaccccgnagcgccc

SEQ ID NO: 12803 - DNA, 1196 bp, Heterodera glycines
tttgaacaaacgtttatcgacaactgttgcatgcaattggtggcccgtcctgaacagtttgacgtcatggtaatgcccaatttgtacggcagcattgtggacaatttggcggccgggttggtcggcggtgcgggcgtggtcaacggcgagtcggtgggctccgactacgtgatctttcagcctggcgcacggcacacattcaaagaggcgtttggaaagtcggagcaaacaaaaaattattattttttttacaaatttgaatttttatttatttccagacaaattgccaacccaaccgcgatgattttgtgctgtgccaacatgctcaaccatctccatttgaacagttacggcacggcactgcgacacgctgtggagaaagtgctcaaagagggaaaagtgcgcacccgcgacttgggaggtgtgtgtgccgtgccattcattcattactcaatcaaaatttcataaaatggcaccaaatttgtactacaatataatgttttttccaggctttgccaacaccagcgattttgccagtgaggtcattgccaatttccaaatgtgaaacgaatgatgttgcgcgacagaaatgtgaatgatggcacaacatgccgaaaaacaaaataattattagaaaagatttttattggtttgtttttttcttgttattctgatctcattatcatcatcatcattctgttgttgttgttaattttgttattgttgttgttgttgttgtcgtaagaatataataggcataattatttatagttttttctatttgttttttgtctcacataaataattcgtattgttgtattttatggtagagactatcatttgttttttcaatctcatccgacatgattgatatgcaatgaaaatttgctgaaattttatgaaattggcaaaaaattttctagaatttgccatttccaagtcatggtaacccctcggaaagttggggtcaattagtcaatttttaagtattggttgggttatctttccgcctcctcccattataattccgccgttttagccaaccactcataatttgcctcgaggggacacttccattggcacaacatcactcctcccccccggggggaaatgaatttgcacggcacaaccaaacacacacatctgtcatccgcgcagaggaggtcaaccgaacccaaaattatcattcatccttt

SEQ ID NO: 12804 - DNA, 2281 bp, Heterodera glycines
tttttaggattagttccagtagcatattattgtacctacattaagcagcagcagcagacagtcgagaaagggccacccccccccccccccccccaattttgggcgttttgcggggcgcctggcagtgtctgtccccgggggcggcggacattgcccccgcccctgccggggatgggttgggttggcatatggggaagagccatctcggcccggcggcggcgtctcccccccccccccccgcgggtcaatttgcccccgtcaattgggccgggggcggcaaaggcactgaaaatgatttattacttgaggggcgagaaacaaatcaaaggaggaagacggcaaaatgttcattctcattagcttgcctcccgcctcgtccccactcatttcggcacccattaaaaaaaaaattaaatttttcaaaaaatttgcatatttttcccctcggggccaattgtttaaagcgaaaacgcgcagcagaggacagcagcgggacggaaagcgccgcaccaactgttttagtttttgatgagaaaaaggaacattagcagcagcagaggacaaaacaaatgcccgccggggataacggtgggaggaagaagaaaagaaacggaggcttaaacaccctcccccctcgggatggacatttttacgacggacgacaattcaatcccttgcccccccccgctctttcactttgactaaaaattgatgggccaaaaggtcgtcgccagaagagggagggacatcacgacacgacgacaaccaccaactcatcagcagcagcagcggtcgtcccggcccggccgtcccccgaggcgcaaggggcaacggggggcggcaggtgtcctctatcctcgactgctgctgacccgcccccgggggattggcaagatcagtccccctcccctccatagcccacaagtccaaggcagggcagcagttgtctccaatgccctccctctgcctgcttgcccgtccgtccatgtgttgtcccccctcaatgcccttcccccccgcccatttcccccgccgctccctatggactttaaaattgtaacaaattactatttatttatgtgtgtaagtttaaattgggtaaaatgggatggatagaaaaaagaagcagcaatttacattttgaaaagcacaacaattgcatccgccctgctctaatttgtcaatggctttttggcacttttctaaaaacatttcgcgacataaaatgccgaagtgcataaaccaattaaacggggcggattttttgatttttttatgcccctcgcgctatttttgtttttaaatttcgcgcctcatttttcaatttttattaaattttactggccccaaaaattaaattttttatttcactctaattgtacgtttttcatcttcctttgccgtctctgttttccatttttttcctttttttccattttttcccctctctctccaaggaattgtcattcaaaattcgtcccattccattcacattttctcgcccaatcgccataatggtgctatgacgaagcgacaaaaatatgggtgtttgtaataattaaatttaattattattttaattttattttccaagtaattaatatcataacttagcttaagcttagtctaattaataaaatttagtctttagcgacagctcgaagcatcctctactacttatgaaattttcaaaaaattagtaaaaatttacaaaaagttgtgactaaaaaagtgcgaaaaattttgactcaacaattttgaccctagctttcttgaaattcaataaaattttttgaaatttagcagaacaatagagtaatctttaggctatctaattatataaacaaaattaaaattgattgttttagaaaaaagttatgaaagaattaatagggtcatatttttatggacatccaaaatgatgtaccgccattcatgtgcatatctattccccgaaataaaataacatcgctagcagaagacgaattgacttccccaccaagatttgacgaggatataaaggttataatctccgccaaggtaccacgagacaaagagaccgaatttggatgatgacaaatctcccccccctccggttaaaccagcctctccacctaaaccaataacaccgtctcctccagctacaccattaaaaccaccccctccagctaaacaaataacaaaaccccctcccgctatacctttctgcacaaccccctcccgctaaaccagcaacaccactgcctgttgccaaaccaaccacacaaccccgtctacctaa

SEQ ID NO: 12805 - DNA, 701 bp, Heterodera glycines
  misc_feature (197)..(197): n is a, c, g, or t
caccccctcccccccgtccattcacttttctgtatggtctccccccccccctctcccgcctcatttcgtctctaatgagtgcgggcgcggcactcccggccccggccaattcccaacaagaaatgacaagagtggaggggaaagcttaagacgaagtgctactagctaggctcgtcgataaactcactccccccccnccttcactctcgagtttttctgttccgcgcgcaattgggcaggcagcacacattttggcgcattgccccatggcacaaatttaaaataaaaaccccaaaaaacggaatgccaacggagtgaaattttcccaattttttttaattcttaggccgcctaaaatagctttggcaacatcggaaatgagctgtatccatggggacattagcagaagaagacctaatcagcagcagagggccaagggacaacagcagcctttctccctcctaattaaattggaaaaaatcaaaaaacaaaatccttattaaaattattttaaaaatttgttggcatccggggtaccgcgcgaccgcgcaattttttaaccgcgatgcgcgacagccgtgatttttctgtccgtgctctccacccacctctggcggacatcatcctattgcccctaagggatggatggatatattttttggaaatggcacatttaaacattataaaaaattttaaacaaa

SEQ ID NO: 12806 - DNA, 1248 bp, Heterodera glycines
taattgttcattttctttatttattttcttattttccttctctgcccatttctcttcaaaatttatttttgaatgccaatatttgatgcaaattttgtcaaaatgtctctctgccaaaattcggtgccaaatttcatttgaataaatgcctaactcgagcaaatttcgcggcatctcaatgctaaactctttcgaatttgaaagaatattttgaaaatggcccagaagaaaaacatcctctttgatatctaaaatgttataaatgtcataaattttgaaaatttttttatttttttaatataaaattgatatttttattctttctttcgaaatacactaagaaaatcattttgctaaatttaaatttaaaaattttaagtttaataacaacattttaccctcttttccaagaaaaagattaaagtcaaaataagaaattttatttgaaatatgattcaacttttttttcatttattgtttttacttagtttttttaatatattgataagttttttaatttaaatatttttatattttctaataaaagtaaccgtttatttttaattattataaatattctttcatttaaaatacctgcaattctataggcttttttggttttggcatttgtaacagcggcttctttttttgcaacagttccttcaccattagtaccagaatctttatgctttgttttttcttcttcattaattttgttttccttttccttattttgtgttttgtcaaccttttcttttccttccaaattttttgtcagcgctttgtcatcattatcatcagtcttttcatatggtgatactttgtcagtttggcaatttcccttggcatcattttttggcattttctctgatacagcgaacgacactgtatcgtaaaatttttttgtcgactctttttcctctgacaattgatcctcccaattttttgtaaacattttgtcacctttaacattttcattcgtatcatcaaatgttgacactttgtcttgtgacattttgtcctcaaaagtgtttttcatgtctttgccattttctttctccccgtttttttccttttttgtctttttcgccttcttctttttcttcgttttgtttttgctactttctccggtattcgtcccattttctttgcctaataatgcgtcatttaaatcatcaaatttggactcaatcccaacaatttttaaaatattgtcaacttcctttatgccaacaaagtcggaaagca

SEQ ID NO: 12807 - DNA, 1756 bp, Heterodera glycines
  misc_feature (1737)..(1737): n is a, c, g, or t
attgttaaaatcaaaccctttttcattcgcgcagcaaactctgtgattgggtcatatttttcctcagttttaccatgttcttccccattggtctttaccatcggctcttggttcaaaaagatacgtttaagctgattagcatgcaattggtttagccattctcgtactacggtgcccattggattgtgccgttgttgttcctgcttttccttaccaccggcactgtaaagtcgctccgattccgtttcaagttgcttgaccagtttttgccatacaaccttcaacacttggggctgatcacaatgccgatgggtgatcagaaagtgtttcagttcgccgcttgttagttcaaaaatggcaatgtcacggcctataccataattatcagtcaaattctcgtcaaaaacattgtcgtataagatctttaattcttcccgttgtttgtgccaatattcgcaaatatattgcccctttggctcggcatcaaaccagcgcacaaacacaatgatattggctgccaatttggcacttattcgttcgatttcgggaaaactgttggcatttaaaattgcatttgtataaaaagacgtcaaaattttgtcgtcctcaaaaactaaagtatgcgcaattttttattgtctaatataaaaacaatttcgcacattatataaattatacaaatttaaaaaattccgtgctcggccattactgccaaatgggcgtttctctaattgcctccccccgcccctcactcatttcaacttcccaaaattcaaaaaagacgagatttagagaaaatcaaagtttaacttttaaaagaaaactaaaaacaatttctaagaaatttttttttagaattttccaaatcttttattatattcattttttcttaaaaacataattaaattattccaaatgctctttttccacccaccatcgccaggatattggcacatttgaggatatttggcacaaagtttgtcgaacaattttttgccaagcaatcgcttcagtcgtgtcactgtccctgccacactgcgcttcgtgaaaacagaaacaaacggaatgccattttctacagatgacaaaaattcgtagtgccatttccgtatcctttcccaaagttgcttaaattgcggcacttgggcatcatttacaacgcaatccaaaattaacggttcgggtggcagaataaagctgccgccgccatccacgaatttcaccaaatgcatcatccaacaaagtccctccgcattgtcaatttgattgtacacctaaaaagggttactgtaaccagagttgggttggatgatagagaaatgtcatttagtcttggcatttagcacgatggtcccattttagaggatttgacacgccaagaagggtgtggccattgggtctatagcccacaccaaaaaaaccgtggaattttataaagtttcaattaggtaaaagcttttttaaatctgcattttttctaaaacaaaaaaaaaatcagtaaatttttaagtgaaattttcagtttaaaaaccatgcggagcacctgactgcgcataatgccaagtgccattcgtgtgtcggtcgcttgagtcgtgccaacactcagcttaacggccaaacgcaatttgaaataactaagaagaagtgatatggcgaaacgatgttcagctttctgtgccatttcagtcccactacggttcaacaacacacgcgcgtacagtgactcacgatgactgnggcaaagcacttctgtgga

SEQ ID NO: 12808 - DNA, 817 bp, Heterodera glycines
atttttctgcgcaatattggacattgtttgcgaatatgggctcttttgttttcgttggtatatattcagatatgattgtctgaagaaattttaatttcaaatagaaaatttaatttgaatttatcatctttataattttaaagtaaatttgctattaatttctcccattaaaatttgaaaatttaaaatctaaaacataccgcaaatacaggaccagtgtttacaattaaaaaaaaaagaaattaatttaaatgaaaaaaagcttggcaaaaattttaattttcgaaatatcttctaacacatttatttcttggtattgttcgaaagcatttgaaaaactctatcaaatgtttaatttgattgacagtgaaaatttatggcccaaaaagtctttcggcgacttttcggccggcgacgttttggggtgcacccactcttcccacactctaataccgtttcttttgatctctcactaattaaaaaatattaaatatgtacggtaattaagcccacaaatcgctttcatatccgaatttttaccatttctgaccaccgttttttgcgcaacatttgccacaattcttctctttgctgttccgtggcattcgtccaaaaaagactgatgctcataattgtgaatttatgaagtgtacaaaatcgttgtgccaaattgtccatttgggcaattgtgttcagtgtgacagtccatgccgaccacaatttattcaatgcctcatttggtattgtaaattgatcactttcaaaaccagtttcaagaaaaagaagcagttcttcgataaaattatttatctgaaca

SEQ ID NO: 12809 - DNA, 2117 bp, Heterodera glycines
  misc_feature (131)..(131): n is a, c, g, or t
tttttgtgtagaatgggaggtctctttttccactccctttttctctctctgctctcattttgtgccatccattttaagcttcccaaatgtgctcattctgtgcacttccaacctgaaacaagcgttggacnccgcctttgtggacagagccgacatcgtccgacgcattggcaatccgacggaggcggcgatttgtgcaattttggagacggcaattgaagaattgcaaagggtaaaatagcacaacaaatcaatgataaataaatagagttttaaaagcgtttttacattctcaagattaatcttgtcgagagtggcaatttgctgagcggacaaaggaaggaaaaattcgaccgattgatcaggtcagtgggacgaagaattgctgaataattgataaaaaagtctttttccattttctctccaaaagagccgcaaaattttacagggacattgtttaaccataattgtcgacattttttgtaaaaggactagcaaataattgcacaatttacacataattagcgtttatttcccatcattttccgagcggttatttcagagagttgggaagtgttcggttctgatcattttctattcttttctcccccttcctttagcatttccgccaaatgcgccagcagtggccgttctcttcgcaaattgcccgtcgtcgcttattccgccgctcgttcagtttcgtcggtagtgttggaattattgtcttctaattaccccttaattattccagaaactccctcccattggtctcgactcgtttttggatgcttttgcgaatatcatcgagaattcatcgcatttacatttgggattttaacacatttctcccttccctttgtccatcgtttcgcttttttcactttgattttttgttttccccatttttaacaaataaaaaattaaattattttggaattcctatccaaaaaggatatttgcacactttttgcgtgaattgtgaaggctttgtctgatttggtaaacacagctgcgttgaaataaaaaaaaggggagggagcattttagactgactttccctctggcataacaatgagttaattaatgcactaattaccccccccccccccttttttcccttttttttgtttggttccatttaaagtcactggttcactacaattttatgccacttttcgaaatttctctaaaaattttcccgaaaactgctaatgaaaggccctttcacattctttttagtcctcctccattgctcctctaatttcgtcttcatccgtgctcaaacatgcaattacgcagctgtgcttggccgtacgtttttactagtaaatcccctactttctcttccgtctgatcattcccttttctctctcttctcttcttttggtcatttcatttccctttctctctttcttcccttttctctctctccccatttctctctgatcactgctttgtttgatcattgttcttccgccgatcaatcaaatcattcgctgtgtctaggacagactttttagggttagaagcttaattaagcctttcgtattttgataatttttgggcctgaaaatccttgcactgatcattcccacttttttaagcttgtttggccaacgaaactccgatagctaatttttatttatttttttgagagtggaaaattggtgcaaaaattgttcaatcgggtggaggaactggcagaacaaccgaattggcttgtgtttttgctgattgacgaggtgaatcggttgcaaaatattgaaaaacaaaaacactcgttttgtttaaatgcatttttcatttgaaaaggtcgaaagtctgaccatgggacggaaggcggccttctccggcgccgatccgtccgattccgtgcgcgttgtcaatgccgtgctcacccaattggacagagtcaaacggtgcgtctttttaggttttttcctttttcgaaaacggttgaccttccctcggtacttttcagttttgaggcctagatttgaatttaaaaaaacaacaaaacacgcgcagaattgcaaatattacgatccaaaattatattgggggcataaatgcaacaagttgagctaaactttcttcaaatggatctgcgccacttt

SEQ ID NO: 12810 - DNA, 998 bp, Heterodera glycines
aagggcaaggatttaatcctcgtttaatggggtatgacgtgtgcggaaaaaaaatgtgatagcggcaggagaagttcaggttgtttgatgtagtaagacttgtgcaatcttggtataggtctgggtttgtccaagaaaaacttgtccaggccgcgctcattctgctgttggatcgatcgagcttcgcgttgttacagcacataaccatttaatcgattcaacgcaacataccgtaattaaaatgataagggtgaattatttggaatcattaggtgcgtgatcgcaaggaacaaatcaagcagagagccgcaaatcatgcagatgctcccagaaatattaattttttaaaatgacgctcgttgggccttgagcaagccattggaaataaaaaatttatttttgtgtattaattgatgtattgaaaaagttaaatattatgatgaagagaataaaatatcttattcttaaattgataaaatctaatagtaatatttattcaaaattacataaaataaatttaaatgaaatgtagggcaaagccgcaaatgtccgattttggcttgggccgcaaaattcagcaaaaaattgggccgcaaatgtccgaaaatggcccttaagaaatgggccgcaaatgtccgaaccgcaaatgtccgggccgcaaatgtcgggccgcaaatgtccgatttggctggggccgcaaatgtccgagccgcaaatgtccgggccgcaaatgtccgggacgcaaaagtggggtaaccatctttgctatacatttttgtagggttcgagccccgcccccgtcacccccgcccccgccgggggcgggacaggttttttggcctcacccccgtccccgcccccgcgactctgacccccgccatcccccgcccccgtgaccttcgcccccgcgggggcgcgcgggggtgaaaatgtacccctaaaattgacttttcgagatgagtgatgtatagttaattggcgatgatacaaaaatttaa

SEQ ID NO: 12811 - DNA, 2595 bp, Heterodera glycines
atttttgcatattaaaattaataaaaacaaaataagtacatcaatttaatttaatttaaattagaatttatttttttatagaagaaaactgcaaacgaaatttatatcgtggcaaaagcaaatacctatggtaaaataaaaaagtgacttttgaaataacacaaaatttttaaatgccgaaacgcgacgcgcaactgcctttgaaaaataaataaataaattaaaaaaatcataataaaaaaatacaattcattctatcatttttcatttatttttgtaacattagaaaaagtattattatattccacataataatgaaagcttttgaacaaaaatatctttcgcaattccattcttttgtgttgtaaatcaaaagctttcaaaaagcgtttagtatataaagcgctaaaattacaccaaaatcaacaaaaagaataaataaataaaatgcttttttcaatttttctaatttgcttaaaaagagaaactattttttatataattaatactagcaaaaaaaaaaatcatttattcgaaattccaaattttgaaatttaagaaaatgccatttaaaattgacattttgtttgcgtgcgcacttttcattgcggcatctgccagcccaattttgccaacttcggcagatgcaaaagatgccattaaaccgtcggatgatcatggagatgaaatttcaacaccaattagacacaaattagtgaaggacacggatggtgaggaaacagccaataaacgggcattccgtaagtaaaacgattaaaaaatttgaagaatttatcacgaatttttgtagtttttgatggacaaacgccattcactcctggagtaatgccctttgttcccggtggaatgccgccgaatgttcctggaacgagcccaatgattcccggaatgatgccgagtgttcctggaatgatgccgagcatgcctggcatgacgccgaatgttccaggaacaagcccaatgattcccggaatgatgcccaacgtgcccgggatggcgccgagcgttcccggcatgccacctaatgttccaggaacaagccccatggttcctggaatgccgccaaatatgcctgtaatgccgcctaatatgcctgggatgatgccgaatatgcctgtaatgccgcctaatatgcctgggatgatgccgaatatgcctggaatgcagccaaatatgcctggaatgcagccaaatatgcctggaatgatgccgaatatgcctggaatgatgccgaatatgcctggaatgatgccgggaatgatgccgaatatgccgggaatgatgccgaatatgcctggaatgatgccgaatatgcctggaatgatgccgggaatgatgccaaatatgccgggaatgatgccgaatatgccgggaatgatgccaaatatgccgggaatgatgccgaatatgccgggaatgatgccgaatatgcctggaatgatgccgaatatgcccgggatgatgccaggattcactccgcagtttccaggtatcaatttcaataataatcttattaatccatcgctcaacccaggaggattcaatcagatgccgaatcaaattggatgaaaaacattttgacaaacttcgatcagtgataacccagcgatataaatttcacttacaattaaagcatttcatttttttttaattttcaaacaaaatgcttataaaaacttataatttttgatttgttatctttcagaatcatatagtaatattttttttgcataccggtaaattgtttaaaaaatacattaaaatggataaaaaacattagaaattattgatgaataaagtttatcaatgcaaatgcaataatatacataatctataactgaattcaaggcatcaaaattcattaaattgaaatctcatctttaagtaattaatctacgtaatataatgctttgataatatggttaattacagttttccactaattaaaatgaattaatgctctaatttgtaagtgattaaatttatcacaccagatttattttgatttctctcacattttcttgttgtttcggtacgccaaatccattaacatttactgctgacaaattttggttttgctgaactgaaagcaccgcttgttgttgttgttgattagctaatggtccgataacatttgctgtagctggtgatggtatcgtacccattgggattacggtacgaattctgtgtaaatggaaaattgactaaatcaatctttttcctattatttacagctaaattccttgtatgctttttgtttatattttaagtatttaacaaatagttttcacataaaaaacagttcgatttttttaccaaatttaatcgaaaaatcaaccaataaatattgtaataatttgagcaccaacaaccgccggctctaaattgagcggttctataaatatttatttttccattacaaaaaaagatactaatggtttggaaaaattcgcaaaaaaagagaaaatgtgaattttccagtttttttttcaagttccggttaggaaagaattggtaaaatagatatcaaattcatgatcaaggacccaaaaaaacccataaactccctaagaa

SEQ ID NO: 12812 - DNA, 896 bp, Heterodera glycines
ttcatgatcaaggaccaaaaaaaacccataaactccctaagaaacaagttttcatgagttcttgtcacaaaaaattttgcaaaaccaaaagggtccgtcccccttttgtatttaaattatattaaaatttaaaagtgaaaatttaaattaaataaaagtaaaaatttagttaattaattgcatttacccatcacatttttccatgcgctgaattccctcattaatttgagtcaaattttccattcgatggctgatgaattcttcgagtggtagttgtccgatcatgtacttttccaccaacattggtaacgtgtcgcgactcttccaaccttttttaaaaattcaaaaaattttataattattgaaaaatatttctaattgattacacctccataaattgcccctttaattgtgcggcccattaaaagcatgtccggtggaattttcagctcctggtcaatgacaccgagcaccactgtttgtccaaaacccttctttgtggactcgaatgcttgtctctgcaacggaacaataaaaaatggggtaaatattaattatagtcccgaaatttcgaaattggccacaaaaaaagattttaattgctgtaataaaaagaaaattaagaacgcgcttgccattttttatttaaataaaatcgacgtgctgagtaatttcttaatttgcgccaaggggtaggaaaacaaacaaaaaaatgtaatcatttattttcataatttgactgaatttcaaccaaattaatttttcatggtaatatttaagagctcattgattattttcaaaattttacgaaagctaataaatgactattaaattttaaaaaatctttagtcagagttttttgtctcataacgtttttgaaacttatatgtattttc

SEQ ID NO: 12813 - DNA, 2896 bp, Heterodera glycines
cgtcgcccaattcattttaattttccaattttgcccaagccaattgatcaaggtcagaaagtgactaactgatcgttgaatgtactgcttgaacttgatcccccgttggttgtagaataatcgtattgttacaaaaatgctttcttcttccgcctgctgtactctgttggccgcgctcatttcggcggcgtttttcgccatggcaaacgcacaaacggtgaagcagtgcctgtgctccgaaattcagccctgttccgaaaagtacatgaacacatggaagacatgtatgcagcagtgtaaggtgagcacaaatcctaggctaaaaatgccggagtttggatcccggggtcaaaatgcccaaattagaatttctggggccaaagtgtcggaatttgtccgtccaattcccgccgtttgggaccaccctaggcttgttatgttcgagaaatctcgattagagcattccacggcttgcaagtgccagagttcgagtcttggggtccgttctcatgtcttttttggtctcgaattgcacaaatgtggtcgggattccgccccaaccactgaacatagatgaactcaaatgccaatgcgtttgtttgtttagggccatttttccagcgtgggcggcgacgtggaaaaattgggccactgtttggacagcaaccaggcactgctccagtcgaccatcagatgcacccaatcgcatggggacgagtcgtaagtttgacgagtcgggcaaattaatgcaatgccattggggctactgtagtcaaaattacggtcggcaattccattctaattagattattttatgccaatgacccgatttaattggaactctttgattaaccaattaacggggttgggaaaatcattaaatgccattgggactactgtgatcaaaaatacgatttgaaattccgttccaactggtcattttatgccagtttggtgtcccgatttaattgggactctttacaattagtgggaggtcccgctctttttgggattgatcagtatttgagtagtgtggaaggggaaataatttggaaattaattgaaatgaaggtgcccaaattggaagtgacagtaaaatcaaataaattgttccctttttccgatgtgccaaatcgccggccgcggttaagcaggtgccaaagcgatacccggaaacgttggaaattgcaacaatcagtgagatcaaccggatgatcaacggcatgtgagcctggggcaaaatccaacagataaaaatggcacatgggaatggctctgatcagcagattgataggcaaaaacaacagccgaacaatcggcggaagaatgggtcattctccgggttgcttgttctgctgatcagtgccaatgaggggattgttggttcatctccgctgatcagtgccggtgtcggcggcagatttggtcaatgatgccaaaacgcaaccgagcgagattgaccaaaaaagccctgattcaaatccattttttgcaggggcctcgaaggcgcaatgaaaggtttgatggatgccggcaagaaagcgttcggctgtacgcgcaaatgcatgaacaccaaggcgggcaactgcgagaagacactcaagtgggacagagatttttttgaaattttagaaccagggaaatttttgaaaaattcattcctcatgggtttgatggcacatttttagccgtacaaattgccggaaaaatgccgtccattttcatcccctcttccattcttcgttaaaatttcgcgccaaatattttgaatttgcccaggtgcggcttggacttcccgccggacaacgtggcggtgcaggaagtgaagaagtgcgccctcaacagcggactgaacaccgccaacgcgcaagcgctgtgcaaatgcgcgtccgccgcgggcgttaagtgagtgatctaaatttgttttgtccattactcgagactctcgagttttcaaacacaaaatttattttgggataagaaacatctctgctggttactattagtcgagttatgcgggaccgggaatctttggaaaagcggggaactggcttttcaaaaattctgggacctgaggaaaccgggaattcccggaccggtcccgcttaattctaattgctagggcttttcgggagtggaattctcgaaattttgggacagagactctcggaaactgtcctaatgatcgatcacctccgtctagagatgatcacataaatagcatcaaattgcatacaaattgattggccaaactaatcgatcatttttccattttcccaggaatttgacgccagccatctgcgcaaaggtcaaagtcacctaaacaagttcatgtcgtccgggcgctgctgatgactgactgatcagtgtagtaacagagagatgagcaattttagtgatcgattgaccgaaatcccccaaaatgttttgacaccggtgattgatcgatagttatcatttatcattttggtggtcccttccaccccatttgtttcccatgacatcacctttttcaatttaacacaaagcatttctctcttttcactggcaaaattgctttttcttatctgtagtaaaaaaagaacatccaatcatatggcacgtgtcataatgccaattataaatgccaaagacaaatggctgcattaaataggggaatggcttggtatgaagcttccaagatggatttctatatccatattttatggccatattttgcgatttttatatccatacatcaaagaagcgaaatttaaaaatagtcataattcaagttaataaattataaatcaatttaaattcggcttttacaaaaattcttaaaagttaagcatcgatttttatatattcttgataaacacaataaaaaattaggcactatcttagctatagggct

SEQ ID NO: 12814 - DNA, 1301 bp, Heterodera glycines
  misc_feature (1193)..(1193): n is a, c, g, or t
  misc_feature (1205)..(1205): n is a, c, g, or t
tttgtgcgtggacccgtcaaaatttgccactttctgcctggagaaagccataaatgatatccaaccaaaaaatgccttggccaaagtttatgccctaagcccttggcgttttatatcgcctgaaaaagggattggccattgtgaaaatgccaaccaaaaagccacccgaaccagtttcaccaagactaatgcgaattattttggcaaatgtttgatgatattatataaatacttggcccaatgttcacgcggacatgaagtgacgaggccatttttcgagaagggtttctataaaataacaattgttgatgttttggacagtttggcatgaatttgcaacaaaatgtacaaaaaagccaaggaatggattaaattggaaaaagggcgtgaaaaaggaaaaagtgccgcgagtttttatgacccattttggtcactctggcattttaccttgatgacgtggtgagtgcaataaaaatatttttatttctatttattattaaaaatataaatttttttagcccaaatttatttaaagttaaaaatcataatcttccgattttttgctttagcttttctgatatgctaacaactctattttaaattatcatattttacattcaaaaatatttttatttccctaaaataaacattgtatattttgagctcaatttatgggttattattattttaaggtgaatgatggactacttactgtttattgactttatcaaagataggattaactcttttaattccaaaacagtgaaagacgtcaattttaatgtgtacttagccttttgtatatgatgaaaagcaattggcattgtgccaatgccaaagcaacaaaaagtgccaatgaatgcgctaaacttggccattacttggaaattttgtatgaatatttgttcagaatgcgctttgggttgccagctgtgaagccaatgtttcaaactgtaggaaagatacggtatataatacagtatcaaaatttggcacataaattatatgcacttttaggccgattattctgaatttgagagctcttactaatgaatttgacagattatctgaatcgtattttggcataggcaatgatgagtcatcaccaaataatctccacttaacaaatgaacatgaactgaactacataataacaggtaatgaatgattttgccgaataatttttattgttnaagcgattgctntttcattgctaatacagaaaatttataattcttaaattaaaaaaaacaaaaaaaatttttaaaaataataaaaatttttaatctttttttttaaaa

SEQ ID NO: 12815 - DNA, 2746 bp, Heterodera glycines
ataatatgaaaaataaattcgataatcactgatcatttttaccgtttttttacttttgataaatttaaattattcatatatttcggcaatttttttttcgatgtttcaatttcgataattcattgtcacaattttgataattttttatacaattttaaaataatattatatcataattttcaacagtttgttcgcgattacattaaaatggacggtgtttttatgctacgaatgttgacaattcatgcgggaattttggtgtgtactgaagttgtcgatgcgatgtgggaagactttatcgcgagtaataataaaataaatgaattaaatcataattagctttaaaggcaaattaatacattccaaattttaggcctataaataaaaaaaattttatttgacaaagaaaaacattgaatatctgagactttttgaaaaaaaatcattttagttgttttttatttttatttttaagaaaatgtattaagaaattttatgaaaataaattttgcaaaataacaacctatacaaaattcttttcctattaatttagtttgagattttgaaaattcttttaacaatttaaacatgcattagaaatttcctcactaattttgcgaatttttgtttatggcaaataaatttttttttattttgcccatattttgggtattttattttccagccgtagttggcatttagtcaacataaacactcatcccaatttttatttatgaagataaatttttatttttaattattttgagattatttttttcgtattttgttgatcagatcgtctccaattgcgcaccgcggccaccgaatcgccgccggccgtttcgacgccgcccaaaccgccaccggccgtaatttgttttagcgctcctaaggcgtcttatgctgctactggtggtggtgtcgaatgcgtcaccgcagcaacaaccgcgtccgatccgacaatataccggcgaaagacaagcgtcctggtgccgttgcttagcgctgtgcaagagcagtgccacaaaacggaattcgcacaagatttgccaagacattccgccacatacacagcggcaagcggagcaactttggcagtcgcgtcccggcaaattttggtgccaccgcggaggtagacaacgtaaaatgaacggaatagccagcagggggccgtcctcggcgagttgctctgacgttactcaaaaacctcaaaaaaatgttgattttcttttggccataattttttcaaatttatacgaattttctgaaatttttaaggttcttagaaaaatcattgggctttaagttttatcaaaaattaaaaatataatttttgagcaaggttatgaataattttctgttcaaaaatttcattttgataccagacaatcaattagttcattcctatttttcaaaatttaaattattcagcatatttgaaacctcaaaaagtgataatttagcctaaaatttaaccttttgataatttgaatttttaaacagagaccaatttttgctgaaaactcccaatccgagcgaatatcattcggaacagcgacaagctcttcgccatttaacagtgagcagtgacaacaagccgtcaaatgttgccgccccattagtgccaaaatatcaccaattctcaatgatgtcaaagtgccgacaacgacatttggcgccggcatcgtatggcaaaatcggctgcagaagtcgaagacggacaagcagtagcaatggccaggggggcattgtgccgtcgtggagtgccatgttcggaagcgcattggcaccgttccaaaacagaagtttttcgttgaacagcgccgttgcccaacaactgccatcagaaatccccgaagtctcttcgtgtggagaagaagcatctctagttgaggtgccggctcaatttggcaacatttaattaagcaaaaggggcgtggcgaggccatggcgaaacggacaattagtaccgaaagagcttaagcaagaaaacatctctttttagtctttgtctcttaataggatctattatctatccaaaattcatcaaatttctgatattcaacattgcaaggtttagttttttgtaagttgtttatccccttttaaaacattacattttaaaaactaaaaaacattttatataattttcttattaattaccaatattttttagcattcaaatgttagcagtaaatcaattaaataactcttaatttttctaaatcgttttctaaagttagaagagggagaaagcagcagctgcgtaacaaatcaacgcccaacaaacgatgagaaaaaggaaagtaacgaaactgatggggacgaagaggcaaatgtgccgcgctgttcaacctcaaaatggcacggagaatgtgccaaaaaatgacaaaaccaataacataaaatgccaattcaaattttcaagaaaaatttttagagtgatttattcatgttttttgatgaaaatttattatgcatatgtatagaaatgtaagaaaatgcttatttaataaatttacaaaggctaattgtaaggaccaatagagataaattaatttgaaaaaatgttaaaaagatagtgtaccttaaaaagaaaatttaaaagaaaagccatttttgacatttaattcttgaaaagcaggataacaattctttaaattaagttcttaattatcaaaatcatttaaataattaaacatgtgggggtcaaaaaattcctaaaattagggataaatggaaatca

SEQ ID NO: 12816 - DNA, 1468 bp, Heterodera glycines
actgttttattaaaataattttctttatttgaacccacatgcattgttccggctttgtcgccccacacttttggcacgccttggcacagttttgtgccatccaatgcgggttccgctcacattcgctcgccgtaccagcaaacttttcatggtaatgggcccatcggtggcattccgaataaagatttttacaacctgaaactttttttttatttaaattctgtccacacattattttaccgcgacaggctaaaacagcgccttttttggttggttttcgaaagttgaaaattttgccaccccatgcccctagggagtaacttgtaccccccccccccctcccgaaaaattaaaaaaatttcaaactcagaaatttttcaaaaaagctcttaagaaattttttcataaaaaatttaaagaaaagaaaatttcaaaaggtttttacttttaatcttatgaaaaaatttcctgcgatttttttgacaaatttcagtttaaaaattaaaaaaaaatttagagaaaattatattgatccaggagggggaggggacgtagtgcatccatgctccggctaaggcgttcaagcttgacacaccacttgggcatgcgaatttttgagtgtccatccttggacattcgtcgtgccattctttctcacttgcctgatttgtcctgcttggggtggggtcgacacccattgaaacggcacgttcccgaacaccacgtgttcatgtgccgaggcgcagatgtgcacgcccctttcgcggcccaatgagcacaacactcatggccatcgtggcaaacgcgctttttgggtggaggaggctgaaaaagattaaaaaattcataaaaaatattcaattttattaaaatttactgttggagaaggtgtggtcgtgcccaagtgaccgtcggttgattttgttatttgctgagatgaagaaatggtggttgtgacggcctaacaaataagggattttgtgtatgtaaatcccttataaactaatgccataatttgaaaaattatgtaaaggaattttggcatttaaaaatatcgaactgtaattctttgagatttgttaaatcacttggaattaacaaaacgtaatcagaaacttatcatctattaacggataacgactctaatgatgatcaccaccgcaggaattctacataatatttgtctttacactgtatgcaatcaaaatattattgtctaaattatttcatgtaaattcataaattaggacgacgacatcacagagaattgtcaaagaatattttcatggattttgaaagtaataaaaattttaatgtgaccattcaaaactttagcctccggaggtatgcgcaaaaaatggagtgcgtttgaaggggcgcaacttaatataacaatgtccactgatgtcatccggaaccggcacaacttacacaaattggaaggagtgcaaaaaagcacccatagcta

SEQ ID NO: 12817 - DNA, 1972 bp, Heterodera glycines
  misc_feature (27)..(27): n is a, c, g, or t
  misc_feature (1837)..(1837): n is a, c, g, or t
  misc_feature (1891)..(1891): n is a, c, g, or t
  misc_feature (1926)..(1926): n is a, c, g, or t
  misc_feature (1943)..(1943): n is a, c, g, or t
  misc_feature (1961)..(1962): n is a, c, g, or t
gatgattcaaaggggtcaataatgatntttttgagatgatgatttgctgatttttgagaaatttgatgatttatacggatttttggaaaaaatcatcgacaacggccatttttgtgtaaaactgctaccaaaacttccatattttcaaatttatgtcgttaggttgtttttatgtgtgtgacttttattctttttaaatatattgtttatattgtttatcaattaattagttcatccatttttcactacatttatgacttcaaagtgcaaaattttaaaatttggtgatttatgaagactatgaaaaaattccttaaaatagccaaaaaatcaaaaatcgtcaaaaaaagttaagaaaaacgtacaaaaaataaaagttctcggtatagtagccaaagtaaaaaatcaaattaatgtttaaaaatttttcatatttttatttaaaaacaacaacatatttagaagcgggagggggaggggagctggagggcggagaaggggtatctcatcattttccccatagccccccgtccaaatattctctttcttggcgcagtagttcgtcccagttccgagtgtatgtgtccggctcctgtcgtttgttgctgccgcctgcaccttttgattgctccaatctctcctcacagattttcttcatctcatcggtcctcttcttccatgttttggggtcttttttttctgcttcctccctctcccacagaagtcttcgttccttccattggtgccgaaactccttcaacgttgggattttttttgtttttgccgctgcggcatttggtccatttcatcaaaatccggtaccgcccacattggcaaaacatcatcggacccttgattttgctcggacatttctaaaagtggaaaagaaatgttaaatcaaaataaaatagcataaactaatgtttgaaggcaaaattatatatcagtaatgaaaatttagagtttcttaaatagtcgctttttgcattgtaatgctgacgcaaccctaatttagttcaaattcagcaaacgaaattagtaaatgaccttcaaacttgcaaaactttttggtcttttgtgcagtaaggctcaaatattacactaaaaatcatgcgattctattagtaacgaaaatgtttcgtttttttgcaaaaaaagttgcgattttattagatatgccgaaataacgaatagaaaaatttctctatttctttctgtaagaaatggactaaaatatttgttttctcaggcctaaacaaatgacttactgcagttactctaatttcattatacaacattttgatattaaatttataattccctatctttttttgataactttttatctccgaaaaattggtatcggatataatctctgcatcttgacatttaaatatatttcgttctttgataccaatttctaatttttgcatagctaaggcttggtttatatattcatgcataataaaccctggtaatttttgaattttatcgatcatttctaagaatgaaaaatataaattttcgatttcaggggcactaaatgccgctatgtagaaatttttcacccgtttaaaaagcatatttgcaaaaatttcgagattatttgatcgtttgagtatttttccagaaattttccaatttctcgtaattttgttttttataaaattaatttcttggtctattgtcgacatctgggattatagttacttctaatgttataacatcattcaaaggatagaaaagcgaatataattcttcttttaataggacatgttggaacaaagcctcggctgtgttttcgctagggcatctaagagggcaataaaatgattcnaaaccaaaggaaagcttcagaatgcttttgaattttccttgttcatttttatanattttttcgattattgatgcgagtattagtttaanattttgctcagcattancaaaaaaatggattgacnnaaataaaact

SEQ ID NO: 12818 - DNA, 1791 bp, Heterodera glycines
aagttgcggttttattagatatgccgaaataatgaataaataatttctctatttctttctgtaagaaatggactaaaaaatatttctttttcaggcctaaacaaatgacttactgcagttactctaatttcattgtacaacgttttgatattaaatttataattccctatctttttttgataactttttatctccgaaaaattggtatcggatataatctctgcatcttgacatttaaatatatttcgttctttgataccaatttctaatttttgcatagctaaggcttggtttatatattcatgcataataagccctggtaatttttgaattttatcgatcatttctaagaatgaaaaatataaattttcgatttcaggggcactaaatgccgctatgtagaaatttttcacccgtttaaaaagcatatttgcaaaaatttcgagattatttgatcgtttaattatttttccagaaattttccaatttctcgtaattttgttttttataaaattaatttttggtctattgtcgacatctgggattatagttacttctagtgttatgacatcattcaaaggatagaaaagcgaatataattcttcttttaataggacatgttggaacaaaacctcggctgtgttttcgctagggcatctaagagggcaataaaatgattcaaaaccaaaggaaagcttcagaatgcttttgaattttccttgttcatttttataaattttttcgattattgatgcgagtattagtttaaaattttgctcagcattaacaaaaaatggattgacaaaataaaacttggttttgtgttttttaaagccaaattttaagtctttatgacaatatgtctcaattatggcacaattttccattttgttatatcattattttttgttcttatatacccatatgctcccaaacaattgtttggagtctattttcataatttaacatttggctctgcacccttcgggactcaaaatgtaatcttcgggcttcaattaatgaattttgcgattgttcctcaaactttgttgcctggtcaaatgttttacatctttcgaactcacgccacgcagattcagcctttattgactccaaattgatttggtccatgattttgaaaatttcccaaattgaatctgacattttaagatataattcccgaacaccattagcatacggagctttttccctagattttattgcacgattaagcgtttcccgagaagatttggcaaaatcgccaacttctgctaacgcagctacatccctccaggctctttctgtctctttttttgcagcttccaccaaaatggtattagctttttctgatttttcagaattcatttttttatttttcatttattaaatttttcttttatattttatatgcaataaattcatctctaaattctgtttggagtctcggatttttcttagcatcatcaactatttcttgttgtcacccaaaaagcattttgcccccgcagaaaaattatgatattttatgtcctcttcgatttcaatcaatatagagtcaggatgatgattgtgtcggcgcgtcattgtaaaaaacccttccttttcaaaaccccagccctggcacccatgtgaattaaagtcacatttccaccaaagtttggaacttggtcgttttatgtttgtaatagcgataatcatcacaaaaattttcctttggcacctttttattgatacaagttgaaacattctctatatgcccccattaaaggaccgcccctaaatggttttagg

SEQ ID NO: 12819 - DNA, 3075 bp, Heterodera glycines
cggatgaaaaaaaattatgttatgtaattaatgaattcttaaaaaataataatgtgcctttcaaatgagaaatttaatacaaatattttttgcacgacaaattgccattttttatttgacgtctcttctttaatgaaattggcattggcatttctcgtgtgttgtttatcatattatctacctttgccatctttgaagcagacatttttcgcacaatattttaattttccaactttaattttaggacaatcacccgaagaatttttgggctctttatcaacaaagggtctatcaacggtgccaaccaaatccgaacggcaaatgagaaaattggctataatattaaaaaaataaattatgagcatttaaaaatacactaaaaataatctttaatcattattaatgaataattaccgctccaaaagcattcaaaaagacattgagcagaaggatgagcttcatatcaatcttgtttcttagcttatctaaaaacaaataaaaaaatatttattttttaaatttttaattatttattattaaatgaataaattcactcttcaaaaaaaatgaatcgaatgaatggttgggtacacaattattatgttttcgatgcatatctcttatgattaataaaatgctgattcatcactgatgagaacaaaaagctaattgacacccaaatcagtaaaaatttatgcataattatttttctgacaaaaaaatcggttttgagataatgaatgataaattatgttattgtttgcataatcgtttaactgaaaccgatattcaaaagtcaaatggcggatcaaaattgccgacaaatcccaaaaatccgcaacccgcaatccgtaactccaaaaaccccgcaatttccgtaatccgcaatccgcaattgcgttcagccctggtagccagcccctttgctaatgtattttctgcaaatttcgcctcgttcaaaaaaaaacaatgaaatggatttacaaaaaacaactttttccattacgatgagtttttttatattaaatgtaaatctttaaacataaagaatttcttttacgcaaagaaaaacatcccaccggaaatcaaattaattaaaaatattattgctttgatatttttattattattaattttaatgtcaatcaatatgaataacaaatttatttacatcaatgaatacaggtgaaataaaaattttacatattatttcaacgataatgatacgtcaatgatgatgtaaaaattattttacctataatattaaatgaaggtaaaagtcgttttataataattatatttgttattcaaataaaattcattatacattttcataaaactctaattcttaaatttgaattaaagcaaaatgttatttaatataatttctttattattgttcttctcatattttgccgaaggtaatttttttcattgatattgataaatgctttttttctatttctattaattaaattatttatattttgtttttgatgaatatagagatacgttatttcaatgttaaatggtcaatttatacatttacaaaaaattggtccaaagtttaaatttcagtcattttaacgagtgatgacgaaaagaattcttttgcatttgacctaaagaagcgacttgaacaatttaaacgaagcaacaaaaatgaaaaagcaaatgagatggaagaaattgaaaataaagtggagagccaaattgaggaagcaattggacttatcaaaaatttgacgaacaatgaaattcaaaggcttcaaaattttaatgaatttggtaatggcaaataggaaaacatattgaaatcaattataaataatctataattgcttttaattttttttttcagcgaaaaactcaatcaaaatttaaaatgtaaaaatgtgagccgtgacaaaaaaaattaaaattttcgctctttagtgatacactttttccaatttaataaggttgatcgttaataattatagaaaaagtaaatcgaaatgccaaaatcaatgaaaaaggtacctagtttagcacaaaagtttgaacacaaatgaatttttatgttgtatatatatatatatattttatttaataacattaattaaggctcaagctactccttcgattctgataatttaccgacaaaagatcatagagcgagcagcaatacttttcatataccaaattgtgggattagaattggcacttctgctgaacataaagcaaagtctagaacgagcaataggaacaacaaaatgttcaacgagttggaacagcaagcggctggcatcaaacaaacattgtcggcacaaaaaactgccaccaatgagcaaccacaaaacactcttagtaacacacgaaaaaagttgctggaactccgagcccgaatggacaaagttggcattaaaccgatgcacaaggcaaactctggcgaagaacgaaaacaatcattgacaattagtccgaccaaatcgccaaaaggcattgttgtggataagcgaaaaattcaaagggacaaaatattaaacaaatggcgatggttgatgggaagtgttgtgttatccatgcaagaattgtacttcaatgccgagaagtcacaaaaatataaaccgattgagcgtcagttgttgagtgaaactttaacgaatctgaaactagcaaaacatgaagcatcgaaagattccgcacaaattcttggactgttatccaatgccaaaaaattctttgatcagtaccaaacacatagaaagaaactccagcaagctcagaaaattggtcatgaacatctttcggaagatgatgacctttaccaaagtgatttgggctcagagaatgaacaagaaaactcgggtaaaaatcaggggttgcctgtggtatttattttccgtaaagaaaaatggatgcttggtgcgataaaagatttcaaaaaagctccgtaatactaattattatattatatataaacgatgatattttataaaaaaaaaatgaaagatgcttttctactgacgcattttccactgaccatttccggcggcgattttcattaattatttcatacttccatacagacaa

SEQ ID NO: 12820 - DNA, 816 bp, Heterodera glycines
ggttcgtggacgaccctatttataatgactagtgaaaaaatctgatgtgctaaaaacagcctaaatagttagtttttaggttcgaaaaacccccaaatagatgctaaaaattggaaaataggtgcaaaaaatccaaatttaggggtataaaatttttcaataaataaataataaattttggagatgaattccttagaaaatatcatttattatggtttattttgagaagggtcgatgcataggagtatattttcctgattttttgggtcgattctttgtggtgtatttttcatttttattgcatttttattaataaatttttgttaaaacggtgaaaacgccaaaatagctcaaaataggttttttcaaaattttttactaactaaatgaaaaaatttccgagtaatacctcagttgagatttgtgcgttttgctcaaaaagtgcaaatttaaaggattttaattattttctttcagaaaccaataaagtaactttctactccgctcaaaatttatgctttgaaaggtcttaataattttttaagttccgtttctttttttttttgtaaaaaaaataattaaagtagcactctcaaggtagcaatcagtatacctcgatggtcgtgacgcaaccttatttataatgaccaaaaaaaagtaaagacaaccatttttataccgaaataaaattacaaagaaacggaagaaaaatttcaaagcaacggaagataaatgaagcatacaaaggaaagaaaagataaatgaaacaagttttatagtagcatctcctttcagattatgcgttttgctcaatat

SEQ ID NO: 12821 - DNA, 2031 bp, Heterodera glycines
atacggtagttttagaaatgtttttccatcgtgctgagtcatttcttaaatgtcgtgagcatgggtatttttttgaagagatttcatttctcagaagccaaaaattagactcttaaatttatagtatagctctaagtattttctaatgaaatattgaataccgaaatctgtaagaaaatttttcaatgctttttttttacctttctaattggacaccacccaaattatcaaatttttattgtcagaaaaaatctaatgaaattttggtcaaaaactcatgatggaggaatttaggaaatgactcagcagcatcaatccatcagcggattcaatgtgggcgcaaataatgggtttctgagagatgagacattccgctggagtattccaaacggaatcgtttcaattcatcgtccacattttgactgtccttttcagcatactgtacaaatttgcttacagtagtctgtccaacgctaacccattcaccgctcagcagctcatgaatgagagcaatgacgccaagatgtgagactaacacaacgtgtttggctaaatttatttaattatatttaaaaaaaggaattatataataaaacaataaatttaatatttaaatattcaatgaattaaaaaaaattttccattaaaaaactataatttattacttatttttttaaataagaaaaaaagtaagaatacggttatatattagttaaaaatagttattttaaattttccattaaataattttaaaaccatttttgtttgtccttagaatatgacgaagtgtttgctcaacaacagaattgcattcattttccagttcttttgctttttctttttccaatttgattgctttttcattttccagttcttttggctgttttaataaaggtcgtcccatgattccaagctcaagcaacctattatattaatattttgtatttaaatagatattctaatttataattgtattaaatatgtattaattaagaaaaaaatttctttaaccttttgttatatacagacgaatatttcgagttggaaaatttaaaaagttgatacgaatcattttgatgcaaatattcaattttttgttgacagggtttatagaactgaaatatttaaattggttttaataaaataatttaaaaaggtacctcagttaggcccggctcaatgttcaaataaatgccaccatttctgccctccaaaatgccatttgctgtggcgactgtgcgttgaaaaggcgacgaataaatttgatcaattggaattgatttgaacctaaaatgtcgcgaaatgagaaaactaattagtggaaacaaaaagatattggaaaaattcattccggcgaaccaaaacaaacctttgaataaaaacgcatttttttaattatgtgttgaaaaaattctatgtgtacttgtgtttcacaaattttacccgttatgtacttggcaattggcatccctgtacttgaaaaaagggcttggacgatcccagccctgttataggtttagtccttaactatcgaaatttcgaactgcatggagaggattcgaaccggtgcctttatagagactaacactctttgaccacttagacaaaattcagatgacttattgagacactttggcatgaatttatacattgccataataatttaataattatttaccattctccaagctctttggcttgttcaaaaccgtgtttcgttaatggcacgtcctgatcagacatttcggataatggcaagtcttgatcagatatattggacaatactaagtcctttttcgattccaattgcttcttccaacccccgtcaatcccctcaatgatatcaaggcgatgcccgtgtcttataaggtacaatgtttggacaatagttggacggtggtctgataaaataaattttgaatttatatagaaattttaaaatattttaataaattattaaaaataagattcctttttaataccaactgtccaaaagtcgttccaaatctgtgatcattgacatcactccat

SEQ ID NO: 12822 - DNA, 1217 bp, Heterodera glycines
taaaacaataattgttaaatttatttcagttaatagtcgtttttggttttttattcaaaaagtatttcttttttatattctttttgcttttgttaaattaataatatgaatttaaacttgctatcagtgccgtaaattttatcgtatgttccatgagatattctggatgtaattttacttcgtacttgatttctggagtaaatttttaaaatatataatattttatatgtaaaatattttttaacatttatggtacagaacatgaacattatttttaatttcagcaattttgtacgtttgaaatttttttctattttcgctttttgggcctatgaaatttattagaatatttgaaaattcacaatcacttaaatatgagtcaatttaaatgaataataaataaaagtttcttttgtttatattttcgattaggatatacttatatagattaattcgaatttccatcgtgatcggagccataaaggtgttttgtaattttactagtttttttgaagaatttttttttatccctatgtagtccatacataatttggcgaaggcctgctccagaaaaaaacttaaaaacattcagtaatataaatataaatttttattaatatttaattctaaactaattgtttttcatttaattattggatttttttattcttattttatacatttgatctacaaacattaatattttaacaatcttataaatttaatattattcttttatgcattttttactctgcccaaatagattaaatattgggtcaaattaaaaaaattgactttatgccataaaatttcgaattttatgaattcaaacaaattgagacaaagaccaaatctaaaaacattaatccttttttcaattagatgacctctccacagcctttttatcgcactatgtacaaactgtcccgacccacccgtttcggcgcgcacgtttcggcgccagctcgtttttccacttaagttttttctatggcatccaaatccaacaatcttggtatcattcgaaagctcttaacatgctctattagccttatcaaaaacgaaaagtttttcaagccttgaaaaaattttattgagaaaaaacttgaaaatttcgactttttcgcaattttcatgtataactttttttgtatttgtctaatcgtgaagcaataccttaaaaaaagcttataagcatgttaaactttagaatgata

SEQ ID NO: 12823 - DNA, 1961 bp, Heterodera glycines
  misc_feature (24)..(24): n is a, c, g, or t
atgaactttctaataacttattanttgttgaaaatttcttcttcgcttttttcattttattaatttgtctattaaatccttaattttatagaataaaattttagcttaatcaaatggatttttttatatgtcagcattattgaaataatacttttagtttttaatatgagtaaatttaaaataataatttttaatttcaaataatgaaggactgttgatttctataaatgatttttttaatgctttcattttttattcgttaaattatcacaattttgcaaacaactatttggaaagaaaataaataattggatagaatgcaaaaatgtaaattttaaaattgctccatttgtctgaagttttaataatttaaataaaaaatcgaagacgaaataacctcaaaacaagtacgccgaacgaaaaaagcataattcttaaaaataaacacttaataccagaccccacaaagcacggacaaaaaaaaacaggatgccaaactcaaaattttttaaaaatctcattcagaaatttattcaaaaattaaaaaattgcccaataatttactgtcttccactcagatttttttgttattttattttcaaaatcccaaaattattgaacctgcaattagagaccggaaatttcaaatttgcgggtcctgttgcaggattggtattcaaaattttttacaggacaggatccggcaggattaatcctgcaaatcctgtaaatcctgtattttccaaaatatgcaggattgcggactgggatcctgcaaaatcctgcgcaggatcctgtcctgtgccggtctctacctgcaatgccgatagcttcgccggcgaaaaatttgaaaattttggattgaattgttaacagattttgactaaataatgcaacatttttagaattttgaaaacccaaaggattgagggtttcagaggtgctaataagcggcaaaattttttcatttttaattcatttattaacagattttttcaaaccttatgaattaattaaaatggggtgcgattaataattttggaaaacttcaaaaaattgcatcaacagcatctcgccgaatgattattaaataaaaaggctttcttcaacaacgccattaattcctaccaaaacatatcttttttgagccaaattagtccctaaaaaacaaaatccatattataaaaataagcaataaattgatttttaagcacttaagcattttatgaaaatactgctttgtatagaattttgaattttaatttagttttacacatttaaaatcttttccatgatatatcttaatgataaataaatattatataactttaatccatttaatccatttactttttaatcttttaaaattttgaattaaatgtttatcattcattgtattttatagattttataagaagcttttttttagaaaataacaaaaaatttagacctttaaaaatatatgtgccattttgaaataaagttttttataatatgctaaaacaaaattacactttttataaactaaatattttcaaaaatctttaaaaagttcaaaaattttcgatttttaatgtgttttttaattccaaaaagtcaatcctgagggggtgtgttttttcacttttcttgcatttttcatgccaaaatttccaaaaaatggctactctaaattaaaaatgacaaaatataaatttattttcgaaaataccctaagtatgcattttatacattaaaaactttaccaaatcataaattttaacgtagaaatagcgatttttgagccaccttcttcatagcatatgcgtagaaaaaatgcaaaagcatataatttattgttctttttataaccatttgaattgttagtgttatacatattttgcattaaaaatacatttgcttttttattttatgatagaataaaggcatttatattcttatttattttgtaagcatcagaa

SEQ ID NO: 12824 - DNA, 2854 bp, Heterodera glycines
cccccaccggaataaatgagtgagcaaaggcagaggtcattaaagccactgtttatatcaccagcacttgcacatttgcatcaacactatgggtcaagctcagttttagttagacaaaattattcgaaacgccaaatagtttgcgttaattttttgcgcgctagttcaaaaattacactggtaaatgcctttttttcattgtttattttcagacataactcgcttcattcccaactaaaccgaacaaattttcaggcccggttgttcttcgcgttaacatgttgcagaaagacacattttatacatacttttgaaacgttttcaaaaaagtccttccttaaagtagaattagaaagatttatttatttcaaacaaaaaactaacaataaacaggcagcgtaacaaacggcatttttcagttaaagtggtcaaaaaaagatttaaaaatgtttttgtcaacctacccatatacacactacacaacacatgtacacattcatgagttacatattgtacatgtttttaatgcatgtacaatacgcaacccatgaatatgcacacgtgtcatgcaacgtgcacaaaaacaaaacgacaaaaaaaaacactttttgaccacttcaattaaaattatgcaccaaaacatcccaaatatgaatcggtctcttcactcttcctcatgctgaggctgtattgcccgacgccgagctgtgcccagccgatgcggagagagacgacgaaattggactttgatttggcgtcacaagtggtgagggcggcgttactccggtctcgatctaaacatttttgagaccaatgcttaatttttgcgtctattcgaatagagaaacataaaagatagctagattaattaagcaatttattcgttttggcattaaacaattatattttttaaattaaactaatgtcgagacccttttaaaacgatttttaaattatgaaacttagacagcaaagtaaaaaaaatttagaattgaattcacatcctgacttaatgaaatgagaaatgctcaaaattaattaaattaatgttaatagatttatggagaaaaccttacttctctgatggcgacataaatcaccaacatcgcattatgcgacacttgacaaaacttgtaaaagttgtcattcggaattttcagacgcaccagatcccactcctttaaataaattttaaattaagaaagaattcgatttattttgatttcctaattacccaattgaaggggagagagagtcaagaattttgcaagtggccaggggtcagaggcgaggaattacatagatcctaattgttttcgttttcctctttctattcttcgttgggacccaggggagaaaacctttagacccgccttctttccctttttatgtatattgtataatgaccaaattgtccatcaggaaatgatgaatttcactggttccaaattggttgccgaaactcatgataacgttctcttgttgaaagtaactctaatccgctgtcgctgtgtttaaaatttataaaaatgaattttaggcaaattttggtcatgaaagaacagaaaccatcacattttcaatgattgtttaaaattagtttgttggattaatttcttgcttctgcttatatcctattttccaaaatttttgggaaggcaaattatttatgtgctatttccaaatttcctttcatttctctcgtcccaaaaagctcaaagtatcaaaatactggtgtttaacctcgtccggtccgctcattcgcaatgaaacgagagcgtaatgtccgccgccttccgcaggatgaaaaaactgtgagagatcataaggcaagaaatttgcaacgcgatgacgttcatccagtggcagaaaagagcgaatgggtgtgcctgcgccaaatgtataagtcgtcccggcctctctctctctgctacattcttaaaaagcataatatttaaattaaattggatataaaattagatttaacaataactgattttttgttaactttcgattttggcatactttgcgtttcaattgtttgcctcgttttccgttatgaaaaaaataataaaccaaaaaattggagctgattaaaacccttcggtagtaaaactcgggaacaaaatggagcagttcgttgttcagttcagggggaagtttggtgttaattttgatgaatttcattagttttgggccaaaagtgttaataaaaggataaaaaggaccaattgggcttctgaaataaatttatgtcaaaacgcaatgaggtgatatttaaattggctaatttagtagtaaaaattcgacttgaacatacttcgttggcacacaaattgacgacgtaagggaaagccattagaatgaaaatgagtaagaaattggcttgagtctagaagaatggaaaatcactttgtgattcatgaaatgattgagttaatcatgtttagctttgatgggacttgcaccggaaagcagatcctggcttttgtgataaagccgaatgttccagaacaattttaggacattcgagtttaatagacccgatgaaaaaaccataggaacccttatcagtttgcaatgttttgtttcttttgcaaaaattatagacaatgtgagctaaaaaaatccaaaccgtagcaatttattgaatatttcacagaatgtatgtagattaaattcatatgttattatgtttgtctaagaaagcagacgtaattatcagttttatttgcaaaaaatattcatttgagaacatggtctgtttgtgtttgtgtgccatttgaatgacggactgccgacctctcattttcttttttgtttgtgagaatgaatgaataaatgcgtgagcaaa

SEQ ID NO: 12825 - DNA, 2018 bp, Heterodera glycines
  misc_feature (64)..(64): n is a, c, g, or t
gggggcgctatgaggtcgaatacaatgtgttcagttcaacgatacctcgacgtgtaacaatggngctgtggaatacggggcgttcaacgggaatccaaaattggaccccttttaacttcaagcactttgacataagagacattgcggtgcacgctggcggtttcatatacccaatggtaccgtacaaattggctttcaaaaaggacgcatttatgcgagcgtatgttgatttgtatgaggcgctcggcatggcaaactcagacagatcttgtgatattacgcgccagcaattcaaaaatggatggacattgttcgtcatccccctcacatcaacactggatgacagtgtgggctatgaactgttgcgaagcggcaccacaaccatacgtgctagcttcaacacagcaataccaggtggtggggttgaaatgattgtgctcggcgaatttgatcaaatgataatgattgactacaaccgtcatattgtttcagactctaaactgggttagtttttgcctatacaaatatataaatatattggtgtgtgtaaatggaagtcgttaaatgacaatgaacattacaaccaacacgacaaaaaaaccccttgtccaaattttgaatggatatgatgttgatggaccatcatcatcacttgaaatgacaaattttgaaaaaattatcttattttttggtctctaccttataatatttccgatgtttcttctctgctggttttcgttaattaattttttaaagcgctttggccatattagtcaaagtgaagcaaacggtatggtcaatggactgcaaaacatacctttaccaagaatacgatagtttacaagggaaaaataattctgaatgttcatttcatcattatcattattatcatcatcatcatcatcatcatcatcatttattagtcagaaagtgtctgctcaaacctgaaggaaaacaatcattagcctgtagaagtggggtggtatttaccccacaaacgcataaggtcccatgctttccaacaaattttcatgaactgatttgagcagtgcctctctatcattgttctcacttgggcatagtgccaagaacgtgacttttcgctgatttcggcatatcatcaatacacattgcagacgctgggtaaaagcttttagaaaaaacaaaattgctgttacatcttccacacattgtagtttatggtggtacatctctgttaattaaatttatctcaaaaaatgctacaaaaaataaattgttcacattgaacatttttttttcataatccagaaaagcaaatcactattttttaaaattattcggatcgtgcaatcttctccttcgagcctcccgcaccatcttgatcctcgcccgtttttttcgtcgtcgtcttgtaaaagcggttgaccacccagtcaaagccagtaaaactttgactgtcttcctaagagaaaaaagaatagaggcaaaaaagaagttttaaaaagactactacctttatcgtcacttttgcagtaatcattgaccctaactttgcttccaaatgtgcgtatagcaccttgtcttccatttctaccacctgggtcgccttcaaacccaggaaagtctccgccacctggtccacgatttatcaaatgtgaaaaaaaaacgaggaacccaaaccgcggaaaacatggttgcacgctgcgtgcagtcgctctcatcaatatcttgcagaacaactcgtaggtagatgttcttgattggcctatcaactttttgcccgccacaagattcacaaatgtggttttcgggtagctttcggcgacagggaaagccccgcattcgcagaggacatgactaatgggccaaaaatgaatgaaacgaaaaaaggggaaaagatgtgcctacatcgtacacttggtactgtaaatcagcaactattgccccaatgtaaaaagtgccagcgcctgcgaagcgaataacttctcgcaaatttttggcactttccagctcctcttcctcgggcgcggagcgtt

SEQ ID NO: 12826 - DNA, 990 bp, Heterodera glycines
  misc_feature (952)..(954): n is a, c, g, or t
caaaaactagactataaaagctttacgcggcggaggattttgtgttcactctacgcctgcggagcctgcgtaggggtctgtacgcggcggaggacttttgtcttcactctacgacagcggagaaacttgttcactctacgcggcggagaacttcactctacgaggcggatgacttcactctacgcttgcggaggacttcactctacgcggcggatatacgcggcggaggatttcactctacgcttgcggaggacttcactctacgcttgcggaggacttcactctacgcggcggatatacgcggcggaggatttcactctacgcttgcggaggacttcactctacgcttgcggaggacttcactctacgcggcggagtacttcactctacgcggcggaggacttcattctacgcgacggaggacttcactctacgcggcggaggacttcactctacgcggcggaggacttcattctacgcgacggaggacttcactctacgcggcggaggacttcactctacgcggcggaggacttcactctacgcggcggaggatttcactctacgcttgcggaggacttcactctacgcttgcggaggacttcactctacgcggcggaggactttgtcttcactctacgccagcggaggtacttctctctctttctcgacgcggcggaggacttttcactctacgcctgcggaggtgtatcagcgtgcccggggattgaacttccactgacaaagtcattatccaatacactacacgggccgctgacaaattgcaatgtaaataatatttcaacataatttattataaaaaataattttccccgtttttttaaatgaaatggacaccaatttcacaatatgaataaacaattaattagcgtttaagtttgaataagtaacaaattaaaaaaaaatttacacatatattaaaaaaaaaatnnntttcctaagtagagaatggatttcaaattcatgata

SEQ ID NO: 12827 - DNA, 1040 bp, Heterodera glycines
  misc_feature (78)..(78): n is a, c, g, or t
ttgctgcttctgatcactctgtccacccacaaaatttgccaacaaatcctgcgttatttttggcactcggtttttgtntggcaattctttttgttcacttggtcctgctacatcgtctccaattcggcgtcctaattaatttttaataaataaaaataaattcattttttctaaaaatctttctgttactttctgactctgttctttcctttgtttgataacattttatttctgctcctgatgctccatttttattaatgtccaggtcataattgatgtcacgctgattagcattcagcattagtctttggcattgtatgttcacataaaaatcttcctaaaatataaaaataaattaatgcacttaatatttaaaattaattagtccttctatatttcataattacctcaattaagaatgtcaactgatttgctgtactttgcgcgacaatcacaccaagtctgtacatgttattttcacaaattccgtcccaaaattcgatttgtccctcttttttacccaaatttgtttcagcataaaaattgttgtattcgcgtttagcacaatataaatggaagaaatattttgtcccattaccaaattctgtgtgctcaattttaatattaaatttgaatttatgtgaaggaaattttgacattggaagcgactgaaattaattgttattaattaattttattaaataaaattttaaatattggaaaatttttattttgattttaattaaaataattaaagtaaataataaatctgaaaaaagcgcttacactttgaagtgttaaaatatttgttgaagtatgatcataaagaaaacttttgacaacatctttagtcggctcgctgataaaagtgacgcaatttcgtccggacgacaactaattaaaacgaagtgtcataaattagttaattaaaaaattaaaaggtcgctcagaaacgaaaaatgcaattttaattgtctttaaaaagtgattaataaaagtgacgtgaacatatataattgtaaattaaattatatttaaat

SEQ ID NO: 12828 - DNA, 2132 bp, Heterodera glycines
tttttttgaactattttatatctcaaaattattttaaaaatttcaatgaaaaattgacatttttcctagcaattttttagtacaaaaaggagctttacaaattaggtaccatcaggccaacttttcacaaaatcttttcaaaaatttattttaaacaatcataaattcagcgaaacttagaaattttcctcggcggaacgcccgcctctttcggcatcgccgctctccaccccaaccatcgctaaataattaattaatttgaaaaagactcatccaacaaaagcaagaaaatgttagtaaattttcattctgcggatgaaagaggataaattgtttttactttattccattaatatgcctatttttgaaggttttaataaatatatttcttatttgtagaatttatttcttgacaaattttaggcaaaaaataaaataaaaatttatttaaaaaaataaaattactaataaatttaaaaaaaaacaaatgaaggcacacaaagctgacaattttatgaaatttaagcacactaattaggtttttcccccagcaagcttcgctttttaacactgacttttctaaggggcgctccgtgccgtgtcaaataacttttgttagatggcaatttatttttgatgccggaaattcaaaaattttcttcttctttctctttatctttcctattcctattttttcatttaaaatgtattttaaaaaattttaagatttcgatggcattgaagaaataatataaatatattttttgttgtttggtaaatggcattacttttttttattgttataatttcctattaaagcgaaacattttaagtacaagccagtttaaatacaatttattatttaaaaattctttttcaaataaaagctttttcaacaaaaaatgaattcttctgcgatggaagtgcaaatcataaaggaatcagaggtaaaaatgaaattttcagatgcgaattttgaattaaaataataattaaaattaaaaatattatttttgattccagttgtatctgcatttcaaggacgagcgtccttgctggccatttattggcttgtccttgacatttggcatgctcgcaactgtggatttttattttgccctcattcaaatcgtcaatcacaatttggtttggcttggttatctcggccattccactggtgatcggtgcgatttcaaatgctccgattttatactagactaggtaaataaatagatttaaaaaattgcctaaatggcattcatattcatccattttatcagcagccaacatatttaaattagaagctataaatttttaatttaatcgaaatttcgaattttcagcgtcaaaaatcctaaaaataggtttataaaaatcagtaattttataaatttaataaataaaaaggaggaatagcatttaaaaattagttcatataaatttatgaaataataaattacctaataaattaattactgcgtttaaataagcaaaaaatctaaaaaaaaaaatccatttataattttaattaaatctaaatacttcaataattaatggaaacactttccagtaatgccgaatttgtgacatcaatttagatccataaaataaaattttttctttttttagttcgcactatcgcgagacatttgctgttgaattgaagaaattttcttctcttattggacttggcaacttatctcttggcaacaataccatcagcgctagtggtcaattatttcaaacgccagcaattcaactaattagtagtgctaattagcacgctaattaattgcacaacagagccacataaaacagaattaattacattgacatttaacaaccaattaaggaagacattcaaattttgtcatttatgtataaataaacgacagcttaaaattttattaggagaaatatgcctgagaggaaatttttgtaaaaatcggtactgaatttcagttatgtaaaacagcaccatgtaccaagaattattgtcagtggaaattatccatgttcaaaatcataattttcttaaatccgatctttatccatccgaaggctgcaagtttatgcctaaggacgtcctgaaatccaggacataatcaaataatagaaatgaacgcgaaact

SEQ ID NO: 12829 - DNA, 2321 bp, Heterodera glycines
  misc_feature (26)..(26): n is a, c, g, or t
tctgttacaatttgatttattccatntaacagcttttcttcagccgtttcttcatgatgtagtattccgccaaatttatccaataaatgtgttctcttttttcctccgtccgccgtcccctcttttttcgttttgctctttttttgcttcggctccgataatgatgatgatgatgatgatgatgcatttgtctcaattatttctttattttgttcatccacctttttttcttttccactttcttcctcagcacaaaattcccacaaattcgttcctgaacttttttcaattccaccaattttgtccacaatgcccttcaatttttgctggatgtttttcacttgttccaactgtttttcttcctttgttttaagatgtaactttttttctagattaggctgcttcttcttttgttcgctgatcgtttgctccaatttcgttgcaattccgttaattgttccattatgatttatgtaccatttggtgaatgcacacaaattttgcagagcttttttatcttccgctgtaattgtttctttgttttttattttttctatcactgctataaattctttatttgttgctaccattttgctcttttcattttccatttcttttttattcgtttccaatgtttgctttttcttgtcgttttcttcagatgccttagtgttttcttcaaattcttttgatgttttttgtttttcccgatcagtttcccattttttccattctatcccttttttttctttgtttgccttctccaattcattttcttgttctttaatggttccgtccaccaattctcgtagcttttccagtgctgttttagtgtcatatttatagttgacaatttcaattttggacaaatttactatgatgggtaaataatgttcattcgatacgaatgaagaaatttgacgcacatcattgagtttttcatcaaaatccattgatttgactcggtcatggatatcttaataaattttttctgttttaatggtaaagaattgtgggcctaaaaattggacatcaaccgtatattctctggaaaattgaaaaaattcggttattaagctgaaattttttttaattcttccagacagatttcgagcagccctgctcatttgctgtgtattttctcacctttgctcgggttgaattcgaaatttattgccaaatcatatcgaatatttttcataagttcaatttttgcctcttttgaaatgacatcatcccattttcttcgccttaaaatgcaaataaataaattttattaacatattaaattaaatatgggaaaagaggacagagaactcaaaatcataaattaaaatttgttcaaaccactcacagtccttcaaaatatccctctatttttttcttttcactttctttatcattggcaatctgtataaaatcgttttcaatatctttcagatacgaatccgcatctaattcttttgcgtcaagccttaataaacaattaaaaatagagtcccatgaaaaccaattaactcacattgaccaataatgagcctttaattgttcatcacaattctttttagcatcaacctcctcttttatgtattttgcaatttctccctcgattgcactgtgatggaattcaacgttctgtatcttttctttcaatctgaaaatcgaaaattgctttaaaaacagtataggtatgccaattaaaattcattccaatccaaaaaaaatcactcacatttccacaaaatttttatctatttcatttttcacattttttataacattctttagaagtttgttctcatcgatgctcatatagagtgctgcattattgtctaacattctcatcaaatttggtgtaatgtgttgaaagaattgccaaaatgcaatttttcgacctttttcactcgtcgttgtattgcctgaagggaattcttgcctaatattatgtgccgaatccgtaataatttttgacgtgttgaaaactcctttcgggtcttctccagctttgtcttgaaataatttaatcatttctattgcttcatatattgacaaattttgctcatgtaagcgtttcaatgttatgaaattttctggaaaatattttttatattaaattgaaataatttaaaaaaaattttcctccaacaaaaaattgtttgtctccaaatttttttcatttttacgattaattttgaaatccgatattatttttgatattttatttattattatattattaaggtccataaataattttttcttacaaaaattttttcttagaaagtttaccctttgaaatgcttttgctttcatgggcatca

SEQ ID NO: 12830 - DNA, 4546 bp, Heterodera glycines
cttttttcattggattttttgattttaatttaggcttttgagttcttgactcgggaaaagatttgttcatcaactgcatttttttctgtgacctttgacgaaaaaatctacaaattgtaagttttaagaaaattgcatccggcataattcttgccaccaatccaaaatttgtgccaccatttccatctaatccgctcgtgccaaactgacctttgcatcgcgaaaagaaggcactcgttggatgagagcgggaaagacttgctcaaaaaactcgtcgtagtcaatcggcgggtcgtcctcgggctttgagccggccattttgactgcatctttctacaaacagatttcaattcgcaaaataaatataattctataaggaaattgttttttgactttggtgggtattcgtccgcacacataattgtgtccaacattgtcgggacgacaaaaaatgccactcgggtccatcagaattggcatctgcagcaccggcacttggggcgcgtggacaatgaaatttgtacgccgtgtgcaaacaattggcaacggcacactcatcacaccgcctttttgccctatcaaaaatatttttttgtttatatattttaccattaaaaatggcactccaaaatgttaaaaatcgcttttttgtggggttattattgcttttgtgtttaatatggtcttatgcacaaaaacgaaccaagtccagcccgtctggcaacctcaccagcccatggaccagcggcattctgaaaacaaacaaacaaatgttgacaatgtaatgaaaagtacaacaaataaaagatttgcggaatattgggatttttgtggcattatttttgttttactagtgtaataagagggtccgatgaaatttcaaatcgaaagggtccgtcttcgtgcggtttttcagttggacccactaaaataaaaaaaaatgtcgtttagaagtcatccttggattctcaaccaagaatttgaaagaaaagcaactaacaatgagtctgaagctttggatgcgacgaggcgttgcgccagtcatttggggccgcacctaaacaacaaaagcataaaaaaggaagtgggaaatgtaattccatcaaaacttaaggcaaaacaaaaaatgcattgctaatttttgttgttttgcgacaaaagccaaaataaaaggaatgaataaaacacaatgccagggcgtggatagagcttttttcgttttataagttctgcaagaaaaacttttttccctccaacatcaaaaaaaaaaaatttgtccaaattttcaatattttagacgggtaccactttaaaaaaccccaaaaatggcacatacaatggccccgcgaatggtctgcatggactgctccgccgcgtccgcatcggccgtgtcggtggtgcgcccgtgctcctgcatgccgcggtgccggtacgtcactgtgccctccatgtcgcccttcaaatagcgcacacccaacgtcatgttcttctcgcgcagcgcggacaacagttgccaagtgtcgaaaatgccctcattttcgaggcctgaaatacccattgaagcaactatttgcgccaaaattctttaaaaaaatttcaaacggcgcctttcgactcccccttatttttcctcaaaaatgtccttttctttttttttggattaactttgctagtaaccatttgctcgagaattttttcttcggctgcacttaccccgagccttactatttaatttttttaatattcctgcaaaaagcaatttaaaaatgctttttttgggtccaaaatcctatttttgacttattctatttttatctggaaaaaattgcgagcactgacttttcataataatttgcaaaattgcaattaaataccgactgttccaagcacaacatcgtcaaaattcatgaacggaaatctgctggacagctcctctctgccgatgagaatcacatttgccccacgatcacttaaaaaacaaaacatagttaaattttataaaaaaagtactaaaattgaatcaaaaacttcgagtagttgtaatttaagaaaaaaaaattgaatattacacttgaagtttccaagcatttctgaactgctcggcgtcctcctccgtccgggccaaatgcataacaccacagggaagcaaatgaatatccgggggttcgttgtctaaaaaataaatagttttgaaaatggattaaaacacctttctgtattaaattgaacctaaaatttttagatgttccccggcatgtcgcaaaaattctgaggaaaacattgccatatcgatcatttcgggcgtagaaaattgctgagtgatcacaccactgccaagcaatgaacgcgttttggcaaactgaaatttgggatatgaattcacattagatttatcgcgtaattaaaagtgattgtgacccaatccatttcaatttttaatgtttctttggcatccttttcgaatatttcatgcatttgaaccgggtttgttgaatattttgtagtttgccgaaaattaaattttcgagtttttgttcaaatccgggttctgtggttacgaatttagtcaaaatgaatgccagaaccgttttctccggccccgaaaacctataaaacaactttattttaagaaaaaatttcaacaatttttttctcgaaaatgggggctttcatcgataatcagggttcgtaagtgtcctttttttaaagatttgtcctttattttaggcttccctaaactttttaaatttttttgtgcttaattatttatttcgctgataaaaatgctaaaaatctttgttttagcatcgtttgtcctttttttgaaaaaaaaaacttacgaaccctgtcgataatattacccaaaaaaataaacgaaaacgaatacattttcggtgctttccaacactgtgaccgttaagttttcgtcacgaaagccctgcttaagccaataagcggccgctgagccggtcagtcccccgccgatgatcaaatattcgcaatgcattggcagcagttcataatcgttcacgttgactttcatgtgtgccagcggatgtcggcgacggaatgcgtcatattttgcctgcaaattgttaaatttgcgaatgtttttttttttttgcttattgttgcctcgcgatatcgccgcgcggaacgtctgaagtcgtagctgagaatgtgctttccacggtcccaaaattcttgaccaggctcaaagtatcgctcattttcataaggttgccactgtttgcattgggtaaaactgagaaaccgtgatgaggttgaggcaaaatttataatatgtgtttgaaggatccgttgatttataatattcatttgaaaaaacactacaagaaaaaaatattaaacacaatcatggacggtaaaaaggaaaaaaagcggcaaaaaataattgacgtaaaaaacaaaacgccaatgcattcaagtgggaaacaaagtgtgtttggaatgctaaattgggagatttattgttatttgtaggggctataaattatatgtatgcttttgcatattttttgtgcgcatatgctatgaagggaggggctcaaaaatagcatttctacgttaaaattttttgatttggtgaaggtttttagtgcatataaaagcatattttcgggggtttcaagaataaatgcatatttcgccatttttgggcttttagagcatattttcgccattttttggaaattttcacaagaaaaatgcgagaaaagcgaaaaatacacccccaaggatcgactttttgtgattttttttaaaaaatacacctttaaaaattgaaaattttttaacttttttaaagaaattttggaaaaaaattatttatataaaaatgtgattttgttttagcatataataaaaatttaaaaatttggaaattcaatatttttgcaattgtctaaaaaatacaccttagcccttcttttggtgttttaaaagtcaattcttaatttatagacaatttttgcatttttttagggttaaaagccatttttggcagtttttaaggcatattttagtgcatatttgggcattttttggatttttagggcatatttggcggacttttagtgcatattttatgcgcatatttggcattttttagtgcatatacataatttataggggtcggggtcacttcggcgcggaccatttcggcgccgcaaattttgaaatgctataacttttttatttgtcagttagctttagccaatctggcatcatttgaaagctctgtgtgtgctctatatttacatgtaaaaatagaaatgaatgattcaaaaataaaaaagttatgccacgcggcgccgaaaaagccgagaaaaagttaatttttgaggttttttggccgataacttttttgtaaactgacgaaattttttgaaattttacgggctaatagagaatctgaagagctatcgaatgataacgaaaatttttaatttggttgatcgggagaaaagagttgtgagcaacggcgcacagaaaaggcccggcgcccgaaagtgggccggtttcc

SEQ ID NO: 12831 - DNA, 3416 bp, Heterodera glycines
tagcagatgagcagcccgccgcttggcccaaaacggggaacaaaatgtgccgttgtcgccgcgtcagtggcacgtagcccctcaatttgaccatttgttgttgctgttcactcaatgagttgcgcatgcgttgccatcgttgctccgcgcgttccatttggtcaatgattggcataatgtcgcgctccaaccgttgcacgtccggcttcaacttgaccacaagatgttccattcaaaaaaagaaaaaatgccaaaattggtcaactttaaaaattatcagatcgtattcctctacaatacaattgaatttacattttggcacttccggtgatgttcaacagcagctccagccaagcggccgactcgcgctcgccaagattggcagactgaaataatttagcaaaatttccattgtagcatgattgggtccaacacaattggcttttttttagaaaatccacgggatcctcatccaaaccagagtgctctcccgactaagctaccggggggggggaggattagccatctttggattctcgatcaataaattgctttttatggagcaattttacttgcattaagcatgtcagggatggacaacaccgaagccgagtcattgttgcttgtatagaatgagaaaaggtccggtgacaacaaatggggacgacgacgacggcgccatttgggggatgggaaaagggagaaaaagcggggcgacagcaacgcgatgtgatcaatgccaagtgagtcgaaaaagcgtgcaatttgttgctggagatcaaccaacgcgggcggcccctcgggcatggccgaacgaacattgacaaacgggttgaagcgggaaaccaacctgaaaatcatgatcagtcaatcgttagtacgacttgcaatttccgattttatatttatggttacgatatgttaacggtattgcatgtacgtctgtttattcatggactgtttggttactgtatttctctgtgcccgcgctgattactatgtcatatttagaaaataataattgccgtgggtttagtttctaattaggtcctctaccatacccggtggcattttcgatcatttttttcttaagtacatcaatcaccgactcggtgttttgcgcgttgatccgtgcaatagagcgtcgagccctctcaaaaatctgcatatatcgctccaattcgcgtagattatttaggctttcattcagcagccctgttgttgtggcaaaggaatcccgtcgactaactgtctgaatcggggcgttaaatggctggctcaacagcattaattaagtttagccattcattacattgaaaaatcaggcatttggttttgtggtcttaccacatcctattgcggctcccggtaaattggacaccagaaaattggacaccgaaaattggacaccgaaaattggacaccgaaaattggacaccaatggaaaaatggacaccagaaaattggacactgttgtaaataaaaatgaaaataaacaaaataaattactaaacaaaaattttggcttggcctaaaagatctttatcttaatctgccatatgttgtttataagcgtaaataatatggaaatgaatttgttattatttttgtaacttcaggagaagaaaaacatcatatcattcataaagaaataagttttattactcatttctggtgcattttttggcccattgatcaatcgtcacccatttctggtgcattttttggcccattgatcaatcgtcacccatttctggtgcattttttggcacattgatcaatcgtcccccatttttggttcaatcttagtgtccaattttccggtgtccaattttcctttattgtccaaaattccggcggtgtccatttttccgcttggtgtccaattttctggtgtccaattttccggtgtccaatttaccggtccccaggggacaaattcggacaaaattttcattcattctaacctttttttcattttcagggaaagaaagcggataaaaaaggtgaacgacagcagcagaggatttcttttttataatgtgagaggggaaagccactacaaattgctgtcatcaaaaagtggcatgatttgactgaaccaatcctctaacattttcattactaagtgccgaaggttttctgaattttagagattacctggcaaaatcccgggaaattgtctctcgtatctctaaaacaaaaaactgaatttttaaatgttacagcaaagaatggcgctggtcaggcgaactcgggcgaacgcagcaaattggataagtcaaccgcccgcggcgtcgggaacggatcaccgaaagaagcaggtaaaaggagagagaggggtggaggagaaatgagatttgtttgcgagtttaattttcccttttcagccgtcccggccaccacgccacagccagcagcaggagaagcgagtggtgagagagaatggggagacgaaaacggcaaattcattatttcttttgttcgttcagcaaatgccgcggcgaaagcggaggtttcacagcgcaaaaaggaaaagccggacattttcatcacgaagaaattgcctgagaacaagaagcgcgaattcgtttcaggtagagcgaagcaaggaatacgaataggcgaatttttgcaaaattccgttcgttttcaggcaaaaacccggactacgagacgctcaagcagttggacatgcaaatcttcctcaaaaagaaactgtcgggaacgcaggcgaggccgcacgacttccaatcgcaagtgtcgtcgcaacaatcggccatgtagaagtgtgcacagtttttggtggagtcagcagtcagtgatgatgatgatgaatttgtgttatatgtcggatgcgcccccgttttaccaatgctatgaacaacagttgtgacaccaccgcatttatattgttaaacatttgtgtgttatttgtgatgcatatttattgtcagtgaattattgtattataatttaatatgtatgtgctgggcataaagcaacgaattttatgcctatgccgtcgattgaaaaagcccgtaaatgatctgtaagctctctttaaatgcttgttatcattctatacatagtccctcacaaatctcttataaatccaaaaaattggtgtcccaacgaaagcttataggtctatagaagcttttgtataactttatttttagctaaatgcaatagacaaaaaattactctcgaaaaagttgagttttgtgttttcattgtaatttatttttaatgccaatatttgctttgctcttttcttgcatttataaaatcccgagactttatctttcgtttgataccaagaatataggtattggccaagtaagaaaaagtgatggccttagaaactgaggatggcaattcaaaaggggcataaaacacgaacagaaccaaaa

SEQ ID NO: 12832 - DNA, 1094 bp, Heterodera glycines
  misc_feature (1067)..(1067): n is a, c, g, or t
aagttaattggcatttgttcgcttttagttaattacgttcgcccggtcattgtgctcggggctttgaaggatcgcataaatgacgaattggtcagtcgacaccccgacagattcagcagctgtgtgccacgtaatgggccatcttttccctaattagcatcgtacaattccgtcactaattgtctctcttcagatacttctcgcccaccgcgggaaggcgaagtgcacgggtaatttgcgacaattaattggatttgctttcttcgattcatttcaatttattctccagacgcaattattatttcgttacgaaggccgaaatggagagggacgtgaagagcaaccttttcattgaagcgggccaattccaaaacaatttgtacgggacgagcgtagcggcggtgatggaagtggccgaatctgtacgtttttggaggaattgtcaaatttcggcatttctcgactttgttttactttttcttttggcttaagggaaggcattgcattttggacgtttccggcaatgcgatacggcgactgcaaaacacagcccatatttatccagtttcggttttcgttaagccgcttaattaccaacaattacggtaagaaaaggacgggcgatcattgggtactgtatccggtaacactgattgtgaggctaattgtaaggctggttgagcccattaaacttggtctcacggggtttgggttcgctggtcacaaattcctcccattacggtcaatccctaacagcgaattcgaattctaacaaaagtcagtgccaccaacattttcccctgctgggcttccctttttatatccgcctaatttattgtaatttccttcagagaatgggactctttgctcagtgaagaagatgccctgaagcaatttgaacggtgtcaacgccaagaacaaaacttcggggatttgttcaccggtaaatgccggccactagtaggatgggatttatttttatttaaaatcacgaaatatttaaataaacataatcccgtccctaagtaattagtgttgccaatcgctttgctcaaatttgtctttangaatggtcaccggacattcgcccgacg

SEQ ID NO: 12833 - DNA, 2410 bp, Heterodera glycines
ttccaaaaagaattcataattcacttatcgttttgaacttttccgtttcattcagtgccgtcagttgtgctaaagcaaatttgccaaccttcgtttataaacttgctcataaatttattaattttatttcatttgtccctatataaatacataaaaacaacagaatgcggggttttatcatgaatatcacttttccattaataaggatttaaaatttgggtcagtacaattatttaagtaagaaatcacgaatagatgtgcttatgaacgggggaaaattagagcagactccaaaatgtgagtccgcatgacaagaatatttaggaaggggtggctcttagaatttgaacataaatagaggaaaatgatcagtacgctcctccaccgttttttgcttgcatcatttcatttagtgatgggctcggcctttcattggttgaaaatggattatttttgttattggtcatggcagtcgttgatgaaccgaccaaaaacggattagtcgctgaaagggttgaatgtgaacaattttatggcacgaaacaagaaataatcaccttttttaggggcaatagtcgaatggttggaaggcccaagcagattatcaagattaacaagagcagaattctcttaaattgcaattgtattaggcaaaagcaacttttgaaaacctccaagaaaggactcgggtgtctttacaccggctctttgctgtccctgacttgtcggttggttcgtcgtttgtgcaggttcaccaatgtttccaaagaaatcatccgatgattgtttcgttggttcggatgcagcaaaactttgtgtttcaaatgatgcccatgggtcatttttggttgaagatgactgcatgagaggaccgagaacgtggcccccatcgggatttattgttcgagtcgtcgacgaagaaccaaaggacacaaagcttggatccgaggaagaagccgcaggtgcccatgggtcgttttgaataactgtgtgggaagagaaatgctcaaaagagaatggacaaaatacttgtctggtgagcggagacaggcggcgcagtttcaaccattggaatagttgtggaaggccgtggcgaccaggggtcgttgaaaacgcccagttgaggtggctgttgttgtgtttgtgcagaactacccggcgcagtcgcatttggaatattactcctgaacacgtcatccagtcccaatgaaagcaaatcatccaaagctccgtgcgacttggaggtgccctgtttttcgacagggtcaattccaccagacggagacgaaagacttgaagaacgagccaattcacgcttgctctcttcaattgcgatctaaaattaatgaatttgctcgaccagtctgactgaattatgcctcgattaatatatttaactataatttcaaactttattaaaaatcaaaatctgtatatcaaagttgagtattaaaatagcataatattagtaaatggtaaaaattaaactcatttacttgcaagcggatgtcatcacctcgacggagttcacgttccttttcacattcttcctttgaaagtgctaatgcaatttgcagttgcatttcctcctctccaagggaagacggccgcgcttcttcaaattcaggatcttcaagagacgaaaagcaaagaaaaatgaacgctttcagattgattcacccgttgcgcctgtttcgatgtttctccttccaacagatcgtctcgaaccgtccgatgaaatcccagaagatccgttttgaatgaagcgctttcgagtcaacaaaaaacgggctcgctcattcttcaatttttcgtcgtcctgcaacaaagcgaccatctgtttggcttttgcacgcacattcaatccttggtcacggttgtcctcgatgtgttggaaatcctattaaaaaaaatttagcaaaaaacatgaattgcaacgactttgagtgtctcaattgaaaagagattctcgcggcattgagctgacactttctcgcttccgcactttatcaaatagtcaaggagcaccaaacttttgtacacctaatgaaggtttattgttaggtttttttgtgacaaaaaacatacatgacgccaattctttccgtggtcatttagccttttccaaaccatagacataatttcggtgaatgaaactgggttgtgagttaaatctgcgatttcagacattagcactgtggttggtccccatgggtcgttgctaaattgctcgatttttttggtttgcaaatttttgggataacctggtcgcctctctaacttttacttgtgcatcagtgtaattgcaggccacattcttcacttggcgacgtaatgtagatatagaagacattgacgcagctccaaaagccaaaagtagagaggaataattgttctgtcggttatgtcg

SEQ ID NO: 12834 - DNA, 2105 bp, Heterodera glycines
tcagtgtcagtaatttatttttattcggagatagtcctcccgtgatgagacaaaacctgtcacacattcattgtgtcattaactcattaaacaacatatgtctctctctacccatctaagaagctaagccatttcaatttcattttgcagaagggagtgtggagggaaaggaaagaaagggaaaagaaggggcgggggagttgcgcacacagcttaattagtaaattggacagagaacagcttgaacttatgaactaaataaaaatatttattcttattgttttttaaaaacggagaacaaaaaaccaagctaaaaaataatttgcacctacaacagaacaggtaccacttattaggtagctacctaattagttcgtcttgccccaagcgctttccctatttaaaaatgtttgcttttttcggctcgattccttttaaaaaaatggtcgctgttcgtctgtttaatatcgttttttataggtgtattttcttcaaatgtttcatattttcttcgtcaatcgtggttatatgcttgttttggagccacctgctcttggttccgtttacgatttgcagaagtgagtttatttatttggctgcttctgtattccttcctttaggtgtatcgctgattccataaacattgatataaatgagcaggtctgatcgtttttttaatcaaatatccctcatttttgattcagtaccttttcctctctggtggtgcttctatcaatcgcaatgcgatgctttctgcaatttctgacgtgggaaccgatacgaacccgatatttctcgttcgtcgaatcactaatacccaatcagaacctaccaaaacaaattctgacggaattaatgagatataccaaggtagagaatctcagtgtgttcatacattcttcctattttcagattgggagatttccatggatcgtatgttgggaattgtgcccacaaattcgccctctgcaattagtgaatgtgtcgaccttggcaaaaagtgcgctcaactcgctgaaaatattgttcgcttttgtaacaacgtgctaattgagcatcaatttctatatcaggtcagaaatgctttttagttttgaatgagaattttaattattttcttcttcaaaatgcaattgtactattttttaaattttcggctccattaatgcaatattccggaatccaattgtgttgattgaatacacaataaatttttaaaaacttacatttaatacttaagggttggatgtctgtgatctcaaatttggatgaaaatattctgcgtattcaacgtcgtttggacaaatcaattggacaagcagaaaaattggagacatttcggcaaaacggacgctctctgttgaatgggtttgacaaaatcttggaaactttaaagaaagtgcgtcttcttttttgttatggtgttcttccatccttaaggctttgttaagattgtgcttcccccttcgcttctttctcttggccattcttccacaaatttatccgattctgatggatctgctgaagaaataacacttttcgattggatttcgtcaaaagacccggcctactcgctcagctctttttcgcaacatgtgctcgatcacttgggaaaaacgacggacgaagagctaagagaggcgcaacatttgttggctatggtccaagatgtgtcgcaaaaacctcagtaaaataaattatttataatttcaatacttaaattattggtttttgcttgtaaacaaatccaaaaaatttttatttttgaaatattattttgtttccatttaccgaggtgttttcggttgacacgtttggccaatcccgaattctgaacccataatatttttaatcatttatactatgaagcaggactgtatccagtaaaaagtttcgggggagtgcaccaccgaagagcttttctttttttttgttctccagaccaaaaaaaaaaaaaaaagattttccggtgtcatttttcaagtttttagcaaaaatacccataattaaaggtaccgtgacataagagggattgacaaacgcttgggcacattaaatgcacatctacaaaaacttgaaggtgtgttctaatatttttgttcaat

SEQ ID NO: 12835 - DNA, 4158 bp, Heterodera glycines
ctttacaggtgcagcaaaaacccatcttactcaacacatctatacccaacaatatataattgaatccgctattttctcttgataatttttgaaaatctgccaagtcaacctgaacatcagtcatgaatccagcaggcacagttcgtgacctcttaaacctaacacgcctaggtttatgtaaagtatatgttctgtctccctcgagaaagtgttcaacgtcttttcttgtgatcgaagagtcatgttttattgcctcttcgtaaagtctttcctgtccagcataacaggcgggtgaatttgggtcattatacaatttgttcagtaacttttccattttttaattataaattttcgttgtttacttttaacgcccgatcccgattgttcattaaatttttgttttaatattccactagtcctcgggtcgtttctcagtcgttgctctaaagcttttgtacctatgggtgatggagcattctcgggtgaccgtctcaatattcgctctaatgcttgattaacattactttttaaatatgccgttccatcagctctcagtatatgtcctctatagccaaccccaaatttctcagggtcattatttataattgacataatttttccttttttcttgactacaaaagacttttgtttttgacgaaatttacttgtcccaacacgcattggttttatcagtggtctcgtctttggtgttgatgttgttgactcagcatcactctcttcagcagtagtgtaagggtcttcaagtgttggaatagagcctgtttcatccaatccttcgtcattaacaatttgagtaggaattttgctatctctttcacgctgttttggtttaaacaccattaatgagccatctgaaagctcaacctttacgggtttgtcttcaatttccttccttagtttcaagaaacgcctcaattcctggttataaagtaaattttttgaagtagcgtctaattttctctgcttcaaaagtgatgacaatttatttttagcattatcaacattaatttctccggcgtctggttttagtaaatttttgtacaagtcggaaggaacaagaataaatttattctccatattttaacgcggcaataagtactggtaataataaaggagtcaaattaaggaaaccaccgcctccgttttgttgaataattttatttacacctttctcagttctaactcttcctaattttctcacaaaatttgcgtatggtaaaagtctatatttttgtctcttcgtgagcggaaagtacccctttaatatattataactaatttcaattaataatgcaatttgttcactagtcgcttctttaaatatttgttgtctctttttaaaagactttgtttttaccaatttctttaaaaaatccaagttttgaataacatttttaggtaaattaatcattttgaatatacaatgctttttcttcatcttctttaaatatcctcgtccgtattctcagtaaaggggtcgatgccgggtgtaaatccaaaaataaatacccataaggtgataaagtggcatctttatacgcacttaggaaaaatgcaagattttttggaaacagttgaacacccaaattacgtatttgtagcgcggcattcggagcagacattaaaacaatatattgtgaattaattcgggctaccttcacctttctctcgaacaaattttgtgttatgaaaatcacacccatattaagatgatgagcttttttaatgaataattcggatagagttttctcatcaattattgttaaaaggtcatctagaattaataagagaggcttctttagagagctcagcaattcgtccctaggaggtcctttgtgcacatgcactcccattttttgtagtacaggaatactatcattaaattgaccataacaataaagcactgattttgggtgtgggctaatcaattcatctctttctctcaaaaattttagtaaaaatgttgttttaccgctactggatggtccactaattaccataccaaaaggcaattttaatttcaaatcgttcaagtgaaaaaatttttcatcaatcatctttattaattatataatgttaaattttaatcttaaatacaattagtgggggttctttgtgtgtttgttatagatatcagtctgcatcatattgtactttacgcaaccgggacacatcacttgtgtaaagtggaactcatcttctcccatcaacttgaactggtccttgtgcttatagttgattcgacgacaccctgggcagagaaagttgatcactgcaaactttggccgggccaatttccaaaaggattgtttgtggtcaagcaagttatatacggtgtgggttgatttccgttcactcttttccaactcattctgttttagtggtttctcactgctttttatttctgcgtcttgttgaattacttgctccactacagattggagagtcttctttgaagaagtagaagacattctaatttccaaattgagttacaaaaccctgactatttctctccttaaatacctttttgtttggttaatttataccttttaatattagtaatgacacatttttcaattttatttctgaataaacattcaaatgaaaaatacaagtgtaaaatagaaaataaagagaaatgataaaaagaaagtatgcaactcttttgatagatttgaaggcatatcagaattcttagagttccctttgaaaaaagtgagcaaacacacccagggaacggcttcacccttcggtccccaatccaaacactcacgcaccaggctgtgcattacaataatgaacagctcgtccaccttcatctcagatggatggcctggagtgttggagaggatcaaccaggggtcattccgtcccacatgagtgatataaacagagagaaagaaaagaagggaacaataagaaaactaatatacagaaaatttaattgagaatgcatacttatcatttgcgataaccaaattcgaggacttggaaggcgttattaataatgccttttgtgaagacaggttgataatgcttagttagagattgagtgtacactttgccttggataaggttaggacgaataaaatgggggtatgttacaataatggggtccgcggggtcatcggacccataacgcataatttgatctttcacactgtcataatggatagtttgcacagtttgttcatccagtgttatcccccttatcttcaagtcgtactcaatttacccattgtccttacgttccaacttcagccgtagtttttgcagccagcgctgatgaactccaaaatgttgtccggcttttcgtcagtcagctcaccgagatgtccctttcctgtcgggagtgggtcgttgtcctcggggtgaaccacaagatttggaacaaaagctggaaattttattataaattaaatttacataggattattctttcatattttagatatatttttaacacttattctatattttgattatattagcgaaaaaacgaaaaaaactcgtaatttagattaatgaaatggttagaagcaactttttatttttgccttttttgatgatctaaataatttattatttttttttcttttgattttttgaatcataaaatggaataagatatatttcggttttactcgtacttgtgatcgatattttgcgctggttttgaacatcaatagaatttaaaattgttaaacaattatttttcttatgccactttaaatttataacacaataattaaatggagacttaaaataagacaaaaaaaatattcaaacgttaaacgaagaacactttaactgatcatttttgaataaataattgttaaaaaattattaacgaaacaaaaataaataaaaattcagaaattatatgaaaaattaaagttgcgcttcaaaatcgtatgtttaggaaatttgaaaactctattctaataagaatttaaaaataaatgtatttgcaagtttagctcagcaaaaaacaatgtaaacgaaaatttaatattaaaatattactaacatttttaaaataacaatcaaaaggctgacatttaaatgaaataagaataatattaaaaaaatctcctatacaatttcttaccgaaaataaggaaatgataaattaat

SEQ ID NO: 12836 - DNA, 4868 bp, Heterodera glycines
actggcggtggaaacgggaccacgacagctgaatctgtgccatttgaccgagccgaagtcttcacagagtgccaagttaggtgtcctgcggggtcaacgaaattccggctgaaaggggagctcgcgttcatcccccgtcaactccaatttggatttggccacagagagtcagttggtggccagcttgaacaagggggtggaatccgactacccgattggggcatggaccccttccccctgttccgaatgctcatcggaggcccatggatcctagtggcgatcggggccggagccgtcggactgctcgccttatatttgtatatcaaattcaacccagcttttcgcatttatcggtcgctgatcacggttatcatcctcctcgggttggtcggcagcggagaaagtgggcaaattccaccaaacaccgactccgtcagcttagcaggggctcaagccccttttgccttcattccaatcggcgggattttagtgcttggcttggcactcattcgtctcacaactccacgccgacgcccgacaattatcatttttccgccctcccccctggtcttttccatttttcttctctccccactacagctcggagttctctgcccaaaaggggaccaatcagcaaaggggtacccccctgagcgagggggcggagcgacggcgcccggcgcaacacccctccaacgtctatttaatacagcggtccagagaagaatttcacttccttccacatttaccccccattcactctcttattgtcattccctttgtgaaccgagtatgactgacgacttcgcaaatggcgggttcggcgactgcaacgacgactttggtgggggcggaggtggggaagtttcccctcgggcacaggcggggagagatgcgcagcggcgaaggagcctcagcaaccattccgagctgggcgcacacggtcggccgatggcacgttgcaaaagcctggggcgcccaaagccccttccgcccaaatcagagcgccgttgcgtcgcggacgatgtcaacttgttcgccggcgagaactggggagacgacccttggcaacgggtggaggtcgaacgcttctttcgggagcaggaggcccggggaaagcgaatgatccacgagcggacgggcgaacaggtcccctttccatcaactttgggccttttgcccgctaatcggcaggaaattgccccggggtggacggtcgctgactatttcgctgaaacgaggtgccggtccctcaaatggcctcaatggccatgcatttattcgcccggaggtgtgattgggagttcgaagcgcagtaggactcttcagcaaaaggggcatgtcccctggcgtctaggccagacgcattgtgattggcacccgctggaggaattgtggtggacaacgcagtccgaattggactcggaatgcgatggcgcgccgatgacgagagaaagagcgcgggcggacagcacagaaagagtggcgcagccggcgggtcgttggggaatctctcccccaaattggccgacgaaaggagcacttcatcgaatcgatgccatcaacaacggccgccctccacgcccctgccattcaatttggggccgaagtccatcaccccgccctgtctcccctcccaagcacctcccaccaactgaagacaccattcattcacatcactttcattgccatcaaactctttctcatcaggggactttcccctccgatcgttcggaattggccttctccaaaaccccatcccttcttagatcgtactcttcctcctcctccttttgttctttctccaccttctcatcaaaaatgtaccgcagccgtgacacggaacgttcgtcggggcgcacggctcgacgtctgcgcctcttggaattgacggccgccgaactcgcccgaggagagttcgaccataatcgcatggtccagcagcatggtggaaacgctgaccgcgtcctggccgccgccgaccacttgacagaactgcgcgggaaattttcccgcaactggtcgaagtgccacgacattcctgggaaggaccgtcttcgacaccgcttcgatgtggaccgttggttggtagtggcgccgagcaatgccggagaaaacggtgggcaaaacgacgggcaatcccgaggaaaaatgcgttcggtggtggtggttgtgccgcccacctcgccaccagtgggggggagtacgcctgggaccgtggcgaaaaagcacccgccgacatcaccaaaaaggggcctgtcccctagtgcgctcccaggcccatcaaataggggcctgccccctctgtccccgactgtcgccattgccaagccggtcgaggagatcactcaagtcgccgaacttttgggcaaggtcggcgacgaaatgaaccgaagaatggcggaggacgaggagcgatcggcgacggggggcgaactcttgtccctcccatcggaagacgaagtggtgccggagacgccgacgccctcgtcgccccgcgccgggagtgtcgcaaaaaaaattagcgacgagaatggcagaggaaagaaaggagtgagcgccctccaccgagggccgggaatcacgggtcagggctgtttggtgttcaacgccaacgacgggactcctcgagagctatcgtcggatgatgaagaccgttttgggggaggcgctcgggaccattttgatccgatcggaatgtgttggacacttcttcccattttatttttctctcacttttaaatttcgtaccctttcccattttctcttcctcttccttttttatttccatcgcttaatttgcatttgtttatcgctatttcactaaaattcaaatgttctttgtccacccgattggggctcttttctcagattcccattttttgccccctctttgtcctattcatcgtatctcttcgccatcaccaatcttttcaaatttgtgcttccccttcgccttctcatcgcctatcgcaggtgccgacccattcacatgttttgcattttttgtctccctgcccggggcctatttaaccccccggctcctcttctttttcttccttctgttttttttgactgatccatttttcgctccccttttttccttatctttttcgctccccactttgctctctccgattgttgtttatcctacggcaaataaattgtgtttgttgaccgctcctttggtcgcggcaaattcccttccctcccttcggaattgccaacagcaaatcgtacaattggggccttcctctgccccttggtccgttctcgaaaactgcaactgtcgaacgggatcggatctccccgtgatccgaggctcacttcttcccttcccaccggtgaacgagtcgggtcaatcccgacggtcgcagtttggagtccactcactcctcccttgagtggtggtgccgtttctttccttccctctttgtcccgccctccctcttctcctttctcggccccccttgggcctcaattcgaaaggggtcgactaagccgagaacgagggcatagaacccggtgatcacccctccctttgatcaccaggggttttcggacaaactggtgccgctaacagggggttacctttcttcggacaacgccaacttcggacattggatttcggacgacaaaatggacccaactgacaatgagcaagaacacggcaacgacgggaatgagcgaaccggaggctcacccacaacgcaagtcggggcagttccgccgagcgcgaagaaaggaaagggcaaaccgaaagttgtggagacttcggcaattcaaagcaattcgggcgttcagcccggagggactcggaaccttcgaagtaatggcattaccatacgtgccattcgggaccagctggaaagggcatcgggccctctcgccgatcggatcgcggaggcacgagaactgctcgagccggacctcaacgcaggagacaagcctcagtcagcagtctgtctctcagccatggaaaggggactgcgggagttggtcgacattttcaagggccacttcgatcggggcctagcggcgatcggggacgaggcaccggagctgcatgactatctgtatgatgctttcaccgtgccactcccggcagcgacgagatgtttggggcttcgatcgcacccgcccccggccgaactgcttcaaatcgcgatggaacatcttgctgatctgcgcacggtccgtcgaacactcgaggacgtggaaaagctatctcagctttcatccgagactcggtcaggaacaggggacagcctgcccgcgggagatgatcccgctagccgtcgcacgccgcctccacagcaaatccatgacccgactgatcaccagtccgacgagtggctgtttggacgattcccaagacggttcgagcagctgaacatccaagagggacgtcgggcggtgacgcccgtgatgcgaagcgtcgcccaggtcgcccaatacccggtcgtaaacgcaggaggagccggagccaacattcgagaatgggtcaatcaggccagtgatcggagggaacggactcactccccacggatccaacaggcgggcaatcggccgcgcccaccgggtccaaaccgttcagtcacgggagatccaaatccctgtagtcgttttcggatacccgaacagatcaggggcagagacccctcggttctgcgcgccgcccgacgtaacgaagcgacaacggcattcgaaaccgtgcgcctccagccgccgacattttcgggaaaaccggaggattggacgacattttggtcgtatttcaagcgggcagtggacgacaagcccatcccgggcttcgaaaagcagccttacggcttcgctgcttaaaggaaggatccccagccaggagg

SEQ ID NO: 12837 - DNA, 1365 bp, Heterodera glycines
ctcttttgaggcgggttgtaaaataaagcccgacccctaaattagagcttcccctgaaataaagccctcctcctgagggggaaggttgaaaaacaaagccccagggggctgtattttactaaatacgataaaattggctatattcacttcatcggcccaattacggggggtcggagaggttgaaatctgattcccgaaatttctaaaaatgagattttctgttaaaaaattactcagtttcagaagaaaaaggtttggctcaatattcacatccaccaattgcagcagcaggaaggaaggaatccgtttttcaccaccacacaaaatgacatgcggtttatggcattttgtaccgtttgcacatatcgtataacaacatcatattctttcttgggccttcttcaatttgtgctgttttttgctgcaattcactttgcttatccggtccaatctgccaattatattggtcaaaaacaacagcaaactggtccaaattcatcgttgatgtctgaagaagaagcatcatttttggacaacggactccggcttgaactgctcgaacttcttgccaacatgttccgcagccgaagcagcaatagcaacgacgaccccgcaagcgatggacaaccaaaagcattggcacaacggcgcgaacctcgctttttcggtgatagtgcgccgttggcacttgaagagggccaaaaaacgggtcaaggatcggccaaggaaacaagggtcagaaaaaatgggaaaatccgtaagggtaaagtatggaaaatttgcaaaaaacgagtggaagttttaaaaatcttaaaaaaggaaacattaaaatctttgagatggatacaaaaaattaaaaatgccattagagacatttgaaattcgttaagcatccccctgcccaattttctcgagttcgaactcgtgaggaggaggagagacttttggaggaggaattacgggccgaatttgtgcgcgtgtcaaccgttaatgacccggatgttgcgcatcggtttcgaaagaaaacctatggtaagtcggcctaattaaaaaattaggggtcttgaaatttcataatataatttaatgtttaaattataaattaaaatagtaaattataaatattatctccccaaaagcaaatttgcccatttgcctcgggggtcataaaaatttaattagcgcatccgacgacaaagaatattgtgggaatgtgccccaagggacaaccccaagggacaattaatagaatattagcctcattaaaggcgcttagtcacaccaaatctttgtttccgtcactattttttcgtggggatagattttctcaataaatcaatgctagttgaagacagtttttttggg

SEQ ID NO: 12838 - DNA, 1525 bp, Heterodera glycines
  misc_feature (74)..(75): n is a, c, g, or t
  misc_feature (81)..(81): n is a, c, g, or t
  misc_feature (84)..(86): n is a, c, g, or t
  misc_feature (88)..(88): n is a, c, g, or t
  misc_feature (90)..(90): n is a, c, g, or t
  misc_feature (94)..(94): n is a, c, g, or t
  misc_feature (116)..(116): n is a, c, g, or t
  misc_feature (123)..(124): n is a, c, g, or t
  misc_feature (127)..(127): n is a, c, g, or t
  misc_feature (130)..(130): n is a, c, g, or t
  misc_feature (132)..(132): n is a, c, g, or t
  misc_feature (134)..(135): n is a, c, g, or t
  misc_feature (140)..(140): n is a, c, g, or t
  misc_feature (145)..(145): n is a, c, g, or t
  misc_feature (147)..(147): n is a, c, g, or t
  misc_feature (153)..(153): n is a, c, g, or t
  misc_feature (155)..(157): n is a, c, g, or t
  misc_feature (159)..(160): n is a, c, g, or t
  misc_feature (166)..(167): n is a, c, g, or t
  misc_feature (172)..(174): n is a, c, g, or t
  misc_feature (179)..(179): n is a, c, g, or t
  misc_feature (212)..(212): n is a, c, g, or t
  misc_feature (220)..(222): n is a, c, g, or t
  misc_feature (229)..(229): n is a, c, g, or t
gacccggggtatctctagagtcatacgaattataatcatataaaaggcattaaacacgagcaataaagggaatnngaaatnaannnananaaanaaaaaaggccttttataaaaangaaaaannaanaanangnngaaanaaaananaaaaanannnannaaaaannaaagnnnaaaanttattttttatgtgaaagaataaattgggtatnatttatgnnngtttttnagtgagaatagttatgaaaaaaatataattttaaatttatttataaatcccaatatttatataattttaaataaattattataaaataaatatactaattttaaaaaactctcaaagaaatatagcatagaaaaagtgtactaaaaattataatagagataatttatgaattttttctattttgttaaaaagattgcattcaatgataaatataaaaatagcatattatttcaataaaaatcaaatgataaatatcgaaatatcatttatataaacattgtacaaaaattcaataaaattatatataattaaggcatattacaaaaatctttttaataaatgtttttataaaaattattaatttttaaacttaatgataaattacttttttgaatttaactgtttatagaatttttttaaatcatttaatccataattttttgtagtagaaataaaacattgcgggtattagccattttatttatcataattttttatttttatcctaaaaatgcttcactaaattttgaatgaatgcgaaaaccgcaatcattatttttctttgtttgtcaatgttttaattaattaattcttttaaatgttctttatatgtattttctttacttttataattttttcttgtcgaattgttcgttacattgtggactttcaaagtgctgatttgtaaagatatgtaactttataaattataataaaataattattttttatttttaatgattaaattattgaatttaattttccaataagttatacatggtttcaaatttaaaaaattaacccttttaaaaatacccgcaatatattcagcagtaaaaacatgaaacttttatattaaattgttaacttaatttagtttaattgaagaagaacataattacaaattgagacgaataaaaataagttttttatataatgaaatagaagattaattaaaaaattgactttaaaataaatatataaattatttggttatttttttttatttgataagaaaaataatatgaagttataatatatttacaattattgttttgtttttaccttttaattcaagaatttaaacattattattaaaatattcattattaattaaatataaacaataaataatgatttaaatatttcaaatttatcttttaaattgaaaacccttttatattcatattttaaacaagaaaattaatggaaataaatatacaatgaaaaatttcacatttattttacttaattaataataaatgaatcaaatatactcaaaatgcaacatctctg

SEQ ID NO: 12839 - DNA, 2229 bp, Heterodera glycines
caggaaatacaggtttttaaggcctgtacctgtacctgtattccaaaaatggcctgtaccagttttttctgtacaaaagtataggaaaatacaggtacaggaaaaatacatgttgctaaaatttgtctgtatctgtacctggctggatccgtaatttttaggaaaaataattataaatataatataagtaattaaattttaatatttaattgaaggatagtaaattaaattttttgtatatccatatagtagtcctcttcttatagcatcatttaattctttcataaagtttcggaagaccactttatgccaaatggaaaatctgaatatcccaaacattaaattggttttttgaatttacgaaataaatttgaaataaacaattttaattaaaaatataagaaatttcttcaaattagctaaaaaaataattcaagtaaataaaaataaattattattatttcaaaattatgtttttcactttttttttaccaaatgcttctgattaaacaataaaagttctcctttgtgatgcccgctatttttatattttttatagattttggtttttattttatcgaagattattaattttcaatatcaattttccaatggtttctgattttttctttttaattttattattaaagtggcaaaaattttgcgattttgagccaattttttaagtaaaacaatgatacatttcgctaaaatagttattatattattcctttttccaattcacgcaatataaataaataaattacttcgataacatttgcattaattttggtttttaatgctttttttatcacgtcttttaatattagctcggcttattttgagttaaattagattcttgtacattaaattattaggcatttagtaaattacttctctttgtttttctggttattctgtctcgttcaggggtgggtgaagctcggcttagcactcgaagccgaagccgaaggcgaagcccaatttttattcgaaggcgaagtccgaagctcgaagcccaaataaccccgaagttttcgaagccaaagtttttcaaaaaatttttttaattccaaaaattttttcatcacaaaatttcggttaaatatcaaattcaaccaattgacagaacacctagagaacaactaacccttttaataaaataaatatatgattttcttgatgaaaatgtatttagaaatttggaagttttataaattagtaaagcattgacggtttttgactcaattaggggtgcatttttcacactgaaaactcgatctttaggggtgttcccgaaacttcgggtaaattacccgaagccgaagcacgaaaattcgaagctcaaaaacccaaagttttcgaagccgaagtttcgcgcaccccctggtcgcgttgcgtgttacttatatttttgtcttttttattgttcaaaaattttatcaatattttattttcttgtggtgttaattattatgtatattgtttcaatttctttgtgaaattgaataattattagcattttttcgtttttgataaaaagattgttgaaaaatatttgattaaatgtgccgaaatttggtacataataatgggacacttcttatattattttataagttattttattttatcaaattttaatgataaattacgatttttcaaatataaactcgaagtcggatctccttttttaaaagtagcagtttggactatttaatttaatgatctttatttcgaataattttattattcttttcatgtgcacgtcagtaggagtgtcgtccttttatgatgtcagctgcattttctatattattagtctaaacatttcattttagtttcaaatatgctaatatttctgttttttttatcattttttaagattctaagcgaagtaattttaattaatgttttagtattttaattatacgatcatgattaattgtcaatattattaattgaattaaatgctaaattttaaaatatgtaattatttctcacgaataacttcagattattttattaattaataaatttatcatattttaatttgttaatttttttttcacttcttttcatataaaaaatttactttctttattaatcaaataaatgaataaaaataaataaaaaataataatttaaaactaaaaattaaaaaattaatagtatttatttttcatttattttcttcctggtgcttaattaaaaaaatttatttaaaaa

SEQ ID NO: 12840 - DNA, 3021 bp, Heterodera glycines
  misc_feature (2973)..(2973): n is a, c, g, or t
ttactcgtcatgtaatgcttcttcagtgagaaatgattggtttttcattttgataaaaacatcatcacaataatctggtttctttttcttcattttgtcccaaacagcgattttgtaacgccccgggggaattacctggagaaaaaaaatggaattttttaattaattttcattttttatggttacgaccgtcgccgcgaaaaaaccttttaatagaatttcacaaaatttgaatttttggaaaatttgggtgaaggaaaccttgaagggggcacaaataaggaaaatcgaaaatttttggtactaaataatagaaagggactactcaaaattaaaattttctcaaactttcgcgctgcaagccataaatttgtaaatttgtgtttggtttatttgtattttagctcacctttccgattcgtttgtcatttttgctcactatcacaacattactctcgagcaatgaattcgaaaagagcccaaaagcaattgccaataattgaagcaaataaatcatggtaaaaaattttcaaattctctaaaaataatttagccgtaaattttattttattttttaaattacggtacctccccgacccacaacacactttcgggtaaaaagtcgagagtgagccggggaaggtcgggatttcgtttttcaagaacaactcaattttatatatttatattttattttgccatgccaatgtaagtccttatttctaagattgttattatttttcgagggtttgacaaagttcaaaaaagaaatttgacccaattcatacaacttacaataaattggggaatgcttcaagttttgaatgaaattattttcacactattttaaatcataccactttaccaggaaattaagctcagaaaatttattatattttgtcaaaataaattttatattaattttattgaaaggggtttaatatagaaaagtaaaaatattataattttaatattaattctaatgcgaaaaactaatattatacattttttataaaaattataatataaaaatgaaattttattcgctattgttgaagaaaaaaaaaatttataaaatcgataacaatgcattttaactcatattttcaattataatattattcatcttttttcatcatacaatatatatacagatgaaatcgtaaaattgcaaataaaattgtaaaaatatgtataaaaaaaaatttggcaatttatgggtaaaatttctcagagagtgtatgatttttagagaacttacaaatttttacaaaatcatcgtgaaattagctaagtaaaattttttgtgaaattttcaactgtcttttaatgtcaggggccactttaatagagatatccattcaataatttgggatcccatgcggtacggcggattatggaaatttttgaaaattaaataaatatcggagtattaaatgttttttttgaaaattagtataaaaccaaaagtaaattcaattttcaaataaaactttccataaaaacaaaaaaaatgattgctttacggcaaatacataatttttagccgagctttttcagtaataattttttcaatgggaaggggtcgcgcgggaaaattcgattgtgcctaaatgagaatttttaatatatttgtgacaatttcttttaaaaattaaaggagatttatattttaaatattttttaaatgtattggttttaaacctttttaattttcattttttaattttcttttattaatttgctgggataactttgagaaatttttttttaatccttaatttccttaacattttatcaaatgtatagctagtaaattcagctcaactaataatctcccccattccaccacacccttttcgggaaaaagacgagagtgagtcggggaatgtcgggatttagttttcaagaacaaacaatttaagaaaaggcaaagaattatgcttatgcagattcttttttgctattattgatattttgtattttcttattgccaatcttcaataaggaaaatatatttcattattattttatttatttttttaacatttcattattaatatttatataagccccgacatattttggggaattatgaaagtcgtaaagtgcacttgaaataagatggaatccccgttccccgacattttgctccccgagggtcggggcttaaccctactagaaatcactattttggagattcgtcactaaaatagtgaaaattcactattttggcgttttgtcactatttcaacattttttggaaaattccttaataaaaatgcaataaaaccaaaaaatacacccctaagaatcggccaaaaatttttttttaaataaccactaagaattggaaaattttttcaaaaattcttcccccaaattttttttcttgacaaaatttttgatttaaaaaatgtcaatatttgctaagagaattttataaaggaaatgtagctcatttgcaactgcaatcagtgaataaaaattattttttgctcaatttttggctgaaaattatgtcactatttgtcactgttttgaaatttttctcactattttgtcactatttttgcatttttattcactattttagttaactatttcgagattttccatcactaaaagttgcggccctactaatcaataattccataattcaaattgattgacctattgcaattcattcacttcacttccgctgctgaccacttgggccgggagttgtgtcgagaagtctaaaaatcgaaaaagaaaagcaataaatttgggttttcgcttaagcattcgcttacccatatcttagggctcggatttatccatattttagatgttcgcccttaaaataagtttttgctcttattttggcattttgtccaaaatttattaacaaaaattcaataaaaaccgaaaaatacactcctaagaatcggcacaaaaaatttcggaaaaatatacccctaagaatcgacnccaattttttaaaaatagacccataagaaatgaaaaatttctcaaaaa

SEQ ID NO: 12841 - DNA, 1427 bp, Heterodera glycines
  misc_feature (1409)..(1409): n is a, c, g, or t
attcgggtccggggttcgaaattagtcaaaatgaatgccagcttcgtgatcagcgacccagaataccccaaggaaatgtgttttactcggctttttttaaaacttttattttttagaaaaatggggggggggataaacttcagtattacccttaattttaatgctgtttaggctataaggtttgaaaaaaattcaatttagaatttccggcatttagactaaaaatggatgttcgaaaaatttgaattttcgactgtttgttcgagttcgaggctggttaaatggatgctggataaacaaattcaaaatagtcttaaattcattttccaatttcataattaaaattgatcggtcactttccaacaattcattcacaaacaatcctagaaataagctcattatttcagaaaatcactaagtcatcctaattgcataacacaaatccatgaattgatcactccaatacaaaaaagaatttatttaaatccataattcaaattgatcgatcacttcccaacaattcattcattcacttctgctgatcacttgagccgggagttgcatcaagaagtctaaaaatcgaaaaagaaaagcaataaatttggtttttcgtttaagcattcacagacccgtctccgatttcgtccacattaaatagaatttgattccactgatcaaaacattcccagccaatcgcttcctcttcccattttgcccatttgctcgcatcacgcacaattggacaacggaccaacacaaaacagtcgtcacttttgtcagtttctttaaatgccaattgttcacgggtcaattcgttggtcaacacaaatggcacaacagggtcagcaaaagacgaaggaataaaacacatgacgacaatgaaattgacgggagatgaagccgaggcaaaagcctaaaaatgtggaaaaattggttaataaatatgaaaatgaatgacacttttcggttgggagggggacatgaaaaaccaaaaggtttacaacttttatggttgaagtggccaattctgttagagccaaaaaaaacaacgaaaagccaaaaaaaaaaatcattgaaaatcaccgctttgaaggcttcaatcttcgacgccaaattctcgtcatccatgtccaacgtgcagatcaacacctttggcacagcgttttgaagtggagtgaaaagccacttaaccaccgcttgtccatccgatgtgatggcactgtcatcaaatggaaattcggcgaaaatgtcgtcaaaaatgaaagagacaatgcgaagtgatggacattcgttgagaaatgatgggacgaatttatgcaaagggctgaaaacattctcaaacaaaaacatcccacaaatgtttttcgcgatcattgggccaatggtgcgcagaatgaaggccaaaattncggtgtttggtcgtgcag

SEQ ID NO: 12842 - DNA, 1506 bp, Heterodera glycines
  misc_feature (1336)..(1336): n is a, c, g, or t
  misc_feature (1441)..(1441): n is a, c, g, or t
aattaatacccgcaggccatttaaattagagagagcgaagagagagaaagcaagaaaaagaaagagagagaaagatgggttagagagagaaaaaatggttgaaacggaaagtaagacaggaaaatagcgagtgagatagagccaaatagagagcatgaggactaagggagagaatataaatgcaaatacggtaaaccctatcgtaattacggatattcaaattgaagaatcgtcgttaaatacggcaggaaacggggtacaaattgttcagatcagtgagaatccattagaaaacaatggaagtcaaaaattgaattatattatggtgaataactcaaagggtactatgggtcaaataaacctctcggcaaatttggagacgataaattggaccgaaattcatcgtctgtttcctccccctaaaattgcattgaaggcaccacagcctgaggaaatgactctgagccaacaaccgtcaacgtcaaatggtgttgctgaagagagtctcccgagttgctcaacgattggaatttgcaaaaatgggaaggcatttcgcatctgggataatcgcggtcgtccagtcggcattgttagtccgtctttcaccgactcgcaccgaagaccaacaccttacttccgcccacggcaactccagccggtcccgcaacaaccgcaacaacagcagcacaaccagcaacaaaaaaatattttttataagataaatttattcttatgatcattttttgttaaatgtcattatttatataattaaatttaaaatagaaataatagtcaaataattatcagttttaactatagatcaaaaagatgtaaatctcaagagagtataaattaattatatttatattattttcacggcacaatgaaaaatagcatacggaacttaaaagtcaaattttaaacataattgtataggaaattagccagcgatcagccaaattatcttaatttaaaatgaatttgctccttactgaaaaatgaagttatttgctaatttattatttaaaaaacttaagaaggatttgcacgaatttaggaaaataaacttaaatattttttataaggataatttaatatagaataataaaatcaaataattgaaatttacaaactataataaaattagcatatataactattaaaatatatttatatttcattaaaaatattgattgaatgaaatactatttattaaatcattaaaaagtacaattaagtaaaataatcagaaaaattaacgacttttgttcaaaaaaaatggaaatatttaaaaaaagataaaatataattatgttaatttaagttctttttttanattgtaaaaaagatttaaaaaatctaattaatccttaatctgactataatttattaaaaataatctttttttaatgactaacacgccgatcaactgctttataanatgaaaaaaattgaataaattaatttcgtaaatattaattaaataaaaatatataaattactttt

SEQ ID NO: 12843 - DNA, 1661 bp, Heterodera glycines
  misc_feature (1654)..(1654): n is a, c, g, or t
atcaaagaaaaaatatttaatttaaaatgaataaatattgtatttaataatttaatcaatttgaaatccatattaacttaatacattattattttttctaaaatattatagttgtttttatttcatttaaatatcatattttttacaattttcaattttattataaaataaaaatatatttaatatatgtgttagtgtaaaattttaagagattgtttatacatttcttgaatgctacagtaagattttaaaaactaaatattggtattataatatccaacgctacagcctcgctcttttattgatacttaaccatttttaacaaggtaaaaaattaaaaaattcgattttaagctttgtcagaaaagcgcaaacagaaacgcattgcaatcagtggtgtgcaaaatctgcgcatgaaattcttttaaatcaaaaaattcaccaccgatgcctatcggaatcgcccgactcttttactttaagactttataaaaattactagagctacatcagcttttccacctactaggatcttcattatcttagtttgaggatacatttaaaaactttatgtttcttaattgtggattaaattagttcaaaaaaatttcgtgtttttcatttacttcgtacgaaaacgattattttttgttttcgtatttcgttttcgtccaagaaaaaattttcgtttttattttcgagttttaattcttgtttctttttcgtaaaaaataaatattttcgctttgtttcgttttcgaaaattatttttttggttttcgcacacccctgattgcaatgtcgtgagaattaaattatatagaagcagataaaagagaaaataaacaaataaaatttataaaagtcattaaattcggaatgaaacccataaatttaaaaggatatgaaatatgacaaataaaatagatttcaaataacaaataaaaattgaattttatttataatattcttgaaaataattttagaatgtcagttaaaggcattttcgaataatttaaaaattaaacgataaaaaactattaacatgcgaaatacaatgtcaaacaaatgtataataatgaattaaatggaaggacaaattatagtaacttaattaaattaagttttaaataaaatcagcgattggaagataattttaatatttttcatgaatttgcattcattatattaatttttttagatatttcaatttatttttatatgttttctatttttacattcataataatcttataatactattcgtaattgattttttaaattattttacttgaaatttaaataaatttaaacaaatataaaagatacaaaaattcacagaatttataaagtaaaacaaatatcaaactaataaataacaacgaaaacttactacatatgaaaatggccaccttcgcaatggaaaatttcctggctgaacaagcaatagattttgaaaaataaacaagtaaagagtaagcattaacaattttttacagctaaaaaccgttaatattatatcataaaaaatacaacacaataaaattaaatgaatgaaaaaaggtgaaaaaaatttgaaacccaaacataaattagaaaagaattaattagcaaaaaagtcttgaattacattttgtaaataaaacaccaaaantataaaa

SEQ ID NO: 12844 - DNA, 717 bp, Heterodera glycines
tgtaactgatccatgggccgagatttttgaaatcttatggtcggaattcggagattagccccctcctcttgatattaactgattagctaatataattgtagaacctaatccgaagttttgattcgatctgctgttgatcttgtgatctatataatagcatttttggtataactctctctgttcaattataaaaatgtactattgactgattgatcaattgattgatcccttttttctctgatcagatggcatggtccattggacgacgaaggtgtcaaacggtgccaaagatggctctggtggagcagcaaagaacatcggcgatgtcgcttgggacaccaaccagtacttctctcagccccagtcggccgacgttgagatgagcgcgtacgtttgagtccccgcgggaacgaccttttttgagagagagcgagagggagagagatagatagagagagggagagagatagagagagaaagagagggagagagagagtgagagagtctctcgtactcaatttgtcggctttcaaatttttcatttaaaaaattgccaaaaaagaaaatgccacttttgtttacagttatgccttgctcacatacatgctgctggacaacaaagagcatgcgctgcccattgtccgttggctgaccgcgcagcgcaattccctgggcggcttttcatccacgcaggtgggaatttgttcaaaattcaaa

SEQ ID NO: 12845 - DNA, 2350 bp, Heterodera glycines
  misc_feature (54)..(54): n is a, c, g, or t
catgaatcgtgattaattaggcaatgattccgatcaatttatttctaaagattntattgttgacgtatgccccgcccccttttcagatcatcttggtacccgtggttgggcgttggcggcaaagatgcaagcaccgtatttgatgtaaacaagcgccacaattaaccctactgaaagctcccaactttttagtttacccgcgtgatgcagacccgcgcagtgagcacggaggggcgtgaccagcaggttcgagcagaggttgccgaaaaatacatccaactgctcgagaaaatggggcatagtgagaaggctttgatggacaaatgggacgcaaaagaaacggcacagaacgaacgctggaatttatttgtctctacacagagcgaccgctggactgcatttgtctctgcacagagcgaccgctggacttcattcgtctattttataacgggcctttttgtttccatgtttgtggggttcgcgggcctttattattctatgttgtctgagtttggcgaagtgaagcagctaatcagcgcaaagcagtagagaatggaatcatcggatgacgcgggcaatttgacttgacaccattttttctcattgattctcattttttttaaataaatgtatttgttctaagcataaagacataaattctctattactcattattttattatcaatgaatacgctatacttgtgaaaatatttataccatttcaaatttatagttttggaaatctaagaaaactggtttgagagattttgttgctcgttattcattatgcgttcgtccacttacactttcttgggctttgaacaatagttaaatttgattagcattttgttgtaaaatattttcattttgctagaaaatttctgttttctcttcatttttgcattatgactattatgatggcataccatttaagttcggtcctctttttgccacggttacttttgctttccaaattcacaccatcatcagtggccaccgaattgacatttgaattgcccgacaatgcaaagtgcccaaaagcggtacgatttaaaaaatttcatggctgggatttccaagtttttttcggagattgcaacagaatttaagggtttaaatccattacgatttttaaatacttttcatcaaagagatgttttatttgcttttttcgaaaaaatttttttagcggaaaattgaatcaattttgcaaacttttcgaactcataacttttgtttacgataggcatcgaatggaatttgaaattatttgtaaatgttatcatccccaaattttgccttgcgtttctctcgccaccacggacgtcaaatttttaattaggaatttcgtaaaaaaaaaaaattttttttcacatcgccaattttttgggggatttgttataaattaatatttatttattgttttacattttttgttcccctgtttttaagaattgttgacgattatcagacgcaccatcggctacgcgaggcgatctcgcgcaagcgggcggaagatttgaatgagcgcgtcacttactggtcactgggccaaaccgctgttgtactgctgatcggtgttggacaggcgagttttgcttgtttgagaggcccggaattatgaggaaaagagattaggcgggcttggttttttctgacggtttttttacggcgaagcccgagcctcgggccgaacaaattttgataaaaaatactggaaccggtgctttttcaccactccttcgcctctccctaaaaatgggtagtttttttgaatgtacttcctttccagtattttttttttgaaatcatccaaaaatttattttgctggcttccctggctatatgccataaacctccgttcaaaaaaaaaaaaaaatttttttttcaaagtggtcctgctgattgtgaggtcgttcttcgccgacagaaaaccgcccggtggctattgagaaaactcaaaaatgtctctgtaatttattaccgttttatttttgatgggagagaataagtcactttatttgaggggccagaaatttcgaatttctgcaacttttctgttgaaaatctgaaaattggccggttaaggaataaaacattcgaattttccaaatttctaattactaagacacgttttctcactatatttttgcaccgtttgatccgaatgttattaatatttgttttcgcaggtggtcattggtggccaatatgatgttgatgttgtgttagaggatccgaatggcaaagtgttgtacaaggaggccaggaaacagttggacacccacacgtacaaagtgagtgacgatggcaccggtgaaatcgaatgccaagggtttatttttcata

SEQ ID NO: 12846 - DNA, 1604 bp, Heterodera glycines
aaaaaaaaaacttacctgtggggccacgtgcggcaccacaagcgcgttggggcctccgaccccaacgcggaaccagcagcccaggcgctggaagcgggcgcgcgcaacgcagttaatgaaccaataggcgctcccgacggatagggaggccaacacatgcgcatacgcttgccagccagaagcctccactcggtgtccatcacccgtgcgcagaacgcagttggtgacaggaagcgggccagctgttgtctgttgtgccgcacggtgctcaactgacacgacgatcaggcacaatggcctgaaaactttgtattatgtttttaaaattaataaaaatgagctaacgggagcagctgccccacttctgcaacacaaccattcaaaaaatgttggttgtgcgtaccatcagcattgaaagggtgctgaaattttaatttaaaaaaataaaaagcatgacgaaaaagaaacaccggaatttgctgttcagccgcattgatgagcattggttgaaccaaatgagcaacctgaaataataaattattaatattttatttatttattttttaattatgacttggccaaggggcggcatttgcccgaaacccgttggtagctgttgagtcattacaataaaatacaatttatttatttttttcgctgtaaaaaaaaaaaaaaaaaaatcaatataatagaataattgcggaacaaagttttttcattgtttggcttttcgtttacttttttttcgcctgctatttatttttccatggcttttcgcttttcgtttcatcggctttttcttttcttttcttagctttaaaatttatttttcaatgtttttcatttccttttttccatactcgcactgctttccttttttttttttttattctataaaatctatttttattttatttttttttattgcttggcttttcgttttctttttaaaactcgggtgggggcttttcttttcttagcttaaaatttatttttcattttcatgatttttcgtttgcttttcgtttattagcttataaaagttctttttgattttcatgacttttcgttttctttttaaaactcgagggcttttcttttcttagcttaaaatttcttttttttttcatgccttttcgttttatagcttggcttttcgtttttttcctgattttcttttcttttttgtttttcatggcttttccttttctttttaaaactaaagggcttttctattctgagcttaaaatttctttttgggttttcatgccttttcgttttatagcttggcttttcgttttttttcctgattttcttttcttttttgtttttcatggcttttcctttactttttaaaactaaagggcatttctattctgagcttaaaatttctttttgggttttcatgccttttcgttttatagcttggcttttcgtttttttttttttcctgattttttttttttttttcatggcttttcgttttatagcttggcttttcgttttttttttttcctgattttcttttcttttttgtttttcatggcttttccttttctttgggaggactaaagggcttttctattctgagcttaaaatttctt

SEQ ID NO: 12847 - DNA, 2653 bp, Heterodera glycines
ttgaattcaaatttcacaggccgtcaatccattaccccctaagctgaacggcgaaagaatttcgcctcaggcacaactttgagcggtaaattcccgacgccccgcccactcgcgcaccccgagacttgcgcagcaaaactcgcgcaccccttgtccgattgacaccaaatttaaggggcaatcaatccaccaccccctaagctgaacaacaaagaatttcgcctcaggcaccatttcgagcggtactttcccgacgcaccgccccctcgcgcacccctaccccatgcgcagcaaaactcgcgcaccccttgtccgattgacttcaaattttacgggcagtcaaaccacgacctcctaagctgaacagcgaaagaatttcgcctcaggcaccattttgagctgtactttcccgacgcaccgccccctcgcgcaccccgagacttgcgcagcaaaacacgcgcaccccttgtccgattgacaccaaatttaaggggcaatcaatccaccaccccctaagctgaacaacaaagaatttcgcctcaggcaccatttcgagcagtactttccagacgcaccgccccctcgcgcacccctaccccatgcgcagcaaaagtcgcgcaccccttgtccgattgacttcaaattttacgggcagtcaaaccacgacctcctaagctgaacatcgaaagaatttcgcctcaggcaccattttgagctgtactttcccgacgcaccgccccctcgcgcaccccgagacttgcgcagcaaaactcgcgcacccttgaccgattgacttcaaattttacgagccgtcaactcacacccccttaagctgaacggcgaaagaatttcgcctctagcacaattttgagcagtacattcccgacgccccgcccactcgcgcaccccgagacttgcgcagcaaaactgtggtggtaagaggaagttcacgccgttgaagaggaggtccgcggcgatggcgagagggggtccacgccgacggactgcaaaatgatgggggggggggggggtccgcggcagtggaaagacggggtccttgggagacaggggtccgcgccgacggacggcggaatggtggggagggtccgcatcagtggaaagaagtagagggggtccgcgccgcccggacggttgacagcggggaggggtccgcggcgacggagagagggggtccgcggaagagagggggcccgatccgacggagagagggggtccgcggcgatggtgagagggagtccgtggaaaagagggggtccgcggaagagagggggtccgcgctgcccaacgaaatggcggaggcgaccagcggggaggcggccgagctatttaacgcaaaatatcacgaccccgcccattcaaccggtggccgactggttaacgcgtcggcccaccaccatctcgggttcaatcccgcgcggcgaaactcccgcgcatttaacacccacagcccaaaatctcgcgcaaaccccatcccacacccccaaatcccgatcccacaccgtcccgcgcaccaaccaccatcccgaacacacatttcccgacgcatcccccaccccctccccgcgcaccacagggcagagaaccaccccataggcacgggacccccagctcatcctctctgcgctcagcggagaaaatcaatcgataatcaaagtgggcaccttatgtagtattgaaaaatgtccgaaatttggttctgccgttgtttcaggtggaatgtcccaacgtttgctggacgaaacaggacggccaaacagtctaaaacagctttttttcctaatgataaccaacaatgttggatttggtaggaaagcaaaaaaaactcacgcaatatgttcatttcttgtaagaacaacttgttctttttttctgagtagcctttttgaacactaaattttttgtaaaaaaccaaaattatggcctagacaattattaaaacttactcgctcaattttatcgtggttttgcttttcatcgaagagtgttagtagttcgcgtttgacgcgatctgacaatttgtgtgccttttgttcgatgtcgtccattaatgttttgttggatttaggcaaaaaatcagaggtgtgctgatttgcgtcatatgcccatttttgcttttttaatacatcgaacacataaatctaaatttaaaatttctaatcattgcattaggtgttgacctttttaccaaaatcatgctcatttcatgcgcaattcttttatctgattctaaggcattcgggtcttaaaaatcgaataatccgcgacatgttcgggggggggctatatccctctgctcactcgtcgtgtgatgttggaaatatatgtccgcctatttagcttctcgtcgtaccagtgcttttctagcttgaaaaatgtccgaaatttggttctgccgttgtttcaggtggaatgtcccaacgtttgctggacgaaacaggacggccaaacagtctaaaacagcttttttcttaatgataaccaacaatgttggatttggtaggaaagcaaaaaaaactcacgcaataagttcatttcttgtaagaacaacttgttcttttttctgagtagcctttttgaacactaaatttttaaaaaaaaccaaaattatggcctagacaattattaaaactta

SEQ ID NO: 12848 - DNA, 2150 bp, Heterodera glycines
tcgaagcgggtcagttccgtctggccagttccgtctcgccagttccgtctggggccggttccgtctcgggccagttccgtctggccagttccgtctggccagttccgtctcgccagttccgtctggggccggttccgtctcgggccagttccgtctggccagttccgtctggccagttccgtctcgccagttccgtctggggccggttccgtctcgggccagttccgtctggccagttccgtctggccagttccgtctggccagttccgtctcgccagttccgtcttagtagtaaaagagccggttccgtctcaaatatttttggacccaaatttttttaaatttcagaatgtaaacagaaagttgagatataattaacagtgctgccaaaaatatgcacgaaaagtagccaaaatatgcatatgcacaaaagtctcgaaatatgcaaaatatgcaaataaaaataccgatttttctacgcaaacacaaaaaagaacgtgtttttcctattatttatagcatggaaaaggcaggaaaaaaatacatttgcatgtttttggcagccctgatatttaatatgcctaatatttttgggtgttaaaaactaaaaactgccaaaatatttaggttttcggttctaaaaacctcaaaataggtgttaaagtttcaatttaggggtataaaataacaaaatttttgaggaaatttttcatttctcaggggtgtatttttgaaaattagacgaaatttatgtaaattaatctttatattcgggttcggggtccaaaatgggtgccggattcgctgcaaacaaagtgctggacacatttttttgggtttttaatgtatattctagcaattttagtgcgtattgcatatttggaatgtttaggaacatataacactatccctatttattattgatataattagccaaaaaagttttctcgaaaatcctccgccgtcgcttttccttcgccgcgacgccatttcagcaccaattgattgggactgaattatgtgaaggtcagcaaagcacacacagcaaaacttgaggaggcggaggagcattggcgccggagacggcgctcgtcgatcgatggcccctcggggcccgtaccaaaagaacgaggtaatgatttttacaaattaaataaatatgatggccattaattccctaaggctattcattcattagagcctccgagcattattcctcgggctaaatgaaattttcttcaataaatatatttcataaattgacagtcattgaaaaattaatatatataaataaaattacattttttcgataatatttatttattttttaaatcgaacatcattttttgctaattggtcgtttttcatcaaattaccgtgggagtttttttctaataagcaaataaattttccattcttgattctgttcgataaaggaacagctattttgtgagcttttgtggttacaacttattttatttgaaacttatccatttttaaaattatacatgctaataaataacacttaaaagccaacgaatgatttgaaagatttggttgcttttgagcaaatttgtctactaaaaataatttttttccaaatctggtacatttagccaagaaaatgtgcccaattctcgtcctataattcttgatatcataagctaaaccacttggcttgattattagcatgaaaattatttaatttggtgtgtttaagaaaagttatgaagagtttttttcggtaaacctgcaaattggcacttttatgaaacgcccatagtggcattttttatgaaacgacctagcatcattttaataataaaattttttaaaataatttattctacctaaaccgacaattcacatttcgctctcccccccccccccccctaaaattgggacacgaagagagtgcgctgcagtttcaattgtcgcgcaccctctgtcgtcagcagttcctccttgtccgccctcttctgactgtcggcggcgggcgatcggtcacgcatttcccattaaataattgactgacgaatgactgaccgattaatgttgatggctgacctgttttgatcggatggatttgttctcacatccactcgagacgaccttgtgcccacactttttcagcatattccttctacggg

SEQ ID NO: 12849 - DNA, 2042 bp, Heterodera glycines
  misc_feature (121)..(121): n is a, c, g, or t
  misc_feature (139)..(139): n is a, c, g, or t
  misc_feature (144)..(144): n is a, c, g, or t
  misc_feature (161)..(161): n is a, c, g, or t
ttttcaaaaatccccagttccaattttcttgaaaaataaaattttcatatttgaaaatacaaattttactatcactgtaacaaaaattaaaatgtcattcgtagctctaagtgtttatgtnggtctacataataaaaanaattnaatcgataataaagtgntaaccaaattagtttttaataatttgaattttgggtcgtcttttttatttttttatttccattcaaagctttcgaatgatattaataaataaattgaattttttcttgggaaatgcttattttttctcctttattttgtattacgtcaatgatcgttcagccgagtttcttagatttgcatgggaatagaaaaacaaaaatacatttttatttaaatataaaaaatttagcaaatatttgaatttaataaatttgtgtttgaagctttagttttttaattgatacaaattttgaaatttttaaggaaaaattttttcatgaaatgtttacagtgactaaattatcattcaccaaatcattcatgatctaacgagaaatcttctatattagctgtaatattttaatttttttttttgcaaagttaaagaaattataacaagaaattatttttttatttcagttattttattattaaattagaaaacttaagcttttgagcaaatacaaaaaatagaaaattgttttttttgccgaaattgtaattttattttttcattttcttccacttggcgcatttaagaatttttaaattaaattaaaaagatttaaattttataattaatcagcgctatgtttttgcgtctgaactgcttggccgccattctgtttgcactgtgctgcacctctagcactttttggctcggttccgctactactgatgaacagaacaaagcgccacatgttgaccaccataagctgaccgaaacacaacaatatgaagtgggtaaaactaacaaatgtcgccaattaattgagacaattagcgatgctcgagagtgcgttcgagtcgagagattcaatttaatagcttttgttttaatgaagttcttagcaaaatgcaaaaaaatattatttacataatattttatgattgattcgcaaaaattttaattttaaagagcggcaaggaaaccgacccgaagcatgaccacgagcagttccttggcaaggacgaggccaggcagtatgaggagttgacgccggagaagagcaaagaacgactcgcgtaattttcgaaaattttatttaaaaaatattttaaatattttacagaagattagtgccaaaaatggacctaaactcggacggtcaagtggatgagttggaactacgggagcacatcaatttcatgcagaaacgttatgtggtgcgtaattagttgaggggatttaaatatatttttttaacttagccgaaagctttttaatttttattttgaaaatttgggtttataattttttattttaagtaatttcgctgaaatttttaattttaaatttttgaattttcacattttatatttctcattatccctcatttggtttttttgagatttttttaagctttttttgacaattttgacggccttcgatgttttacttatcttttgatcgattttctatgcttcggttcactataaatttcgttttttttaattttttcaatttattttcttatactggctaatccttaaaaatataatggtttatttttgcagaacaacgatgttgagcggacatggaaaaattacaaggaggagcagctgaaggacggcttgctcgattggcaaagactacaggtgaagaaaatctaaacagagggggaaaagggtggaaattctaaaaaaatttaaggaatttgatttacggaaaaccacaggagggccaggagatttcaccggaatacgtcaaaatgattgagcgagacgaacttcggtggaaggtcagaaacagacctaattctgctaatttatattagatccgagaagctaacggccaaatttttatatttttaaatgctttacatacagtaaactcaaaa

SEQ ID NO: 12850 - DNA, 1117 bp, Heterodera glycines
ccgatttagagcagaatcagcgcatttccttcttcaaacaagtcaccttccaaatcggctttcttatccttttcttttaaatgcttttgtttagaacaaaaaacaatttccgatgtttccctaccaagaggagaagtcgcgggtttgtctcaaaattgatcaaccgtcaaaatgattgatcatttccattcagtgggacgattacggtgaaatcattcgtccggaggaatatataattgtcgattccgccgctgcgactcagcaattagcgacggtgacgaaagagaaggacaccgcaggcgatgaggaggagggcgaggagcagcgaagggtggcggtggaggaatggccaaccaaatgcatttcgtacatcgccaaaatagaggcaacatttgagtgattaattaactcactgatttcatgtgattgctctgtcgcttttagattttgtgcaaagtcgaattcatcgacttcgaagggcgttcagacggcgaatccatcaaaaagcttctgagtcaaattaagcccaagcaattggtaattggttgcccattttcttgtcaattcttcctctgacaatgagacagcgcttaattttgttaggtcatcgtccatggcacggccgccgccacgcgtcatttggcacaatattgccaaggacagcaaattgtgcaggtgtgttgggtccatcgcgttaatttgttttgcaatttgattttacaaatttattttaggggaaaactttcaccccgtcacttggcgaagtgattgatgccacaattgagtcgcatattttccaagtgacactttccgaccaactgatgtcctctctgctttttcaaacggtgcattaatttttaacttttttttttttaaatacggtaccacaggtgaaagaggctgagctcagttggttggatgctcgcatcattcgcaaatcggcgattgttccggtggccattgaccaaatgccgggagatgagagaagggatgagaaggaaagcgacgaattcactgatcacatgggggagaatcagcagaatgtggcggaaagcatgaaagagggggagggtgagaaagtgaccgacgaggcagtgaagacggaaggggaaacgga

SEQ ID NO: 12851 - DNA, 1559 bp, Heterodera glycines
atgcccaattgcccattgtttgatgcgaatgatcacttggattaggcataatgaatgccaagggcagtccatgaaggaattggaactgacaattagagagacaaattagcagcaaaaatcagtcgaacagaaattccaagaaagggtcgtaaatataattgttccttttttgaaatcgctgatcattggaatagggaatggactggactgactgcctttctttgctgtgatcgttacgctttatcgcttattttttcacccctttttaatggatctcgtttcccataaattttccgttatttattgttattatattatttgttaaaacgcttttgcgggttgacgaggcgatcgtttgcgatatctttcacatcccccatttttttgcttcgaaaaacaaattgcgtgctctctcattctgctgttgtttgttgtcgcccttctcttttcacgcttgctaatcaaatttgaaggagttccgtccaattcacgcgctttcattgcgtgaacacccccaccctttcagcgtcaacgtcatgtccatttggttaactaaccacctgctgctgaccatccatccccctcctccccttcctttatccaatctaagagccttcttccgtgtctccaaagtttctgctgtcggcggtttatgatgagctagagaggctgcatttcgtcaaataatgatatttcggacgtttggaagggaaagggacgaaaattccttctcacgggaaaatgatggggcgataggagcagaaataataataagacgaaagaatggacagcagcagcagggcgtgggatgaggggagagcgggaaaggcagagggaagggaggcgcattttgagtgtcagtcggccttttgctgccggcacttccaaggcggaagtcattcctccccccccccattcatgagtccattcttcgcacttccaaattttgcgtttcctcagcaaatccggccaaatatctttacgcttaatctattcgcaatggcacgtcatttcattcactcattcaaaaatcggcaacacatttgtcaggtagccattggatacgcaaaatgtgaggggagggtttgttttgtgctagggagtggacagaagcggaggacgcaacggggggggggggattattggcacactcacaaaagggtggcggagaattcgagcggtgtcgctggtcagctcccaacgacggaaaggaagtgcgtttccgcctcttcgccaatgcactgtcatctccgatggtggtggtctgtccgttcgtcttccgcatgttcatcatcattcccaccatcctctttcccttcctcttcccctcccttgttcaatttcctcttcccctcccctccttctcctctccaaccttcgcagccgccggttgttcgtctcgttcttcttcaacttcatgcgcttctgcccttccgtctgtttgtccaacgcattcgtttcgctaataattctcataatctaatgcgcttttcttccccacattcccccgctttcctttctttcttttcccctcctcttccgtctctctctctctctgc

SEQ ID NO: 12852 - DNA, 1578 bp, Heterodera glycines
  misc_feature (189)..(190): n is a, c, g, or t
aaaatgcaaatggagctgagggggaacagggccggaagcagcataggcaaaagcggatgaggacgacgaagacggcgactgcaaatgccatcggcagaaaaaggcacgtcatgaaaaaaggtgggcgaaggaggcacggcacaacggcaaacaaagtgccatcctcgggggggggggggcgactgccannaacatagggatgactaatcgttgggaatttgtttttccaaaatgccaattccaaatccaatgtaaagtgattaaaattgcagcattggccctttctttgccatgtgtccccaaattcattcccccggggacccaattccgttaattgaatgtgccgatgcgatgccacgcgtcggcattctccgaatcggacccaacagtaaaacaaatgcactcactctctgctgccccatggatatttatgtaattattttcaattcttttttgccattttcccttccttttgaaattcctccacaaaatttgactgttccaaatacattccttcaatttcgatgttttgagaagtttgctgattgttgtgagacaatggcagttgaattttggttttgaggggacaaagcgaaatgatccgaggaaaaaaagagggggaaaaacactcgacggacgacggggagaggggggggggggcagctgaaaagccaaaaggggccaaagagaacaaaccaaggccaaagcaccaaaattaagccattcattccctttgtttcctttgtgaatttaccatttctctccgattattaattattttttatttttaaattaattccattttattttcatattatttttaatttttgtcaattttcttcgaatgtttctccaattccccctcaattctgttcacgatgactccgtcattattgactttgaatttgtgcgttttcccaatcgccactccaactttttgtcagtcagaggtaaattttaaaaaacatttaaataactggattattactaactttggccactttttttggcaattatatgatcgaaatagccgatctatggcatttttctcattatctctgagttttctttcctccgtcgatcaatgggtccctctcgcgcctccctccctccctccctcccctcaccctccttcctccctcttcccctctcttccctcgcctctgtctgttttcacggttgatgctgttgtccgtccctctccctgctgcaaactttgccttgattcgccttacttggaattaattgcggcgctcgttggggatttggatggggagagagggagggattggatcagcaaatcgctgaaatggatgagattggattggattgaattggttgggatcgcattttgggtgttccgtcccaccgaatgggcggggaaggaattgaggtgcaacacaatttggaggacatcttcaacagtccttcgcccgcagcagtttcgaaatgaatgcatgaatgaatgtgcgtggccttttcagaagaatttctcttttttggggggaatttggacaaatcacttcaattttgattaaaagcgaaaggataggcaaagtttccaaataaattctcgag

SEQ ID NO: 12853 - DNA, 3644 bp, Heterodera glycines
gggggggcaaatggacacgaagttggcggcgatcaccggtgatcagcactttggttaggcaggggagtggctttaccaagttgaggatctggacgtatggcgcctgtccagcttcatcgatgatcaaatgcgtcgtttccccaaacagtgccggcaattgctcacagaaggacaaagtggcgaagcacaggcggcgatttttgtgctcctgcacaattttggcaactgccatttcctgggccaggcgtgggttccgctcgcaggcgtccaggtaccgctccaccttgacgcggtcttggtccttctgtaggagttcctgaaagtcctgtgcctccaccgcggtggcgagcaggtggggggaaatccgctcaacttccttggcatatctcaacttacctgtgccggagaacaaggcaagcatcggctccacgtggtttccggcggccagtgcgtcctgcatctccagcaccagcttgacgacggcgacattcggcggggccagcgccaacacacgtgccgtgggatccgtggccaggacagttttacgatttaccaaaattctgcgaaactgaaaatgttaaaattaaactatttgccgatgatcttaaggcctatcatgttctttcaaatatttccttttctccactccaaaattttattaacaaatttaatcaatactgtaaattaaacggccttaaaatcgcttcaaataaatgtttaactttacatttaggacacaaaaaccaaaaaataaattattttattgatgactttccaattcctaaaaatcccggaaacgaaccatcagagagaggaccttggcatttattttactaatgatttgaaatgggcacaacatattgacattatctcgaaaaaagcattacgatctgctttcgctatactaaagtcaatcaaaactggtgatacgcaaatacttgtaaatttgtttaatatttattgcagaccaattttagaattcggatctccgattttcaatccttatttaaaaaggatatagaaaaactggagaatgtccaaaaaacttttttgagagtaatatttagacgtaacaattatgctgctgatttacctaattatgctgaattgttaaacatttatgatcaaaagtcgcttgagagtcgtagattaaaaatagacttaaaactttttcatgaaataattttaggtaaaataaatttacaaaataatgaatccttttctttttccaaaaacattgtaaaaaatgaattcactataagatagagcccggacaagagggtcggtcggtcggtttcggtataaaaaccgaaaccgaaaaataccgaaaaaaaccgaaaaaaaccgaaaaaaaaccgaccggtccgatctctactataagaacagcgtattgctcaaccaatgctagatacaattcgttctttattcgaacctctcgtctctatagacttttgcctaaagagacgagattactaaattctaatgagtttgccaaacttcttgaaagatctgatctgaatttgttgatttctttgccaccccagctccaaaagtgaccaattgtctgttttatttgatattgtttcattatttcttatttttagcattttaaaccagggctcggatcgaaaatttttcaaaataagaacatcaaggccaaaaaataagattttaggatcaaaaataagaacatttcgcaaaattgcttcaaatcagttattttacaatttattcgatcaaaaatgtatcaaatattatatgtttcaccacttcccatgatcatttttaacaatttaggggagaaaattagcaaatcataattttgtgtattcgggatcaaaaaaacagatttttaacaataaaattttttgtaatttcgttctgatttgtgaacagatttgcatcaaaaaggccaaaaattttgcgcaaatcttatatttgcttgataaaatagtgacattctgccataaaatttcaaaattatgaatatatttaagaaataagaacaaaataagaacaatagtccgaaataaggacaaatcttacaaataaggacagatccgagccctgttttaaacacaatcttttttttatttcgtcattttttattggaaccgagacattgtttttttaaaagcgcaaaaaaggttttggaaaaaacgcgcttcgaaaaaagccaacgatgatttacatggccggacgccttcgcaaaattggaaaattggccgctgaccccattttttgcaaaaaaaaatctgaattttggggtctaaatctaaattttagtgttctttatcctgaatttgaaaaataattaattataaaaaatgcccaaatattcagcaaattagcccatttgaaaacaaataatttgaaccaaaaagtaaataattctctcatcgaaaatgaggaaaatttgtaaaaaaaaacaacattttatgaaaatgccaaaaaataaatttgatcaaactcggacccaatcggcagagtttaacaaattcattcatccaaaagtcggacggataaagccaacaaaaattctttgctgataacaggaaaaaactgttcattgtttgccttgaaaaaggcacggaagttgtcaacattcaaatgcaaaaaataattctaaaagtggaaatttaattaaaatttattttttaaatttaaattttttaaataataatcactttcaaattgtcgagtccgaagcgttcaatcagaaggaaacggtcgatcagcggaatttccacgcaattgatcagatgcgtttcgcagcgcgacttcaacgaggccacctgaaagtgaagcggcggttttaatagaaataacaaattcattagcaaatttgggagcattaatggctaagtcaaaaagtgccaaatattatgatggattacgagaaatcacagaacggttcatttgtttcattcatataaaatattagagatttttacacaaataatataatatttaaattaaaatgatcagacaaagaaagaagatgtgataagtgatcagaggactcacctggaagtaatcagccaatttgagaagcatcagcacatttttggctaaaaaattgagaattcatattaaaaaaaaaattaaaaatcatattttctcccctcaggggttatagtagtaataaatacagtatcatggaattacggttgggcagaaaaggtccgcagatggcctccaaaaactgcttgaattggtccatgtccacgcccaactcgtccaaagtgatcattcgctgctgcttctccttcatctccacgctgagcatgcgactgatcaccggggaaacggacatcagccaatgggcggacacagcgatctgatcagctagattaattaacagtgctctgactgggatttactagttatccggacaaatttatcagtgatctaagcaagatttagagtgatcagaccaaaaatgatcagtatcaagaattgtcagcgatttgatcaggaattattaatataacctgtctaaatctagtctttggtctgatcaaattatcattgatctagtcaaagtttatcagtgatctgataaagtttggtcagttaaatggtcagtttttaaatccattgcgcttcttctgttgtttcacctgtttgtcaccaattttcac

SEQ ID NO: 12854 - DNA, 1466 bp, Heterodera glycines
atttttaatgcgatttgttaacagatttttgtcaaaaaataacaaaattttgcgcaaaccttatatttgcttgataaaatagtgacattctgccataaaatttcaaaattatgaatatatttaagaaataagaacaaaataagaacaatagtccgaaataaggacaaatcttacaaataaggacatttttattttgtcagatttagaccctccaaataaggacaaatcttataaataaggacagatccgagccctgttttaaacacaatcttttttttatttcgtcatcttttactggaaccgagacattgttttttaaaagagtcgtacaaacagatatgattgttgtcagggggcctttaataatgttgttgcactgcacacggcaaaacagacaacagcccaaagcaaacagcaaaacacaaaacaatgccgaagataatttattaattccaaataaaatagggcgaggacaatcaatagggataactgacgaccgcataaaactaacctaacacttcacaaaaatcacaaacaaaaatgaaacaaattaaataacaaaacgccaaatatattttaaaatcacaatattagcacaaaagcgcaaaaaaggttttggaaaaaacgcgcttcgaaaaaagccaacgatgatttacatggccggacgccttcgcaaaattggaaaattggccgctgacccccttttttgcaaaaaaaaatctgaattttggggtctaaatctaaattttagtgttctttatgctgaatttgaaaaataattaattataaaaaatgcccaaatattcagcaaattagcccatttgaaaacaaataattttaaccaaaaagtaaataattctctcatcgaaaatgaggaaaatttgtaaaaaaaaacaacattttatgaaaatgccaaaaaataaatttgatcaaagccggacccaatcggcagagttaaacaaattcattcatccaaaagtcggacggataaagccaacaaaaattctttgctgataacaggaaaaaactgttcattgtttgccttgaaaaaggcacggaagttgtcgatatccaaatgcaaaaagtaattctaaaaagtggaaatttaattaaaatttattttttaaatttaaattttttaaataataatcactttcaaattgtcaagtccgaagcgttcaatcagaaggaaacggtcgatcagcggaatttccacgcaattgatcagatgcgtttcgcagcgcgacttcaacgcggccacctcaaagcgaaacggcacttttattaggacaaaactcattagcattatggtggttaaatttaatatttaattaaaatgatcagacagggaaaagaggatgtgataagtgattagaggacccacctggaagtaatcagccaatttgagaagcatcagcacatttttggctaaaaaattgagaattcaaattaaaaaaaaaattaaa

SEQ ID NO: 12855 - DNA, 1621 bp, Heterodera glycines
tggcaatttaggcaaatgccattcaatttaatgcatttcatatgtttttgagacagttatagatatctctctctctctctctctctctatcttcatcccttttgattcattttctttttgttatcccccccccccttttttaaaaactttgtccctccattttttccaaattttctttgtttgcccccccccccccttttcaccggccaaagtgtcgtcgtcacttggcaaatatttgctgcatattatttttaatcgggacaaatttcattaataatacacatgttctgttgacacttgtctcgttttttgtttgtcatttatttgacctcttccgtccgccgatggccaaaaatgggtgaagtgaaagcgaatggaatgaatggaatggccggcgatgcgatgcatttcactcgccaccattcttttttctcgaatggatcagtcgtaccattcattcaacggcatcggcaaaatgtgtaatccaatacacacacgaaataggtacatcataggtgtacaactaatttctgctgctgtaccgggaaatgaggaaatcaatttaaaaaacggaacgtatacggtacaagttttatgggacacgaagtcggctaacgatgcgtaattcacgggacatggaaggtattcgagcgtaatgtctgtacataatatagcttttcacttgtaattatatcgggacaaggtccaattaaaccatggttatcgcccggtgtcttagatttaaatttttatttaaattctgtttactggaattatatttctataaatatggcatttctttcatctttctattttcactctcatcagtgacaatgctaattgcactttctttttgttggcatcctccataatttatccccccaccgctaatacattcgcttctgttctaattaccttcatcttgtgattattacaacacaaggttaaccacttttgtgtcatttttaaattgacaaattatgggttttattggaaaataaaaatatgtaaactgattttcccatgagataaaagtgagtgcaaacacaatccattaatcagaatcaattttaaaatagtgaaatgtgaaatcaaataataattaatcaaaatgtaaggtcaaaccaacgtaaataaaattaaatacgattaaaattgatttcaaaaatttcaaagtatttaaaaattttgatatttaatgtaaggaatttgtgaaattatatatttattttaaatgatttcttttctcctcttcaaatacattttttattttctttagattttcttccccatcttcggcagaatcctccagaacaacgctttcctcctccttggtggtttatgacggcacttttgtgcatttcgaatgcccaagtgggggcagtgatcagtggctggtggtcagtgcagtgagcgagatgagtctgatcgaatgccaggtgaaaaatggaagtgaaattaccttaaaatgatgaggaaatggtcggaagttcagaacgaaacaaactaagggggattacgaatatttttaatctcctcatccatttttgcagtatttaggggggtagtgatgctcgccgagatttgacccctagaccgaaaattttttctttcggggggg

SEQ ID NO: 12856 - DNA, 852 bp, Heterodera glycines
  misc_feature (803)..(804): n is a, c, g, or t
  misc_feature (819)..(819): n is a, c, g, or t
tgggcgaggaggaggaaaagcgggggacaatggcgacggcggaagcggggagggagcggaggggcggggggacgcgcacaaccgattggccaagtcactgcgcatcaaaccggagtgagtgacagatggaaatgaatgcttaatgaccgctctttttacattaattagctcagatacaattctaattttattcatttttgagcaatttatttatggtaaaattcaaaaaaataattgtcaaattaaaaaattttcaaatatttagactaaatttccctgatcataaatccaatgaaaaaatgtgagaacaaaaattaaatgtgtttcaaaaatggactaatctcctattcactcccaactgttcaaaatgatatttaacgcataatttttgaataaataatcattttaagttatttattaattgccacttaaaaggtatctcgagtttgtgcgcaaccacgcaatccgtggcggcaccggcgacattcgctttccgccgacggaagaagacgcgcgtgacgagcacgtgaaatggccccgtttcgtctcacgagtgggtcaatcggaacaaaaatcaaattaattttattttcgaaatgttttaagaattccgaaaatccgtggcggcgcgcgcgtccagcggcagcactttattcaacaaatgaagcacttcaaaaggaaccgccggaagaacggcacaccgacgacggcacaattaatggcaatgaaagcgatgatgaaatgaggaggaaaagcgaaaggacgaggcacaaaggcaattaattaattggccagatacattnncaaaatgagattganaaatttatttaaatttttaatttcttttcttta

SEQ ID NO: 12857 - DNA, 1939 bp, Heterodera glycines
  misc_feature (23)..(23): n is a, c, g, or t
  misc_feature (32)..(32): n is a, c, g, or t
  misc_feature (57)..(57): n is a, c, g, or t
aaaaatgagatgaaaaaattatntaaaatttntaatttcttttctttattaggtccnccgcctttcgacgtttccgccggccatttcccattttcccaaaggaccaattgatttggacgacaagctcagcaacgagtatgaagaagctcattctgagcagactaagcattttgaccatagtatttgccgtccttttcttcaggctgcctttcctcacatctttttaaatcagagtttttcgatcattgtttttattgtttcttttttatattattattattattatttgtctcattttttattgtgtttttatttgtccgggtatctcacaatgcataaacatttttgaaagaatgaatatatacctgaaaattttgatatataaatccgcaaaaaattttaaattaaaaaattagtttttgctttttcaaatatttcatcaaactaaaacaactaaaattaaaacaaatgaaataaatattcaaaaattattttaaagatttatttcgttcaaaatttggaaaaaacatactctgatataacaacatctctgctgcttctgtttatgctttttgccatcattttcccattggccgcgctgcgtgccgcccccgggggttacaccttcgcccgacttttgcttattaacgtttttcatcaacagcagttgcactgctggccagcaaagaatggcaaggcgaatgaaatgcgaaattttagcagcacggcgaaaagcctaacaaaattggtggaagagcaaataatgtgaatttttcacatactaagcatttgcgctggttacaatcaattcattcattctctgaatgcgtgcgtttgtttgtacaaatgccatattgtttaatattatattaataataattattacttatttagaaaaattaataatataatcacaattttagcccccactttatttattttttttgccatgcaattaaatgccgtttccgtaatttctgctcttctgctggtggccattttggcactttcgccgccattttgtgacggagtgcgcgaagaagaaacgctgaagaaaaagtcgaagcggccgacaattggcaaatcgccaaatgcgtcgccaattaggaagccaaatgcgctgcaattggccgcaaagaaaggaaagcaaaaatttcatggccgagaagcactttcagttcaaggactctcttctttggctgctgaactatcacctccaacaccgaaaataactgataagacacttacaccagcgaatgcggcagcaaaacgatccgctctttcttcgctaccgtcactacttgaccgggctttgcaaccatcgagtttgggaaaaaaggcacttgatcaggcttttcaaccattgaatttgggagcatcaacatcttatcaggctttgcaaccatcatatgtgggagaacatgcacttgatctggcttttcaaccatcgaatttcggagcatcaacatctgatcagtcttttcaaccgaatttgggagaacatgcacgtgatctggcttttcaaccatcgaatttgggagcatcaacatctgatcagtcttttcaaccgaatttgggagaacatgcacgtgatctggcttttcaaccatcgaatttcggagcatcaacatctgatcggtcttttcaaccgaatttgggagaacatgcacgtgatctggcttttcaaccatcgaatttgggagcatcaacatctgatcagtcttttcaaccgaatttgggagaacatgcacgtgatctggcttttcaaccatcgaatttcggagcatcaacatctgatcagtcttttcaaccgaatttgggagaacatgcacgtgatctggctttacaaccatcgaatttgggagaatcaacagctaatcaagcttttcaacaattgaatatgagaaataggatacccattcaagctttgcaaccatca

SEQ ID NO: 12858 - DNA, 2011 bp, Heterodera glycines
tgatcaatcgcttcgatctcacacttctttatttttgattatttacaacaataacaaaagtgaattttaaaacgatcactccaaaagagagaaagaaaaaagacaaaacattggcaatggacaacaaaatcggacagagagaagaggaacagaagagacaggaagagaagaaaagggacgaggaatgccgaagagagacggaggaggaggaggaggaagagagggaggaggagagggagggggagggatcggaaggagacggcacaaatgccgaagaaatgacggaaagggacgcggagcaaacgcaaaacgcaaccaaagtgagtgtggtcggcatcaaaccttcttctttcacttttggaatattctggtgtttgattccttaatgactctgatttgcttaaaaatgtaaaaacggagcgaacaattcatcatttgataaatttaatggcttttcgaacgattccacggtaaaaggaatccctttttgccccattgttttgaaatattttgaattaaaatatagaaaaagcttatatcttaaaaagtgaatgcttttaaaaatagggagcagaaaaaaacaaacagagtgttaatattaacctcatgaagcaaaagattctatctttttttgacaaaaaaatatatctgggggattttagagagtgctgctgttttgaatatgatgttaagcatttgagtcaattactaatcctaatttataattcgaattcaaataaaaacaaaaaataaataaatttttagatttgtttctgatacatatgaaggatttgaaaatttataaatgtgtttcagttttgtgatcagtgatcatgaaaattccatggatttatgtcacggacaacacaaaaacattaaaaaaactaaaagagtccttcgattttcatattttatgtgaataaggacaattgattttccaatcacttcataaaaaaacaaatttatcgtaggattctccggcggaaaaaatgccatcggcgaacggcggaaaaaacagcgcaattaatgccaacgacagaaaagggacaacggcaccatcgaacggcacaagtgcactgactgtggagaaatatctgatgcacttgcggcaaaaggaggagcgggtgcgttttgtgacataatttttagaaaatttgaccatctcgatgcgtttgcattgattatttatcgattgatcgttctcaaagattcggcaattggaggaggaaaatcggacgctcagatcgacactgttggacaaatcgcgcgtttaccaagcccaagtggacgaactgaccaacgaattggtgcgaaacgcggaaatggtggcacgtctgcagtccgagttggcactgaacaaaggtgccagcatcatcactcattcggcgcctcccttaaggcgagtttggcgtggcggcactttttgtctgatcgctctcaatttggtcagtttttttcagagatttgcctcagccaaaaaagccgcggaaagtgccgtcctcctccgtccacacgcacagcaccagacaccagcagcaacaacagcttttgtccacccaccaattgcagctcaacggcggccattcgacgcgtccgcaagcgaaagtgccgacaaacgcgtcactgcagcagcacgccgcgtccaaatgtggtggcatcgcccatcagctgcagcaggcgtcgacgtcagcgaccgacgcagatgaaatttgtgtcgcgttgcaacactttgtggagcgaaatcggaccaatcagccgcagcaacagcagcagaatggggcgggggtggtggaggcgataatgggcgtactgaaggggggccaaggcgaaggtggcacttccacggcacagccgacgcagccgagtaaaagcatgtgatcaaactgatcaaacaaacacccactgaattaagccgcggcggaagaggaggagctggccgcacagatcgccaagttcgtggccgacgatccttccggccttttgtccggcattttgttcggctccgacccct

SEQ ID NO: 12859 - DNA, 2495 bp, Heterodera glycines
cagcaccatccgttggacccttccgttccctctcccgctgctgcgtcgatggcggagaacggcgaagtgaacggattggacccgaccggacttttcgcactttcgatgcttttcgatgagatggcagcgaacgacgaggaaaagcagcaaaacgcgacgttgggaggccaacagacaaagacggcactgaacagcgttggcataaaaagggaaccgcaacaggaacaacagcagcagcagaacatcgactttgaggaggtgggaatggttggagagagaaagggggtgagagagtgtgtgatttaagagggaaaagacgaagagagggggagagggagtaagaggaggaggacattgagagaaagagagacggtggaaagaaagaaaaacgaaatcaatttgagagtgtgagaaatagagaaaccaattagagaaaaataaaaatgcgaggaatgggaaatgaaactgctgaaataaaacaaatcattacgttttaaattgtatttgtcatgcccaatctttttaaaggtcatgcaacgagtgatcggcggcacttcggcgtcgactcggaccgccggaagtgtcacttccatcggcagcaatgcttccggcacccatttgccatcagtttctgctgcttctgccccactcattgggccaaaaggaatgggaagaatggcaaagaaaaagagcgacagaaagtcgtccattggcactccatcgctgcgattgcatgaagggacatcctccgctggtggcattggcacgaaaatgccgacgatggtcacggagagtggcggagtgccaattgcgttgcccaaagggtcatcgaacacggtaaatgagaataccgtatcaactatcagccaataataaatgattgattgctttgtacacaatcactcgccatcgtttagtctgtcggacgaaagtcacattcgaacagtgccgtcagtgtccccctgttgaagaccgaccaactttcgccgcttccaaacggcgctaatcattcgacgccccccgtccaaaagccatggagtccggacgagttaaagctggtcaagcaattggaagtgagcaaatggccattaaatatggtaatttgtggcattgtttatgcgatttaggcacggatcgacgaaaacatcgtcaaactcggcccgcgtccgctgaacaccgccgaattggccgcacaatgcacgcgactgatgcgcgggtacagcatcggacagcgactgttcgcacgcactgtgatggtccaagtgtcgcaggtgattggcaagagacacaacgcaaatgccaaccgggctttggcactttcagtcccagggatcactcagcgaattgttgagcaaaccgcgtccatggcacaaactgacggacaaagggcgcgaggcattccgacgaattttcggatggatttccgacgacgcggccattgatttgttgtgccaactgtcgcctaggaaagtggcacttacggaaagattggaacacccaaacccacaatcgctgattggagcgggcgatccgacgcaacagatggaaatttacggaggaactgcggggccgaatttgacaccgatggaaggaggcggcatttctatggtcaacgcggcaggaggcggtggaagcggagtgggacgaagcggaggggggaagagaggtgaacagcgaagagggaagagaaacgggggaagggtgaaaaagaaaattgggtgggaaatgaggagggaggaagaggggagaaaagagcagggaaaggagaggaagggagagagggtgagagaagtgagaagaggaagcaaaaagtggtgagagaggacaaaatggaaaggagaggaagggggagagaaaggaaagggagagagtggagaggagagaaaagtgagaggagacggacgaattagggaaaaagaaaaacagggggaaagtaatggcaatattaaaagggtgaatagagcgactgtttgtggacccaatgatttaattgccaatttcagctttgaaaagcacaaatgcctttgccaatgcgccgccgtccaaacgaatgggatcctccaccctcaaagtcgacaatcactcgccccaacagtcgctttccgaaccgtcgccgaagttcgcctccaaagagaatggcagcggcacggcaccggcgactctttccgcgacgccgggcggggggcggtggcggcacgacgacattccgaaggagaaaatcatcgacatttacgaggcggagaaggtattggagagcagcaacaacaagcactgattgaaaagcataatgatcagaaaagtgacactttgtgttgatcagcgatcactccgtttttgttgtgtccctttgtgcgttgtgctgtttttgttgctgttatttattgttttcctatttttgaataaatttatatgatccgtcaatgccaccactgacccattcgtccggttcaggccaaacggatggagcaggagtgccatttggagcgtgccatcgg

SEQ ID NO: 12860 - DNA, 1222 bp, Heterodera glycines
ccatcaggatctcagcagaatttgattttgaaaattaactaattttttgaactttcgctgtctaatgaagcgcccaaaataggcattaaaaccccaaaaatagacacaaaaaacctcaaatttaggggtataaaatgacaaaatttattcaaaaaagtaacaaaatttagccaaaatcagcagggctgtcaaaaatatcaaaatatgcgcataaatatgcaaataaagtcgtgaaatatgcacaaaaaaacttgaaaattaggggtgcaaattaattaaaaattttattcctcataaattttatcgttgtttttgcaattgcaaatcaaaaatttctcaagattttcggcaagaagctcactgttgacccactcgcgcatccattcaaatttggatttaattttatacataatcaattttttccgaagggatattcaatcggaaaatatttgacaagaaatggcaaaatatgcaaaaaaacctgaaaatatgtataaaaaagggaaaaatatgcatgaaatatgcagaaaaagtcaaaatatgcaaaattaaagtcctgatttttatacgcaaataacaaaaagatgttttacctactaattatactacagggtgcggaaaaagttcgcgcactttattaaaacttatttttcgtattaaatgtactttttcttagaagcttcaccactatcgtatgaagagaccttttctctaattatcccccatgggggattatttttcaaccttcccagaaaggggggggggataattggagattgggggataaatggagattgggggattatttttcgacggattttcccaccattttacatatttcgggattttcttacatatttgtacatattttggatttttttcatatatattttcatttttttacatattttgagtattttttacggaaatttttggaaatcctcaaaaaaaaaatccaaaattttggcaaatatttttgtacatattttgaaaatttataaagaaaaaataagtttgaaaatgttgcctaaaataccaaaaaaagtaatttttatgtcattttgtggctatttcatactttacggggattttctttcccaaaaaataccattaaaaaaattttatttacatatttggggtttttcttacatattttgggatttttcttacatatttatgtacatatttggaccactttttgtacatatttttggcagcccta

SEQ ID NO: 12861 - DNA, 2982 bp, Heterodera glycines
aaaaaacttcacaactcggaaacggtattccgaggctccaaaaaatatcggaagccataggccggaattccgagaccaaatgaagtcggagttttaataataaaagaaattagaattaaaaaaactttaaaatttaaataattttactaaaataaaacaaatgaatgtgtttcattttcacagatttacataggttttatcgcaaaaaataaaaatttccacaaagaccaatgtatagccatcaaaatttttaaccaagacgcaaaatttttttatgatattagcgtacaaattaaattattgaatccaatgacggaaattgcgaaggatggacattttgtcagcttaatagaccagtaatttattaaatattaaagtcatatttaaaaattaataatttagtggcgtcataaaagaaaatgagaaatatgtgacaatttcggagttaggcgaaggaaatttaaaagaaaaatttaaagatttaaagacattaatctccgaaataaaagcagcatttgcacatttaagtgaattagtcattatcctcaaggaagttatgaatgcgctggttaaattccacgaaggtaatttaatttttataaacataatgggcccattatgagctttaattagcgaagggatttaagcgacaaaaactccaaaatatatacgtaaatatgtgctaataatccgcaaaatgacaagtaagttttaagttttgtttaatatgctttttattattttttttatgagctccagtggccagaaatgcatgaaaaatgttttttgggggattcaagcttagatagagcctattttctaggtttatttttagagcctaaaaagcctaaaaaattttgtgaaaaactattttggcattttgccctaaatttattaagaaaaattcaataaaaacgaaaatgcatccccaagaatccaccccaaaaatttcagaaaaatacatccctaagaatcgacccaaaaattttcaaaaataaacccctaagaaataaaaaaatttctcaaaaattaatctcttaaatttatttgtttattttcttgacaagaattttattttaaaaattatgcaattttaaaaaatttctgatttttaagagaacctaaacagtagcattaagaaattgtaaaattaatggtaaatcaatgcttttttagttggaattcatttgcatttcaatccaaataatttatttgtgtttaaaagaagaaattatggtcttggaaaaatgctgatcaaattatttgtgtctgatggtaaattgtttaattaggataattaagataacatatttattattagacattatttaatttttattcaaattaataaattatttttaatgaaaattattttagaacattttaattcttataaattaaaaaatattatctttaataatttagctaaattaaattaatattaaatttgctttatgttaaggtttcgttttatttgacaatcaaaaaaaggaaaaaaatcagaaaaattttatggttaaagttaaggaagaagatatagaatattcaacagattttgctgcgcctgagctgcttcaagtcagaagttattgttttttatttattgaatttcatttcagcaactttcaaatggcactgatgaaaagggcgaagttgaggtgagctaactgatttttacgtttaatttttccattcatattttattttcatatatatatatatatatataatcactgaaaaataataataatgaggttaattattttaaaacaaaattaatttttttatctttgacagaaattagggagggggtgggatttaactaaggaattctcgaaaaatgtcaaaatgcacaggaaatggcgaactatgcataaaaatccaaaaatgcataatcaactttaaattcaagttgttcatatacagtaaaaatatgcatatggatttaattgacttgcttaattataacaattaatgaattattccaatatcaggtcaccccgaaaatggacatttggtcagcgggaattaccatttttgaaattgctttctcagaaatggttggcttttattcgacatgccaccgaactgttgttggggaattgtttcgaagtaccaaattgaatttggatgtggaaaggccagcagcaaatcatcttttaaaattaaaactgccagaagaaagtgctcatgccggctctgaaaaatggtggaaaagatattgggtagtgatcgatgacattctcatcgtatggcataaattgccagagattgcgtttcttgcggtggtaagccggggaataatttgaaaaagcaccaatccatcataccttagagaaattggtggtttgttaagctacttttcgagttattagcacctatcttctaggtttttatgtttagagcctaaaaacctaaaaaatttaaaaaacctattttgatcctacatattttggcgttttgcacaaattacaatattaacaaaaatacaataaaaacgaaaaatatatctctatgggcagctcggtgatgtgacacttactccgttacatttgcggcgccgatatactgtggcaccccaaattaatgcttaaaaattaaatctcaaacactattttgtttcctttatggtcataagaaattcttttcaaaagtaataacgaaccactgaatgaaatctttttaaaaatatttttcagcgggggctttaagaaatcttttcaatttttcgaatttataaatttttaaagctggacagcgacgggatattgtaaggaagaagttagctggaccttaaagcaagtaaagcggcggttgatacgaggcggatttgcctcagaacgcaatggcctagttgccaaaggactggatttccacccctggcttaacattttgcctatttctttattaaacagaggaaatccataaaataaaataaaacttttttggttcggggtcattaattctgcgcagcaaatgtca

SEQ ID NO: 12862 - DNA, 4619 bp, Heterodera glycines
  misc_feature (4507)..(4507): n is a, c, g, or t
gtgttctccggaattgggatttgcaacgacagcattgtgaacagctcgaacgtcttggacgaatatgtacactctgggcatctgagctcggagacggactgtccggcgaacagatcgaaaatctgaaaaaatgccattgtttaaaatgccgtcagaatcgagtgttctcctctttcttaccacgctgcctttctttggtgcgagcacttcatttctccaatgctgaaaatgccaaattaaacggtacaaaaaaaatcacaaaatttggcattacgtcgattgcattgcgccaaatttggtcgtcacgttgatcagcaccaccacccacgccgtcatttctgtacatgtcacagctgacgccttgcgtaacaccgcgcagaatgcccttcatcgactcgtgcagctcgtccacaaagaattggatgaactcctggctgtcatgttggaacgaatcagcgaacaaattggtacggctggagatgacttcctgaaaaaacggcgagtcatgaaacgcaacaccaccatcaccaacggcacactgttcaccacaccttcagttcgaatggcgccgccggttgtcgcaacaccaaaatgcttttgatcatttgcacatattccatcgacgagtttgttgggcagtcggttttcgctgaaaaaagaggggtaaaaacataaattgatggcattggacattgacattattggcacccacttttccatcagaaaattgctgagtgctgtcacgttggccaatgattggagtgcagcgcccatgtagcatgtgttgccgatgttcagaattccgcccacttccttctttttgttgttgttgttgttgtcgtctttgatgtctgctgctgctggtggtgtgtctgatggtgtgcccattttcgcttaaaaagagaaagcaaatgaattaaattaatttttatttgaaatttttgttaggaaaaaggacagggggagatttgaagtagggttggccgagtccggtttttgtaacctctgccggatcaagaaacgctgagtcagtgtccaaatttttcaaatggattttgccggattttgaaaaacataaaaggattttttggagaatgaaaaacaaaagtttaagacattttctgaacaatgaacaacagaaaacgacgcttagcctaagaattaaaaaatagaatggagcagcagctgaagagaattcaaaaatagagagaggcgttgttgggagaaattaaaatgagagaattttttaaaaaatggtcccttttatagagaatttggcaatcgtttgcttttcaatttttaacttttcgatcattttgcctgaatttacaggggtataaaaggggacaattttggctgacaatcattgcatttccattcactgtttcgtcacttccttttcattgtaagtttattcaacatttggggacgctgatcatactgatcacgaaacaggcatccatttcaaccaattccgcaccttgggccaagattcgaaccaaaagtcgagaattcaaatttctcgagtttcgcatttttgtctatgatgattcagtttgtttcagaaaatccaaaccgattttcaaccaaaaatgcgaaactcgaaaaatttgaaatttcactttctgttcgaattccggcccggaagttcgaaatttgtcaaaatggacgccatttcacattactctcttttcttcatttgctgttgatgctgttccgttccacttccattctctttcagcgcctttgctgaaactcacctctctgtgctgctgttctgtaccacccgctttttgtgttgtgttcactgtgccgacgaccacaacgactccgaccgtccgcaaatgacaagaaccagccgaagcagcagcagcaacagaagccgaggcaggacaacaacaacaacaagaagccacagaagcagcagcagggaaagtccgagaagtgtgctgatgcgccagctcgaaatgttgatgcaaagcgcgagcaaaaacagcggattccgtgcgtgtctcaacgatggcaatgtgagagaatcagcgacctaactgatctgatctgatccgcttttccgttacgcatatttcagtcccatccctttaaacagatcttcaaatggcgcgttttcatcgatggtcctccggaaacaccatagtgagtgggcggcggcggcagaggaaaagtgcaaatcaatcaaattaattgtttccccattaatccctcctctcccctttttttagcgcgggatgcacgtttacggcactgctcaaattcccagcttcgttcccgttttatccgccaacaatgactttcctcaccgacattcttcatccgaacagtaagaaaagcgcgcaatgattcatcaaatcccagcaaaagcccccacccgtcccttttcagttgacacgagtggcaaagtctgcatcagcattcttcatccgcctggcattgatccactgggctatgagcaggcgtcggagcgttggaattgtgaccgtaccgttgagtcaattttggtgtccattcaactgctgctggcggagccgaacttcaacagtcctgccaatgtggatgctgccgtaagtggattgattcttcggcatatgaatatagtatatcaattttcatcaaaatttcaggttttgttccgcagcgacccggcacgatacagggaggaagtgcgtcgccgcgttgagatagtgatggcggcaccaacacaaccggaagggcaggggacgacgcaaccgtcggaagggcagaggacgcaagcggcggacgaacaggggacgcaaccgccggaagaacagagggcgcaaccgccggaacagcaagggacgacgcaaccgccggaacagcaagtgacgacgcaaccgccggaagaacagagggcgcaaccgccggaacagcaagtgacgacgcaagcggcggaagaacaggggacgcaacagccggaagaacagggaacgcaacagccggaagaacaggggacgcaacagccggaagaacagggaacgcaacagccggaagaacagggaacgcaacagccagcgacaccgccgcctgaagggccgcagcaacaaacggacgaatggtacatgtgatgtgatgtgatgccctctgagtgatgatattattacacttatgtatgtattgtatgtgattaacagtctctctctgttcatttgccctgcttttgttcactgtacatatgtgtatatattgtcattcaccaattactgtatgtatattgtatatatgtgatgtatcgagcaataaattttcaatgccatgttccatcataatttctgctgaattcgaacgtttaagataagcagggcttcaatctgtgtttattttctgatttggaggatccaaatctgtcaaaatactaatgtacttatttcttctccaaaattgataaaactgataatgggaagcaaaaagcataatatttgacttttgttcgaattccggtccggggtccgaaattggtcgaaatggatgccagattcgtgatcagcggctccgaaaacctatggaaacatgttttcatgatttttgaaaacaaaattattttttcgaaaaaatggctgggaaatttgtctataaaaggacgagaatttggcatttccaatcatttcaatcgttccctttattctcatttgctattcttccctccacttcttcgactacaacaacccatttcaagtgcacaacagcgtggacgcatgacggattcattggtggagctcagcccgggagcgctcgtctccggccgttggactgtcatcaagaagcttggagcgggcgcgttcggtgccgtctacttgtgccaagaccaagatgggattacaaagggagcactgaaaaccgagccaatcaacgcgccattcccacttctcgcgctggaggtagagtttgagtttgaggggggaacacaaaatttggtgtaatttttgtttccctttatttcaggccatcgtgttgcgcagctttgacacacttcgagcgagcagtggaaagcatttttgccgttgcatggaccttggacgcgaccaacagccggatgctgcttctggacgtacgctggagttcaacttcattgtgtgagctttgacagggccggatgtgtggagtacataaatctttgtccccccattttcagcatgtccctggttggccgtccattcgacaagcttttgcaagaatccggcgactgcttcagccccggcactgccatcggcgccgcactccaactgctcaaagcgctccaggccctgcacgatgttggctatcttcaccgtgacatcaaaccagcaaattttgccatcggactgccggaaacgaacgagcagcggcttctctacctcctcgacttcggcatggcgcgcaaatacctcaaagacgacgtgaggagtttcactgctgctttttgtttttgaattttcaaaatctgtatcccccgctttttcagggcactcactatacgacgccagcgggcctcagncaactttcgtgggacaccaatctacgcgcgatctccgcgcacatcaaacgcgactacagccgtggggatgcaaatcgaccatggttctacgtgctcatcaaattctacaaag

SEQ ID NO: 12863 - DNA, 1955 bp, Heterodera glycines
cttccttttctcctcttttcccttattctcccccatctttctttacccctccaccccttcttcccttacttctttcctcctcttccttactctttccccccccgccccctctccctcttcccttactcgttttccccctcttccgcttttcctcctctccatctcctcctccttttcctccccttaaaattgttttgttttacttttttcttcatttcctttactctttctcctcttcccttactcttttttctctcctccttactctcctcttcctccccttcaattgtcttccttttctcctcttttcccttactctttttcccttttgccttacctctttaccccccccccccctcttcccttactcttttttctctcctcctctgcttttcctcctcctccctctccatttcctcctcctcttcttcctcctcttccttttcttcctcctccgattccactcgaattgcgttggttgaacttctcgtcgcataataatagtgccgtgctgcttctgccgctgtctccgcttcttcttttgttccgcttgtcctcctccttctgctgtggccatttactgaggaaaagcgtcggtttggctgccggacgaacaaagcgccctaaaaatgaataaaaataaatttaaattaaaattgaaaattggaaaaccctttcagttgagcctcgcaaatatgcattttccagctccagcacctcaatttgggtctgcaaattttgcacgtacacaccttccagaaaagcctgtggaaagtttctctcgtcctttgagaatttccaaaatttttcaaaaataacgaaaattctctcaaaaattgccaaaaataaagcaaaaaatttctttataaaaagggccaaattcaccatgctttccgccgcctctgtgcatttgtaaacatttcgctggctaaaggaaaataattttttacccatcgaaaaaatgaaattgtgtaaaaaagtgtactcattcgaattggcattggcctgctgaatggcactcattgaagtcaccaaatgaccttaattaaattcataaataatttttccaataaattctcgaatactaacgacaaattttcccgaatctcgaaatttgaaatcttttacgtccgtctcgctctccaataatttttctgtctcacaattagatttttgaaatctcattctcactctcgagcttggttatccgtcaaaattggccacctaaacttccgcttcttcgcattgcgttcgatggccgcggcaccgccggcggcggcggcggcggcgcttttgccctttccgccgccgcttttttggctgccacggcattggctgccgtttgaccacggccaaatgcgacgacagtgcgcggcggctttggcacggaagtggacgcggtggcaggggacgagggcagcaggcgggtgcctttggtagggagcaggggtaattagagtaattaactgatattgatcgtgacaaaataaaaaaaacaatgacataagcaatgaggagaaatgatgctttaaatgctcaccgatgaccatcagctccgctgttgtgtcctcgccaaaattatcgatggccggcgcaattgtaatttcgtctttttatataaaattaaaaaattaataactgaaatttttggatggatttaattttaatatttctttaatttcccgaaaaatccttcaaacttatgttcatttaaaagatgaaaatgcttctccttaggttggtggttatgcttagtttatttactatttatgtgcttttgctatgaaggaagtgccaatgccggcggcggcggaggtgccaatccgtgggttgtccgccaattgccccggggggggggggtctgtcggtcggtggtcattcatcccatccatcgtttggttgtctctctgtcctccccccccccggggaatttccttggtgtcttccacataagc

SEQ ID NO: 12864 - DNA, 2159 bp, Heterodera glycines
  misc_feature (49)..(49): n is a, c, g, or t
  misc_feature (54)..(54): n is a, c, g, or t
  misc_feature (1947)..(1947): n is a, c, g, or t
  misc_feature (2073)..(2073): n is a, c, g, or t
gcgggtggcatgtgtgaactttgtgatgtatcataaaaggaaattaaanctagnccaatagtgccccagggtactctcgggattctcgaagtgtaggagtggtcccctgctggtaaaatacttttttggatttattggcaaatgtcatgtgtttacattcattttgtttgttacataattgacatttgagatgaaatttaaatacaaatactgttggattgctacaaaataattgattaaattaattgatttggcatgtttgccttttttggcataatgtttgcctttatctctgatcatccttccttcgccactgatcagagttcgtcctttgtttggtgcgtctcgcgtttggtgccctcaatgatgtcgtagggaaagtcggcactgagctggcgccagaattccaacttttccggcgctagcgatttctccatttgagtggtgtctgagctaaaattggcgtactgaaacggtgcgtggggatctgtcggacgccaattggccaacgaattgatgcgcggaactcttaaaaacacaaaataaaacccgccacccaaattactgccattttgataattgagacccaaaaataggtacggacttgtgatgctcgagaccgagttcctcgagactggagacagagaattgggccaaggacttgagaccgagacggccccaaaaatccgagacttttgtcgagtcaaatttaatccaaagtctcgaggccaaaaccccgagaattttttcaagtcgagactctcgagtatcatgaagaagaacaagccgagaaaccaccaaccactaatttaaagtgtcattgctaaatttacccggcctttgtgaagcttgtgatggtttcgatcagtgcccgttggaagtgtttgtccgcttccgtcgcattttcagtttcgtaagggataggaatgccaaacaaagggtccaattcgacgccgtgggaagagcctggaaaaatttaaatttaaaagttaattaaaatttaaattaaatttaaaagttaattaaaatttaaattaaatttaaaagttaattaaaatttaaattaaattttgaaaaattaaaatttcaaaatttgagtgtttgcaattgccctcctgcccacctttgacaggaatatcagatggatatcccgaattaatgtgctcaatttggtacagataaattggccacccggaggccatcttttgctgggcttccaataacatcggcacaagaaacattgtgtcagtgattatctaaaaaaaaaatccgcaaatttaaaatttaatacatttaaaatatttgaattgaaagaattaaaaagattttcttagattttctttttaaaatatattgataaattaattaattattaattgcctcattgtatttggtcagccaatatttgttgttttcttcttccccattttttggtgagtaaaattgcaaaattcgctgctgtgccattttcgctgtgtcgtcaaaatatttttcgggcgcaattttttgtgcaataaaatgttgaaggtcggcacgaccaaaattggcccatttggcacgaggaatttgggtggacatgatagtcgggtcttcggtgaaaagggctaaaagcaatgggaatttcaagggatagaaataataaaattctaaaatttttgggaatttccgacgcttttggccccctttttgtcagaacaatttaaaacaattaaaaattgttatcatttgcttactaaatgtcaatgcttcaagcgaagcgatgcccataattgtgcgctaaaattatttaaaacaaaaattatttattttaaattttcaaaacttttgggggcgctttttgtatcaaatgtgccgccgaatcggtgggcaaaaaatcgccgtcaaagcgcggatggaattgcaaaaagttcagctcgtttcggccacggccctaaatgcgttaattanaataaaattgaataatttaaattcgatggtcacaattttgttgattccgtccatcagttcgttcggcgttttttgcctaaattttttcaaattattattttttatttggccatacatgcgcaaggngggtgcctgctcacccgttgcccaaaattattaaaattaaaatgtaattacgggatttcgctcccagtgaatccgattgcccatta

SEQ ID NO: 12865 - DNA, 1403 bp, Heterodera glycines
aatgatccgagtcgtggcccctgaccaagtttctacaccacgggtttgtccacacgccctcttccccgccctcgcccgtctcacttcgagctctgggacagaactgaccatccgccccggtcccgagaattggtgatcaatgttgtgccccatggtgattcgacggctcgaggtgccgtggaggaataccgcatcggtgttggccgcgaactcacgatctctggccccctcgttctacgaatctatgctggtgcccttcttcttgccctattctctgttgcccttgtcgatggccaatcatctattgccggtctctgccctgctcattcttttgccctttgctcttcacggctgcacaaattttcttgccttggtccgtcgctttttggtccttccgcgtttgattttgtgcaaatcacgaacaaatttgcttcgttggcttactcaccgcttcctggcagcgaacacttcgctgaaagctatgccgaagcagctgactcacccatctctccgctgtgttctgccattctgccatttttgctctctggcctagttcgtatttggccgctatttaagccatggatcgcaagaacgggccaccattcatttccctccgactacctaattctcaacaccttctgtgccatgcccgccaaacctaatcttctctcgcaggagcttgccgaattggaaagaaggaaaatggagctggaacagatgatcgcctcagctaagaaagaagtgccggaaaggaagagccgtcgtccaaagaagtgccaaagttcggacgagcccgcccctcaagacgagcccgaggaaaagggacctaaggcggcagctctctctgatgctccgactactcagccatcccatccgccgctcggcatcgtgcctccaccacccccatcacctgttggctccgacatggccgaccttttgcatggtcacgtcaataagtgggcaatggaacgtgaggaggccgtgcattttttgcagaagaaaaaaagagatgtcgccgtgcctgttcacgatgcactcaaaaagttcaacggcggcatcaaacgcctgagaacggcgctggacgacgtccaggaaagtgtcggctcgatagctgctggtgtgaacgaattggccagctccaccagtgacggcttggtcattaccgtcactcttctgcaagttgaagtcgatcgccaggcggtggagctgcgatcccttcgccgatctctgcaccctccgccagacgtcgagaccgttgagacgttgtcagtcatctcgtcggaagaaggagcagcagttgccgaaccatcttcggcggcgagtgtcgccaaagcgactgagaaaggggagaaaaagaagaaatgaaaaaaatgaaaaagagagagggaatgaggaagaagaat

SEQ ID NO: 12866 - DNA, 3281 bp, Heterodera glycines
gagtgctacaacaattcgggcgtgtacgccttcgggttcagcaccgacgccatggacagaaagcgttccaggccgtccttcaccttcaactccttggccaactctttctggaaaaaaaagaataaacggtaagaaactgtttggtaatagttcggatgacatagcaacttgttcaaaaaatgtagttttaaaaacatgtttttgtgagggttttcaggcacgctgaacacgaaactgacaacccatttcgatcaattttgaaccccggacccaacgaattcgaacaaaaagtcaaaagtttaaatttgcactttaatcaattttaggtgtccaatcaatggccatccttattgtcagttttttggccacaactttttttccttacttgaccaaagccatattcttgacaattggttgaaatagatgtaagattcatgattagcgacccagaaatccccgacaaaaagttttcccaataaaaattgcaaaacaaaatggatcccgcctttggcactttttctgcggcccccacagcaaaagtgccgtttctttaatggtcattggttggcattcgtgtggttccagggggccaaaaaatcggaattttgccatctaataactccaaaaaaccgagcctcgcaagtccagaatgccagaatcggagtcccaccgcactaaaaaaacctggagacccgcgaactcgtcgtgcaccgaaagtgccgagtcggccgaagcggcggccgatgtcattccgcctacggcaccgcccgcggtgccatcgccatcatcgttttcgcccatttttaagtcgtcgccagccagcacagaaacagcaccaaaatagcaccaatagtaaaaaaaaaattgctaaaaaagaggaaaatttggacaaattttgatgaaataaacggaaatttaaatgtgcaaaatttgaacaccacccaaagatttgattaattgattaatttttgattattaacatttgtaactttctttaaatacatatgtattagaattttcgtgtgcgttcgaatgataccaaaaatagaaggtttgttcgaacatgaacaaagttattgtataaaaatcaagtattgtcaattaattggactcataaagtgcaatagaaccaattatatttttgaattcccaggacatattaggcttttgtttaataccaaaaaaagtagaaaaaaatttgttaatgtggtgaagtacaaaaattcgtgttttctctgttagcagagaaaaaaaatagtacgccaaaatgagcggtgtatttttctgtgcactctccattttttggttcatctctctgttttgtaacggtttaatgaacatttttgagtttgtgcgaacatcccgaaatcacaatcagtaccaaaaatccaagttccgggctctacattttgtggactttttcttccattttttttttggctatttggtagaaattttagaaaattacccaataatatttttatcttttggaaaattatgtaatttatctgtaccaaattagtcaatggaaaaatgtctttgataaaaatgattttaaaaaagtgacgcgtttacaaaaatggccattttatcagcaaaataaatattttgtacataaatttgtgtcaacgacggtcaattaaaattggaaaaacattttttcttcgtaactaataaatgggctcgggtttaaaaatatatatttttttaaatgtaactggtgtctgtagtttgttatttgaaaaaaattagagaccatttcgggatcgagacaccgtcggaattttctcgggatggatggggctacccgacattgaggtgattggatatttgaggaccacaacattgaaaatgatgtccttgaaatctccggccctcaaatgtccttgggtctctgggggttatcctcaaattatgaatttttttcgtaaaaattcagattttctgacaaaaaaaatgaaaaagcataaaaaattagaaaaaaaaaatttattgagactttcacattttagcagccattttttaattatttttttgccttttcccgagtaataagtgatttaaataaaatggacccctttaatatagccgcactaattaaattttgttttttgaatacaatactatttaagtcgtaaaaaaacactcgtttcctatacaaattgtgcaaatttgctcatcattaagcaaattaatgtcaaatatttaacgatttttaactcttttttttgagcggcatttttttgattggtcacaatggggagagattaaaaagtgagaaagaggagagcactttttgataaggaaaattccttaaattttcaaattaacacgaggggagacatgggagaggggggggggggggggggggaggagggtaattaatagggccatgaattttggtgataaaaatctaaaaaattaggggtataaataatggtttggtgaaattgggcacaattaaaagggcccgggttttggtgtgaaaaatcgcataaattagggggtaaaaatgatgaaagttggcataattaagggcccgggttttggtggaaaaacctaaaaattaggaatataaaattggttggtgaaattgggcccaattaattgggcccagatttttgtgtgaaaaatcccataaattaggggataaaaatggcaaaataatggtgcaaattttcaaaaaaaaaaccccgaacttttcctaaaaaaaataattaaaattagtcttttttgtcacttattgcagttagatttcatcttcttttttttgaataaaaaccaatcgcaaaaaatttatttatttttcatttttatgccactttttcaaaggaaaaaaataaaaagtgatttttgaattcggagactaaatttgaaacccacaaatttttttacaccaatcattttaaaattgccttgaccttaatccgcaacaaatagcgaacaaatttcgcagcagcagcacacacaacagttccctttttaaatatatttgttgatgggaaaaagtgtttcggtgaaaatttttgaaaaaaaaaaattatgacggaaatttttttaattttctccaaaaattggactcgattaagattgatgaggtcaaaaaattttttaaaaagtcccaaataaattgggaccttagctttggaagggataattaaaataaagtttaaaaaagaattggcaaagagttgaggcccaaaatggagtcaaaaatatagaaaaaataaaaattttaattcctgaacaattctcaaattttattttctaggattataaaa

SEQ ID NO: 12867 - DNA, 2721 bp, Heterodera glycines
  misc_feature (50)..(50): n is a, c, g, or t
  misc_feature (53)..(53): n is a, c, g, or t
  misc_feature (55)..(55): n is a, c, g, or t
  misc_feature (60)..(60): n is a, c, g, or t
cataccgccgcaaaaaatcgcggccgatttgttttgcctttaaagggggncanangaggngggaaagaaccaaaaaacattaatcaaaatcggattttttcacagtgtgtaaaaacacacactttcctctcatctcatcagtcagccaaaatgaatttggtgggcaaacggcgcgggggagggcaaacattaaacacaaaatcatatgacgaaggacgaagaaagaaaaagggggaaagatgggcaaacactttcataaccaaccctttttgctctgtgctgataatcgtcgcaacacaccagcaaaagaaagagagaaatgaatgaatgagctgttctcggatgtgtgtctgctctttttatggccaaccgggtgatcagtgatcacttatcactgattagatctattaattctcgccgatattcgacgagaatagaaatgtgtggaagcagcagtagaggatcaaacattctcgtcaaacaaatcaagaatggagagaactgattaacgcctggtgatcatgggatttgagatttatcccccaacaaaaattgctgccgcttggccgccgccactcaataaaaatgaatgggtggagaatgcaccgaaaaaaacaacaaatcgatcattcattcattcattgctaatcaccactaattatccgtggtgccatcaaaacaaagacaaagggagttgcagacgcggtctttgcaccgccgtgaggacaattatcgcgtgttgagaaacgaacgaacgaatgaatgaattatggtggggaaaaaagaattgttttcatagcatggaaaagaaaatcagagagagatgagagaacgagaagcaaagttttaagcattgaaaggagtagccctatgagaaaatgaaatgggattcactcgaaatgtgaaaatggcaacattaaaaaacatccgattatgaaatggttccgtgtgttttagttagtgcgtgccagatttagtcgaattcattccgcgaaattaccgcatttgtttgccctcccctctcgcccacatggattatttattgcccactttggcctcgcgtgagaattgacccccccccctcgcccgcccgtcggcgcgtggtgcggacgcaaaaaggcgtgtgtaatagcataataatagccatccatcctttgtgggttgtaaaagacggggagcgggagaggaggaggcacggcactccccgccggaggggacgacgacgacgatgggggttaatacatatcacttgcgggagatagaatgttgtacatgttttttaacaatgggagctgctaattgtggttggtttccgtgaatatgatggatgattaaagggacggacggggcataaaaagggcggtaaaaaaagggggaatgaatgcaaatttttgaaatgcgcgtaatggcaatgtgaaagcgactgacagaagaaggcagtggaaaagctccaagtttaatgttaagcggaagaaagatagcctcgactcgggccaacctcaaaaatgtgtgtgtgatttgacaaggcaaggggaaaagcggtagaaaggtgcggcttatgtgcccttggggggggggggggagttgttgtgtgttggccccgggggttgcgacgaggtgtccaatttcatgtcggcgttttcttcttgccggatgtcgtctcactgtgtttgccctgctgcagtcggcggataatattacagctaatcccccgtttcagacccaaaagggacagaagagttgaagccgccgctgattgaatttttgtgactaacaagggaacatatcgaactgtatatgtccaaatcactttagaaccacttttatcgtgtagagcatggtcgatttactattgtaaattttcggcttttttggtgcagtcgccaaaaatgatcagaaaaaagtgatcaaagtttcgaaaaatcagtaaaaatgacaaaatttaaaaaaaaaattcctaagattcaaaaataatgataaagtcatctaactttttttaaatgatcagcaaacaattctatatcaaatagcatcataaaacaaattaaaataactgaataaaaatatgctaacttgaataatattttgaaaaaaataatcaacttatcaattttttgctgggtttttcatttgatcacttttttctgatcatttttggtgactgcaccaaaaaagcagaaaatttacaatagcaaatcgactatgctctctacacgataaaagtcgttttatgcattttttgaaaaaaaccgactctgttcgaattcgggtccgggttcggaaatgggcaagtactgtaacacttttttaaatttatttgtttatggtaaattcaaaattagtttcctatacaatttaaatatgtttacatatgatgctacaaatattttaaaagataaattcggagaatttcttaagtcgctaaataacaattggataagctaagccgaacccaaaaaaatgtaaatgtgtatgatttattattctggaaaaaaaaactaaaattaataattaaatgtaaatattattattattattattattattaacacttttttaagttcaacccaaaacctcactcagttcgtgaacatgaaaagtatagttctaataaaatacgaattcaataagctattcattttttcaaaattttaaagttaaataaatagcaatgtttatatatttgttggaataataatctaatttcccagatttgcttaa

SEQ ID NO: 12868 - DNA, 922 bp, Heterodera glycines
  misc_feature (910)..(910): n is a, c, g, or t
gcagttcgatatgttcccttgtaagtcaattggacagaagagtgacttgaaaaggaagtgcttttcagcacggggatgtggcaatttgcgcaaaatgcgaccaaaattgaattggataagagaagggggggggcagacacgtatccagaaaaaaatttcggggagggcacccgaaaagctttttttttattattattcttcgggccaaatattcttttctcgtattatttttcagtgcatggggcgaaaaacaggaatttgtagcgattttgggccaaaaaatgactactttttgccattttggggttaaattttcagtacataatgaatgctacattggggtccggcggtaccgataggcgccgcggtttttttggaattttaatgaaatagagtaagaaaatagcggaaaatttcaaaattttcccatttattcgtgaaaaacttttaatttttcatttcggagggcacgttcccccactggataaggagatatacaataacagaataatatttatgtaaaaagtttgtgattataaaaaaatggttattgtacatttttcggtctttgttggggggtggtgcatcgaagggacggacactcattggccaacgaaggcaaacagaaacgcgtataaatataattaaatcacgcaccactgcacatttatgtgccgctcaacaaactccgctctaagaaatggattatgccatttgggtggggctttttggtttttgacaaatcctaccttatttatgctatgaaataatatgtatttcacttatttattcgttatttgcggggcgtgtgctgtgtttttgccattcccaatcaaaaatacgtcagccgtcactgacaatgggaagaaatgcgggtggatgaatgatgtgggggggggggggggcgaanggggtgaattgt

SEQ ID NO: 12869 - DNA, 4065 bp, Heterodera glycines
  misc_feature (21)..(21): n is a, c, g, or t
tttcctgggggcagtgaacanaatctcaaatgcaatttaatttttgcaggtgaaaggtccgattgcggttggcatcagtttcacaacttatgacatggtcagtgaacggctaaagcggtggaccggccaaaagggcacacattaacagtgagaagaggagcagaagtaattcgagtccatccatttgctacattaaattataccctctcttcctcccattttcgatgttatgcgtgtcagtcaaaacaacaaaaatttgttttttgttcattcgttcatttcttctcacattcttttcgtaatttttggcattcgattttattgtatccaagtaaataattgtgtaaccaaaatgtgtcccttttggattgtgcctttaactttttcctctttcctgtcattttgtgttcagtcagcttttgttcggtgtttttcagaatcgcacaaaagcgaagcaatttagtactgtttgtactcaatgccaccagttgtgcagtcattttggtttctttttcaaggttctattttccattattctttgggtttgcacaaagccttactgtcactttttactgatttatgtaagaacttgtaattaaaataaaaaaggcgttgtgcttctgttttgttattcgattgtattttggggtttacttcaaaatatatggccttccttacaacaaattgccatcaattatttatctgctcgtcacgccatttgctcaatttcgaccaaacgaatcactcgttttgtgatttctcttgattgttatacttcagaggtttcttttgcactaatcgaaatggtacagattttgttcacaaatgttgtatttgtacacaaacagaataaaattatgttaaagttcgaagtctaaaaaaataatcgtttcaatttttgggttgtccttaaacaaaagaattttataaaaaaacacttgaagatggtctttttttaaaaaatgattgatttggcgaaacttgcatatgccttgattttgttaagaggttcgtacatccataagactttgtagtagttcttgggaatgttgccctttatttgtacgcaaattttcacctattatgccgttgcatttcaagttatatattttgagcaatttgtcgtgtcgtttttcaaacaaaattttcttttcagataaaaattgaaatcaaatcgttctttgacatttgaaagctgttcgttaatgacggatcaacagcaaaagccgatgagtcggagtatgactccaaaaacaccttcaggtttatctttaaaatcttgttaataaggatgaaagaagaattaagtagatgtaatatgtgaccatcaattcacattaaatgagtccatttgttaacttttcagtgcaaccgttcaaaaagggcgacatcatttgggtggtctaccgaaaaagcatcaattggccagccaaagttcgtttttgggtgttctttccaaatgaagttcgaaaattgaactttcacaggtcaccgcgtactatcccaaggacaagaaagtgtcctacgtgttcttcccactgaagcagaaaaacgccgtcttcaaaacggacccggcaaaagtgcagcttttcacggtacgatttgctatttttgacatttcgcattaattgtgttttgtttctctcagttggatgaccaaatgccggaaaatgccccgctcgacttggagtacagttttgaacaggcccgtcgcattcttcaaggcgttccggaggaggaaattattgcagaaaatgtgcaaaaagaggaagaagcactctcccaaatgaagccgaagaaaaaaccgctgacgacggcggacgcattgaaaaaagcaaccaccggaacaccaaaagggacgccgcgaagccaacagaaacagccgaagattgtggccacggaaaccaaattcaagcagggcgacccggtcattgtggacactccgatgggcatgtggccgggaatggtttgtaatttgaatggaattccaaattgttttgaattgcgttcggaataagacaaataaagtgccgaagagaggccgtcgccttcgctttggcgttgcgcggcggtgcggagtttcggagccctccccttccccgggagcatcgctctgtccgcctcttcgtaaagaaagtgcccgctttttttggcacggtccgcatattcctgatcgcttggtactgccccgacggggtcatgaccactgggaaaaaccatgcggaacacaccgttttttattcctaaatttctttttcatgattcttttccccatttcagttcatttcctacgtgaaaggcaatccatcgttggtcaactattcactgtttcctcgcgaggaacactcccacgaagtcgtgcaaacgtcgggagaggcaatcatggcatttccacccgagcaaattgagcaagcgattgaggacgggcgcagcagcaactctgaagtgctgttagccgcgctgcaggacgtgcaaaagtacatgaaggagatgggacatgctgcttcaccacatgaagcagttggtaccacttcgtcgatgcaatcaccgaccatggacacgccgccgccactttctgccgaagatgcacaaccgatggacaccagtgaggaattgggcaaggagaagccgaagaagcggctcaaagtggagctgaccccgcccagagaggtgagtgagtcggaagagaaaagtacaacaaatctgccaaaattttgagtgtttgaaaggccggaaattacggcaaaaaaatcattttgcaaatgatttttaattgttttagacaaagcctcatcctcgaatgtcgttgaattcgcgtctcagcaaccacactggcgacgaagttgttgacaatgagagtcattcgccggcggtggcgacgccgccggtgccgaaaagcaaaaagcgaaccgccgcctcgctcaagcagaacgacagcggcaacaacaagtcacttagcacattgattgaggcggccaaaatgatggagggcggctcttcatcggaagagcatcaccaggacggagtcagcatgcccaactcgccggcggggagcagtggtgccgcgccgctggtcaattcctcgcgttgaaaactcaagcagacaccgactcggcaggagaccgtgagtaaatggtgtccagacatttgcgtttcgggcgacccaagccaaatcttacatttttcggcccattcttgcttaaaacccaacgagcaccattttttacatttcaccccattcatggggcggttacatgtcgtttcgctactcattgttagtgaaaatgcgttacttatatggtggataatgtctttatggtgtaaccttttggtttgcaaagtttttgtgataataactcgtgtaaacttgttcccagtgcttttttgttccctgatcacgaatcaggcatcaattttgaccaattcctattccttaatccaaactcagcccaacggtctaaactcggaaaatttgaattttctcgaaattttgttcgagctagggataaattgtcaaaaaaaatttgtcgctttgtaactatcgcatacctgtgcacagggagggtcagggggggtctcttagtcgatcgtaagggttcgagacagtcgatcgtacgaggtgggggggggaagttgggggaggggggagagtgaagggaggaagaggaagaaaagaaaaaggagtgagagaaaaaaagtaagtcacttatttcttaacaaatttcattaaaaaatccaaatttttgcgatagactaataccgatacatcaaattttaaaaattttcccgggatgcaaaattctatataaaaatttgtgaaacaggtcatcaaaaaactataaatttgttgaaaactcggggtgcaattaccaagcggaatgacttaccatttagcgaaaggacgcatttttactgattgcgagaagcgaaacgacttaaaattagtggctaaaaaatcccttgtcgcgtctaactcatatggtctaatgcggttctttcgggacttctcccccacttttaatgcacaaaaaatctaaataaattaatttttttctatatgttaat

SEQ ID NO: 12870 - DNA, 2657 bp, Heterodera glycines
aatgcaaaatttttaaatttttataaaggggaaaaaatgaattttttaattaatgaatttaaacaatgttcgaattaaaatgcttaaaaatttatctaataaaaaaaattcagataaataggcaccattattttattactattgtacaatattatttgtgcatgtcgtggtcgttttgtttttgtgcgaccaaaaataacgcacaaaaaagggggagacaaaacaaagcaaaaaattttggggttggctgaacaaataaaggggaaaaatgccaaaatttacccggaaaatttttttttgtattatgttatgttgaattagttgtataatttttacaacgaaaatggaaatttctcgagcaaatatataaaaaaaatttgaggcttgtactagtactacactatttttaatgtaaattcctctcaaaaaacacataatcttgccaaaaaaatatgccaaaacaaatttaatactttctaattttggagggtgtaagctttcccaaataaattttttgattttttttaattcagaatttttacatattgaattgcagacctttcatgaaaagattgcaaattttgtaaaaaaaaatttttttcattttgctgggtattcaaaaattaaattattaaaaaaggcaaaaacctttctcatgtcaatgatgttgttctccagcaaaccgaacaggccccgcccgttgtccaagtgcatgtccaacatctcgcgagacagctccaacccgctgtcatcgacgctgccgctgttgtggccgaacagttgtgtcattggcagcattgaaaaattataatttaaaatcaaattgtttaattactgaaaacgaagaggtaaattaattaaaattactttaaatttatttacgaaatttttggaaaatttgaaacaatttaaattttttgaaattgttggccaagtcatatgaaaaagtttcggacgaattccgtttttttgattggaaacattttttatacaataaattgaaaaatctaaaaaaaatcaattaaaatttaaggcggatttcatttttttgcctgcataaaatttgagacatggcccgaaatttgagaagtatttgttggccaacaaccatcatcattaatgcatacaatttctaaggctttctttgtgtaaacaaaaattttttagtccgtatttttataagtgtgtgggaggtacgccgctctctccgccgtgtttctcctctcattgctatatatatataatatattgttgctaattttgataatgtttttgaaatgaacaggcatggggaacgtgggacagttttaaaatatgaaaaatggccaaatatggacactaaaaatgaactaaaactgccaaaaaatgcatttaacaaaaaactaaaaaaaaaaatctgattttcgggcaaaatgcggtgccgtcaaagttgaaacttgatcatttcaaacaaaaaaattgttgccgtttcccatgattaacgctttttaaattgcaattttaggcggggaggagggggcatttttctattttaagcacatgggaacagctggcataaacatagtaaacgctaactattttaggtttcgacagaggaacaaaaaacgattttatatttttttctttgtggtaattgacggatatttaaaaaaaatttaacaaaaaaaaaaaaaaaaaaaattcgcaggccaaacgaattatggatgaaggactaaaactatacatatttaacgcttttaaaagcagcatcaaaaaacgtacatatgattttgtactatttattgtacatgtgattggagtccagttgaaataattttgtgtaaataatggaccgaccgactcaacccaaatcaataataaaatgactgaaaatgtggacagtgagggggacggagataaaatggaagtggtgagggaaggggagggggcggggaatgaagagaaaagggcaccaccaaagcgccaacgctaacacttttaaaaaactaaaaaatttgtttttgaatttttcgtatacaggcattaaattccattttcacaaaaaaagataatctgatttctgaaagaaatacgaggctttaaaaaaattcagcaatcacaattccggccccagagaaatgccagaattcaaaaaaaattcagcaatcgaattccgaaccaaaaatctcggaattcgggtttttaattacctctctggcatgtgtgagcatgaaccctaatcaatagataactgcgctgcaaaaaattggacaccgagacgtgtggggcggaaacgcataaaaatgaaaatgaagcagcaccacccacggcatgtaataaaattgaggggggggggggggtgcgaggggaatgtgtatgtgtggtgggtaagcgggacgatgaatgatgggcgcggcgcggaatgccatacgacgaacggacagcggcggaaggctaaatgaatgtgaaaggcgtcgccggtgtgggggggggggggcttacattaaagaatgaatgaataagcaaccaactgctgacggacggacggtgtaattaaacatgcacataataattcattactatgtacctgtatattctctaattatcgccccgtcaccattaatccctctgtctccaattatccccccctttctgaagaggttgaacaataatccccc

SEQ ID NO: 12871 - DNA, 1341 bp, Heterodera glycines
caccatgataatgctacactctgtggaagaatataaaggagtgagcgcagtttatggccacataaattcaacccgacaaaatcgcctccaaaattgcttttcagtcgaaatccgatggatttttttttggatcaaattgaaattaatttttgtcgtttgcatttctgtgttcgcaaagtgtcaaagcatttaccattgtgtcgattaatttttgtttttaagttcttcgtcttttggtatgccttcgcttctacatacaatatctacttctggtgtgtctctgctgcggtctcaaccaatttgctgctctattggacgagcttctggacttgcgtcaacttccaagcggaccacacaaatgtgccgttggtcactttggtgtgtttgtttttggcatttgattttgcacattttccaacttttaggtgatcagcatcgtcatggtgtgttcgtccgtctccgagattttcttcatatattcgctgcaccagaagaagaagaacggaagtgctgtcatcatgtgaacaataagcacagagacgaatggaacgatgctggtgccaacaaaacataaccaatgcgatgaaaggacgatgttatgaataaaaatatacatatgatatatcagataacctatttcttcataaactgttgtattccattgtatattctattatatcagtagatatatatgtatgcatcgttgtataaactcactcagaaatctgctgactaatttgttttggagagatcacagcattttatccatatgttgcttattggagaaatcttcacaaaaaaattccggtgtccaatttaccggtccccctattttgcatatttacggatttttgtgcttaatgcctaggcgcctatttttgtgccggtgccctgacatttgcgatccgactgataacaaaaaataaaggattcatgatcagcgtcaaaaattagatttaaaaattagtaaaagaaatttaaggggggggggagtgacaaaacccagaagtagcgaataaagttcggcgtaaatttgaagagaaaaaagggtaatagtacggatggtacccccccccccccctttttcgaaaaacgaaatttttgaaatttttcatcgagaaaagattatattaggggttttaagggtcagagaatccgaatctgacattaattttgacctatgtcgaaccctgaacccgaattcgagcaaaaagtcgaaaaatcaaattatcgaattttttatttttggtctaaaaatggcttacatattgagaaacaaactaaaattggtcaattcactaataaaaaatcatttcaaccatttttagaccaaaaataaaa

SEQ ID NO: 12872 - DNA, 907 bp, Heterodera glycines
taaatatggttctacaatcacaatacaaaataggtaatgaagtcagacattatataattccagtcataatagcaaattaatcttccgcttcggcctttttcttcgcctccaattgcttcaaatcctccttgttcttcgtgagcatttcattggccaattctgcgaagcatttcttctggtcctgaattaaacaattaataatttgtgaagactaaagcaaaaaaaaatctctcattcaatgagaaaccgaacaatacccactgttttctgctctttttttacctcgatctgctgaaagtggtcgcagagtttcgtgactttctccagcaccgccgacaacaattcgttgtattgtgtgtccaaacgatttttgtagtccaaatactgttattaaaattcgaaacatttaatagtctatcactgcgaatgcattttacatttttgtgcttctcggccaattcgtcatggagtttgcccaatctcaggtcaattttgcccagttcgtcgacggtggcctggtgtttctgtctgatcacgtccaaactgtgcttcgcgtcgaccaatgaacgctgattgtccccaaacttgcgcttggcccgctccagttcaagcttgtgctttgacagaagctaaaccaaaagtcaaatatattaagggatttcgtcgcccgaaatttgcggactccaaatcgaattaaaaactaagtttttttcaatccccgatcgcctaaacagcattatatatgtgaagaaagtgattgtgtctaataatttgatagtcagtaaatttttgaaaaaatcatcaattattcaaacaataaatagaattaattatcctaataaactagaagattgtgttttcttaattttaataccgcttaggccatacatgcaaaaaaagggggggg

SEQ ID NO: 12873 - DNA, 1784 bp, Heterodera glycines
  misc_feature (111)..(111): n is a, c, g, or t
  misc_feature (123)..(123): n is a, c, g, or t
  misc_feature (216)..(217): n is a, c, g, or t
tttttgagaaaaccgcgccgcaaaaaaaaaagatttaaaaagcaaaaaaaaaaggtcgtcaaattgcatggctggaccatttcgcaaaattggccgctgaccccccccccnccgcccctcgancccccctccagaccatttcgcaaaaaatttggtcgaccccacccctcctttttcatgtatggcttaggctatcagggttgaaaaattcaactnngaatccaattttggacataggcgtaaatggcgtggctccacggatttatatgtgtttcgatttcattttgactggcctgttctttgctgaactccaactcgttgatttcgttcaccaatttgctgttggtcactcgcattgattcctctgcttgttgcacagcacggatttggcattccatcatcgctttcagttggttgagcaaacgtgtcaatttgttgtcgtcacggcatcgctgaaactcgacaattgcctgttcgacgctgcactgttccaattcggccaggtgctgctgcagttcgtcctcactgaacaacggctcgcagatgacgcgaagacggctcatgaacgcgttgtagtcggaacgaatctgaatgatgtgtgtttaaaaattcttattgaattttttcatcatgtttcaagaaaaaaaattttcagcgactttttcaaaatttatgatgaagttctaattgtaattttttcaaaaaattttcttgtgaaaaaacttactaattgtaagaattttctttgaaaattttctatgtttatgaatttttataatttttcggggagggagaaacgacgcgggggaatgaagtgcaaccaccaaaagtaccttggcggactgcttgaaaatgatgggctgacgttcgtaaatgcgtgcctctgttttgttgaggttttcgtgcagcaacaccaactcttcgcgaacctaaaactcgaaaagtgaattttgtacattttgaaaaaacatttgaccgatttacgcttcgcgaccaatgcacgcgcttgttccccgctaattcgctacgtgctgatcagacgctccctctcccggttttcgttggccaaattctcccgtgccatcaccagttccttgttcgccaatgtgattcattatgtaattagagggatttggtcaaattttatcaagtattcccctcgaaactgaccaatgtgcgttccttggccgacgcaaccatttggatctcctcaatgtatcggtccatgctggcaatgtcattctcgcagtccgcggcttccttttcaagctgttcagaaacgcactgcgcctgtaaatgagatttcaagtgccgaattttatcatgtccccaacgcgcctacctcggcaatggcggcctcgagtttgtgaattttctgctcctgggccacacgccgtgccaccaattcgtcatacgagttgcagtcgatgctcttctccgccattttctgcacacgatattcctcgaatgcctccttgaatgtgtcttcccggtcgtacggttggccatggcctttggacgcaaactttttgaagcacgaaatcagcagactccattgaggatcatcacgaattttgtccaaattttggtacatttcgttctccatctttcaaaaataaaaacttaattttgttggcattttgccaaaaaacctcaatgatatcgatgaaccaatccaacgagccgagcaacagaccccacgaagttggcaaagtaatcgtttgcattgtgctctgcttcagcacataaggatagcccaattggttgagaaattaaaggcctaa

SEQ ID NO: 12874 - DNA, 1535 bp, Heterodera glycines
agtggcagatgcattatcgagagttgcaattaaatgggaacaaatagaaggaaaaagcagagaggacattccctttttattgaccgttgatgaagaaataggtttacatcgaaaaactatagaaaaagagacatttgaagatagtatactgtcccgagtactgtcacagataaaggcaagctgggtggaaccgatcgatgatgatgagttgatgccgtactttagagagagagataaattgtacctcgatgggaaaataattcggaaaaagttggggagacaaataataattccacagaaaatgagaaaaagggttttaaaaatgattcatcgggcacattttggcattgtgagatgcaaagcccgagccagagacttagtgtggtggcctaattggtctgaggaagttgaaaattatgtgaaagagtgtcacatttgtcaacgaaatgcgtcaaatgaaccgcgtgtggaccccgaatataaatggcctgaggccaaatatccattcgaacgggtccacgcagacctcgcgggtccaatttgggggacgaattttcttataattgttgacgcatattctaagtatccatttgtgtgccaaatgaactcaactcattcatctgccatcgtaaattatttacgagaagtattcgcattttttggatcaccacaatgtttggtaactgacaacggcccccaatttgtctcaagtgagacggagcaatttttggaaaatgagggtgtgcggcacttaaaaaccccaatatatcatccttcatccaatgggcaagcggaacgttttgtccgcacattcaaagaaataatggggaaattattggaggaagggatgagccttaaagttgcacaatttgtatttctccaggagtacagagtaactccgtgctcagcaacggagggggaaagcccagcccttagatttttgggcagaggaattcgaacggcacttgacaaaataaaaatgccgccaaatttgccggaggcaaatggtaacggaccctctggtgaggtgaccgaattggaggggccgtcgcgcgcacaaataaaggataaaaatttggatccaggggataatgtttgggtcaaagagcccagtggaaaatgggcaccaggcgttcttttacagcctaaaggagagagaatgtgggaagtaatgttggagggtaatactgtaacgagaaccgcccatttggaccagttaaaaagcaggagaattggacagtcacggcacatttgagaaaatcatcagctaaacacacactcaaatttgtacattatccccataactcctattaaaaaaataataataataattaaaaaaaaaaaaaatttgctttaactttaattcctcgttttgcaattgaatttcgcccagtcgatttagaactgcctttgaaatgaattttgaaaataatgatgcagagaatgtccaccccaatgagttggaaaaatggaaaaagcgctgaaggatggcataaaaaagtcgcgcagccacgagggcgagctaaaaaaggagt

SEQ ID NO: 12875 - DNA, 1652 bp, Heterodera glycines
attaaaaaaaaaataataataataataaataattgtggtgaaaattaatatggaaatgggcaggaacgtgttatggctgcgttggtgcaatcggtcgatgagttcatggcgggcattccagtggaggaaaaggaagagaaggagcagcatttgaagagcccaactccggagccgaagagtccaccgcccgagcaaaacccatccgagaatggagagtcggaagagactttgcgctcagaagagagtgccaaccagccagggccatgtcatggtgcgcctccgatgcggggcaggggtcaaggaggccctgggcgaagaggccctacgatgggaccaggccaaaagcaaaagcgcgtcaattatttggtgcggcaattgggaaaagaattccacaatgggccaaggagctgccaatgttggtcctgtcggcgtggaaagaactgggatggtcgcgggggacgaggaggtggcggcggttcgggccgcggttacgctggaggacgcggaggatacggatgcgctggtggacacgaggcacatggacatgaacgcggtgcacatggacatggacgcggagcacatggacattggcgcggagcgcgggggacataccatcacggaggacaaggccatcacggaacgtgaggccgaaaggggactggggacagttcatggaggaggggagggatgttggatctgcatttttggcttaattcattttttccattatttatttgtttctctttttttcttcgtttctttgacatttcctatgttgtaatttccctggcccttctgctcctcactcactcataaaagtgaccccttcgtccaatccatcggaaaatattcttccaaacaattttgtgtaattccatctgtttggcccctcccatttgtcattggtatttaagtctttgcttattctcttatcctcaggattttactcacccattcgttgactcaggttccctgcctaaagcgatacaactcacttaacaattggctttgttttcttactatttaaaaagcgatcattctttatttaactttgcatttccacttttgatttccattttaataaattgtcttaaaagaagccttgctgaaaagtaaccgggaaaagtccagagtttgggtacggacacaacatcaataaatataattttttttattaatttaaactaattatttgaactggacgccaagagaatattaattattaaatcaaatatttttaatttaattattatctcattttttcatttgctttatgaacaattttatatattatttattagaaatactataaacataaaaaaattccaagaataaatgaatttaaaaaaacaaaatatttttttcctcagcagaataaaaactaaaaattcttcaattgttatattattttaaaaaataaaatagataaaggcgaaatttgtcagttcctactggaatttagcaatgcaataccattaaaactttagctatttagaaataatttttgtttttattattaattaaaacatattaagaatttcgtcataaataatgctgaaatgcatttttgaaaaaaataagttaaaaataaacccaaagtaataaactttttttatttaaatttagttgggatttataatctatgcatctcc

SEQ ID NO: 12876 - DNA, 1369 bp, Heterodera glycines
  misc_feature (1347)..(1347): n is a, c, g, or t
  misc_feature (1357)..(1357): n is a, c, g, or t
aacaataaataaaaaagccataatataataagataaactaaacaaaaatataaaatcagcgaaaaatatttgaagaataaatcaaattatttatatactaaatgtttcatcaaaaactttatttaatattattcaaaactaattaaaacaagtaattatttatagaaggtaaataataaattctttataaaatagataaaaaagggtataatatgaaaatattattaaaaactattatattataccttaaaaataattttttgcaattataagcgcattttctcaaaagaatggtgaggaaaaggagccaccactccgacacgacaacttcaagtgaggaatagcaaatagatttataaatctaaaaagtgttaggcaagggcgtagccatccccttggctttgggggtctttcttttttaagtcggtttttaggggtgtatttttggtttttttgaaatcccgaattatggggtgtattttacaaaatttttcgccattttggcctccatttttcaaaaatatgctaaaatggaggtccggcggtgccgataggcgccgccgggaaaatttttgagtattttaatgctattttaatggcataataaatatataaacaaatgtattaacttattatttatgaaaaatatattgtaacaaaattataaataagcaaaatttaataaattttttaatatttaattaaatagattatgtagtaacaaaattaatcattcaaatttttatattaatattattaagtattttgcttaattccgaacaatagttgaaaattaatcaacagcgaacaaaaagaacactaaaatgaatagattaatcaaaaggataatcgaaccattaatatgttaaaataaataattcaaataatgcatattttaagactttaacttgaaaagtagttgaagagatgtaggtgcgcattgatgcatgttaaataatatttaataaaaaagttaaaatcaaaaagaaaattttaaatagtattataaatttaaaacgaaatagtaattgcaaaatagccataaatttaatattgagttaaacccaacaataaattaaaaaaagcataaaataataagataaacaaaaaacaaagaaataaaatcagcgaaaaatatttgaagaataaataagcgattttttagtcagaaaaaaataataaacacaaaatgaaccaaaaactttattaaatatcataattaaacttataattaataaataattctttataataatatatcaatatccgctataatataaaaatgttagaaaaatactattacattatcaaagggtaataaatttttgcaaacacattattaattanaatatctcanaaatgaattatt

SEQ ID NO: 12877 - DNA, 5480 bp, Heterodera glycines
caaactttgataccaattctgcgcaacaggtgcgccgtaatagtgctgaagaagctgaaatgacggttgtcaagcactgaaaagtattacatgatggcatcctaccggttggggttgcggagcaaacggaaaaacgaattcggcactttcctcggcattcttgggatgttcggaggacaagtcctggaacaaagatgacttttaaaaaggttgcaacaaaaaatacctgaaatttgttgctgggggcaccggcaagcgttggaaagtcgcggtcgcttttctgctgctctcgagaagtctgctggctttgggacaagctttgcaggttcaactccggctgaacagagggcggaggttgcggctctgaaggaatgttggtgtacaaaatgatcgacaaaatatctgttcctaaatgccacccaaattggtacttttccgttttgggcctacacatcaaaattttaaaaaagtttcacattcaaaatttatgcgcaagatcgaaagtgtcctttatcgctaatttaatttatgctatgttatggtatacaattgtcgcctaagtgcgccctttgttgacattttataaaatttgaggtgtaggcccaaaacggaaaaataacataaatttttaaaacgttatcattatgaaaccgatgaaaacttgtttgtcatatactctatttattcatttgaggacatctacgaatatagtattatttgatcttcatctattcatttttgtacctcgagctgcagtgtaagtggcctatgcccttctgtggtagtttttatttgacattaaataaataaataaaagggtattacaaaaacatacaatttattacaataatataccacctcacgtttggcgatgccacaaagtgtcaccgcaaattttaaaaactttaattggaatatagtataaacatttggtaagattttccaattaagcggaggaaagatccaacttaacttaacaagaagtttttaggagtagaggtgattttcagactataaaaaggtgcttatgggactggttttcatttttaccagctttgttaatcaaaaatagaacaaaaatagttttaacgcgaaattattcagtttaaatcaaagatattattatgttctccaccgttctgattgtgatatcgacacgttcctataatcttacatgtgcaaggggtgtctcagcccaagggccatacggcaaacaattgggacaaggagggaggggggggggggtgtctcgggaccgattttcatacgaaggtccaaattttttctccggcgtcgacctttttttctgctctaacaacctttttttgcggcgcgttttttccaaaaaaaattttggggaaggggggtggcgggcggtccggcggtgccgacaagcgccgccggaaaaaattcatttttttcgctatgtaaaatttgtcaaaaatcaaactttggttggaattctgcgcaacaggtgcgccgtaatagcgctgaagaagctgaaatgacggttgtcaagcactgaaaagtattacatgatggcatcctaccggttggggttgcggagcaaacggaaaaacgaattcggcactttcctcggcattcttgggatgttcggaggacaagtcctggaacaaagatgactttttaaaaggttgcaacaaaaaatacctgaaatttgttgctgggggcaccggcaagcgttggaaagtcgcggtcgcttttctgctgctctcgagaagtctgctggctttgggacaagctttgcaggttcaactccggctgaacagagggcggaggttgcggctctgaatgggcattggtttaaaaataatttggcaaaaataatatacgttttgtcgtcgtgcgacgtttcgccttcgccccgtttcgttgcgaattgttcccatgttcagtaccaccacttctgctgttagagccacgcattgagtcgcggtcgcctttccgttgttcacgagacaggttcaactccggctgattgtgagcagagggcggagattgcggctcttaaaagacataagttaaaaagtatttttaactagtttttttttttttgattatacatcgtattgtatccatatattgtacagcaatctttgggtttgtcacttacaccctttcaaaattctccaatcaaatgtaattaaaaatcaatcagaaattcttgttaagttttccctgatgcataattgtgatattattattttcaaaatgaaaattttattgttatctattactttatgatgtcaaacccacgctgcatttgagtatcattcttgttggtagttccaataattttttaagtgcctacgttttgtcgtcgtgcgacgtttcgccttcgccccgtttcgttgcgaattgttctcatgttcagtaccacaacttctgctgttagagccacgcattgagtcgcggtcgcttttctgctgctctcgagaattctgctggctttgggacaagctttgaaggttcaactccggctgagcagagggcggagattgcggctctaaaaatacaaaaaaaaaacaatctttttttcggtgtttgcgtttttgggctgtaacataattattgcaatattttttttattagtaacccaaagtctttataaaaagggtgaattgaatgtgtatgcctacgttttgtcgtcgtgcgacgtttcgtcttcgccccgtttctttccgtgttgtttccatgctcagtgtcgacacttctgctactactgccaaccattgatttgacacctctcattcgctgtgtgtttttcttcttctccgttgagtcagtgaaacttttcgactttttttgctggtccaacaaacagttgtagtcttcggcgtggaattcgccaatgtttgagaaactgtcgcccgtttcgtttgagttgcatgcgaatggtttctagacaaagaaacatcttggctacaaaggtttttcaaaatgaaatgagcacctcgtcgtgtttttcttggaccgcggaagacgaattgggtttgcccccactgcggacaaaagtgcgctcacgctcccctttggcatgagtggatcgaccacgtttattacgggaattgacaaattcgcgaggaattgaacctgcgaagtaaatgccattgcaaagaatgtaaaaggtaatggaaaatcacccttttccttggcatctgatgtgcttgttggccttgtaccaaattggtctttgtttcttctattgaacaacgagcgttccgaaggctttcgaaatggcaatgggtcgtcccaatgcgattccaattcgccgcagatcgatgggggattccaatgatcggcatttccgaagcttgtaactaattgaaagtgcaaatggatgacattagataggcaaaaaataaaaggtagaaccgtttgaggcggcgttggtgctgggcggacgggccgagtgctttttctccggctgttccctgtccgtggaaactcttgcgccccgttgcaaaacattgtatttctgagccgaactttggttggaattctgcgcaacaggtgcgccgtaatagcgctgaagaagctgaaatgacggttgtcaagcactgaaaagtattacatgatggcatcctaccggttggggttgcggagcaaacggaaaaacgaattcggcactttcctcggcattcttgggatgttcggaggacaagtcctggaacaaagatgacttttaaaaaggttgcaacaaaaaatacctgaaatttgttgctgggggcaccggcaagcgttggaaagtcgcggtcgcttttctgctgctctcgagaagtctgctggctttgggacaagctttgcaggttcaactccggctgaacagagggcggaggttgcggctctgaatgggcattggtgtacaaaatgatcgacaaaatatggttagccagtgccaacttttcgaaaatttcttaaaattcgttaactcacgctagggccataatttcttcaaaaatgatcaatgaaaatttatgtgtaaaaaataatttttataaaataaatttaattatttattgcacaataaattggctacatggtttcagcgttgggggccggggaggaaatgatcaaacacaaattgagaatgaaaacaataaataataagggcaagctcaatttgggttgccctggctgatcttcgattagaaattgggaactaatttgccgttactcaggatttctgggtttttcgtacaaataaacattcattttgggtgggaaataggtaaatcaacaaaataatggatagttggagaaagatggccattcgaaaagacgcgcggattttttcaacaaatttgaatatgctctcccccaccgctgcaaaataaaatgactattttttattttgctgttcaagcaataaatctttttctcctgaattgtttttcaaaaatttcagcgacgctgaattactcatttttgccttttcagaagcatgacggtggtgccgataggcgccacctggcaaattttttttaatgcaacgacctagtattgaaattccataatagccaaagacaaactttggttggaattctgcgcaacaggtgcgccgtaatagcgctgaagaagctgaaatgacggttgtcaagcactgaaaagtattacatgggcatcctaccggttggggttgcggagcaaacggaaaaacgaattcggcactttcctcggcattcttgggatgttcggaggacaagtcctggaacaaagatgacttttaaaaaggttgcaacaaaaaatacctgaaatttgttgctgggggcaccggcaagcgttggaaagtcgcggtcgcttttctgctgctctcgagaagtctgctggctttgggacaagctttgcaggttcaactccggctgaacagagggcggaggttgcggctctgaatgggcattggtgtattgcttttccccttgacaactttatcatttaaataaataataacgaagcatatttgtaatattttctttttgattaattttaagagaagggcccgttgtaaaaaggaaggagtaccttcgtaattgtctccgacaataattaagaacaaaatataacaaaaaaaacaaaatcaaaaaacaaatcttttggcttattttttggttggggattatctcaatttgtcccactttttcgaataaatattcattgctaatccgtgggctctgcccaccatttcccctttttctattaatccccacaggcattttggtgaattgcactgatttagtcgggaattggcttggcgttcttggccctgttcatcgttctgccccccacggcccgatcgtgcccaactctcgccgttgtcccatctgttgtccgttgctcatccggacactgtcgcccacccaccgcttggcccaccaatcagcattgttcgcctaccaccaatcacccggacacggtggacccgcccatcccgtttggccgaataaaaagaaagaaggatg

SEQ ID NO: 12878 - DNA, 3319 bp, Heterodera glycines
  misc_feature (25)..(26): n is a, c, g, or t
cttcaggtgccctccccgaaatttnnttttctggatacgctcacacaggtacatgttcatgcacagactagtaatttttattttgtcatagtttttaaatattttattttctttgttatattttattttttataaatatgttgattaatcccgttctgattctcagtcctgaatccgcttttttaaataattctggctcaaaaattctcgattacacgatttaattatattttattattcatagaaatttaatattttctctttgattccgcaaaaaattacctaattttaaatcaatgtaggccagaaattgctcatcgttgtatgtggctggcagtgaatgggaggtatggcttgtaaaaccatcagatttgattacgatctaaagatcattatttttgatatcatttaaattactcttacattcttgaaaaaaaatccattttcattttgggcgttggacagaatgtgtccgatttcgtggttacaaattctttccaacttaatatttttgaatgaatgcaattatttaaggctataaatgtaaaaaatacagtgaaaagtgaaagataaggcaactcgggacgggacatctgggaaaactataggtttttgatcagagtgccaactgagtttcgaatcaaaaaatgtctgctttgaggacccaaagttggtgttgactaaaagttaaaaaaattccagcctctgtctctaccccctagcatgggggcttctttttggcatatgcgggacatttgagtcccaggcacataatttgaggggggggggggaaggttcggatccggacggagtagcttatttttctattacttttgaattctttcacatgtttttaattaattaaaaatattttttattttcttaataataaataaatttttaaattcaaatcagatttttctgatgaataaggttttatttaaaataaattaattttttttatttaattttaatgtattatattaattagaatttacaaaccattaatttcatttcgatttcaataaatataaataattatatgcttcaaattatttttaataaataaaagaattaattttttttataatttattaaaattattgttcttttcgagattattaattctttatgcacaatggtatctagttagcgttctccaaaagagtgtatagctttatcaaagtccagggccaactgttacggacccactaattactcatacacttacaagctcgtcggtaagcgttagatcttggtccgcggaaaagtgactcttctcaaaggccttcacctgaattgctatttaatttattttgaataaaatgtcacatgaaaaacagcagcaccttacaaaatactggttacatattttccaacggtttcatatttaatatgaaataaaaatttattcaaactgaccgaaggcatcgaaggtctgccctgaatctcaaagctttgatcaaataagtaaggtccggtttcaaccatctgtttcaatgacttgaagagggattcggactcttaaaaaatattggaagggaaggtattcttatttgcaaagaaatctttatcaaaaacagcaaaaaagcttcatctaaggccaagggttaggggccaatacgagttaaattttaaaaaattcaaaccttttcttaaatttcctaaaaatttaagaaaatactacatcaaacattgaaaattttaaaattgatcttttaaaaaccattttggcaatttttagaaaaaaatttgaaattttatttgaataaaaaatatatacagaatgttatgaaagattggacaaacccaaacgccttccattgagcatgcaaatgatttggccagtcaccaaattgacaccggcatcatgaaatgcgtagttgccgccataaccagaaagccattcgccataagggtgaaatcaatccattgcgatctgggaaatttggagccctatttttctttaatttttggttttaaaccgagacgaacccattgtatcacttgagtcaatgcgagtggatccaagcgcctcttttattttaaatttataatcattctttcttttaatgataaaatgacagttttatcccatttctttctgatataacattttctactgtgggtcgttggtaaatagatcatctaacgtaaaaccaactgttcattatcagttccaaagcgcccggcggctgttcataagtggctgctgtaaaaattataaaaattaacatatcggattctatgaaacaaatttaatatgatttaattttaactctagaaatctaatccaaaaattagaagcccaccgtcatatcggttacagaagtcgacaagggagcaaaacagatacattattgccttttccactccttggcacaaagcaaacttaatattaaatgatttatactgggatataatatagaaatatatttaaagtaatttttatgttttttgcaacattatttatgttttttataggaaattttaatggtagaaacctcttcatattaccacagtagctccagtcgtcgttgaatatctattatttatttttagatattagagtttaaatttaattacttgaaacatatcattttcctcatcctttcctttcgtaatgtcgatcccttcaaggaagctaaaaagaatttaatattacatttactgatagatatttacaacgctattacttacataggtgtacgcggcagtcatatacgcttcgcgatcacttcttcctcctttttttccccgtagtgggccatttcatttgcgatgcccccttaattttctacattatatattgcttccctgggtataagtacatcaggaccgtatctaggggggggggcacgtgccccccgaaatgaaaaatcaaaaattttttcaagcaagaatagccaaattttctgaaatgtttgcaccttcgaagagcaaaaaaaaagctcttcaggtgccctccacgaaatttttttctggatacgggcctgaagtacatgttcatgcacagcctagtaatttttattttgtcataattttaaatatttgattttctttgttatattttattttttataaaaatgttgattaatcccgttctgattcgcagtcctgaatccgctttttaaaaaaattcttgctcaaaaattctcgattacatgatttaattatattttattattaatagaaaattattattttcctttttctctttgattccgcgaaaaatgcctaattttaaatcaatatagaccagaaattactcatcattgtaaaggctggcagtgaatgggaggtacggctcgaaaaacca

SEQ ID NO: 12879 - DNA, 1676 bp, Heterodera glycines
  misc_feature (17)..(17): n is a, c, g, or t
  misc_feature (1570)..(1570): n is a, c, g, or t
  misc_feature (1597)..(1597): n is a, c, g, or t
  misc_feature (1642)..(1642): n is a, c, g, or t
taactgaatttttatanttttttaacaaatatttaataattggcttcgttaaaatcacttgttaagcaatattaaaaatttctttatataatttaggaatctatttacgtgcaaattcctcgccacaattttatgcggcgccctgcaatgtcctattcttattcagaaaaatttggctgttcatcagtaaaaacacttagataacatttttttaagtataaattaagaaccagattcctccggtccctgagcagatggcggcagtcagtgagcacaatgtaaaaaaatgtatttttaaaaagcaattaaattgctaattgccaattttttatggaagattaaataataataaacaattttttcagctcattggacaaatggaggcggctgccaatccgcataacgtaaaaattaaacaatcttttaataatttaattaaaaaatacattttcaaaaatcatcttaacagcaaaatgaatcggtggcggcagccaaccagcagccaaacgtaaaaataacaaaaaaatattctattaatttaaatgatttttattatagaatttaattaattttaaaatttttcaatcattttaaattgtattataatggatttattaaaataatattaatttattttttaggtccttgaagaatcggtggcggcagacaatcagcataacgtaaaaatatttataacaatgttttaaataattaagaattgttaataatttacattttctggttttgtaaatgaatttttattaggaaatgaataaatcggtggcggcagccgatcagcaggaagtaattaaattaaacaatatgacaaagaccgaattttttttcttttttgccttaacttgtgtcccatacaaaattgtaaaatatttgacctcataaatttaacaaaaatacaaattatttttattgtatttcaaactttctatatttgataaaaaatcaaaaaagtttaatcatctgtagtatcttcacaattataaatttggcaaaaatgtgatgtaaatcactataaaacaaaaaaatcgggtcagttcaaaaattttaaaaatttctacggattttcaaatcttgaataattcttgaaaatgtgttaaattttgatccttgatataatgaaattttttcctcggcggcgcttattgtttattgtttattcataaaaaataaaaaagtcatcagaagggcgagaaccacttactctgacgactaaattcatttttctgttcatgtgccgtcaatgcaagtgccatttgaattgcttaacgaatggacaaaggaaaagctgacattgaccaaagcaaatgaattggacaaccgatggataatgaagcgttgtaaaattattggggagaaagaggagaagcagcagaacactgtgttcatttggcttgttgctggcactaattgcattgggtgagcaattaaaaaaagcatttgatttttatccgaatttgaattttgcgcttaatttaggccattgtctccgccaccggaaaaagtggaagaacaaacgggacaaagcatcacaaaagggacgtcttctgctgancaatgagtgacggacaaacgaaacaanatcatgaacagacgcagaagaaatgaatattaattgaaatgaccngacgatcataattcatcagtgatcaagtgcattt

SEQ ID NO: 12880 - DNA, 2983 bp, Heterodera glycines
ttcatgactataaaatgtttgttttttcgcttttcctctcagtttgaaaaaaataaattttctaacgcaataattctgcaattattcttccctctgtgacgacgacatcattcggagctcggccaaattgtgctattgccacaaaaatgaacaaacggtaaaagaattttaaaagtcacacaaattcatcatttatttaactaaactgttttccataatttcagttggatttgcaacgacgtttggatggacattttcccatcgtttgaccatgcccaactcggcctcaaattggcacttctttcgccacgtttcaatgcgttggtggacaaacatttcaacggcaaaagcgaatcgttttctgctgacaaaatgagtgatggacaaaacaacaaaaacagtgatcaaccgcagaagaaatgtattaattaagaatgaccgaccgatcataatcatcagtgatcaagtgcattttatgaagaacaacctctcaatttcggtaaataaatcggacgcataaaaatggcaaaaaatgtacgaaaacaacaacttagatttgcacaaaataatgaacaacaaaaaaaaacaacttgtttttcgtgcgtttcattccactgggagctcaggaaaaaaatagggcaaaaacctaaaaatataagccctattttcaatacgattgtttgaaatttgccgaaattccctgagaaattcaatgattttgaaaaaatcattgaatgggatttgcggaactcaggctatatgctccggctataaattttacaaagagtttaacaacccacgcataacacaaaaatttttgctatctatcgaatgtatgaatttctccttgaaaagttatgacttgggctgggaattatatggaaatccatattttttttcctgtacagtgggatgcctgaaacggacgacacccaactcgtactgctccaactcgtactgctccaactcgtactgctccaactcgtactgctccaactcgtactgctccaactcgtactgctccaactcgtactgctccaactcgtactgctccaactcgtactgctccaactcgtactgctcaactcgtactgctccaactcgtactgctccaactcatactgctccaactcgtactgctccaactcgtactgctccaactcgtactgtttttcgacaaaaaaaaatgtcataacttttgttaaggtcgaccaaattaaaaacattcttggtatcattcaatagcctttaaaattctctataaaatgagtattagctgcgttttgtttttttcctctaaaataatttttaacaccatatttagccaacttttgaaaacaaaaaaaaaaaagattttttcgaaaaaaggaggcgagacaaagcgaaaaaaacaaatattcaaatttttggaccataactctttttttttctcaaccaaattaaacatattttgtgaaatactctattactaagccaaaatcggacgtattaagttgctggcttattgtgacttcttaatattaattcatttcttctgcggctgatcactgtttttgttgttctcaacccaacagcattccaatcactggcactcaattctcctgcattctaatcactgggactcaacccaccagcattccaatcactggcactcaattctcctgcattctaatcactgggactcaaccaccagcatttcaatcactgggactcaattttacatttcagaataaaagaagccaatctataggttttcggggtcgctgatcgcgaatccggcatcgatttcggccaatcccaaatcccggaccctaattcgaacaagaagtcgtaaaagtaaatttttttatttttcatttttagtctaaaaatggtttaaatgatttttaattgaagcactgatgactttcaattagtttccgtgtatttaaacaattttgaccaaaataatatgaaaacaaaaattttaatttaaacggcgcgctccgcggcgcaccgacggccgttggcactgccgtcggatgggcagcagccgcaacgacgataaaagagtcaaattttcaaaaatgataaaataggggttctgcggtgccgttaggtgcctgccgagaaaatttttatttctaaattttaatccatttgctaagaatattgcttaatttttcacaaaatgtgtccatttgtaaaattttccatttccaggtttccgtcatatcagtacgccaaaattgtataaaaacccaattcatttttggccaattcgttttttgaaatgacaaaatatttttgatttttctaaattttaggaaaatttggatcctggccgatttttggtctcataattataatatttagaccgttgttttttatcgccccttattagctgatcagattttccaagcccttgtgccacggttggttgccattgtgcacgatttcaccgccagttttcgctggtcgaaattggcaatttccatcccatcaaaagctttgtgcctccgctaccccacgacattttgctgtatttttacatttcgtccgtcaaaagtgtgtgtgccgcaaatcaggtggcattgtcgccggcggggacggcatcaaacggcgcgcgccgcggcgcaccgacggccgttggcactgccgccggcggatgggctgcaacgacattgacacagcagccaaacagtaacggtggtttggcgtcaagttaggtgtggtaaatggtgggttttcgaaatttcactcatccctcggtttgtgtttttctacctttctctactggcacgcccgtagcttaaaaaatgacaactggaggaggactagtggcaaaaacaatgtccgtaaaaagcgtcaatgattgtttcaatgaattatcaataatgttgatcatttgtttatcttttttcacatttttttctatccccgattttgatcgttttcaaaaaatccgactacccaagtgccattattctgtgttgcgaaattg

SEQ ID NO: 12881 - DNA, 1613 bp, Heterodera glycines
  misc_feature (14)..(14): n is a, c, g, or t
  misc_feature (1573)..(1573): n is a, c, g, or t
acataactttaccnttttagacaaatatccaatagggatccccaccccgcgctcgaattaatcacttttgaattgtccttcccaattaaccataaccgcccctcattcccttatggaccgaccctcttgacattcgtggttgtgtccctaatcatttggttcatgttccggtgcctaaaaaatcgtccaaaaaaaaggacgaattgggccccacctccttcaatgatcgccctgcttttccttttcctcatctttaacccaatcgaatgccgccctaagggcttctcaaaaactgccaaaaataatcctggcgccctccgccgttttggaaaacccgtactcgcccacggtgcccccgttttgtccaccatggccctttatctaggctttgacgccttggcagaatttatccaaaaagaagaaccggagtcgaactctttcctttacttgaccggttgcttggccttgatcattcttttcgcccttctcaaattgattatttcaatttgccgttcacccccctgcacctcggcacccacgggccagcaacatcataccaccgaacctccgtcgatcgaattgagcgaaatccgatcgaccgtatccgaattgcttaaaagatccgaccctccccgtcgcacgaactcatgaaccccccccccttgttttccgttatttattttcaacgcgacaatttatttacagaatgaaaactcgccaaggccctaaattatcccaaaattctctcaaccaagtcctttcacacctccaaatcgcggcaccaatggaagagccaattcagagtgactccgtccaaaaccccacccttccacacgaaacccaggcgactactgagtcatcatttcccgaaaatgccccaacccaaacccccatcagcaacaaaattcccgaacacaacaattcccccgtttcccccctctcggtctgctcttccaaccccgagcatcctcatgtgaaattcgtcccccgctcgcctccctcccgatcccagtcctgcccgccttcaaaattagcgcaattcaccgctcacggtcaggtaaaaattttgaagcgtttggccccctcaataaatcctcccacccctcgggttcaacgcaaattgtgcgtgccacttgcacgccgcctgcacatcccacaccccgtccccgcggcactgatcaaattcgtgccacattggaaccgaacccgtcaacagcagggcaacgaaagaaaggaactggtctcgcggaagaggaagatgacagaaaacccaattttgatcagaaaaccgatccctcttaattctatctcattcccgcctccaattcgtccgctcttcccgttgagttcttttgcctacgttccttgtaccccctctcatcactcgcgccctccaaattatccccccttccgtcgccgggccggagtgtcgcgtcccgaaaattaaacgctaaatttcgtcccccgagtgagtcatccattccctccctttgtgaatcgccgcctattttttcctttgtattggccctaaggacaggtgcagacaaaaatgaacccccttttttctcacgancaactccccccccccgccccccctttttctctacatataa

SEQ ID NO: 12882 - DNA, 3005 bp, Heterodera glycines
tttttcaatgcaaaatagtgtaaacaaaacgtttaagttacgaaaacagcacacattgacagcatattagggtttgcaaatactgaatttccttacagagcccccgggggattttgctatattatgatatctgagattgagaaatccctaaattttggcaactattttgggcatagaaaataaatattcggagcacaaaaagcgattcacgatcaaaatcaattgttttccgagaaaaggacgtggatgattgattcattaaagaaaaaaatttttttttcacaattttaagtttaattaaggattttttaaatatttaaataataaggcccacattttttgtccacaaccccctaaaaattctcattttttggacaatttgttaaaattcaattcaaagcagacccggatcatgctcaatgagcagttcaacaacatgcgacggtggcatcgaaattgtgttcggcagcaccaattgtttgtccaaaatcagcttgcgcacagcgtacggcgccttttgcacctgcgtattgatggcggaaagcagtgcgtccaacacctaaaacagcgcaattttttgttgttgagaaaatggcattttatatttctggaaaattgaataaaaaaattagaatccaggaaaatgaggagtttaaaaaaacatatttaaaatgccaaaacaaaatcggcgtatgtaaactttttgtttcgtgaggttgggtccggtttttttacagaaatgtgaattttctgaatttttgacttttttcgagtccgggtttggggttcaaaatggatctaaacgaatgtcagaatcagttgcccgacacttacaatccctaaaacgaattgtctcgagaaaaatctaagaatttttatttcaaaaagggtaggtggtgtaccacaggtattatttattaccaaaaatggtaaaaaaaaaatatggcacaaacaaatgccaaagggttaaattctgaaaaacaaatgctgcatttaaaaaaaaatgccgtgcctttctgtccacagcgtcattttcgttgatcgctgtccgtacatacagctccaatcggtccaacagatcggagtacgagttgatctcttggcttggcacggtcagtggcgagggtttgctgggcccagcagcggtgacggaggaggacgagatgggcactgctggctaaattaattgttgtaaaattggggacattaaagcatatgagtcggacataaaataggaaaatttttaaaaattttagggggtgggtggaaaatggaacataaaaaatgaaagaaaatggtgccacggtcgaacaattctaatttgaaagacatagttttttcgtgcatttgaaccggttttgttgcatattttgaattttgttggaattggttcgaatccgggatttagaatagatgttcgagtcgtattctctggccggttcggaaatttagaaattttttttttttgaaaaaagggggacaccatcggtagtattaccaatatttctttctaatattaggcataaaaatcccccaaaaatcaacttctcttgaagttttggggtcctcgggaaccggacttcggttgaccggtggctgtggccccggatgatcagtgggccgtgcctttttcggcactggctcttcaatcaggcgaatctcatcgtcatcattattgttggtgccgttctcctcctcctcgtccaacagaatacagtccacgttggctttgtctgcaagaaaaaaggcacaaaatgaaaatgattcaaaattgaaaaaatatttctattagaaaaactaattagctttcaaacagttaattccctgggttcgcatttttttaaagaccaaggcctcaaatttaaaattttgacaccaaaattacaatatttctaataaaaaaacttttggcacttttcttagatgtttgagcaccgaaataaacagcaaaagtgccaaataaatttgtctggcgccgatacttcaaaatcaaaattaagaaactgataaaatcttcaaaagtttgtccaacatgcgaaaataaaaaatgtaaaaaaaggtttttttctgtaaattctaattaaatgagtcaatttccccgaagggctgaattgttggcattttcctcctctacctgtgccatttttcttggcatcttcattttgcccgacaaccatgacatcatccccattttcattgtcctttcgatcgccgcttttgttcaaatgttgctggggaagagagaccgtttgatcgccaacaatggccaatccttcgccaaaaccattatcaacctttgaaattcatattttaatctttttatcatcctttttaatcacattgctcagttccaccacttccatggtgttgtttacgtggtgattttgtgtctcaaaatgattgcccgagggctgacgaagttttgttgaagaggaggccgatgaggccatatttttgaagcagaattcttagcctaaacgtgttgtcccaatgaagaacggaagtacaaacaaattattaagccttccaataaaattatccaaatttaaaattggttttaaattggatttttagggttaattaaatttaaattacatgctaattaacgtggttcagtaaaccgtacaaatacatataaatacgagattttaggcaggtaaaaatagtgaatttttcactcaactatttttgttggtggtggtgtggagtcgcggctcttaaaacacaagacggacgcggaataccgccggtgttacagtatgccaccgcttgccagcagtagtaataggaacagcggttgtgaaaatggtggtggtggtggtggctttgattccatggtttccatcatacacatacatacatacatacatactcttctgctgcctcgcaagcgttcatccgccatccgttgttatcgatttgtctttctattgctgccccacactctctcgtcggtggcccacatttctttttctctcctttctctcgccctctctcattcatta

SEQ ID NO: 12883 - DNA, 4152 bp, Heterodera glycines
attttcaattttacagtaccccatgctgtaacccaccattgctgtaagtttttctgatttagtcgaaaaaaaacttaattttttttcagcataaaactgcccaggttaaatttttgacagtttcgataattttgaatccccaaaaaattgaatttgaacaacagaacatgcccctgctgctgcaaatgctggtaaaaaaaacaaattcaagaatatttcttaaaatttcgactaaacattattttttttcacagctgtccctgctgttgctgctgtctgttttttttaattttttgaattttcaattttaattttaattttgcgttcaatcttaaaggcggtggtggtggcggaggccgaaagaggtggaataaaaaaaaaacaaccatatgcattttaattttaaaattcacacaaattttggacccttaaatgattggtccaaattcaaaatttcaccaaaatttatattttttagctgaaattacatttttttaaatttaaattttcctaattccaatcagacgtgatgttcgcctgctgtggaaacgtgccgtgccatttccccaactgaaaatgccggcttcatcttctcccgcttctccattggattgccaatgcaagaacaatggcagcgccacggatgcgcgaccggcgacgacaaaacgcggcattgtcatgctgaatggcttcatggcatcaccatccaacgacaacaacaagtcgaactgatcgaatttgtgtggtgtgtggtggtggtgaaaacgaaaattcatatttattcatcgaaatttatatatattttttgaattaggacaattttttattgcaaattttttgttggtgttattgtttcatttgttaaatgacatgttgttttcggagatgcgtaccacctatatttattgtatcttattgtaatattttaaatacattaatttatttggacaaataaattttaaagcaaatgaaaatgggactaaatcttcagaacccgaacgggcatacactttttgaaaaaccgaaaattcaatttttccgaaacaatgcttcacgggtagacatcagtttacaaaataattttgcaaatcaagaggtccccttttttgaatttgaattttgaatgggcgccatttttaaattagcgccaatatttgaatagaaaatgtttggtgatttcgcgtctaacgggaaaagagtcttttcagagacgctgcaatgaagccgctctctcttagggcagagacgcacatggtcatactcactggtcactcgctgcatcaggtcccagtgcagtgaatgttcactggtcacatacgtctctgccctatgagagagccgtaaatcattcactcgttttggtcaatttggtatcgatttgttttgtacatgctattccattccgatgctaagaaaatttcgaccatttctgttcccggaccctccaaaaaattgagacttcaaatttcattggtgactttcaatttgtttccatgtatttacataagccgtttgaaccaaaaatgtgttatttgaaaaattaaagtttctattttttttgttcaaattcggacctgggattgaattggcggatgaaattggtactgtattcgtgatcagcgatccctaaaacccttaaaaaaaatttccacatctttttaaaatttctaaaaatttaagggtggtttaccatcggcgtcattcttgcctttgtttttctaaaaaataatttaacaaggcttaatccaattttacatattgcacattttttttctcttctgttgtattacatattaacaattcttctacacataacccttgaaatgggggagtcaattcgggtgatcgctttgatcgatatgggtaaggaagggaaagcatttttttggcttttttccaatttatgcattcaatcactgtttacgcgtcctcaatttccttttggccataatattcctacttggtcaatcaatgtctaaaaaacaaacacaaaatttggtgtttttccggtatattcattgaataattttttttgtcaattgcatttaacaaagaatttaattatatagaaaaaaaaatctatagactttaagccttcgattgacaccaagattttttttttttaaaaaaagggcggggtttccacgtttgagaaattttgcaaattttaatgaaattaaaaaatcgaccattttttttttgatttttcatttcataggcatacatacccctgccgaattgaggaaatttttttgccaaactttgtagatactttttacacccaagtggaggagcgtgaacagccccatctccgcggccgaccgttggccgtcgttccgttcagtcgcggtacaaccatcacgggacagtaagcaaatatttctagtttttgaattattatttttttttctaaatccgtccttttgcacctagcgctcacaacatcgtctctcgaattttttgattttttttaaaatttaaccctccattgtttttcagggccattgccgtcaactatccagcccgagccttcggaatcaaacggggaatggacagcaacgaggtttgagtttcaacaatcaccaaattcaatttaatggtaccgaaaaagtgccggtggtgtaaaaaaacggatgaaattttgcgcattaattttactattttactcggagcggattatatataaccccgttcatagttttacaaaccggacccattaggtaccattcgatagcactaagtgtaaattttgtaattaaatagagaaaccattgggctatggaatgacatcaaattcatctaattcggacaaatacggggggtcttttgaataaaaaatggaccccattttttaacaaatttttgtttattaaatttcatttttttcgatgcgccatctttgtccgatcatccatttgtgccgtgtgcctgcaattgaaggcgtggagaagggagacatcagcaaataccggtgagaattttttttttttttttgatgggggtagaaaatttcatttccttgtaaatttccgccatttacgaatcaatttggtattttttaagtgcaaaatactagataaagcaaccgctctcaaatccgagctaaattactcaaaaatagttgtgaaaaaatttttgcaatcaaatttgattcccaaaatggacgttttctaagaattttttcaaaaattaatgaaaatttatcaaaaattcgcgaaaaataatcaaattctgtaatttatgtaattttacagggacgcaagtggtgaaatcttcaaagtgctggtcgatttttcggatcaaattgtggtggaaaaggcgtcagttgacgaggtcggaccatttttgggcaaaaaaaattttcttttatttttttaaaggcatttttggatttgactgcgcactgtgagatggaattaaacagccaaccaatggaggaattggttcaaaaggtactcattgctaatatctttttttagctgaaatttctatgttttttgcaaaaaagtggatttgacaaaaatttataaccgaaaaactcaaaaaatgaaccaaaaaattcaaaagtagtctttttgagatttacgggtattgtgtcgagggacggtcccaatgggttccccaaaaaatgtcgtaaatcgcaattcttacaccaaaaatattggaaattttttttgtacaatttttaccaacaaaaaaaaaaaatcattttagctgaacgatgaaattgcgcagctgttcccgagcacatttttggtcaacgaaagcgacaaacaacagacagtgatcgcggaggaacggttgaacagcttgaaggagtggttgagcaacgactgtcgcgtctccaggcaacaggtagggcgggtgcataacatgaaaaaatgggtgggtgcgtttttttgcaaaaaaaaaaaaagattgggtaacaggacgggacccgtattgtcatttgtccggaaaattttaattttagggccaggctccaattgacgaaacaaatttttaaatttgttaacaataaatttaaaaaaacttctttttttttctgaattgtggttggggaccctgtgaaaatttttggctttttgctaataaattttcaaaaaaaaaaattgttttatttcattttgttgtatttttttaacaagttgg

SEQ ID NO: 12884 - DNA, 3661 bp, Heterodera glycines
tttccacaagcactttattcattgatggaaaactttcagcctccaatttacttagtggcccttccaaacacgatacaactcgaacatactcttcgaatgcaggaaaataaaggcgcaacttaatatatttttaaaatgaaaaaactttaaaatactaactctgtccaatttttcaatgaaatgagcagcatgtaaatttaaagtagtctcgataagctccaaatcactttctataaacgttttgacaattcgcaacattgacagccatcgagtggcaaccggcaccgataaaataccccgcaaagcatgacgtacgggagttatgcgcatgaaatttaattatttttaatttaattattttattttaatcacattaatttattttctattttaactattattttttaattaattaagtattatgacctcaattctccaataaatacatgcaactcctttatgaattcattcattgtgttaacaatctgctttttttcgtttgttaaattcgcattgacataaggttcagtgatccgccgacaaattgtagaaatgatatgcgcaaggcaaaaatgatgactttctcgatcacccaaatgagataaattgctgccttcatcagttacgtaataaattcggcaatttttgatggcataaagttctaacacgtcatcaataaatcccgaaatattttcacgatttttttggatgtccccaggccatggaacacagtgaagtacaaaatgattaaggttccttaaccttaaaaaattatttttcacataatagtaacagaccagtttttgcaaataaaatgtatgactacaactgcataatcaacacccaatttttgtgaaaaatcgagtgacaatgtgcaagcactttgtctgacgtcaattaattttttgtccagttccgattcctttgtctgcagagtttcaatcacttttctgccaattgttctctcatttggcaaaagatcagctgagagtactgatcgcttttgcagatgccgttcaatactaaaacttttcccttatactcattcaaaaccggttacattaattcggcataagcatccatgaaatgcttgaatccttcgcccttgataattgaaaagggacgtccatcagcaacacaaaattcaaccaatgctaattccattttgtcatgtttgtcatttgtgccaaattttatcccatgccaattttccaaatgtctcctcaaatccaaaaatatttaaattaaagtctttaatataccgcaaattatgaaacccggcataattaaatgtaacaggtttcgcaggtggcacgcaggatttgcatattacataattagtcaaatttccatttccatccaaaataatatcgtagtattgacggaagattcgactttcagcccactctcgccgttgtctgggactttgaaggtcaatccctgcaataatttcgcattttttcgactttggacgtggctcgccgtcatcataggcaatgttatccaaccaaaattcatcaatttcgtattcatcggaatgactcgccataaattctaaattattatgttaacaaggcaaatccgcagaaaaatgaagagaggaaaagcaacaagaagaagcattctcgaagaaatcgctgtaaacgatcgaaatgattgtcaacggacggagagacggctgtaggcgatcggaaaataggagatgagtcaatgtttcaattgaaagacaacaaattgattgacaacatatttttttgctttcatatttatttttatttccttcaattccgtttatagctaatgagatatactaaataatggaattcatttttaaatttttaaaaattacgttgatatttaagttgatggcgtaatgtttgttgatttaaataaatatcaacattgaggttgattctccgcaaaaaaaatatttctaagtgaaaaatgttgatttgccattctctaggcgtatataaaaaaaaatttgaaaaagaagaagaaaatgaaattgccaaaacattgaaaattcaccaaaataccattataagatggaagaaacaatttggagaagaaataaacgaggaatgaaaaagggataattaaatttaaaaaattgtggcattttgttgtcctccttatttaattttattttcaccccatcagtttttgtgttcaccttattatattcattctcataatttgtgaatccattcaaagatgtcttttatgtatattaaacataatttcatgtaaatatttccaaatttcgtctgacgatagcgaaatgaaatttaaagtccgaaaataaaaacgaaatgaaaatttttatatttcatcttatgatttctgttgcagttctttcacttgtgttccaatttgattaattttgatgatcaaaaatataattaaaatgaataattggtggcgtttcattttcttcaaaaattctcataaataatttgatatttatttttctcaaaaatataattttaacaatttttatttttataaataataaaaatcttaaacctactgatttcttacaattaagaaaaaacctacttaatcgataataaaaaataattaaggttttattaaattttattccactgaacaaattattggcaagaataagtaaaataatgattaattttttttatattttttcaattaattcacattttattagagtggtcaccggaaatgattaaaatcctaaatcaatagtttccttcagctttgtttagatgagaaaggcagaaaaatattttttcgcgcggaaattctccaatttaactgcaataaaaattatttacggaatatgttgaaattattagcaatttttggttaatgctttcatatttttcttaaaattcatcagaaacatgctttaaaaacgattaagaaaacacttttggaaggagcagttttttttaatacgcccctaaaaataggaattttcaaaaggctattcacaaacttgggtaacttaattggaaaattttttgttatatatataatatacacacatatatatatatatatatatatatatatatatatcaggggtgtgacttgtctcagaaaagacgagagcgagagtttggcgagaggcgagagtccccaaaaagacgagagcgagagtttggcgagaggcgagagtccccaaaaacacgagagttggcgagaggcgagaggacgagaggcgagagtttttcaattttttctgtagccttatttttaatttaaaaaacttcaaaatcgtatattaaattaggggtacgggcctgggtatttgggcaaataccgggtcagggtattgccgggtacagaaagccgggtcagagtcctagtttttaaaccgagtccaagtcatgaaaaatctaaacaaaaatctttaaaattttttcatgaaaattaaaaaatattttcatgaaatatatttattttagaaacaaactttattatttgtccattttttccaccttttttttgcggtgcgttttttaaaacttcggggacagttggggtcgggcggtgccgggaggcgccgccgaaaaaattttgaaaaatgtcctccgattttgtaacaagattttattcaaaaaatgaacaaaaacttgttttttaaaatttttttgttttttaagtcgcttttttt

SEQ ID NO: 12885 - DNA, 547 bp, Heterodera glycines
ccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaataatttaaagaaattattaaaaaaattctgtaccgttggggaattgaacccaagagaaaaataatgaaaggcagaaggtttagccagcagaccatatttgaattgtagctatccaaaaaatagagaaaacattaaggaaggaaagaaagagatttaagattttttttcgcgtaaatttgaaaatttttctggctgctcaaaagttcaatctttaggggtgtattttcaactctcgcctctcgtcccaaaaaacgagaggcgagagacgagaggcgagagtaccaaaaatgacgagagttggcgagaggcgagagacgagaggcgagagttgtcccacccctgatatatatataaattcaaatattcaagtttcgtgaacagcaa

SEQ ID NO: 12886 - DNA, 1205 bp, Heterodera glycines
taaaaaaatttcaaaaaatttgatcgtccataaatattgtaaattgatcagcggctcaccaaattttgcagagatacgtatcggagcactacaaatgcttactaattttcctagatttattaaacccggtgaaaaagttaagcctaaactttttcggcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttgcaaaaataaatattttcctagattttttaaacccggtgaaaattttttgcagacacccaccacttttgcacttaaaaaaatttcaaaaaatttgatcgtccataaataatttgtaattgatcaggggctcaccaaattttgcagagagacgtatcggaacactacaaaagcttactaattttcctagattttttaaacccggtgaaaattttttgcagacacctaccacttttgcacttaaaaaaatttcaaaaaatttgatcgtccataaataatttgtaattgatcaggggctcaccaaattttgcagagatacgtatcggaacactacaaaagcttacttattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggaacactacaaaagcttactaattttcctagattttttaaacccggtgaaaattttttgcagacacccaccacttttgcacttaaaaaaatttcaaaaaatttgatcgtccataaataatttgtaattgatcaggggctcaccaaattttgcagagatacgtatcggaacactacaaaagcttactaattttcctagattttttaaacccggtgaaaattttttgcagacacccaccacttttgcacttaaaaaaatttcaaaaaatttgatcgtccataaataatttgtaattgatcaggggctcaccaattttgcagagatacgtatcggaacactacaaaagcttacttattttcctagattttttaaacccggtgaaaattttttgcagacacccacacttttgcactt

SEQ ID NO: 12887 - DNA, 1345 bp, Heterodera glycines
aattgccttttccgacggctgatcagattttcatgccctccccacatcctttgtctcgcatgactaatcccgaattttatccaaaaatatgagattgcggacagagaccagcaggaaaatcccgcacgcgtgcgtttcccgtcccgagacaatctctgtggttttacgtcgaaatcaattacagtgtgcgtgctcggtcatagtcttccttcagcatttctttatcgcaatacaagtcacggtagcacagcatacggttggagttcggtacagtatcgcaaggggcggctcttaattttataatacaatttgtttcatttttacagtttattaattgttcaattttgtgcaacaatttcttgatcacttgacaatcttccccatattcgtcccagatggttgattgtccctaaaatttttgctattttaaattttggtcagactcgaagcgaaacaatgcccaccgatataaatgtgatcggaattaatttaatttatttgtaaactttttttaaaaaattttctttaaatacggataaatattttttgaaaaatttaaaaaaaaatttgtctccatttcaagtctcggcttaaattagaagtgatgctctgacgcatcccctttgccggcttttgctcatttcttactacttttttcggatcattttcatatggtttcaaatccgtttggacattgatctgtttgtttaactgaggcgttggaatttggaagaacgcaagcatccgatcagcaaaaggcggcaccaaatgaatcattttggccaaattttcattgaatttttctgctttgatgtcattgaaaacggtgccaatgccaatgtcctaaatttcaattcaattaatttttgaaataaataaaaatcgatttgtttcacattttcattcaatgctccgctgatcactttcccattggctttttctcgattgcgctttgctgctggtgattggtgccaaattcgagaaagaaaatggaaatagtttcctttgtctcaataatttgttcaatggaaattggaaagctgcgcgtcattttgatgcttaattaatccaattaattaattaattacatgatctaaattcattaataggcgtacaattcatctgtggtggaaaggttgaaagatgttgtagcaaaaacaagcttctgttccttttcatcccgatgtatgcaaatttgtacagcaaatccggcaacattcgactcaccaagatgatcttggcataatttggcgatggcactgtcgtttggcataaacaaaatataagaatttagcaaacaaattttgtcattttgcacaatttaatgatgccgttttgtttagct

SEQ ID NO: 12888 - DNA, 771 bp, Heterodera glycines
tcccccccccccccccccgaaatgaaaatttttaaaaattttccagcaaataatggaaaattttttcgaattcccccccccccaaacgaaaattaaaaaatttaataggcaattttcgtaacaaatagcactcaaatttccaaaaaattttcccggcggcgcctatcggcaccgccggacctccattttccacaatttttacaagttttttgccttaaaacggccaaaattgggtcatttttagtgaaaaagtgcagttgttacccagcagtgcaaaaaaagttattggttaaacagcaaaaaaaaaaaaaggtcttcaggtcgggtcccccccccccccgaaaaatgtttctagatacgcccctgaattccatctactatttgttgtacaacatccacccaatttagcgtctctctttcagcctcatgctccacgaagaattccttcagcaatttgttttgaattcggtacccttgtcggagaaaatgcgatgggggatcattggcatttgctcaataagctccttgaatgcctccaacatctcctcggccttcttatttttgagtggaacgacaaacaggcgttttgagagaacatcaaccgctatgagcaggtaccggtgtccgcgattgtgacgagaaagcgcttgaaagtcagcaaatccacttggacctcggtcatgaagccagcagctacagttttggcccttggaaagcgcacccgcctgggacgcatcagagtgtaggtgcggtgcccttccaaataatgct

SEQ ID NO: 12889 - DNA, 2983 bp, Heterodera glycines
tttttttattttgatcagccataactcgcttcattcccaaataaactaaatagatttttagtatctaaaaaagtttttgaaaaggagaacctttttctgagcgaatgctaagcaatttgtcatctaaggaaaaaaagttgagtttcaattttcattacgttataactcaagtcataaactgctgatttcaatcaaaacgctaaacatcatgaaatgcggtcataatcgccacccaagaagaaatatctgaacaagactttatggtcaacgacaacagagcaccatcatcaacaatacgaaattgacgcatgaaaacatcaaaatcaacggtcacttctttttcgtgatgcgcgatttctttgctcctccgttcttctttttcttcggtgcgaccaccttctgccctccactgtctttggttttgccaccttcctttgctccaccaacttgtgccgacgaagtgctgggacgacggaaacaacctgcgagatcattgtagtgcaaagagtgtagacgtaagtctaaaggaaagagtaagaaaaaggtgtattcagcagagttcgtggatttgagtgaccgaagcaaatattgggtatagtttggtttgtccactcccccccccttttttaaataaaaattttcaaaaaatcgtgttaaacaagtttttatggggttttcgaggtcgatactcatttcgacctattccggaacccgtacctgaattctgttcagattctaacataaaagtgaattttgctgcaaaattaattttgatttttgttcgaattcgggtcatgggttcgcaatgggtattagaatcgtgatcagcgacctcgaaaaacaccataaaaccaaaattaaataacccgcatattttcactattcggggaggggcatcatttttcagatattttcccattttcactaaaaattttgttttcggtttcggggcattagccccctcccactacgcccttggggataacaataattggggccgcaacgacaaaacttacaacgagtcgcttgcccaaacatttggacgtcccagtgttctgacaccatctcacatagatggtccacccgtttttcaaaaatggctgctggatcggtcagccccaagtcatgaacaatctgaacaccgacgctcgagtccaagccgaaatgggcactcacagctaaaattttaactgcagaaattaggcatgtaaagcatagaattgaaatagggaatcagtcgactctgcccccttcccctcctctgcccgacaaaaaaagaactgcggccccgatggcttacagctgaaggtaccgtccagtgagtggtttggaagtgtcatgacagcgcgtttaaactggcccttagctctgccaaagtcagccctctaaattcaatcatatcaaatcaaaattttgatggtttaaagcttggattatataaaccatctggcgaagggtttcccaggaagtcaattcaacccgaatccaggcgaattgttttttgagcataaagtggtcaaaaatttccgaaactcggacagacgcccaccggacatcgaaacggagtgcgttggtcaattcaaaaagcaattcgaggggtaggattttctttttttgtaccattttgtggagaagactaatttatggaagaaaaactgatatttctcaaccccaaccccattaatgggcactttgtgtgcaattaggtcatgggaaaggtgaattgtggtcataatcgctaatttaattagtggaagaatgcatgatactctcatgtttacaattaggcccaaaatcagaccacttaaaactggaaaaacatttacaaaatccaagcctcaattttgccaactctagctaagatacttacagcctctgcaagtgtggtaattggtggaccgccgctcataatcgttagatgcgtgtacacaaatggcagatacaacttaaatgtacaaaaggataggtaagtggaaaaacaatccataaaaaaagaaaaatggcatctctgccaaagcataaagtcaaatgaggaatgaatgacgagaaagaattcaaaatggagcatggacggtaaaaaacgaaaaaaattgccaaaaaataattggcgtaaaacaaaacgccaacacacgcaaaaacaaagtatatgcacttacactggtaaatgccttttttgtattttttattttgatcagccataacacgcttcattcccaacaaaaatgaacaaatttggtatctaaaaaaagattttgaaaaggagaatctttttctaagtgaatgctaagcaatttgacatctcagaaaaaagttgtgggaattccaaatttttattacgttataactcaagtcctaggcagctctttctaaccaaaatgctaatttattcttttttctattgattctaaatgttcaaagtgattttgtacccttataaccaaaattattagaatttgcgaatttcatgatttttaatgtgttagagacatgaaaatagtacgccaaaaggagaggaaaataaatacttttttattattatttaataacttttgagtttgactatagacaaaattaatttcactatagaaagatgcagaattcttttctctatcgatatgcaaaatttgatgtggatttaacaagtaggaaaaaagttaaacaggatgaagtaaatctcctgtttcacgcataattggaagaaagaagggaaagataaaatattcaaaaagtaaaatccatgggacgcgtaataatttaaatcggaattccgaccccaaaaacgtcggaattcggaagtcggaaatttttcaaaaaacataaaaaataataaaaaattttctaaatattttaaataatgcaagaattgaattaatacaacacaacgtaagaaaaagcaattgggaaaataaatataattttgggtgcttttggtaagtgatttgattggacggtttttactgtgttcggattattcgtttgttat

SEQ ID NO: 12890 - DNA, 1266 bp, Heterodera glycines
  misc_feature (49)..(49): n is a, c, g, or t
  misc_feature (56)..(56): n is a, c, g, or t
  misc_feature (64)..(64): n is a, c, g, or t
acaataattggggcgcaacgacaaaaacttacacgagtcgctttgcccnaacattnggacgtcncagtgttctgacaccatctcacatagatggtccacccgtttttcaaaaatggctgctggatcggtcagccccaagtcatgaacaatctgaacaccgacgctcgagtccaagccgaaataggcactcaaagctaaaatttcaactgcagaaattaggcatgtaaagcatagaattgaaatagggaatcagtcgactctgcccccttcccctcctccgcccgacaaaaaaagaactgcggccccgatggcttacagctgaaggtaccgtccagtgagtggtttggaagtgccatgacagcacgtttaaactggcccttagctctgccaaagtcagccctctaaattcaatcatatcaaatcaaaattttgatggtttaaagcttggattatataaaccatctggcgaagggtttcccaggaagccaattcaacccgaatccaggcgaattgttttttgagcataaagtggtcaaaaatttccgaaactcggacagacgcccaccggacatcgaaacggagtgcgttggtcaattcaaaaagcaattcgaggggtaggattttctttttttgtaccattttgtggagaagactaatttatggaagaaaaactgatatttctcaaccccaaccccattaatgggcactttgtgtgcaattaggtcatgggaaaggtgaattgtggtcataatcgccaatttacttagtggaagaatgcatgatactctcatgtttacaattaggcccaaaatcggaccacttaaaactggaaaaacatttacaaaatccaagcctcaattttgccaactctagctaagatacttacagcctctgcaagtgtggttgaggaatgaatgacaagaaagaattcaaaatggagggcaaactgacaataccgtagtctcttctcgttgcatgagaagagaaaacacagacagagaaaaaaagggccgacacataaacaaatgaaaatgcaaaaaaaatttatatgtcattttctctaacaccacaaaaccaacaaacacggactgggcgaaggtcggcaaaaaatttgcgacattgcaccgcgggcggaagcgcgacggatgccaccaaatcaaacgggggcacacgtcgttgtcactggtggaggtggagaaaaatcggaggcggcgtccaaatggggcggtggcaatgtcgcggaatacgactgcggcaactcgctct

SEQ ID NO: 12891 - DNA, 4222 bp, Heterodera glycines
tttcctatgtaatgattgacgccttttttctttataaacatacgagcaaataaaattttatttgttcactttttatttagtttaatttttagctttttttattatatttattgaatttaaataaaaattagttaaattaaatttaaaaaaattaattatttcctaaggcaatgtgtagtgtaaaatttggcattttgtttcttcttcttctgacaattatgccgttcatatttggaaatgacaaaacaaatttgccggttgagaaactgacagcacgacaaattcgatcagaaaaaccaattaacgggtaaaaaagaggcaattaacggacaaattttggaactttttttgttttgttttaaataccacaattaatttattataggataaataaggacaaatctttgaaaaatttttctgggtttttaagattcaattcctttaaataaaaaattttcaggaacaaggcctaatgccacctccatttttcagctaaaaatttaaagatttaatcgaatgatttttctccggtagaaaatttaaaagttcatttaattttgatttgaaaataaatactttttaaaattagaaagtatcgtcgccgtctccatcgtcgtggcatcctaaaaggggcagtgatcggtgccacaattggcgccggcgcggcactgttgtccaacgcattcagtggtcatcgtgggcatcacgattattacggctttaatggatgatgatgaatgattgatttttaataaggagcatagcgaaattgttattaaattttataaattgttatttttgtaaaatttcgttttttaaatttttatgttgcgtaattgtcagttatcataattttactctgaattttttggtataagaaacttacttattttgtataatttgatgattttttcaatgcatatttcaatcttttttttacttacctataaaacgcacaaaaaataaaccaatcaaaaaaaaattaaaaaattcgaaagaaaagacaaatgaaatttttactcgtgccatgaggaggataataacaaaaaatgtatccaagccaaaatagtaatttttaatttaattaattttcttacatgcaaatatatttaaaattgaaaaatttttcactccataataattgaaatatttttgaaaattcccaaaaagtcagctttatggaggtttatttttcagatttaggtatgtaaaacaatacaaaccctatccatggcatagaaaaagtgccaaaattcgagtgattaaaaaggaattaggtgattttttgaaaccgaaccgttttgagggttatcttttgaaagcttacttcaaaggcctgattcaactgagaaaatattttttcataaactcaatgaagaaactttaattaaaaaattattgaaaattcaaaaacgaaacacaattttattttttaaaaacctatatttatacaactctaataaaaaaaaattttaaaaatttaaatttatatgaacatataacacctcaaaaaactttaatttttgaccgattcccctctcaaatttttgtttttctcgctcggattgctgcggatgattcatccattttttactttttcccgttcagtgaatctcgggattgggggatccgattatgtggtgggtgcgcgactcggaagaatataatggggccccacaaatgtgtaaacattgtgaaacagacagctctcgtcgtgctgctggttaaatcacaattttaaaaaatggaaaaagtgaacggaatgaattaaaattccgttatttttttttagaattaaattatatatttagttttagcatttaattttttcaatttcattatttcgtttataaataaaaaaatattttcttttcagaaaatcctttaaaaaatgataatgccccaatttttatgcatttttctgctccttattgctcttctaatgccaattacattttgccaaatgcccgaaaaaggcgtgaattcaaatacaaatttaattcgctccaacaatgaccagcttttgcaagcacagcaccttgccaccacgttcatcctaaagtaaaaagattttacaaaaattaagagcaaatttactaaaataaataatattttttataataataattttctttaattttccacccgttatttaaattttcattaattaattcagacgccgtcgccgcggcacttttttgagggctgcgctgggcggcgctgcggtgggcggtggcgtggcattgttgacaaaggcatttcgccaacgaaaaccgcctggagctgctccgcaacggaatttcatgcagaaattgggctgaactaagaacccagcaggactcaagttatttgtccttgaaaacaccaaggatgtccttgcgatacacttttatccttgaaattcgtaaaaggatggatcttgcagatcatcatttcatatttcttttccattttctttgatatttgttgacttttttcgtttgaaacagctaataacaaatcacggctaatttttgattgttggcaaattgattttagctgaattgtcgtcaaataatttgcattgattttttttattggatgtatgaagacgcaattttttttttatattaattttatgaaaaacataaaaatattatagaattttattaattccaaaaaataatacattaattataatattcattaaattatttttataacaattaataaaaaaaaacatctattaagaaagtatgcatttcaatttgtttccgcttatttgtattgttattattcttcaatttaaattgggtaataaaaaatataaaataataataataaatattcattattacagaagaggtcgtttttgcgccgtccttttcgcgccagctcgagtttttggcttctaacttttttcattgacgaccaaatctaacaatcttggcatcattcgaaagcccttcacatgcactattagcctaataaaaagcaaaaagattttctgatctataaaaaagttattaagaaaaattttccaaaatttcgatttttttgaaaatttgcagttataactttcttagtaattccaagcaattgtttataaaaaaaaatcttctaaacatgtaaagctttcgaataataccaagattgttagatttggtcaacaatgaagaaagtttgaagcaaaaaactcaggctgacacgaaaatgacccctaccgcatttattaccttttacagtatgccttgcccctgacagtaacggtggtcaatttgaacttcgcatcgaaaatttttcaaaatttgccaatggaccaattagaacaataaagttgggtcaacccaagtacattagagggttgcactggcgattgaatgcatttgttaatgagcaaaacggaaagaaatctttgaactgtttaattgcaataattaatagtggtaaattttatttatttattttaaattttatgtgccattttagggattatttttgaaaaaaaaaaaattaatgaaaaaccacgattatttatcccatactcattcagcatagcttagattaaatgtgtcaaaaaacatctcgaaatatatttgccaaaactaaaaatgcaaaaatatgtacataaaattatacaaaaagtgccaaaaaatagtcaaaactctgcgtttttctaccaaaaaaagcttaaattgagcttcaaaattatattcttaatgttaattaaattcttacaacaaaaaaaaatcccccgactcagtaccgaaataccggttccgggctctagttttcatgttctaatactcaatcggatactctctgttatttttagacacaaattggcattgtgccgtccatgcgacggcagaaattattgtcggagaaaagaaaataaaaacagaaaattttcaaggctttgtgaaccgggatgaaatcattagggaatggaatttcactgaagaaattgatgtaagcggagaattttaaattacggggaaaaaaatttttttttttttaattatgggaaatttagaaattgttggaacattgtcaatcatccaaaagtgatgttgtccttttgagtgtcaatctgaagatggacccaccaactggcagaaggtgtgacagatcgccaaaatttaaatgaaaaaatttatgaaaaatttttagttttcctatttaatgacattttactggtgaagaatgatgaatatgattcggcagttgcaataaaaattaa

SEQ ID NO: 12892 - DNA, 852 bp, Heterodera glycines
tatgtagaaaccctgtttaatttatgaattagtcaattcaaataaaacaactaaatcaaaaataggatgggtcacggtcgtttaaccgaactgaaaccgaaagttcttttttatatttgaatcaattttatcatgtaatattttgtttattattattattatttttgttgatcctttgtccgtgagtcttttgtctttgtgggtcctctgtccgtgggtcttttgctgctggtgtgggcccccccccccctgtcagtggctcctttgtcagtgagtcatttgtctttgttggtcctctgtccgtgggccttttgctactggtgtgggtcacttgtcagtgggtcctttatccgtgagtcatttgtctttgtgggtgctctgtccgtgaaccttttgtctgtggggggtcgtttttcactgcaccgaattagagccccccccctgattttgtttcagatacgaatgttgaagacattcttcgtctggctgtcaaatatgaaattgaacaggtccaaggcaaatgtgccaaatttttgctcgatccaaaatgtcaaaagacaaaattgggaagttttcgcattgctttcaatcatggcttaaacataacaaaggtggttttaatacaattaaccagggttgccaactgaaaatttttaaaatcagcattttttgcgatattagccaaatttttatgaaaaaatacacatacagacttcatttatttacatgtgattttatataaaatcacagaatatgttttttatttcgtcatttaatatgatatccaatgatggaaattatagataagcaaaaatctatcacagtcttttttttttgtctttctcgggtttt

SEQ ID NO: 12893 - DNA, 3115 bp, Heterodera glycines
  misc_feature (41)..(41): n is a, c, g, or t
tgttttactttctcagttctttcatcgcagtcgctcaattntggaggagaaacatccgctaatggtcgaccagcaacagaattctcaacttcttctgacgcgtcggtttgaacctgtcactttcgagggcacaatggatgaacttcgcttggaatttgagcaggtcattttaacaaaccaacaacagtcatttggttcaaattttaaaccactgccaattttgctggaatggctaaatattgttagagttgctttcgttttaaatcaaaaatcaattctctgaaatgacattttgaccagttccctttgctctggcaggtgttgcggcactattaccatgggaatgcgttgcaattggcctctctaatggccaattacgtgcgctacgaatacgaattgcgttggcaacagtccatgttcggcatcccgccgcatctgatgaagtccgcctaccttctattgtcgcgccattttcacatgaagaatctgcgcctcactgatgtcaacgatggtttggccgcgatggacgtaaacgtcggtattttactttatttaataaaaatttggcaaaatggtttaaaaaaatacaaaatttatatattttttgccttttctcacacgaaaatgccattcttaggggtgtatatttaaccccgaccccgagtcggggttaagggtcggggatcggggtcgtcggggttcgggtcggggttaaccccgaaaaatggccaaaaatgtcggggcggggtcggggttgcaaccctaagcaaaaagaaaaaaaatcgaataaatgatattttgatcactgattttattccgattgttcgcattttctgcgtccgtcccttctaattatcgtccgttccttcgatcttcttcagcgcatctttggtcttgtaatattcgaccaatcggtattttgcaaaactctgaattttggtgttatttctttcttttaataatattaccgtgtaatcgaattcttcaattgatgggcttgcgcccttgaacaggccccaaattccccaaagcaaatgtgaaacgggcacaaaaggggcagtttcctgaaaaaaaccgctgacattggtaaccaagggccaaaactcacttcgaccatcgtccgtgcactttcctgcaaatgttcctcactggcattagggcaaccttccttctcgtaattgtacatgaactcaagcatttgtccttccgtgggaaaattctttgggagaatttcgtaaaaaggtgtcgtttttttgccataattgatggcgcgctcaataaaatggttggcaaaatcaaaacccctataaaaaatgtgagaaattcattatattatttgccatcgatcccaacaattgcaaaagaatcagcgaaagcactcacctgtaattgtaactggcgtactcaaattcaatgaacacaatgtccttttggttggaagcggttgatgcggagcagcttcggatattgccagaatgtgcttcgggcaagaggatgttgccggccaaaaggtcattatgacagaaagtgaccacacaaccgttcatgtcaagtttccttaaaaatgggatttatgattatagctcacgaaaacacacctaaaattgtcaatttctttctgtaaagcttcgcaatttatggtcgcaggagcccattcgtgattttcaggcggcaaatcgaaggaagtggagccgctgggggaccgtttcagttgaataagccaccttaaataatttgtaaaacaaaaaaagactgaaaagcacctttcaagcgcgtcacaaataccagcctaaagacaaaaattttaaaaaatatgtaaagaaattcaaatacatctttcccaacaggtcgtgactgcataatttaattgtataactacgattttacacataaaattattttctcaccggaatgtattcttcaagacggcctccggtgaatgttcccaacagtttcgggcccatgtgtagttccgacaaaataccaaaaagaactgaatcggccaccacatccgcttcggtgtttaaataaacacgcaggagcacttcgtccggctcccctttgagtggtgagtgattttcaggcagacgacaaaggaaaagcatgttgctcacaaagggaggtggccaagtgtccgtgggatttcggaatgagattttttgggtagatagagcacacctgggttcttaagaaaaatgttttcaatttctgccaaatggacccctgtgccgagataaaaaaatgccaaactttttaatgatgaaataaaagaaatacttatttgtgcctcggcacagtgtccagtggtatagcggtagtgcactagtcagcatcaggcaacccagggttcggatcccctacatgtaaattaattttttaaatttttgtctattatgccaagtcaattatcaaaatattttttattaaaaaaactttatttttaatttttttgaaattatttagtgcataaaatactcaataaaaatattagacaaaaatatatttttttaattcgacaggttttttattacatctttatgtttaatgcaatttttaatggaataaaattaaaataaagattttgataaagaaataaaatttgctaattgaagtgctcataaaaaggaaaattaaaaattaaaaaatggatttacacaaaggggattcgaacttgtgaccaataaaaattttgactaacacattacctctacaccaaacaacacattgaaaatatgtaaataattaattattttctttaattataaaaaactaaaaactttggcacgtcataactcggcactcgtgctcatttggcagaaaataaaaccatttttcttaagaacccatgggtgctctatccatccaaccaagtttcatttggaaatcccacggacacttggccacctccctttgtcagtccgcctctgaagagcttggtaaatctatacagatgccgttttttttacttaattctgtgaatcttcatgtcgtctaatgtgacggtcttccaagcaccacccaaaaagcgggcacaaagaatgtgcgtcttctgcttgaattcaatgtgcgaattggggtcgaccttcgggttcatcgtgctgagaagctctttcat

SEQ ID NO: 12894 - DNA, 2564 bp, Heterodera glycines
ccgacgaggaccctggggaaatgaaacggaattatacagatggaaaacattggcacaaaagcggcaccattttattgtgggggaccaaaagaacaccgtttttggccctgctgggtgattccacgcgggtttggcaaaggctggcagaatcggatagacgagctgaaaaaccattcaaggctcatcgaacacagcatggagaaatagtaaagtactcacattatcacccaatttacacaaagttttatataaagccgatgccatagagtgcaaaactgaaagccaaagaaaaagtatcgaatggaaaaaaattgattaggtaggctgacagaagcagataatattcaaagggtcagaaattagattatgttttctttaataggtatttatgatgctgacttgatcgacaaatttgtcaaagatacagatttgtgagaaatctttgatttatccacagagggaggggagggggggggggaaggggcgtgagtttctgacggtgcggtcttttttcactttcgcattccgttggtcaaattcagcaacagttgctcgcacgtcctaacggcgcaccaccgggagagcttggcgaactgggcgggtgttgaggaccgagtttgatgccgttggcctacgattgaaaattcctttttaaagttacaaaaaagaaaataaatttaaaaaatcgaatttcaaagcggattctcaaagaaaatggggatcgatcacctattgataatgatagttcacctcattgttaatgtcaaacacgccctcctggatcttcctgtaaatttccttggccgtatcaatgaatgcctcctccacattggcagccgttttcgccgacgtttccataaagacaagtccattctcgcgagcgaactgctccccctcctcctttttgacctcacgcctcgcttcgagatcacttaaaatcaagcaaatattaaaagcatgtttttagttgacggattgcattttcaaaaccttttgttgccaatcagcattatcaccatgttggaattggagtgttgacgagcgtcttccagccacgaggtcaaatggttgaacgtgtcgcgtctgaaaagggtaaaaatgaaaccaactaatttggtatttcttggaccgagtgatgtcgtaaacgagcaaagcgccagccgcgccccggtaataggaacgggtgatggagcgaaaggattcctggccttaagaagcaaagtcaacttacccagtcaaaaagttgtctcgctgacctgcagtgtcccaaatttgcaatttgatttgttttccgtcaattgtgatcatccgtgctccaaacttaacttttcgttttcacgtgtttttcccgccccgcccctcttttatcgataaaatgggatgatcagctgacctcaacgccaatggtcaggtcgtgaactggctgaaatctcttgtccgtaaactgcagcaacaaacatgacttgccgacccctaaaaggaaaaaatcgcagagaagattttgccctgtctattatggcttcactacctgtgtccccgataatgatgtatttgaacaaataggaatatgacatttggaagcacaccaaattaaagtttctggtcactgtgaaaatattaaatcgttatttttgctaaaaatgagttcagaaaataattgcatcctaattaaattacaagtaaaatttaaatacaaaaaaaaggaatcgtataaggaattttattaagtcaataaagaaaatagcacgtgattttattggaagatagagtactttttaagtacctatttacctacttaatttttggaaaagtcaattggtttctaatacaaaatttatttaattattaattgtatcctattgactttaatcgactacgtagaaaatttttttgaaaatgtgttggttatccgcccgttccaacccttacaaaaatgtgacatcctttcagccggcattaattgtgtcaatatacatacaaaggtccgacactgccctcaataggctaaagtattccgtcccatctcttttccttttatgccctatggccaacagaatcaattttctatgcccaaggctcagagaaaggacaaaaagcacgcgagtgactgactaacaggcaccaaaaaacggagggaatggaaaaatgaaagtgaacacaaaaacaaagggaaattcaattaggggggacataatggaaaagtaatttattaaaataaaaacgaaacaaaaagaagtattttatcgaattcgtttaatgcgttcgtttgctgaactgccatctttctttccaatttgcgcaaagtcttcctttgaaaaaactgaagagcattgtttcgttttgcggggacgaccatagagtatcacttgaaaaaacaatcaaataaatatattttaaaaatttattatttgatttctcacatttcgcattgtttcgctctttcctccgcttttctgccattttttgtcgctgcttcgctttccggtcaaacaaaaccatcgaagagaaattttgtattccaacacgacgttctctcaattgtttttccaccataaagtaatcct

SEQ ID NO: 12895 - DNA, 1649 bp, Heterodera glycines
cgattccatttgcagtgtaatttcttccttttcccactttctctttctctccctttcatttgtttgattgtttcccaaattcataatttttccgcactttatgttaattcaattttttttttcgtattatttattcactatttaattattaatttaggcttttaatttatcctttattcaaacataaatcatggtctgtctttgcttttaaaatgaaataactaagaattttaggccgattcttctaaggtccctggcggtggcaaagtcgtcccacgctctgctgctggcggtggcttaagacaacggttcagtttttcaaatttagatagatttcttttttcatatattttctaacaatttaaggcgagctggtggggcggcaaacactggtcgtactcgaactgctggcggaggagggggcggaggaatgaacagcggcggactgtggcgcttttatactgaggactcgaccgggttgaaaatgtttgtgcaaatgatacttttaattggtccaaatgtgaaatcgaaattctgactttctatttagctttttcgggtaatttgtgacctcacaatattcgaaatatttttctattctgaaatcaaatttagtggacctgttcccgtgttggtcatgtcgttggtgttcatcgcttctgtgttcgtcctccacatttggggaaaatacagtcggactcattgaattctcactttgccgattcattcggtctatcggcaaaaatgcgattttattcatagtttttacaaatcacttccatttaatggaatatttgttttgtatgtaattctgataaagtctttgttataattattttctatggtgtaagagtttttaaaatctaaaaaattagctcaccttttaggaagcgcaaattcttcgtacggtaaggtttttgctgccttcggaaaaatatattccttttaaataatttcctcttttcttttttcccttcaccacaatttcctcaattaatttcccgtgttttctttttctttacgattttcgaccataaaacaggctttaaattgcgttggctcttccctccttttattgtatgtgcatggaaatttcgcgcaattctcttacatattttccccggccgctttgcttgagtcattgctttaatggaaagtttttctttgcttcattttgaaaattatttaataattattacatgtgtattgaaatattggtaatccttcagaattgcggtcccgacgaaaaattaatgttttgcttttaaatgatattccaataattaatgaccagtcactaattgcccccctcggcgatatccatttgttaaccgtaggaaatgaccttcaaaggcgtttccgccctttgtttgtgctcggtccctccccgtcccaattttacaattttcccgcggttaaacgattaaaatttcatttgcgctgttaatcaaaacaaaatttatctgctattttttctccgatgtcccgcaaccatttgaacaacgccaatttccatcagcagccgaatgggcgaagagagttttacacgcgacagaacccgcgggggacggggcgacacattgtgaccacgacagtccaagtcagtggagagagaggacggacggtgttaagacaacgggggggggggg

SEQ ID NO: 12896 - DNA, 3919 bp, Heterodera glycines
ttccttttcttctgctttttctcccccccattttcattccgtcaatttccctcctccaccccttttttccttctctttccgaaagtgattagcggtgattactaacattgctctgctgctgttgctgacacttttcgtcctcctccgatggtccctccgcttcttcttccccaattatcattaaacaaatatttctcaccccccaattttatttatcgcttttctttctcttagcaaattccttccccgtttcactcaagcaatttttttcaatgtgaaggtgtacaaataaaaaaagctgattaatctaatttttacaaaattttaacagtttccgtagattcattttgtccccattattctcttttttcatttgtccttaaaattggctgttttatttgtgagaatttgaaaggcttaatcggggacctcaattcggagtatagaacataaaaaaggttactcgccccccgccggtgggactagaacccacggcactccataccgtggaatgctctaaccgacgaagctacggcctcttattctttatttttcccccacaattcgggggttgattgtttgccatttgtttttgttttttgcctttgttgttcagcagattatgtgtttatcagttggttatcgcagatgcaatggaattggagaaatatgaaaaaaccaaagctcaaaattattctcacgagaagccgaatttaccgaaagttttgagtgtccaattggaccaccttatctattgtttatgcatttctttctctttttattatcttttatcaatcgtcaacattttattagcagaatttaattaatgaatattttccaattaaaatgctccaaaatgacaatctcacagaattttagttccagccaattagataaattaattgaattttctgttgacgaatttattgaaataatcttacatacatttgtgaggattttgatttgtttttgtggttctcttctctgctcattattactgatactgtttttgttgttgtgatttcattagaaattcaaatttggcattgtaaataaaacgccaaatctcacagcaatcactgattttcaacttgatgcattgagaggagggggccaaagccccaattcgcccctttctcctgccaaatcgcccttctattcaattagcactgtgtcagctttcaaagtcatctccaactgctcacattcggtggaataattgcatttaaacgcggtattctttcacagttttctttttgaacttttgcatttctaacggataaaacataaagccttaactttttttgttgttggaatttattagcacggatttcgtgttttttaactaaattctgcagttttttcagaactttcatcccctgtctttaaactatgaattttcgatgaattatttatcagttttgttggttttaatcattcccttttctcagatgccttcggctaacctttcggaccattcgcggctgttaaagggcggccgcgggttggcccaccacaaattgggccccggcgtggtggccttgcactcgtccgccttccaggagatggacgagtacgcgccctatcgcatcgtcttccttttgctgtttattgtttcttccgtggcgctgtgggcgtcctacaaaatcatttggtacgctccattaattacgaatcatcgtaatttacataaatccgtttaatgagacgccatttcaaagatccaaaatatgggcaaaaaaagatacatgtaaattcttttgccttgaaattgctcagaagacacaatattgtgtagttagtctttttcgaaaaatgggaaagtgagcagggagcggcgttgccggggaaaaatgggaaattgtggccctattttacaaaacagtttaccaaaacatatatattttttcagtcaaatcttgaaaaactaatgttataattttggagttcggtggtgccaacaagcgacgcctggaaaaattggggttttaatgaaaatgttaaaaaacagtcaaaatttggttttttgttcgtatgggatatttaaataccatcaaagaggacaaatggcattgtttcgtgtgcttgaacacagtcagtagaacaggcacaacatttacaacagaatttaaaaccccttcgcccttcagcgaaagtgacggggcgtcggaggagggcaccgccggcggtgccgcgtatcggccgctctctcagccgaccgacggcgacgcgtggacggccgacttttgggaggacgacgagtcgctttgttcacatgacacggggggactttctcgcaaatgaatgtgccggctgacaatgagtgattttgtgtgccttttccgcaccgccctttttccccaaatgttcggatttccctttcctttccgtcgtactcattcagccaattaattaattagagtccaattttgagttttgtaagaatttccccggacggtcgcacaacttgttaacgttgggcgttttttaacacaaaatttttggattaattagatgacccaagattggactaatgagcactaattaccgacttttcctgttttcctttgtcaaaatgtgatgccttttgtctctccccctctgatcagttactttcttttctttgtgtcttttagtcgcttttcggttagttagtttctgatgaagatcttctaaatgctctctcaaataaaaaatactcatttaaatttctattcgcccattcatttgcaatcgaattcgaaaaacaaattcaaaatttagaaaaagtttgcgttttccctaaatctattcgaattcgtcgctttggtctcttccttcgctggtcctttcccttctcatttacaatattttatgctctcactcacccaaattctgctgatgatcacaacattcaaatctgcgatacatttttctgacttttctcttttcgtatctcaaaaagtctgtcctccgcgaatatttttcggtcgatgctcattttttaaacatttttcaatataactctatcaaaaataaataatttgatccaataaattttttggttcttttgcaaatctaaattaaaaaacaaacaaatggatcgaattaaaccgcataattttaaataattaatgttatccttccgtccgtcaatccgtccgaaaatgttttgtaatttcccgatcaatgtgccttagttgatctctccactttcaatgctctcaaaaatggcggaactttctctgtactgcttcacatcgcctgtcaaatgcgtccgtctcttttgttttgctaggctcgagaaattacaaaataaataaatgatttattcaaacaaagggcaattggattttgattttcactatttgaatttgtctcgagtaaaaacgttgtcggtggaatggcctaaggccaaaacaatggatgttcttcggactttaagagagagtcgcacgggttcgcttatttgggaaagaccgggcttgggtattgccgggtccgagttttacaacatggaaaagggtccaaccgaatcctgaaattattcgtaattaaatttttccaaattaaagtttttttgttgatttttgtgaggaatttaaaatttatcagaatttgaagtccagcgtaaactaaacatattatacacagcggcccaattttgggctctcagtgcaaataggtttattatttatttagtaatcagaacgccaaaactttgcaaaacttaaaatttttttgggattttcccttgtaaaattagaagagccgatctcgagttaaaaacttaagttccataaaataaacttggaatcgctagaggaggtcaaaatattggcctatgcaaaattttaagaaaattaaacaataggaaaaaattttttacaagggcaaacatttcaatactttaattcttttttagccaagtccacaattt

SEQ ID NO: 12897 - DNA, 4044 bp, Heterodera glycines
  misc_feature (82)..(83): n is a, c, g, or t
agcgcggcgaatgatctgctcataccattggacgcaggcatctcgttcaaagccgtgaaagcgtgaaagcggtcgttcgcgnnccagggacatgacgtttgggcaccgacgtgggcaatgaagcgtctgaagaggaagctggcggagggggcaaattttgagtgggtgggcgagggacagactcgcgcacttgtctgtaccgacgtgcgtgcccttgttgagggtcgacttcaagcgttggcaaaaagtggtgagaggaaaataaataattttttaaatttataacaaaggccgtctgcaactccatcaggaatttgtctcccaaattgtgttggtgctgacgggtgacaagggggcgacggcgtggcagcaacaacaaaattggtactagtgatcggcaacgttgatcacccaaattccccaaaaaatctgtccattttgggcatgatgaccgaaaaaaattggagaacaaatttggcttgatttttgcgcaattgaaccagctggaaaccgttgcattcgaaattgccgggaggaagcggaccattccagttcaaatgtaaaaaataaaaatcaggaatgttaatttttattttcaggcttctctgtgccgacctcaaattcacttcggcgctgatggggcaccagggatctgcggcgaccttcccttgtccgctttgtacagctcggcgggaccaattgtcggacaaaattgtggatgcccgcccgtcgcctcccccaccccaaaattcgtacaccggctctccactcgtcaacattgctttggtgaatgttgtaccgccgagtttccatctcttgcatggtgaagaaaacgaaaaaaacgattcagaatttacaggcaaatgcccagcgaataattgacgccatttgttcggaagcggacgctcgtggaaagggggactttgttcggaaacgactgtttgatgtcggcgtgcgacggcaccctcggacaaaacaattcaagggtagaatgatggggatggggtgggggttattgaggccaacttttgacaggtgcgacatctacaaaatcctcgaccacgaaaacttcgcttcattcacggcaccaattcctgctggaccgttgaaatttttgctggtcgacgccatgaatgacctccgccacatttaccgcctatcgcatgccaaaattcttcatctagaggatctcaattcgcttgaacattggacgaagttgttctacgcgcactggcagcaactccgatcaattgacatcgcccgttaccccgtccgcccgaagctgaaccttctcactgcccatgtcgtcccttttgcgcgctctcatctttggtggggtctgatcagcgaacaaggaatggaacacatgcacagaatgtgcaacaatttggtgtttcaattcgacgatgttgaatgcactgcaggaccgtggcgtagagaacaaccaagaaaatgacaactacccagatttttgaccaaattttcacctcacttttataaatatttttttaactttttcatttcaaaaaatttgagtgatttgaaacgagctaaattgcttaacattcgctttgaaaaagactctccttttcaaaaacaatttttagatacaaattttattcaatttagttggaaatgaagaaggttatgactgatcaaaataaacaatcaaaatggcagtgatcagcgtaaatttgaattcgcgcgaaataatttacgccaattacgctatttggttatgagcaattttgtctaacactgggcttgacccatagtggccagttccgtcttgggccagttccgtcttagtactcaaaggcccggttccgtctcaaatatttttgggctcaaatttttttaaatcaataactaatagtagttacagcggagtcggggtcgttttggcgcccacgttttggcgccgacgttttggcgcccacgttttggcgccaaggtcgttttggcgccgacgttttggcgcccacgttttggcgccagggtcaggtttttaaattttgtctatgtttgaataaatgaaaatatgtattcgtcagttttctgagtcgctaatcacgaatattgtattcattttgacaattgcgaagcccggactcgatttaaatgaaatacaatttttgaacatattagatcaggccttctatctgttttgttttatcaaatgttttaatatggtgggtccaaatctgagaaaatgatttaccagattctgatttagggatagtgactattatttattaaatataccgttaaggttatgtttataatcactaactcttttgaaatttcaaccgaaaaaatttaagagtttaaaaatattcaaaatgttttgacttgaagcatagcgaagagaaaaatttgaaaaaattcttgctaagtcaatttttcatgttgaccaacaaaatgttcacagcaagttgatcatatcactccttcatgttgatctacactagagatcaacattttgaaaaaaccgtagttgtacctgtttcaaaaaatggcctgtacctattttttctgtacataagtacaggaaaataaatgtacaggaaaaatccaggttgccgaaaaatggcctgtgcctgtacctggatccaggaaaaatacagggctggatccaggtacatgttgatctctaatctacacccataaaacacgtcaaaatcgggaagtttgaaaaaaaattctagggggttgtgaattttttgaaaatttgaaaaacccattggaaggtaaaagtttttcacttttttttgtaaaatttttgatcaaatttttaccttttttaatttttggcttcgcgccaaaacgtgggcgccaaaacgaccctggcgccaaaacgtgggcgccaaatcgtcggcgccaaaacgtgggcgccaaaacgacccagtcccaattttaggcaatcgaaatttcggcttttctaattttaaatttgaactcacaaatcagtcaattcgtgtctgaaattgtgtcctatttaatgacaaaattacctgtgcaaagcgtaatacgccctcttcaccgtcccgttcataaactgtcaacagttcgcctccctgttggacacccacccatctgtacatgctggtcttctcacgttccctgttatggtaatcacactgttgtaagcgaattatggtaatcattattataagggaatacgctaataatcactattgtacatgaaggcggttaatttccagactaattgtaacattaatttatcatatttttttacctgtattggttggaccaacggtcgtccgggtcagccccagctgcgctgtccccagaattgtcattgccccaaattcgggcaaaaattgagcctattttcatcgaataaaataacctaaatcatttttaaaatattgaaaaaataataatattttaatctttgatcataaaattagataagaatattaaaaactatctttttaattataaaaaaattttttgttgtaataaaattaagtaagaaatcttctctctgattccacaaaatttgaagtgaattatcattttcatttattaaagcaattggagacataatgtgtcggcggcacacctaaatacacacaggcggccaaaatatgccatcgaatgtgagggcggctccttggaaacgcacaaacccacggcattgtgtaatgggaaaattgaatgaattttggtgccattaataaaggagaggccaattggctttgttggcgttctttgtttaggaattagctgttgaaaatcattaaaataaataaagttgatgtagaaatttaaatattttgttaatgcaaaaaattgcttaaaaaattttgaaagaattttttaatttattaaataattaaatttaaattaactcataaaatcatgaatttaaaggttttatttatattaaatttatataaaattttacctagttgggtttttgtataaaaatattcagcgcctttatttttaccttcatcattatatatttttattttaattaaaaaaatgttttataaattaaatttctttgttttt

SEQ ID NO: 12898 - DNA, 4157 bp, Heterodera glycines
  misc_feature (500)..(500): n is a, c, g, or t
cactatgggtcaactccactgtgcagagaaaagcctagtactatctcgtcgtttctctttttctttgtaatttctctcactttggcgtactatctcttcttttttattatgtaaaaaacaacattcacttcactacgtttaactttttttctatacgttaaattagggttaagccccgagccctcggggggcaaaaagtcgggggtcggggaccccggtcgggtatgaccaaatttatattgtaaccaaaaaataataatttttctttttcaatgctagtaaataaagtcatcaaaactcaaaaatcgtctttttctttactttcctcatctgattcaaattcatttgttggtgccagtaaaagtgcgtccaaattggccttcacaatcaaaatttggcgcacagtattgccggaaagccttaaattataaaataaattaatacattattgatttctgacctatttcgaagtgaattggcaaaaataagtccagctttgnagaacagtctttcagaactgactgatgtagcgggaatgctgtggaccattcttgcaagttttgacaattcgggaagacggccagtattttcattccaccaggaaaataagtctccgttcacttccatcctttggcctgccttaaaacaagtaagttcagcctcaatttttgataaaaaatcagagtcaggatctccggaaattgttgagggaatagaaataccacatggtgattttggttgggcccagatatcatctaaaaagaaaataaagtatttatgtgatgcaattgtcaatacatttctctatgctctcgttgctgcttggactcaattcttgatcagcaaatgtacggtcaattcctgattcaacctgaccaaagttgttcacatcaaaattatcgtccatttctattgttgggagaccaattctaaagggattcatattttaattaccaaatattctaataattcaaccaactctcttttgcaaattcgattaattgctgttcgacaaccctccaattttgctgagaaaacagttctgtgtaagcaaatcgaggatcaagtagcattgcgactcgcaacagtgggttgctgcaaaattcacgaactcgttcatttaaagactccactatgaccctagcacgcccaaaatgcgatttgagaaagttttttcttgcaaaaaatcacgcaatgtttttatagtcgaaataatggttgatgctgacgatttttcattagaaaactgaaattgtttacaattgtttagtttttacatatttcacttgcttttaaagtctctcgatgaaaaattaccaataaagggcacagttcgcgcaaaaatcaaagtcggtaatttccaaatttggtaaattttcagggacaatatctaggcgcgacttttttgatgagccaacaccaaatcctcgtctttctccttcaatagttaaaagaacgtttttttgttcacgaaatgtcatcatcatttcaaaggtcgagttccaccgggtcgggcaggccttaatttaaaagaataattgtgaaaacaataatttatgaaaccattgtgagtttttttgcttaaaatttgtcttttcttgatagtcgcggagcaaggacaggcctttacttgtacgaaaaaaagtaacccaagaccgaattttggaaatgagtcctgccaactcaggcagtcccaatacgtctcccataacaagatgaagaaaatggcacacacattgaaagcttaaaaaaataattataaaaaacaaaaattaggtaaaacctattcaagttcaaaatattgtggcccttatcatgttttttgcgttgtcgcgaaccaaacaaataattttttctgggtttaatccatttgtccgaagagcgtttccaatttcttccgctatgtctgctcctgtgtgatttgtcattggaatcacatcaagtacaaaatcggcgcgtacaaattgttgatttatatggtgtacagtaacgctaaagtctgtttttataaactatgaaaaggaatagagaaccttaagagtgcgggtgattttgtaatttgcgaccatccatcagaggtcacagaaaaaaaatccggaccaattccctgaacaattttttgttgaatttcatcggccattttgggaattacatttctccgaaaataatctttgcggcgaagcttaaaaaatatgacaatagtaaaaatgggtgaaaaatattacttggagtttcgggtaggccaaagagaacaaattctgtaattccggtgcctcaacaaataaaaaagagcaattcgttcttatcatcagccttgcaatttgttcatccgcctttttttgtgggtcttcattgccaaaaaattttgtaatgccttggtttttctgaatttttttatattcaatacaaaaggaagcttgtattaccgttgacgggtcggatttttgcaaatagttttcaaattctttagcgtgtttcgctttaaaatgcccccacaatccttttgtgcacgatttcttacacgctaattggttttcacaaagccggcacttagcaacctctgaagaaattttcgtgaaaaaattccaaatattagatgcttttgaagccattaaaagtaatcaattgagtgaaaatctattaaatttcctggaaaattgtaaatctgtgcaaagtttaatttggcaaattatatattattaatttttctaaaagagtgagaaaaaaacttttattttggcttagtgataggtaaaatttaaatgttttggttgcataacttttaaatttttaaaacgctcggagtccccaatcccccgaattagtgtcggggggtcggggggcaaaaagtcgggggccggggacctcggggggcgacatgtcgggggtcgggtcggggaataggtcccaaaaatgtcgggggtcgggggtcggggtcgggggtcggggggctcggggtcggggcttaaccctagtttagaacatatttttaagccttttctaagagattaagcaacccataaaatgttaaagctggaaaaaactgcagaaaagtcagaatttttgtatatattttatttttaattatttactctttgaaaacacagtgaattttggttatcgttaagagctttttaatgataccaagtttgcttgatttcgcaaaacaaaaagattttgtaatattgtgtattaaaaaaaataaagaaagcaatttattttttaaacccccccccgccccttaccattcgaaatttgattcttttaggtgattttttttcaatttaacatattttggaaatcggaaaactatatataaattgttactatacatattttttttactaaggtattgcaagaatttaaaaatttatataatttatttattttaagatcctatggtggttaaatttcttagagattctgaaatttcctttagcaataaaaaataaaatgaataaaacggtcgcgcgaataaaaacagaaaattcaccctaaaacgaaatttggttaattttaactctctctctctctccataaaatgtggcggctgatgatgacaacattgacgaaaattaatttataccttttataaaattgtttacaaagaaacttggtctttattttctagttttttcctttaaacttttgccaattaataagtcaattggtcaacaaataaatcataaaattaaacaggattagttgccagagaatattgcctttagcattgaaaatccatttggccttccaattgtatcttttaagtcgtatttcaatttaagtctattttgagggtttgttcacatcctaatcctgtttgaggattgtttgtttttttctggggaaaaatttgttggtgtgaaccaaacgacccccaaacaaaaagcagaccatttcaattaaatgtcgggacggcaatctgtgccgctttctgctccgccttttgaaacattcataaaaaggcaaactaatagcagcacagtgaccaaaaaatgccgatctggacttgtgccgatgaatattcctgcgtgttgatgagggataaatcatcaaacgcaaaaatcatgctttaaagtttaaaccatcaaccgaccttttcatgatgaacaacggcgtgtgcggcacggaagagtcattgtcataaactagagttg

SEQ ID NO: 12899 - DNA, 1590 bp, Heterodera glycines
  misc_feature (266)..(266): n is a, c, g, or t
  misc_feature (362)..(362): n is a, c, g, or t
ccaatcatacataaaaaggggggtgggtcggaaaaaatttttgcgaaggggggtcggccgccgatgacctttttttttgcttttcaaaaaccgtctttttttcggcgcgctttttccaaaaaatttcgggaatagggaggccggcggtgccgacaggcgccgccggggaaaatttttaaattttgggtgtgctttgttaacagattttcacctaaaaaggccaattttttcgattttgagccaatttttaaagaaaaatcggaatnttttggggtccggcggtgccgataggcgccgccggggaaattttgtgcctttaatgaatttgttaagaaaatttccaaaattgcgacccccaactncgccgcgcgcgaacccctccccctacctatttacaccggcccccccttcgctgcgaaccccccccctcgctggccccctttgcgagcgagggggggggggggggtcgaccccctcccctaaaaaatgtttggaaaacaatataaaaaatttccgctttttcatgaaaatttcaactcattttagaaactaagtgttaataaaactaattgcagaattcccagaaaaaaaacttgaaacttttttacatttccttgaatttaataaaaaaaaaattcgaatttatttatgatttttttttgatttaggctagataactaaatttttaataattttttaaaattaaaagaaaaatttgcggcgacattttgccctgctcccccctccctccgcaccacacctccttgaaactgttgacccaatcgaagtccgcttgtgcgttcaaatttctgaataaacgacgaatttgtgacttttcaaattcattaccgtcggttcatttttggcaattagcacaattttggccgagttccgaatgatgtcaaacaaaagagcagaataataattcgttggaaactttatttttatataatgagaaaagcggaaaacaaaagatttttatagtcatgaaaagggaattggtgaatattttttgtatatgaatagagagagccctgatttttttagatttttcctattttttacggattgtacttgatgaaagaaacacgaaaatcacattttattaaaacaatttttgattttttttgccttaaatggggttggacaatgtttaaatgggaaacgaaaaatcattgacaaaaacggaaggggcggaaacattttggcataaaatgaccgattggaagaggaagaaaaagggaacgcaacagaggaggaccaccaaagaggagaatattttgcaaaatgatgaccaaaatgaccttaaaatgacttcaaaagcgatttttagtccatattttatggccatatttcgcgattttatatccatatttttaccatccctagttatgaaaaagtcaaactatctaaacgattaaaatggaaaatcatacataactcgtgctatgccaactcgtaaggctccctgatgtttcgtcactgaaataaaaaaataaaaataaacactatgccatatacttaataaaatttttgaacaaaaaagcattaaatttgttgttaagtggtgtgatatttcacatacataac

SEQ ID NO: 12900 - DNA, 2045 bp, Heterodera glycines
  misc_feature (6)..(7): n is a, c, g, or t
  misc_feature (10)..(10): n is a, c, g, or t
  misc_feature (20)..(20): n is a, c, g, or t
  misc_feature (30)..(30): n is a, c, g, or t
  misc_feature (32)..(32): n is a, c, g, or t
  misc_feature (36)..(37): n is a, c, g, or t
  misc_feature (44)..(44): n is a, c, g, or t
  misc_feature (48)..(50): n is a, c, g, or t
  misc_feature (56)..(56): n is a, c, g, or t
  misc_feature (58)..(60): n is a, c, g, or t
  misc_feature (67)..(67): n is a, c, g, or t
  misc_feature (71)..(72): n is a, c, g, or t
  misc_feature (85)..(86): n is a, c, g, or t
  misc_feature (94)..(97): n is a, c, g, or t
  misc_feature (105)..(105): n is a, c, g, or t
  misc_feature (108)..(108): n is a, c, g, or t
  misc_feature (112)..(112): n is a, c, g, or t
  misc_feature (119)..(119): n is a, c, g, or t
  misc_feature (123)..(125): n is a, c, g, or t
  misc_feature (131)..(135): n is a, c, g, or t
  misc_feature (144)..(144): n is a, c, g, or t
  misc_feature (146)..(146): n is a, c, g, or t
aagaanngangaaaaaaagnggggaaaaananaggnnggagaanggannnaaaaangnnnaaaaaanagannaggaagaaagggnnaaaaaaannnnggaaaaanagnaggnggagaanggannnaaaaannnnnaaaaaaaanangccaaagaatcggccaaaaaaatttcggaaaaatacacccctgagaattgacctaaaaattttcaaaaaatacacccctaagaatcgaccaaaaaaatttcggaaaaatacacccctgagaattgacctaaaaattttcaaaaaatacacccctaagaatcggccaaaaaaatttcggaaaaatacacccctgagaattgacctaaaaattttcaaaaaatacacccctaagaatcggccaaaaaaatttcggaaaaatacacccctgagattgacctaaaaattttcaaaaaatacactcctaagaatcgacccaaaaaatttcggaaaaatacgcccctgagaatcgacccttaaatcctgaaaatttctaaatgtacttcatttctaactgcaatcagtaaataaaattgtttgacttaattttaactaatttacatagagaaaacagcaattttaacaaatttcacctctacatttggaattttttcatgcttattttcgcacttatttcgcgcttttttcgcccttatttaagcacttattttggactttttcgcgcttaaaaatccgttccctaattaagacaaattgagaaaaataatttttaaaatcaaaaattctcgtaaataggtaaaaatctaaaaatgtaagccctatttattattacgttggtcagttttcaaatttcaaaaaacaaatgcgcgtctaacatttgcaaatgaaagttggataaaaataatccgtcaaattgattttttattgattgatttgggggtaggggctaaaacgcccggcaaatgtcatcattttgcaaaatatattctcctctgttgcgttccttccattccaaagcactgccattccctttttctgctcgctttttgtcaatgattttcgtctccaattggcatattgtccaacccccgggcccatttgcaacaatttaaggcaaacaaaattcaaaagttgttttgataaaatgtgattttcgttagaatttttggttttccgcttttctcattatataaaaataaagtttccaacgcaattaattcttctgctatttgtgtgacatcattcggaactcgtccaaattgtgctaattgctgccaaaaatgaaccgacggtaaaagaattttaaaagtctaaattcagcattatttagctaaactgttttcccatttcagttggatttgcaacgacgtttggatggacattttcccatcctttgaccgtcctcaactcggcctcaaaatggcacttctttcgccacgtttcaatgcgttggtggacaaacatttcaatggcaaaagcgaattgacaatttggagatcaatcgaaattcgtcgcaaggacaaaggaccagaaccgaagctgtctgtacgaatcgatgacaaatttgtgccatttccaatgcctgacgaccgtccgttgcccagcaaaatccgttttaagcaccttcggatgtggtaattaaaatcagagctatgacaataaaagcattcattcctttttcaggtacatcgatcactccgtcatcgcttttcttcgttcaaatcaccaaattttcgacaaaagaggcacctatttacacttgcggattcaatcatcacacaccacggaagagcagccaatttgggacatttttgttcgtgaaatttggccaattttttcggtaaatattcgccatttggactttgtcaatgctgctgatttggaccatttgcgtcttcgcacttcgacgacaattctcactgatctcaaccaattggtttcaatcgattcctgtgatttgttgcctgattcgattggtgcagagtttgatgcaacaatttctgctggccaagcatgtccaaaaggggcacacaccgagaaaagatggccaacccaaacgat

SEQ ID NO: 12901 - DNA, 3961 bp, Heterodera glycines
  misc_feature (1571)..(1572): n is a, c, g, or t
  misc_feature (3903)..(3903): n is a, c, g, or t
acataagtgaatgaagcaaatgggaagcttgttcaactgaacggcagcggatgatgatgttcatcaatgggtgaccatcaatgggcgcccgaaggctgatcagaacgatggacgtgatcagaagtgatgaggcaaaagccaggaggctttttttcgaggaggagagaaatgctgtatccgcagcattcaaaatttcatattttgtgcataatgtacattgccctactttctcccgaccaatcccgtcgtaaacttatccatctgttcatcccatcccaagccaatcctatccctctcatttccaatgttatcgtgccatttcttcctattcacctctgttgcatatgccatccatttctcttattcccttttgtgttttccgtcattacccctcatcctatccaaagtccatccccattgtaccagtatataagtccatccaatttccccctcgggggctgcgagatgtctgcggtgggtcagtctgtgccatttcttgcctttggcaatcctttcccaaataaccaattgcactgacccacccaaaatgctctgaggttgttgttgagccaaacatattcccggttttcaattcataattatttgtcaatgcttttccttataataaattcctctctcctaaaacggtaatttgaaatggctgaaagccttaaacccggggacacaacactgaccaaaaagtgccattgcccgacccaagggcgatcctctgaacgggaaatgcatctgcatgagtagtccgagaacagctcccgcgtcccatttatcccccaaatcgtcaccccgaaaaaatctttaaaattgttcttaaacctagaaatttcacgaaaaacattttttgtaaaattttgagaaaacatagaaattcaccatggaattttaaaaaatcgctaaaaatctttcaaacattcatgaaattttctcacaaaaagttgaaaatgggcggagttgggcgagtacacggactctctctcacccgtccgatggacccgtccgagcgctcgtattgcaatgagcggtactgcagcgcggcgtgctgcttggagcagctgggatggtcgacggggaagtcggcaattttgcgatcacgaccgatcagataagcggactgacgatgtatgtaaaacaccggtaaagtatcgtcaccctggggagaagtgaatgaataagtgacagagcaccgattgtcaccagacccacaaatttaggaggcaggaaaaatcagcgaaattttttttttttgagaaatgtaaaattgtgccaatccatgggattgaatttatttttgaaaaaaactggctgaatttcaaaatgaaaacgcattgtttttaccttaaacggatataagcgccagcggagtttgggaaatttggcttccggtggttcattgtactgaaaaaagtgaaattaatagaccacaaataacagggagacctaaattttgcatatggagataaaccaagtctttttaaagattccatgaaattcccaatatttcggaaattttccaaagcggtatatttcgactccagcggaccattattgtcttnnagtgtctatttatcgtccacccagccacgaaaaattttttcctggatacgaaacggcatttgcgtcaatttgagttttggcagcgggatggagtgtccaagtctggcgagactgaattgtcggatacaaaaaaaaacaaatggggaaacccatttttgggttggtcggtccaaactcaagttgagtgtactttttcctgttttttacaattgtcaaaaatttaaaaaagtctaaaatttttcattaaaaaaattccaagaattttttttttttaatttttcaacgaattttgcataattttatgatgaataggagatggatcttgcccccccccccgaaatgaaaattttacaaaattttccaacaaataatggaaaattttttcgaatttccccccccaaacgaaaatttaaaaattttataggctattttcgtaacaaatagcacttagattttcaaaatttttcccggcggcgcctatcggcaccgccgtacctccattttgcactattttttacatgtttttttgccgtaaaacggccaaaattgggtcatttttcggtgggggtcaactgggccccaagggccggtcacatttttcttttcaaattgtcaaatactcaacaattatgataattaagggtgcaaatttatgtaaatacatatttaatatttcttcagcaaatgtttcatttcactgttagttatacagtctgttccaaaattatacgttcaaaaattgaaaacatgtaactttttatagggcaagaaaaaatctgaaaaaattcatgtaagtataacttttgatgtttatcaaaaaaagtccattgcaccaacgtgatcagatcactcattcggggtgacctgaaaaccgtaaaatggcttgaaaccatcctagggggttggaaaaatttttcatgaaaggcaaatatgacagacagaaagggcgcaaaatttgttacaaaagcaaaagattccatgtctctacaacttttctacatggagaaatgaaaggtcgaaaaccgagcatccaaaaagtacaggaatccaagggaaaatggcttaaaaatgtttttatctgtaaattatcagatggatgcttagaattttatgaataaatttttgagagatcaaataatttttgacagtatgaaatggaaaatgtgaccggcccttggggcccagtcggcggggcccagtcgacccggtccgtcatttttagtgaaaaagtggatttttttacccagcagcgggaaaattttttttttcattgggtaaatagaaaggtcttcagttgaagagcaaaaaaaaaacggtctcaggtcgggtcgtcccccccccccgaaaaatttttctagatacgcccctgaccttgatcaacactcctttgtacgtgttggtgtccttggccaacttcccgctgggcacaaatgacggattttccttctcctcctccccttctcccctgcgcttttgctgcttctccgcttcttctcctcccccctcctcctcctttttgaccgtgtcgtccccatttcggcttgtcccagccgcccggcggtggctctccctctcctcctcctctccgtccacttttccgtcgatgttcatggtgatgatggtggtgttgctcccgctgttctcgtcccctgtcccgctcccggcgatcttcgtcagcatgactgttgcaaaaaaaaaataaaaaaatttatgcgatagagaattttgaaaaagcaatttttgccgctatttagaaaatgtcagttttaaaaaccacatgggccacttttagtttgccaaaactttttttaagatgatagatttgtaatcagcaatccccaaaactccaagggtcaaatttcatgactaaacatgataaaaaaaaattttttttttaaacttaaagggtaccccccttaacaaaaaaaattttttttttttttgtttgacggcgttttttaagcccttttgtcagtttttttgccaacttttctttccgattgctgccgctttccttggccaacgctccgctgggcacaaacgacggccgttccttcgcctcctctttgtcgctccgcttcttcattagcttgtgccgcaactcctcctcctcttccgcctcccatttctatgaaaaaaaacatatttttttcgaagacaacaagaattaaagttttgggttgaaataaatgcaaaaaaggcaggtttctgtgaccaccgaaattttttttttttttttttgaaaagactattttcaatggaccaaaacacagttaaccgcacatgtttgatagaacctagtcccaattttaacatttttttcactataanacgggttttttgggaagcggtccaggcgttattgtgagacaattgaccgggcccggga

SEQ ID NO: 12902 - DNA, 4354 bp, Heterodera glycines
catgatcacttttgccatcttcttctgatcatctatcacaatgatcacttttgccatcttcttatgatcatatatctcaatgatcacttttgccatcttcttctgatcatctatccccatgatcacttctgccatcttcttctgatcatctatcccaatgatcacttttgccatcttcttctgatcatctatccccatgatcacttttgccatcttctatccccatgatcacttttgccatcttcttctgatcatctatcccaatgatcacttttgccatcttcttctgatcatctatccccatgatcacttttgccatcttcttctgatcatctatccccatgatcacttttgccatcttcttctgatcatctatccccatgatcacttttgccgccttctgctgatcaccttcctcatgatcacaatcaagccctgatcacctctcctctctgatcgcatcctgcgtgccgtttcccatcgccaccccgccactgtgcccccggtgcagttcctgcaatattttcagcagcactccctccaccgacatcgccgttcggctgaactcctgcgccactgtcactgtcctcagtgtctcgaagatgtactcgtcttcgttggttgagctgttgttgttgttgttgctgctgctgtttgtccccgtcggtggtggcaaagggccggtaagtgaccgacgggcggagcaatcggtgggatctttttgaagtgaaatgcatctgctgatgttaacatttgaccaaccctggaaaaggttgacgcgattgcccactctgtcgccaagtccgatgtaaatcaaaatccgagccgcatgatgtttcacgtaatggccaaatttggtgctgtgatttgtgtagtacctgagggttaagccaaaagtcgatctcaattcagagaaaagaaacgactgaccaatcgtcggcggggagaagcatttggatgagcgggtcgtccacttgcatttcgatcaaattgcgatgcgtcgacgagtccaacgccaccagcgcaacactttggagcagcaaacagagcaattgtgggtccaaagtcggctccaaaaggttgaccaatgttttgagttggtggcgctccgacaatttgagacggaactctttgaaactggtgaggaagaggagaagacgagcaactgtggtcggaaagaagcggaatgagcttaagagtttcaatgagacgcaccgagaagttgagtacagtgctgaaagaacggttactataatgtgtggggtcaaggggaggtacggtatgggactcttacatggtagcactggcgccaacgatgggccggcgaacagaccgaacgagtgccagcctgccgattttgcattgtgattgcgttgtgcagcgaagtgatcacttcaatgggggaatgagtcgtaaacagtaaaaaatctatgattaatcaataaatgatatgatcaattggagcgatcgattggttaatccctctctctgcttattcaccgaaactcggctgaatggaggcgaatgccttgtgtaagtcaccgaggcgtacgggctgagtactggtcgtatttacgccatgtttacggtagaaactctgaagaatcagcgccggggctgagctactgtcgccggtctggcggcgatcgaatttgtcctcttgtgggatggacggcctcgaagcttttgttggagtctaacagaaacaaaagacacatttaataacggataaacacaccgtccgaaaaaacgagatgtgtaccaataaatagagagtgccagagaaaaacattatcttttttcctctaattttttgtctccttttggcgtactatctaatatttttattactaggaaaaacaacatttacttcgctatgtttagcttcttttctatatgttagatccataggaaattttgcatatcgttagagaaaaaaattctgcatcgattaatgctgaatttatttttgttaatgctctatttcaaaagttataagaaaaacaaaattttaaagcctcataacttttctctggtacaccaaatcgcttagcatttgcttagaaaaagcttctccttatcaagagctttcgaaagataccaagcttatccaatttggctgacaaaaaccttcaaaaataattcccaaatatcgtgattttttaatattttgacaaaaataaatgaaaatattcatgttgcacaacggactcgaaccaccaccctttgtccctttactatcttacaaaaaccactgagccacacatgcaaatcttttctggcacaggagctcatttcccggacgctgtgtatatggaccaaaaaccttcaataaatcaaaagattttacataaaaatgctatttttgagcctctttcttcataacattgcgcaaaaataattaaatccaatatttccaaaatgaacagcaaccttaaaaaaagagtccggcgggattttacgggagtcccgctcccgactcccgcttttttcggtgaacgggatttttaacgggagcgggatttttacgggattcccgttcgggactcccgtcccggaagattttgaactcccgatcccgctcccggaaatttttacccaaaaacgggagtaaaaatgcactggtaagaattgatttttttggtaaaaataagatttttcattgaaaatctgttaaatatatagccaaaatttcaaaaaaatttcccggcggcgcctatcggcaccgccggatccttaaaatccttaattttattaaaaaacttgctcaatttgcaaaaattggtcatttttgaacagaatctaacaatgtattgtattaaaattttcaatttttttcccggcggcgcctaccggcaccgccggcctccctcctcttccttggtcgccaaaaagtttttcaagaaatacaccgcaaaaaattttgtaaaattaataaagggagtcaaaaatataaagttaataaatgttttgctcgaattaattataaaaaataatttatttaagcaatttgaaaaaattttctgatttttgactcaaaaataagattttttaatttcaaatttctcctttataaatttttctatatatttttaatttaataaattgattgtcctttaaatttgtgcattaaaaatatttttgtgagtttttaattaaattttcgaattactcccgctcccgcccgggactcccgtgtaaaaatggacgggattttaacgggagcgggatttttacgggaatcccgttcactcccgtcccggaaaattttgaactcccgatcctgctcccgctcccgtaaattttttttaccggactctaatttatatattaatgaagcgaaataaattatgtaatttaataatttcatcaaatgatacatttgtttcaactgaaaaatttgttatgagcctttcatcaccaatttaaatgtttttttaaattaaattttgtttatttgaaccataatatttttcatagtccaaattttagagattaattaattaaatagaattttgcttattgacaatttggttgtttttaaaattaattattaattggaacatttaatattttaacaacccaataattgataaatcattatatttaattttaattatattttctctgataatatatttcattaattaaattttttgaaaatttaaaattttcgttggatataggatgcttcgatatgttttgtgaaaatataattgttttgcatgcagtcatcaatgagtgcgagttggccgaacgtccgttgtgcgagcagcgctgtgttgaccaactgatcggctacaaatgcgactgtgatcagggctatcagctgaacaagcaggacatgaagacatgtgtggacattgatgaatgctctggtgaggagaccagaaaggcggagagcaagtcttccccaaaaagaaaatttttaaaaattatcaaaatcgaataatttttcaaaaaaaaaaggtcttgaaaaatttattgagtaaaatttaaagagattttttctatctatttgtaagccaaaaatatacaccataaaaatttgaagttttttaaagatgaagaagaattattagaaattttaaaacgatgaaaaatttatcattttttgaattttcaaatttttcccttacaaattaggtttcaaatttctttgcgaaaaaaaactagctttttttctgaaaaaatctatattttggttatatttttaaaaattttctcgggtggggggatatagcgtaaaattagttaccagtccaattaaaaaaatttttatttatttatttttttttacatttttcagaaggtctctcaatgtgtgccaaattgtgtgataacaaacatggcg

SEQ ID NO: 12903 - DNA, 1198 bp, Heterodera glycines
aaattttgatcatttataaacaggttttcactgaaaattagccaatttataggtaaaatttttaaaaattttttgggaatttaatccaattcttaggggtgtaaaagtcgcttttcgcgccaaaaagcgaaatgcgaaacgccaaaaaatgcgaaaggcgaaacctaggcacatccctggtgtcagcccttacttaattagggtaattgaaaccccgcaaagtacaattcgctttaagcaaaaaaaaaaaaaaaaatcaaaatgaaaaatgctacaagcagttcaattggcacaaacaaattatgtgatgattgcttattgtggtcattcatatatttatgtatgcaacgcaagcgaatcgcggcacggcacggaccaccactcatccggcggcactgctggcggagcacacgcaaaaaaacaaaacaaaaaaacatagagtataaaaatgggggggggaaggacaacgaggagaaaaccatgacatattgaatatataagggccacacaacgacaacaacaaaataaatcaaatccgttcattcattcattttttattggaaaatttcatcaacatcatcattaggtagctgctttttttgtgtgtgtgtgtgtttaaataattttatcagtgctgttgcaacaactgctgctgctgctgttcattgttgagcgatgtcgtgtccgccagtgcggcgatgccgttttttggaggcgttgacgaaccaccaccgccgccgccaccggtgtcaatggcaccgccaatgccttcaccagcgacgtcaccgcctccagcaatgatgccatcgagagtgccggccggtacggcaccaccgacgacagcaccagtcacaaggcacatcaaatctgtaatgttaaggggggagatgtgatgggaaaattcggtcatgtcataaatatgacattactccaattcgagttggcatatgttttaaattttcatgttttttgattgtatccaatcatttgatcgtcaatgaatttttgaaaaaaaacaaaattttaaaacaacagaattaatgttcctaataaaccaaaagaacgagttttcttaaatttaatgctatttaggcgctatcaaggcttgaaaaaaatttcagaacttttaatccgattttggacataggcgcaaatgtcgccatttgaacgtttttttttgagggggtggggggggggg

SEQ ID NO: 12904 - DNA, 2905 bp, Heterodera glycines
gggtggtccatcgcctccctggcggtcaaccgttcctggtgatcgtagcgcaacaatcggtccaaaaagctgatcgcctccggcgtcaccaaatgctggttctcactgtgcacaaagcgttcccaccgtttgcggttatgtctggaataaaagagagattaattgttgattcagttttgaaaaaaattttggtaaggaaacatttttgtaaggaaaaaatctgggaataaaatttggtttttaagaaataaattcaattaccaatctgttacgatttttatttcaaaacgaagccgcaacatgtattcatattttttcaagagtcagaacagatttttattataaatttcacctaaccgatttgtatctccaaattttttgccacagttaaaaatgcctcttaaaaattcagaaaatttgaacaaatctccatcaaagaaatgggtatggaattatttgagttatagaatgacaaatcctttttttcatcagaaattggaaggggctcgggcactcgacggacggacttttgttttttactggccgtccgaggctattcccaaaaatttctttgaaaataccatgccctggcccacggtaaaacgggctttttttatcggaccacccgagcttggtcaactgtcgaacaaaaagcctcggccagacaatcccaaaacccagatctctctaattgtcatggtgccacatttgcattcccctgtctaactttgatgacctgcccaatatgtcattgaagcgcgggtccagctcaatctggtacttgtcaaggtattcaaacagttcatcagtgcccagcactttggcaatgcgaaccaacttaaacagaacagcaaatttggtttaaattttggacaaaaatttcttaaaattttatggacctgacctgatcataattgtcgtgtccatggaagaagggctcctttcgaaaaatcattgacgcgaacatacagccaagtgaccacatgtccaacgagtagtcataacactgtggggagggaagatggatgaacgcattgttacataattataaaaaaatgcagtgaagttttttttaaacaaaattgattgtgagcattatttaactgggccataattgtgtcattttatacgctgcgaatgatctacccttgaagacttgcttggcactttatttgtcccaaagattcaagaccaacgaattggaaaaaaacacacgaaacgttcgaagaattacaagagccggtcgaatgattaaggtggggggaacgggccaaaatctcgccgcaaacaaaaaaactaacctgaaaactcacataggcttggctaggcctaagccttaggctttgttttttaaacttttttattgtacgagttgccattgactcattgtcacgatcgaaaaatgaatggattttttagctgaacacatatttgaaatttcgggcggcgagattttggggtgcacccgattaaggcaccaaacaaaaattaaaaccactcaattcattcattacattgagactttaacgcacgcacaaaaaaaaaaaaaaaaattttttttgggttttagtgtcaacttttgtacacgtagtagcagttcaaccaaacaattcgaagctgtcccccacacaaccaacctggtagtccaccaacagttcgggccccttgaagtagcgggacgccacccgcacattgtactcctgtcggggatggtaaaactcggccaggccccagtcaatgagccgcagctggcgcttctcatggtcaatcatcacattgtgcggcttcacgtcccggtgcatgatgcccatggaatggcagtactccaacgccttgagcaactcgtacagatagtagcgaatctcgtagtccgacagtgtttggtacaattgctggacaaaatgggggaggtataagcaaatttttcgaagaaaaatttttcggattcccattttttggaatggattttcgtacaaagcatggtaacacgtgttttgcactgaaaataagcaacattttgggccctaaaaatttaaaatttcgggtgcggacactcaatgaatgcaattttcaacaaaaaaaaaacgatgaatcattgtatttcagcacaatttctaatttcgacgtaacaaataaattaagaaacaattttccattggcattattggacgtatccaatatgcaaaacggtactattgttatgtctttcttgcccaaatatacgaaaaaaacaatgtgcgtgccaattcagtaccaaatgagaaaattgccgcgagtttccaagggaatatggcacaggaggaggtaaagtaaagtgaaaattccaattttcatacaaatttcctcaacaaattttgcagtatcggcacaaatttcaattttttttttcaaaaaagggtttaggtccaacaaaaattgttagtctgtcaaagcgtgtctctctcattgtttctgtttttttatttctgttgatgaaaatgctctttgccaatgccaaaaaattaaatgccaaaaccttgaagtccgtgttgttcacatactcaaacacgagtgccggcgttctggacaccggatctttgaccacgtccagcagtccgatcacgttggttccgccccgtaaattctccagaattttgatctctcgcttgattttctttttcttcactggctgaaaaggaaaagttttttaagtcaaaatactaaaatctattaaatccaaaattagaaattttttgtatttatttttgtctgttttcaagggtgtccttttttaagggcagggaaatattggaaaatctttacaagacaaggcgcataccgagacaatcggagaaaatgcgtcattaaaaccccaaaatttgcacggaattttgcattaaaatttttggttgggctatgatgcatg

SEQ ID NO: 12905 - DNA, 1621 bp, Heterodera glycines
agcagttgctgtgttgaggaatcaactgaatactgcagttgagcagcagccaatgcagcgattgggaccgttggaactattccttggcacaatgacctatttggtgatcatcggcatcacaattctcgggttcgcattaatttaccatctttattatattaattattagtaaattaacggacggttttcgaggaaacttattttattatattttatcgagagaaatttcataatatccatatacagtatcacaacatgtaaccatatcttactgatgcgtttttaagtataacattgatataaactagtattttatgatagtattaatcatgttttgggtaacatcgatacagtattcatggaactacaaatttacattataccgtccaattataccgtatattttaaaattttcagcaacactttggtcatcctggccgtgttcagctacagaccgttgaaaaaggtgcaaaactactttattgtttcacttgctgcatcggacatgatggtcgcaatgctcgtaatgccattgcatgtcgtcaaattcttggccagtgcgtacagtttaacaatttttactttattttttttgaataattttaaaatttataaattcatttttattttctttatatcccctttaaattgagatttttccatcaaatttaaatcgtttgacatctaatttttttttgttaaatgtatttaaaattttaattaaaaataactattttttaaaatttctgggtgagcccttcaacttttcctccaatttttgtttataaacagccatgtgccaaaaaaaatgcgtgacgaattggtcaaataagcgccattttatgctcgtgggaaaataaggggtcagctgagcgagtgctgacaaaagcattcaaatatttgtttaattaaaaatatattttcgaaattaaatggaaatgataaaaaatttaaacaaaaataaaataaaaatcattttgtcataatttttttttgttaaaatcgtaataattctttctcaactttataatttaagagatttttttgaattattaaaatttaagagttttttaaatatgtcggtctttaaaggcaaaaaaatttaaaagaatactaaatcaatttcattttctgataaaatttcaaaaatacaaaagaattgactttgaaaaaatagtgcaatattatgaaagtgaaggagctgtataaaaatatatattcaaatcataaaaataaccaaatatatcattctcgatttactattttcatgcctgacttttttttaatttgaagttggcacaacaaaatgccaaacaattttttttagatggccaatggttgctcggtgtcactgtgtgccaactgttcactacggcggacattttgttgtgcacatcatccattttaaatctgtgtgccattgccattgatcgctactgggccatccataatccaattgcttatgcgcaaaagcgttcgttgaagctggtcggcggaatgatcattatggtagtttactgtaactttttgaacagtaattctcagtgcatattttctcttagttattttttttaaatttaacggaattgagctatctaatcatattagaaaacacaattgt

SEQ ID NO: 12906 - DNA, 1331 bp, Heterodera glycines
  misc_feature (18)..(18): n is a, c, g, or t
  misc_feature (71)..(72): n is a, c, g, or t
  misc_feature (97)..(97): n is a, c, g, or t
  misc_feature (121)..(121): n is a, c, g, or t
atcatatagaaacacaanttgtaattaatttctggaaatgcgtatttcagttgggtttttacaattgtatnntaattccggaaaaataggcatttcnatttcatactttacaattgtaatntaatttctggaaatgcgtattttcagtttgggttttacaattgtaattttaatttctggaaaatacgcatttcatttcatatacaagtgtaattaaatttatggtaaaacttttttcatttcatactttacaattgtaatataatttctggaaatgcgtattttaagtttgtgttttatattgtaatttaatttccggaaaaatacgcattttatttcatactttacaattgtaatttaattccggaaaaataggcattttcatttcatactttacaattgtaatttaatttctggaaatgcgtattttcagtttgggttttacaattttaatttaattccggaaaaataggcattttcatttcatactttacaattgtaattttaatttctggaaaatacgcatttcatttcatatacaagtgtaattttaatttctggaaaatacgcatttcatttcatatacaagtgtaattaaatttatggtaaaacttttttcatttcatatgcgtattttcaatttgtattttacaaatgtattttgatttctggaaatgggtattttcagtttgtattttacaaatgtattttgatttctggaaatgcgtattttcagtttgtattttacatttgtaatttgatttccggaaaaaaacgcatttcctttatactttaaaatggtaatttaattcccggaaaaacgcattatcatttcttactttctataattgccaattttgcataggtttgggtggccagtgcggtgatctctgtcccgccactgatcggctggaatgattggacctcgcaacagctggtcgatcactgtgagctgacatcggacaaagcattcgttgtgttctccgcttgtggctcattttttctcccattgctcgtcatggtcattgtgtacatgaaaatttttttgagcgcccgaaaacggatcagaaaaaatcggggtaagcgatttggatattatgaacctaaacaagagaattgtttcaagtgaatattttttagtttctagcaataaaattaaaaaaaaatgcaaatttactaaatttttaaaaatacgtcataataaaaattgtttgctgtaactatgctaaaaatcaaccaatttttaattacccatgtcattcgattctctattagcctgccaaatttcaaaaattccttttttccaaagttatcacaaccaaaactggttt

SEQ ID NO: 12907 - DNA, 2155 bp, Heterodera glycines
  misc_feature (2128)..(2128): n is a, c, g, or t
  misc_feature (2134)..(2135): n is a, c, g, or t
tttcaaggattttaaacttagggttattcttgagcaaggttatgaaaaaaatttttgtcaaaaattttccatttttatgacttttaactaattacttacaaattagcaccaaatcaatccttttctcaatttaaaataagaaagatttgccataggtcgcagtgcgctgttcaaaatgtcttgcgagctggcggatatgcagccgaagcacaagcgttcccatcgccttccggtggcggcaacgtcagtgattgcgctggccagcgcgaccggtgcacaaattttacggaagcgaacactgacgaaagctccatttccggacaaaaggggcgtggtcagcgttccggacgttgtgggcgtgcccattccgcacacagtgggcggagtcaacgcaaaaatgcctcagggaggcggcggaatttgccgcttgaccgcgtgtagtgcctcaatgcactcttccgtgttgtcctcatgttgtagtgtgcagcagccgcagttgtacgtgccgaagctggcgctgtacattgatggcattcaagcggaggaggaattggacggggacagcggacacgggggctcaaatgtatgttgggcatgaaaattataaattaattttgttgccgatattttataaataattttaataggtaaaacattctagtttggtttaatttaccaattcccattgtagaaagacagtcccgagaatacggtaactgtcccagcgtctacggtgctaaccaccgctccagctgcaattagtcattcgcctgctgcaaaaagtcactcgctggtgccaacagtcgctgccgctccatcaatggtcgcactgacgagctccgcgagtatgatggcaatggcgagtggtggcgagaggacgccagctgagagcggcacggaagtggcggcccacaaaaaggcaacaagtgatacggtggagctgaaaacgcacctaaaagcgagttttcgagaaaatatcaaagaccgaaatttgtaaaaactctgctgggctagagggttgggaattttctgattggccatgctctggaattctgagaaaaaatctatgaaaatgcctggaccaggggcaaaaattctgacttacgcctatgaaaaaattctaatttggaaccaataaaccccaagatctaagtccagtccaaggatgagctatggaaagtatattccagtacactgaaatatacaatttaattattcaatttgaataacaattttatttatatttaaggagcgcgaaaagatcagtgtggccaaggaaaagcgtgccgccaaaacaattgcagtcatcatttttgtgttcacattttgctggttgccattcttctgcgcttatgtgatcatgcctttctgtacaagctgctatttgcacccaaaggtcaaaccaagatggcatttatttaaaaaaatatatttaaaagaaattcgaaattaatcctaaaaaaacatgggcctccgggattgagttttcctatgtacgggattcgaaattaaaaagcctgtacctcagtggctgggttttacaggcccagggtagggatttcctttctcaagggtcgtaggggtattttggtaaccgaatttttccggaacttaacgtgaaaattttttaaattttgaaaatttattaaaatattttaattttccattttcttttatcaatagttattttgatcaaacattaatttttcttttctcaggttcaccaagcgtttgtttggctcggctatatcaacagctcgttgaacccatttttatatggcattttgaacttggaatttcggcgggcatttcgcaaaattttgtgcccaaagcgtgtgcaaaatgcgcagcgacgtcggctgtcagaacaagcatctgtcaggaagaaacccgcgccaaactcatgatcaaactcattaattttatgtgttattttaacaaattaatttttacttcaaataaaataataaatttcaaattctattaatattttgatgtgtcttaatgtttgcgataattagtatagctaattgcaacagaacgaaataattaacaaaatattgtaattatatagtaaaacattgtctagaaaaggatttttttaatttaaccaggaaatcctaattanacctannatcataaaatctatttttcc

SEQ ID NO: 12908 - DNA, 2420 bp, Heterodera glycines
cagacagagagaacagaaaatttgtggatggatggaacacttaaataaaaaataaattagagttgggaatgccaatgccatgcgctcgctgctgtttactgttcccgccttctcaaattgattgaatttgtgcactcagaaattttgtacaatgaccatgaagccaatcaaaaaagtcgacagtatacccaagaaaaaataaacacaacaaataccaatggtacaggcaataatcccatggtgattaagtgatgactgagattaatgatgatgatgatgaaagcacacaacaatgcatgacaacaacaacaacaacagatttatgtgtgtataatataaatacgaataagtgataatttatggggggaaataagggggggggcgaataatttacagacgacgacgacgacgacgacgaccacgaccagtacaccaattaaatcgtttatttatttatgtgtcattgattgattgatgatgccgcccatggcaatgccgtcgttgttgtcgtcgtccaagtccaacaccagcgcactctcgtcgtcatggttgtctgttgccattgccaacgccaggcatgggatgatgtgggcacaaaagcggtccaacagcgcatcaaatgagggacgtttgtcgggccggaactgcggtttagaaaaacaaaagtgaaatatgaaatggcattttacgagccaaatttcgagagttataaatctcaattttatagacaaaaatttcagaaaaaatccttctaaaaaacacaaaattggtcatgattggagaaaaatttatatataaaaaaatttcaaatattaaaatttacaaaaaaataaaaaaaaatttttaaatagaaattttgtttttaaaaattttctgttccctttcaaaataaataaacactcacgcgacagcacattttggcacatttcagcagctcaattggcacatccgttgggcacttttgctcaaatttagcaaaatccttaaatggacattaaattaaataaaatgtgaaaaaagcaaattaatgacaattatatagtaagtagatcatgcattaaagtactactgacaatgccaaaagatttggtgcgaaacacgcccttgtccgggtcagcgtcagtggcggcaatcatttggcacagaatgatgccgaaggagaagagatcagactgaaaattggggcacatgctcatttaaacaattagttattaatatgaaaaaacaaaaacaataaattattgaaaaaggccgaaatttcacccaactgcccctttttgatggggttgtaaaaatttaaacattttttttaaccaactttttcgtcatagtactgctcgctgagcacctcgggcgccttccaatccgcggtgcccacctgctgcagttttgtgtcaaaattgtccggtattcgggtggccagcccaaagtccgcaacgacagccatcggcaacatggtggacggttgagatttgagcaacacattctgtgaaagttgccaacttttttgttttatttatctatcctcggcgcaattgaatggaattatatgggcgcccaaaatttaagtaaaaaattttgtagaaaaaatagtaatttgaaaagtcactctgcaggggaatgacgcctaaaaaattgtccaaatttccccaattatgaaattttcaaaaaaaaatttttatttgggagggaaagatgttggagaggtgccaataaaaaatcaaacaattgcagcaaaaatctttccggaagcaactcattttaccttgcaaaattaaaaaaaaatcagttggaaattttcaaaaaaaaaatttttttttaaaataatttttgactttttaaaaacttccacacgaggagggggggggaggacttattgcacaactcctcccgcctcttaccatgctggtcaggtcgcggtggaaaaatcctttgccatgcatgaaggccattgcgtcgctgatgtcgcgagaaatgtgcgcaatgtgaagccacggcattgcgggcgccgccggtgccaatgccaacggcggatcagtgccgacaacacaagcgccgccgccgatgatcgcctgctgcaaagtgccacggtcacagaactcgaccaacaaattcagttgccaatgtccgctggtctgatccacgcaaaggcctctgatttaaaaaaaattttttttttgaaaaaatttatattctctgtaatgctattttcgaatatttggtggtggtacttgattggatatacttcgttttcccccatcccgcgtcttttgccccaaccccaaaaaaacaaaaatttattttataaaatataaaagaaattttcaagaaaaaaaaatttaaaaatttttctatggctttaaaaaaaatttttttttttgtcttgcatcaaaacacttttaaaattaaattttattact

SEQ ID NO: 12909 - DNA, 1115 bp, Heterodera glycines
agtaacactgccaagtgtgcgaatggcctaatggctagtctccttgactttcccttcttctttcccctggttcaatccctctacagaaattaaattattttcaattttttttttgtatactcgtgggtttcctataaagaaaatatgattcctcatagttttttaaatggcacatattttatcattttttaaatgaaaatcctaccaattgagcttaataatcgcaaaaaccaacctttttttgttgaaaatctgttaacaaattgcacccaaattttcaaaatttcccccggcggcgcctatcggcaccgccggaccccttctcccaaaagttttttggaaaagcgctccgaaaaaaagtgatgtgaaaatcaaatctgaatttctattaatattcgatgatttagtccaaaaatgattaattgtttgaaataattgaagaaaattttcattaatttaatttattaaataaaaaaccaaattattttgtattattttcacttgatataaattaaaatttgaatttttttttaatttttaaaatttttttgaatttttaaaatttcccggttggtcccggttcccggtttttcttgcggtcccggtcccggtcccgaaaaaaaatcgaggtcccggtcccggcttctcaggtcccggcaagtcccggtcccggttttggcaaaaattcccggtcccgtggcactctaaatagaccaaataaaaccattttatgctcattttgaagggaaaattctgaagaatatttcttaattagtcaaaagtttaaaaaaattgtttattggcaaaaaaatgaaccatgtgttatttgaaaatgaaatggcgaatgctgctggtcgcaaaaatgggccaaatttcacgggcaaaaacatcccaaattggctgggcatctttggttttttgtatgatgacacagacaaatgtaaattggaggtgccctttctgtcccaatgttgcatgttataagcgcgaagcgcccgtatgagttcaatggatttaaaaaacgggcgcgaagcgcccgtccaaggccaacaaaattagaaaaacgggcgcgaagaggcccgactgaggccgcgaagcggcctaacaaactaaaa

SEQ ID NO: 12910 - DNA, 1511 bp, Heterodera glycines
gggagcaaaattgaagagctggttggggtttgaaaattgtgctgaagaaccaacaaaaaaggttcactgccgagccaatttcgtttgtccttcctcaagcaagagcactacacgatgagttgtatgaaatgaaaatcattaaccgaacagtggagacaattagaaagacactttactatgcggttgaacggcgcttttttgagctagcgaacttgaagtaaaaaatttaacttaatttaaattaattttttgtcttagggaatatgcgctggccacttttttggatgtgcgattcaaggacaaagtgctgactgaaaattccgcaacttttcgcgctcgagtcactgtctggatcaaaaatgaagtgaaagaatggcaagtggaaaatgacatagacgaactgcaaaatgaatttgttcgtcctgtaatttcgccacagcccgaaaacccgccagctaaacgacgaatgtcattttttgaacgtctgaaaaatataacaggagcaagcacaagtgcacagggtgatttggtctctaaacattgaatttataatgaatttaagacgtccaaacatcgcaagacgatgacattgaaaaagaaattaaggaatttctcgcgctggaaattgcgaacccagaagcaaatccgttagacgaatggaagaaaattgctccgcgattttcaatccttgccaaatttgcagaaaaatatctttcagcacccgccaccagtgtcccaagtgaacaaacattcaaagtcgcccgtgatgtttttgattatcgccgttccaaattatcacccgaaacggcagaaaaacttattttttttgaacaagtctcgtccccagatgaactacaattattgaaactatttatttgttcatttttataaactgttatactattttgtacttattattatgacactgcgggttttttcccaaattaacttggaaagtttaaatttttaccaatccggttccggatccggcaatttgaaaaatagggattgaccggattacatagattgaccggattatgagagaccggatcccgaatccggtcatttttgaaaataccagtccggtccggtccggtatttttgagaattccggtctctagaatatatacacctttttggaatttttatgggtttaaaacatatattttggagtttttagtccatattttggtccatatttggccatttttgagctttttaatccatatttcgggcctttttagtccatataatttacaacactaataatagcacagtttttaatgtgaaattactgtttttcactgttcatataccttctctaaattttgtgttttttttgctctctcatttttcctaattgtctatgctttaagttaacacagtttttttttgccctttgtgacacacaaattaaattgaaaaaattggtgagacctgtgctgattgaaccacaaaatgaaccgacggacagcaaatatttgaaaaattacggattttcatttaaaatt

SEQ ID NO: 12911 - DNA, 2114 bp, Heterodera glycines
aaaacgatatgatgaaatgactttaaaataattgaataggaaaaaatccaaaaatcattctttgtttttcatatttctttttcttattatatttaaatattctatctttctacatatcaaaatactttttggaacacaggtcgcatcagtaatgccaagtgcaatcaccgatgttatgacatgcgttgccaacaatcttatcaatgaggcggtagattattagtgttattgaatcaatttcaattcaaaagcagttatttcaataattaaggatactcaacgtatggaaaagttattgaaagaactggtatatgtggctatactgaatttagtgcacaattattggacacttcgttggggcataaaatttttaataataatattttttaaggtcgtcgtccatcgaatatttcgcatttattgacgatgtaattcttataaatatggtttggtcacttgaatctcctcaattccacgctaatggttctttggcaatacgcctacatgactgcataccccagcagcaaaatgctatcatattacatgacttcacgttttttattcaaattttctatcgctgtaattagtcagtttttttttattttttttctattttgataatattttttttcattagtttatttgatttatctcagtagttgtattcaattcttacgtataatttttgaaatatttatcattgtctgaagatgtgcgggatttcaggcgggggccgaaggccccccacgaggccgcgaagcggccgagtgagtaccttgggcgcagaaaaattattaaggaggagggttcattatttatttattttttacaaaattaattcataagtatatttacagaaactgctctgaaacgcaccaaaatttatttacaagttgaataaggcactctgactcttatattatcaaaaagggagatgaataaatattttaaaaatttttaattcctttttaaacatgccaaaaagtttaggcttaactttttttatataacctgatcagaagcgcaccagattttgcaagggcatcaaaaagacaaggaaaagcaccgctatgatgctaacgccagtaactctttatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggatttttttttggcttaccaaaacttcatcgaacctggctctttttaaacatgccaaaaagtttaggcttaactttttttaattaaactgatcagaagcgcaccagattttgcaagggcatcaaaaagacaaggaaaagcaccgctatgatgctaacgccagtaactcttaatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctataaagcttatttcagaaaatctcgcatgaattctcatttttaaatttttatagatttttaaatggttgcattttttttggcttacaaaactccatcgaacctgggtctttctattctctttc

SEQ ID NO: 12912 - DNA, 2124 bp, Heterodera glycines
tcgctgctgtggcggcccgtcgcagcacacctaccaggagcgcgttgtccgcccgcgtgtacgtgcacaaccctgccgaggcactgtacttgtgcaggtaatgatgatggaatggcattaaaacgcataattaatcggaatagagcaattctatattagttttttaagattttttggtcttgagtcccgggattgaccgaattatatgcccggtttttaaagaatattcaatttcctcggcacttttttgatcattcgctttggcgccaactttttgaacaacgcaaacattgccgggggcaacaaagaggagacgcagcgccggaggggccgcgcggccatttgtgcccttttggtaacagctaatccacataagtttgctgcatgaacccgttggttttcggggtcgtttatcacgaatcaggcacccaaaaatataaaatgccattatcatgcaattatatttaaaaaatatatattttcaagtccttaaattgacaattgccaaaatgaatttatatatttgatagctctaagaattctccatttatctttaaaatttcgatgaatttcactggatttcaaaaaagttctaaacaaaaaattcatgtttaagttttggaatttaataagcataacttttttatactaattaaaaattttaaaatataatattatgatagaaaacaccttgagttattgaatgctaccatgaaatattaatttggttgaattcgagacaagatatgattttatttgctttacatttttttattttcataccccttggcggtttttaggaaacgacctatcaccatttacggagtgagcattcctggctcgagtccctaatccgtttttttcgtgtgctcaatggccattcagttttatcacttttcaatttttccagattatttctcatcgacttttaaaataaaatgagcaatattttttagctctgaattttgtggtcaaaaatttaaatctaccccattttaatggatgatgcccaaatttattggcacttgccaaatgaacgggggaactgttcaatttacaaaatttacaacaataataataaattccaacaaatttcaacattttgcattgtttttgatcggcccaaaattttatggacggtaaatgcgcaatttcttcacaatttgtgctcgacaaattggacactttttgtccgcactcttctcaatcagttcagcgcattgttcacatgcgcacaaatggccgcaggggtcaaaagcgaaaaggcgctaaatttttcaaatttattttggcatttatttcaaaaaaaattattattttaaaaattttatcttttttttagattaaatttcaattttgtttattctatgttaaaaaatcttttaatattatatataaattcaaaaatatttttgagtgaacatgatctttaatttaattttatttttgatttaccaagaattctttttttggcatttatttatgagatttttacatttgtttggctttaaaataattattattttaaaaatttcccattttattaacaaaaaaatgtttaaaaataatttattttaagcaactaataaaaattttattgtataaatttttacccaaaaaattcattttttgggtaaaaaagaattatttttctcgaaaaaaataattgttataattaattaaagaaattttcttttttgtacctctcttctcatgcaaattacacattttgttggtgggcaaaactaaagttgtttatgtgctaattgtacgtttaattttttttccccacaaatttttacccgaaattttccattttcacagttttttctttcccaataaccaattgtttctttcaaatttccaaccggcaaatttttgaatgacatattgttattaatattttcacaaattttgtccaacaattctttggtgccgccaatgccattaatttggtccaatgtgagggcaaacaattctttggcatttgcaaacactgagcctaaataaaataacgcaatggcattggatgattcaaaattaatatttttagtaaaaaaaaaacaaaaaaaaaagaattttcggcgctctgtggaaagtgacctattttgaaaagtgtttcac

SEQ ID NO: 12913 - DNA, 2340 bp, Heterodera glycines
  misc_feature (32)..(32): n is a, c, g, or t
aagtgacctattttgaaaattttttcactttnttgttcatcattctatatcaaaacaaacaaaaaaaattttgtcaaaaaagtgaaaaaattttcaaaataggtcactttccacagagcgccgaattttctattttttaagttataaaaatacgattaaaattttttttttgtcttcgtatttacccacattggaaatttatctcctttttgccctatgtattatgtgcttcacaggaatagaagcggttcgaaaatttttaaaaatttttggaccagaattctgggtttttaatgaaaattctggaattctaaattgctaaagaaatgctttgtttgttaatataagtaatttcatttttttgtggtgagaaaatttaacaattaatcgaaaatcacattctaaatttacttcatagacatcaatcatctgtaattttgtctcaatcgatctttttctaagaaatattgaaaaatatttattaatggaaaaattttgtagattagcaacagcaaaaatgtaaaaaaaaattctgttttgttttttgccattttaggatatattaaaaaaaattcttcgatgaattcatttaaataataataattataataatagcattactgttctaccaatgcaactaaaaatgttcatctcatttgtcctccatttccaccacgtgtccattaaatttgcgcctgttcgagcagcgaaaagttcgaccgacgcgtgcacaatttgggcactttccgtgccgagttgggcgcgcggcaaaaacacccaacggcgaaacgcctcaatgacccgcgcattgtcggcaaaatgttcggctttttgttgcacatttggccacagagtgcaaaaggggtctatcattaaaaagtgctaaatggaggagaaaaaagataatgatggaaatggacaatttataaatttagattttaaaaatatatgggggcaaatgcaccaaaaatcggaaaaaatgcaaaatattcaattatttgtcaaaaatgaatttaattaatttaaaacatcggaaagtgccaaaacatgtttcttgcaaaaaattgagcattaatgcttttgaaaaccaaaaaaacaaaaaaattaatccgttatttaaattttatttttacgctcttttttttaattactcaatatggctctgatttacatgggaaaattgcttataaaatagacgaacatactaaacatttggaatccaaagaagttaaataaaatgattattatatatttcactttttttacaaatttacgaagattaaataacgaaaaattgaatttataaatttatgagaattaaattttaaaattcctttttaaccaactttcaacttacttttgtactttcttctatgctttcatatttcattaatttgtgccattttattttgcataattcgttgatgatcggcacaatttgttgctggtcaaccaatcgcaaccgtttccataattgcccctcatttgccgattgtgccaaattatgccaaaacaagtcgattaggttggcatctttcaagctgatttttgtgtcattttgccgatttttagttgccacttcaattaaatagtcaaaattggcggtaagaaaaaagtgttccttaacaattcagttaagattagaatacaagctgaaatttttttttattatattgtatcaaccacctaaaaaagcatcaaaagtgccagaataaggataaattaataaaaaaaattatttataaaactttttatttattaaataataaatgtttttcaacgaaatacataagtaaatttttgatacatcttcattttttaattagggatatattgttattgaatgtcatatttttgggattggtgaaaaactcttaaacaacttatagaaagacaaatcgtacaagttttactaagcctaaaggcttaagcttatgcctaagctttatgctccgtttcggctttgcttgttaatttattattgtacgaattcccattgactcataaaaattaaatgttcggtaaaaggcacaaaaattgtcaaaactttttcagaagtgcgaaattctttggaattttttaagctaattgaaaatacactttgtaaggcctttcgaaggatatcgagaagattaattttggttgcatttgctaactttttttttaccttatcggctaatgtccaactgaacttatcataaagccagtgattcagtgcgcttgttgcgctgtttttccactgatcagtgctctcaaaatatctgatcagacaatgatcgccagaaaattcgcacaacgaatcgacgggcatccaatttttaagcagaaaaaatgactcta

SEQ ID NO: 12914 - DNA, 1727 bp, Heterodera glycines
  misc_feature (1720)..(1720): n is a, c, g, or t
gggggggggtcagccaagaggtcttacgatcgtctttgaccccccccccatgggggttcagagcccatttccattacgatcgaccatttttcaaattttttttctagtgagaccttttttttgcttttaagctacaaaaattgacgccgcgatgaaaaataggccgagttttcaacaaatttatagttttttgatgatcacactaataataataaaaaaaattcaatctttctccgcttcaatgaaatttaaaaaaaacaatcatttaaagtaagatggtttaaagaaggccatttggcaagtggaactgaattgggtgctagaaaaaagtttgaagggttaagaaatgaaccaatgctctctgaaccaattttgatgtttcctgacatggaaaactacgatgaggatggttaccctgtaacggaagaaattgatgctcattttaaagaccccgaaagaaatgttgtttcacaaatttttatatagaattttgcataccgggaaaatttttaacatttgagtgtacttttgtaaagattttcaccaaaaaagaccattttttgaattttaagccatcttttttaataaaaatataggattttatagaagatagggaaaaattgagattagtcgatcgtagaaattttttcaaaacacgcaaaattatctcctcttacgatcgacaattttcctcacaaatcggtattagtcgatcgtaaaaattttgaatttttaatgaaatttgttaaaataaggcaattttccgaattgccaatgagaaaattttataaatttctgttttttttattaacgatcgactttttcgctgacttttttttctctccctcatttttcttttctccctcttcctcccttcacccaccccccaactttcctctctcctttcgaaattcattttttcaaatcgcattctcttccaccagttctaatcttttttctatttcagaaattaatgaaacaaaatctttcgaccttttaggaaattagttttttgattaattgtcattttacaaaaaaatgccttaaagatgaaagggtcggggtctggtgtaatcacttcatgtaatccatttaatgctaataatggcatttagttaaaattgaaaaaatataaatgttaaaccaattttggcctctggctcatcccatgccctttgctttgggttctttaattatcggataatcccaattttaccaattgtcttatattatatctatcaatttgttggcacagtcactgatgtgctgatgcacatgatcactctgctcaatgacaaaaacgactggcgagtgcgtgccgcgttcttcgaggcgtgcccggtgctggcccagcacatgggccagaacaggaacagcaaactgatgccattccttcagcaagtgtgttcagggcgccggggcaaaatctcgcattcgagaccgggtgcttttggcgggatttgctcctgatttccgggccccctttttggaggaacagattgggaccagaagtcccagtaaaacgattcttttacctagtcccggggcccggagcagttcgtttcccgccccgaaaattaaaaaaaaatgcattacataattttttttttttaaatcttagaaactttttttctaagaaaatatcacaaaaaaattttttaaattttttttcttaagttttcaaaattttatgattactaatttttccaaaatatctctnagaataa

SEQ ID NO: 12915 - DNA, 3340 bp, Heterodera glycines
  misc_feature (1912)..(1912): n is a, c, g, or t
ccaaagaatccaaaaatacccattttcatcgaaatttttgtctcggtgttacaaaaactcggagctttctcatccaccgcttacatcgctgcagtccaacggactcaaaagagtggcgagcattttggcgtgggcggtcacccgattcttgagccgttgccgctcgttgaacacattgtcacagaccatggcatactcacgcaacgacagcacaaaacagcgccgaatgccggacaaacattggagatggacgtaggcaaagtccgattgggggtccaactaaattttaaaaaatggaaatataagacaatgtatattgaaatgggcaaaaatttaaatttttaaatcagaattacctcaagtgagcacgaggggacggggccgacggacgattgggccgcgcttctgcaaaacattcggcattaaattcacggaaatccaatcgcaaattagaaaaattcgttaaaaaatataaatttttggaataggaaaaagcaactaacttgaaaatgtgcatcaaactcttcgtggccagccgacagaacacttcgccgtccggccccaaattttcgcgtgccctcagccggtcaaaaaactgacggcacagtttcacttttgcgtaagccgaccgcgcggaggaagaggcggacagcatcaaaccgtcttcggtcggttgcaacagaatttgctcactgaacttggctaaaacggtgataaccgaggcgaagtgctaaaagtgggaaaaattgacaattttagaaactctcaaaaacttttgacgagcggaagaaacctttaagttctgctcaataacataagtgtagccattctccaagtgaatctcatgcactgaacgatctttgaaggtcacttctggggttgggctgggcatattcctaggactaaaaaaagaagttgtttttttgttggatttaaagtaaatcaaataaattaaagctaacaacaagaaacatctctattaattatggaaatttgtgggtattttctcatcagcaaaaaaaacaaacaaaaaaaaaaacaatgtataggtgagataaggacgaaatttgtaaagtatagaaaatgaaggatttaaaggatttatgtgaaacaaacaaaaaaaaaaagaaagaaaattaaacttggctaaatgtaattaaaattttgaaaaattataaaaaaatttgaagggctctcgaatgatagcaaaattgttggatttggttgacaaagaaaaaggttatagtccaaaacatgctggtgcccaactgaggtaaacggttaatgaccatttgaaaaaacgtgaattagaatagccttatcattttaaaaaaaaatgtaattttctattttttcaccgagaattgcatcagactataaaaaaacgacgtggctttttgcttcctctaaaaattaattatttaaatgttaattcataaattgatttgttacttccctttattttgacttcatttcataaaatttctatctttataatataaattattatgactatttcaatttttgttatacatatataaaaaatggttgtatttttctttggaaattatgaattttcctttttttttttgcttttgagttttctacgttttggcctacctgaatttttttttttgaatatttttcctgcgtaaaagtggactatgatcacgaattttatattttagatcagtgatcagtgataaattttatgccaggaaaaatatttcaggaaaactcaaaagaagcttttctatcaaaatttccaagacaaaccaaaaatatttattactttatacaattttagcggaaaaatattaaattaaaattttttaaatttcttaaatatattaaggataggaaatggaaaagtttgtaaactttttttatcctcaattttttaaattaattnttgtcacagaagaataaatggaattcaaaataaagaaacgaaaaatgctttcttttaatttattatttttaataatttttatttttattatttcttcgaattttgcgttcgctggcaaaagcaaaaaaggcaaagaaaataataatgcatttttggcacatgaaaaggagcagcaggaagtggcagaaacaagcacaaaatatcaatgcccggaaaagacagaaagaattttaatagataaaaattgtgaaaataaataaaaataatttaatttaataaaataaaaaaggctttaaaaggaatttcaattaaatttttaatttttaaaaatatttgttaatcaaaatgttttttttgagatgagagtgatgacttagttcatttggtgacccttttcaaaagtttaattgtcaaatttattgcggctgaaaatgaatttatgaaaagggatttgaaaatttttcaattgaaatcactgtatttttttatgaagcaaataattggcgaaatgttcgcttttgcgattgaaatcggcacgaaaatggccacagaaagcaataccaaccaatggttttttgatgcaattgaaacaatgcgaaggcgatggcaaaaaattatggacaaaaagcaaaacagtgaatttgaaagcattggcgacggcacaatttgcaatttgtacaaatttgggaagtcatttgtccaattgttggaaaaaagcactgaaaatgaggcaaaatttgagaaaaaagtgcaaaaatatttggagaaaaagcgcataacgcaattctttgcttcggtgaattgaattttaatcgaattaaaaaaatttttggaatttattttgaataaaaaatatttaaaacaagtagaattttctttcaacatttaaaaatgactaaaatattgacttaaaactagagtgcgccgggaccgggccgggaattcccggtcctcagaggtcccggttcccggtcccggattttgaaaagctcaggtcccggtcccggtcccgatagggcaaccgggaaccgggaaaaacaagcactggtaagaatgggggtctgagtgaaaaattagtgatgaaaattggagttaaagggaaaaaattttaaaaatatattaatatattctttaaaagtaaccctgagaattgtgcgaatggcctaatggctagtctccctgatcttcccttcttctttcccctgggttcaatccctctacagaaagtaaaatattttgaattttctttttgtaggctcatggctttcttatcgacaaaatatgattcctcatagtttttttagattgatacatattttatcattttttaaatgaaaatcctaccaattgagcttaataatcccaaaaaccaatctttttttgttgaaaatctgttaacaaattacacccaaatttcaaaatttcccc

SEQ ID NO: 12916 - DNA, 4622 bp, Heterodera glycines
  misc_feature (4541)..(4541): n is a, c, g, or t
  misc_feature (4548)..(4548): n is a, c, g, or t
  misc_feature (4612)..(4612): n is a, c, g, or t
ataggttttcaaacataaaaaactttaaaataaattttttaaaattttttcttgaaaaaatgaaattttatttatttttttttcggcgacattgtcttatcgacggcgactttctgatgaaccgaatttctacatataattgatgacattttgctggttttttccaaattaacatgtgaaaatttaaacttttaccaatccggaatccggttccgaatccggcaatttgaaaatctgggttgaccggattttgagagaccggacccagaatccggcacttttagttgaaaattttgggggttttagagcctaaaaatatcagcctaaaagtcataatgcgtagtgttcctataagcatgaaagtaaaccatctttaataattatatttaggaatttaactgcaaataatcaatttaaaattatggaaatgaattttctgaaaacaatacaaataattgcgtcggcagaaaacaaattgatcagtgaaaagtgtccatcatatattaataaagaaagtaataatgattttttcaaattgctcttcacattggcactccgtctgggtttgttcatcggatcaaatgaatttgttgaacaatatttgccggctttattaagtcaattagaattacgcccaaaaaacaataatgataagttagtaaattaaaaaatatataaataatattaaattaatatgagattaattattgggtaagaaaaatacgcaaaatatgtaaataaatattaaaatttccggattaaactcataaatgaacttttgataaagtaaaataaaagattttttaataagtttttgttttaaaaaggcaaaaaatgactaattttatctttaattacgtttttcaatcactcagttaatgtcaaatctggcatcatttgaaatatctaagtgtgtttccacatttacatgtcaaaatataaaggaatttcaatagtaaaaaagttatggcatgtggcgccgaaaaagcaaaaaaaaaaaaagtcaatttttgatgtttttagacataactttttttttgtaaattgacgatgtaatttgtaggctaatagagaatgctatcgcatgatatcaaattggttgctaatgagaaaagttattaccaacagtgccgaagtgggcgggttccccttcgtttgggaaaaaggcaaaaattatttcttttattctacaaaaaaaaaaaaaaattttcagatccaaatcccggattttccccccgaattccttcccgacactttttttttgaaaaagaaaaattttggacatttggccaagaatttgagtgccaaaaaacatgtaaatccgggcctggcgatgtccatttatgcgatatccccgtttggtttagatatatttacgcctacaatatgttcaattacaaaatcaacgttgtgaataatgttgtccaaatcaatatgccgaattggaatttgccatattttgtgtttttggatgatccaaacgaattaattgatcagaaatcaaatgaattattagtttatgaacatcattcgaaacaaaaatgttttgtcacacaagattataaatttgataaagcattgcccaaatgtgatccaattactttgtatgaattgatcaaaatgacaaaaatcattgtcgaaatgcaaaatgatcaaatttggattagcccaaaggacccggaaattttgaaaatcattgtaaaatttttgaattatttcgatattgaaaaaacaattacggaaagaatggcattttctgccgaaggcaattattgcattttggcacaatttgtgatggatttgttggagacagcaaacggagcaaattatttgccagacattgatattatcgaaatatttgttgtacagacgaaggaatggtgtacagatcaacggtgggaattaaaaaaaaactttaattaataattcaaacggtgctatgacgttacaaaatggatgtttgtcaaaaaccgtcaaaatgaaagattttttcatataactttgtttaaaatggaccaaattttcattttttatatcatttgatagccctaagtgttttctataaacatgcaaaatttcaaaaaattcgttaagcttcaagaaagttatgaccaaaaatgttcaaaataaaacttttttgttttttgagttcctcagttcattttttttgaaatttggaagtctaatagagaatacataaagctacctaattatatcaagatttgaaaatttggttaattttgtgcagagttctgaagaattttctgtcaaaaaattttccatttggttgttttttgactaacgcccgccccagcaccactcaaataaataaaataattaattgattgtgttggaaatttaatgagtatttagaataaatgatgaaatcggcaaaaacaatcacggaaagaaaatcatggaaataacaggaaatattaagatcaattaccacctccaaaatggtatgtaaaaatatataatgcgattgtaattaaattcaaaatttttcaaaatagaaaatgagttttatatttctataaatttatctacataataattagggttcgaaattgtatggttttacatattttttctgcgcatatgctatgaagaaaggggctcaataaaacatttttacgttaacattttttgaattggtgaaggtttttagtgcatataaaagcatattttgggggttttcaagaataaatccgtattttgccatttttgcatttttaaagcaaattttgggaattttttggtaaattttctcaagaaaaatgcaaaaaaaaaaacgaaaaataacacacctaaggatcgatgttctgatttttacacaatttttggcacttcttttttttaagggttaaaagcaattttgggcaatttttaagacaaatttgagggatttttagtacatattttatgcgcatttatggcattttatagtgcatacaagttcgaaccctaataatgacattttcacagatataactcgaataattctccctaatttgattgggtgctgggacgtttcttaaaaaccgccacattgggcgtttcttaaaaccgccagggcgtttcttaaaaccgccacattgggcgtttcttaaaaccgccagggcgtttcttaaaaccgccagggcgtttcttaaaaccgccaggtgggcgtttcttaaaaccgccactttgggcgtttcttaaaaccgccagggcgtttcttaaaaccgccaactcatatgattatgtatataaatatatatatattagaagtttacataacaataaaaaatttaaaatacatatgcatatctattgacggtaaaataaaataattatttttatccttctttaaaagttctcaaaaaatatgaactgaccagcataatatattctaaaaaataaaatatttaagatatgagttggagaacagacttttgttagaaagcaattaggatattcattaaggcaattgcaaaatttaatatcacaatcgtaacgtttctgatatttatttatgtagcacacatcgtggttatagcaacaattatcaactgcaaaattttcgaatataaaattgctaattcgtaattcgtacaaccaaataaaaattaagtaaataattgtaaattaatttaataaagatttttagtctgtcactgctagactaataatatttccggctgacacttacttgcacaacaaataaaaattaatagatattattgaatatttaatttaacggatatacatacataatcatatgagttggcggttttaagaaacgccctggcggttttaagaaacgcccaaagtggcggttttaagaaacgcccacctggcggttttaagaaacgccctggcggttttaaaaaacgccctggcggttttaagaaacgcccaatgtggcggcttttaagaaacgacctagcaccaaaaaaataacgtttagtttaaatgctttttatttatgcatcaaaaataatgaacatttatatatacttattaaaaatttatatttgttttcctgctggctttatcataatgttcctcctataatagtgcaaaaaattttgggtcagattttaaaatgtttttgtatttttaattaattttttaatttaataattaattcctccaatcccgtcataaatttttttaccaagatttgaattttattttttattaagacagtatttaaaatcctccataatataaataaattttgtgtaattgaatatattcttttacatgatatgatttttccactttatttgatttataagctttttaattttgtttttgtgagtccgttgtcgctgatattcttccttaatatttttgggaaaattatttttgttggtcattcattggtcctttgttaaacttttgatgttagaaatactcaggaaaatttaattaatgttaaacataagtaattttaccgattcttattttataaatttgatttttttcttaatttcggtataattttttacccatttcatgtcattatttgtaaaaaaaaattattgcgattnattttanaagactttctgatatttgtattttaacaaaaatcttatgtttccttatattaaaattaaatggntaattatttt

SEQ ID NO: 12917 - DNA, 1553 bp, Heterodera glycines
acaaaacgctcggccttttccatccgccgcaattgcgcctcctgcgaatgccatcggaaaacgactgtacgtgctgcttagcatgttgccagtttaaattccaaattttgaatgttttcagtttcgtttgaccattcaaatgagcttgacgagcgcgtctattcgctggcgtttccgctcaaacgcaccgacaaaatggacgccgacagttgcggcgaaccgtccatcattgacacatttgcggaggacgacgccgaaggcggtgaatcgctggcggagaaaatgcgtcaagcggaagtgcagaaaacactgtttgccaaatgcaaattcttcctgaaccgggaagtgcccaaggaggcgcttgcctttgtcatccgctccgggtgagcattaaaaagtcggggaaaccctttggaatcaaaattttctcggcgtcattttataaagaattatcggtctgtgttttgcaaattgaaaaagacattgaactgagtacctaagcctatgtacgagttgtcatgacaccaatgaaaaatggtttttttcgtatttgacaatttttgagattaccgttgactcttttttcgtttcaaaggcgcggtttcttatacaacaaaaattttaattttttcgctttttaaagttttcctcattgaaattcgagaaaaaaaaatcctagcatgataattataagttaactcttttagtgggggcttcgtctgttgggacggatgcgccccgaattcggttgacgaacacagcgaacagatcactcaccaaattgtggacagaaaagtggagaagaccaacattaacaggtcatccataacccatctcttatgaaataaattcttgcggttacacggtctgtggataacacacaaaataattcgtgcaggcgttgaaaaaccgagttttgacccttacaaattagtttttcaaaaaacctaaaacaactaaattttttgaaattaaaaaaaacaaattttttttgttccgacatttagtctcggcgacgttttgaggtgtacccagggtagggaacgtaatgcactttgcccagttcattcattgccctgtcaccccccttatcaaattgcttattcgccctgttcagagtgtacgtgcagccccagtgggtgttcgactgtttcaatgcgcggcgcattttaccgccggccaaatacgcgccgatggccacgctgccgccccatctttcgccctttgtcgatgcacaacatttggaagtcggcgccggtgcttacattcccttggagcgcattgaacacgcaaaacaacagaatggaacgggtcagtcactaacaaccgtatttgctctttttatcccccatatccattaatcccccaatctccaattatcccccagtctacgaggcgtttgaaaaataatcccccatgggggataaaaagagcaaatacggtaaccagttttggggaaaaatttttcaaaaatttttttggggaattaaaaattaaaaatttaaaaaaaattccaaaaaattggcacaaaaattttttgaaaaattctgaaa

SEQ ID NO: 12918 - DNA, 1957 bp, Heterodera glycines
aactagcgggtgcgtgaaccgtcggctatttagctgggaaaaagcgcttcgcgctttgggagcttcgctacctagataagcattgagtttttttagagatttggaatttattttaaaatcttaaggggttttaaggccgcttcgcggcctcagacgggcgcttcgcgcccgttttttaaattgttgagctcatacgggcgcttcacgcccgttttttaaattgttgagctcatacgggcgcttcgcgcccgtttttaaattttgatgtgcattttcggccgcttcgcggcctcagacgggcgcttcgcgcccgtttttaaaattttgttggaccttttcggccgcttggcgcccttttccaaagtttgttgagcttggacgggcgctacgcgcccgtttttaaatatggtttggaatggacgggtgcttcgggcccgtttttgaaattttgttggactcatacgggcgcttcgcgcccgtttttaaattttggttatcagaagaggtacaaaaatgattagaagaggtataaaagtgattatgagaggtacaacagtgattagaagaggtacaacagcgattagaagaggtacaacagcgattagaagagtgattagaagaggttcaacagtgattagaagtggtacaacagtgattagaagaggtacaacagcgattagaagaggtacaaccactgtcgaaaaggtacaataattgttggagaggtacaaaaattgttcgaatggtacaataatggttaaaaagggtacaatcatggttttaaaattaaataattaaggaaatcgtttattaaaaagtaagattaaaaattgatgtaattaataaatttttaaaaataaaataaatttccttttattaattaaaaagagagtttaaaatgtacagggattgaatatttatttaaattgaaattaagaaattaatattacaaattctaatttaaaaaatacaggagttctttaataaaagtaaataaattattattttaatttaaaacatttttcacaaaaaaataatttaatttaaattaaaaatttttattttttatggattaaacaaaactatttatatttattaaaatgaaaattaataatataatatttatttaatttgaaatgaaattaaacatgcaaaagtaatcaaaaaatgcacataaaaataatgtacaccggccggattcgaacttccccccccctcaaaatgatgcctcagaatccccaatcacacagggattctgaggtcttaacgatgtcaaaagtaaaatgtgatcacgtattcgtgatcagcgtcataaactacccctaaagacatgtttttggaatattttcggtgaaaaaattttttcactcaaaaatcctgtcacccccctttggtaccgaatcacaaaatcacttttatttttgtatcttttttttaaaatgtgataaaaatataaaataaaatttatattatagagcaaaaaattgcggatttttgtagtattttacttttccagaatatcttttcagaaccgagttatgaatttttttctgaaaattcgaatttttccagaaattctggaataacttttttccttttttagatagaaattccaaataaagtccataaaattctcctgatttttctctatttttaaagctttatttgctcaaaattggtcaacccttaggctagatatgaatttttcaatattagcccaaaatcccgtgggccaaaaaatggaaaatattttcaatttttaaaaattctaaaatttcgaaacttaaaataacatcatattcgtattcagcaccccaaaataccccgaaaaaaaatttttcacccctttttcgacccaaaaaaatttttgaaattttctaaggggcctagctccgaaatttttgaaaaatttacttcatgaagtaccccattcgaaagcatttaaaatgctccacaa

SEQ ID NO: 12919 - DNA, 4389 bp, Heterodera glycines
ggttttttcctctccctttctgtcggtctctcttttccgccagtctcttctttttctctatccgtctgtctttcattggttacatttcctttggtgtccatctctgatcaaatgtgaaaacatttgtctctgccttttcgtatcagaacatttcaattcataacttaatgaatggttcggcaccagcagagaatttcgggttcggtaacatttccctacattttttccgagattcgggttcataaaccgcaaaaaccgctacttttatgtttcaactctcgatcagcagactgaacttttggcgtgaatacgtcctaatgttttctacggcactttttcttttcactttctccgtctcttcctcttctttgtccggtggcctttttaccattgcgattgatcacttttgtattttatttattttttgctgcacaaaagacaatttgtttgttgtttattttttgcgatagtttatatgctaaaaataactttggacgcttagaatcaatagaaaaatgattagttttcgcattttggttgaaaatcagcagtttacgacttgggttatgacgtaatgaaagtttaaagactcataacttttctcttgtgcgtcaaattgcttagcattcgctaagaaaaagattctacctttcaaatattttttttagatatcaaatttgttcgatttagttgggaatgaagcgagttacagttgatcaaaataaacaatacaaaaaaggcatttaccagtcaaattttgaattagcgcaaaaattacgccaatttgctattggcgaaatgaataaacagatcgcaaaacttaaaaaatttggaatttttcttttaaaaatgcaagagccggtctcgacttaaaaacttcagttttataaaataaacttggaatcgctagaggtggtaaaatatttgactcgctatattaatggtttctctctcattttgaaacggttgttgaaaaacaaaaaatgattgacggtaaatagtaaaacatgtcattgcattttagatttaaaatgccaaaccaaaaggacggagtgacaggaggcaaacgaattgagcaggaacttgccgagtttgaccttcccttttacatcgtcgcattggcctttttcctaaaggcgttcttccgtctgtatgacttgctcgtcttcatcccattcaaattatttgctgaccctgagctgaaaaaggaacgctctcgtgagcgaaaggttttgcgctttcaaaagtaaaaaaagcaaataaaacggaggtttgctttaggccatgcccatcgatgggaagccgacttcgtcctggagacacgtcgataccattggcacggctctgtacaccgaactgtttgagggctgtccgacgcttggcaaaatttgggacaaagcggcacagttagtaattggctttatttatttatacatgcgtttatgtttgaattgaggttacaccgtggacacaattgcatgggcacgcgcgacattctcaatgtcgtcgaagaacagcagccggacggaaaagccttccaaaaattggcacttggcaaatacaattggatgaattacgaacatgttgatgaagtgattgtggaagttgcttctggactcagcaatttgggcattgtccaaggacaaaaagtggtcattttctctgagaccaggaaggagtggatgatctcggccatcgcctgcttcaaattgggccttccaagtgcgctttaccacaaatgatctaatacttttctaaatcgcccttttcagttgtcaccgtttatcccacgcttggtgacgaggcaattgcttttgccttggccgagtgcgacgccgttttggcgtttacttcgcgtccccttctgtcgaaagtgttcgcttccgtcaaagactgtcctcagctgaaacgcgtcgtttacttcagcgaactgcacgcacttgccgaggtcgccgagaaagcgcctgatgcgataaaggaagcgttcaaaagtatcggacgcgaactgtacagctttaacgccctcaaggcactgggccattcgcaaggtaaacaaaggctcccccggaaattttaatttaaaaaaatctagaaatcttaattaagaaaatttattttcaatagttttttgagaaaaactcttggaaaagatggggtcgaaatgggtaaactcagaattaggctcattttcttaataaaaggcaaataaatgcctttgataagccaatcaaaagaagtcaatcataactaaggaccaattttctctttttgtcccctcaattccacactgacaatccaatgaacagctttaactgtttcattgcagcaaaactcgagcggaatgtgcagccggacgacttggcgatgatcatgtacacgagtggcaccaccggaaagccgaaaggagtgcttttgtcgcatcgcaacatcatcgcgacggcttcgggacagagcgctgtcatttcagtcaggtgaataagcaaaaaaaaaattaagcctacactgccgacaattcagtaccagcgacacaatcattggctatttgccgttggcccacattctcgaagtgtgcgccgaaatcatttgcctgtccaaagggtgccgagtcggttactcttcgcccagcactttgcatgaccgtgccgtgaagattaagaggggaaccactggcgattgcgtcgaactgaagccgactttgatcgcttgaggaggcgggcataaaggtgggacacgacgcaatttcaccgccggagaaaagagactcggccttttcagtaccacttgtcgcccatttgtccctttctcccccgttcagacttatatgaccgtcatggggctgcatcctatggcattttatgcttcgcatgctctgatcggtgcttttagcattctcttcgtcgttggcgccagtgccgttctgatctcttccgcatttgcggtcggttggcgggaatggcattgtcccgtcaagagtgcgctattacgccaattaagggggggggggcatttgtcgtccatcccttcccacaactaccgctgtttctgctgactctttctgttcagttcgtctccgtttcgttgtttctgctcttggcactgctatacgccttcagttgcattcagttgaccgtccttttctgcacgttcactcaaaagggacaattggtccaattgatggttcgtccgtccctttggcattccgtccctttttaaattcgaattctccccgaaaggtcggtctgtccttccaattgctcggcctgctcagttggaagttcagcccgcccctgcacagtgtcggccgttgtctgttcgcttcgcttaatcccgtggctgcctttggtctcggcgtccaaatggcgtgcactttcgaaactcgaagtcggtatttgccaattcagtacgtggtccttatgtcccattttgcccttttgtacttacaattacctaattaacactgactaattgcccattagtgtttctgctcgattggccccatctcttctccggctcctcccatcagttctccgtcggcttggccatgcttatgctgctgttcgactccgctctcttctctctgctcactttttactttgactccgtttggcccaccgatgaaagcccccggaggcatccgctctttttcctccaggcattttttgattgtttcccaatttgaattaaaacaccctgtgaaaatcagcactttggcatcggtctgtccaattatgagaaagtgacaccgtacggagaggacgaagacggggagggatcggctacggtggccaactccgagaacaccgaagtcgagacaacggagaatcggacggcggacatcgaagtgcgcgggatgagcaaagtatgggagtccaccggactgatggcagtgaacgcgctgagtttccgcgcttaccggggaaaggtaagcaatgcgatgccacggggggcggggggagggggggggcttttatcccgcgggcttttgccactttaccattttttcattaattaattttcacaagcggctaattagtgtggccactttttgcggcaaccatcccattgccatggtcaatgtcaatatttcttatattctgcccattttaccacgattcctcgtctttggcatgtccccgctcggcttcgtctcccctccccccccccccgcacattccccgggtcggtgcaccccaaaacgtcgtcggccgaaacgtcgtcggaagactttttgaaccataactttgttcactgtcaatcaaattaagaattgttgatgttgttcgatagctctatgtgtttattattaatttgcaaaatctcaaaaattttggttaagtatcaaaaaagtaatggccagaaggaactcaaaaacccagtaattcgaacttt

SEQ ID NO: 12920 - DNA, 4452 bp, Heterodera glycines
agattatacatggcaaccctacaaatataaacctatattatagcaatattttattcgtttttaaggctctagtctaacagcattcaacaaaaaacgcgctgacaaaattaaaagtcttcttccgagaaatgatccattgcgtggcctcagctggcaggccattcaaacacgtttaagaaaacacattttaccatttgaatattttaattagtttttccgtttattttataatttctactaactcaaaaactaactaacatttttatatcaatctttgacgccttataatttatctttttagttattttattttattctttataatttacattttgcatttaattcatcgttttaatgagagctaaaaaacactgaatagttagttaccttacattatgaaacactaagttataacattacgagctcagctattttttttgtaaagcttattcgcaaaaatctgacgaaatctcttcagtgttttaagttgattttaaattgagcaattatccaaattaatgttcccctctttagtttcaatcattgcacaattttaatgtaattcattttcagtgtattcccatccatttattcatttttattttatttgtatatcattttatcatcgtttacttaattgttttatttgttgattgtttgtttgtcttgtttgtttggttgtttgtctgtttgtttgttgcttgtttgttttgtacacaacacttggtcggagtctttactccccagtgtttttaatttcgtattcttatattgcttaaaaattgtatttgtttgtttagttgttttgtaaacaacacttggtcggagtccttactccccagtgttttgtgtttcaataaattttttaaaaaaattatttctcatatttttatcactacaaatataacttgtcgataggtagataggtcttgcacaaaagggccacctcatcgcggtgtgcaagtctagtatccaacaacacaacgaaaaggtttttgttgtgtgttgcttttgttggagaagctaacggcccatagttatgagaaaagataaatatgatttgattgatacatttttttaaatttttatttactttaacaaaatccttaaccttatttttttatatacacaattgtatttttatattttaaggagcatccatcatacgctgctatacatttattgttttttgaaagaatacataatgtgtgtacttacattctatcaataatcctaatagattaaataaaagataaagtaatgaatgtcggagattgtttttgtggtgaagccttgtatcctcttcctggtgaacccattgacctgacaagacaggttgtccaattaccatgtgagtgcgcaccatttcatattggctgcattgctgccagcttaattcggagtatacaacttcaaccaaatggtcagcgacgcggaacttgtcctttctgtaggagaccgtcattaacagaggaatcacttttacaaatcaatggcaacaaattggtaaaatatcaaatgcaaataatgttatgctcaataaatttgactcttgcttctaaagttggacctttaccaccaccgcaaccactgcaaccgccactgccgccaccaccgccgccacttccaccgccgccacttcctccgccgccgcaagagccaccggtgcacattgatccacctgtacctcttgaagagatgcagccacagcagcgaagacgtcagattgcagcgattatttgctcacgccgaagcaatgaaggcaatgggcgagaattgcgaatacattggcacagtgctccttaccgaaatgacacttgggaaccggaacaacatataagagatgttagtgtattctagctccattcaattttaaaacccgttttttagcaagccccattaatctatgccttatggcatgaacgacatgataatggagaaacaccttcccatgattatgtgtttccgttacgtccagctccgtggatgacaacaattagggcaggaagagatcttcctgaggtagaatttgctcattcaactgctcgtcgacgtctgttccaggaggcgaatggtatgatgattgtccaatgcaatatggaagaccatatttggaatatcaacccagttgtgaatggagaacaacatgcacaaccagcacaagctgcacaagaggatgtagctgctgacattgaaattttaggtataaataaaatcattgctgaaaatatagttttattaagaagagatcgtcgtcaatccgcagggaatgcccgaaaatgagttggaaaacaatgccatcgaaattttagaccgtaataaaaatacaaaaaataagcattatttacttcatatatattaagttgttcaacaacaacaacaagctgctgaagctgaacaacctgcttatgaacacgttcgtcaaagacacaaaaggggaaaggtaataaataaagattcaaccaattttattatcattatatattatttagaacttttgtggggcagagagacgtcgcagacgtttcaatcaacgagctcaaaattaattcatttgttttgattgtttttgtctatcatttatcattatttaaacaatttatttattgttctttatttgtttatgtgcgtacacttggtcggagtccttactccccagtgtttcattcatgcattaaatttctgttttatttattttatttgttttggacataacacttggttggagtccttactccccagtgtttcattcattcattcatttctatattttgttctctcatttatttattttgttttgttcacaacacttggtcggagtctttactccccagtgttgcattcattcatttatgtttatgtttgacaaattgcatttttttgttgtatgcacatacacttggtcggagtctttactccccagtgttgtgtgttttaataaaattttttaaaaagttagttctcatgtttttaacactacaaatataaattgttggtaggtgggtaggtcttgcacatatgagccacctcatcgtggtgtgcaagtctagtagccaacaacaaaaatatattgttggtgaagctaacggctcattaggcacaaataaaccacaattttacaaaatctgtttcaatataattttaaattgtttttcgttttctgcatctccccaaaatgttttgctttttttatgaacaataaattttgttaataatttttatataaaaattaagctctaaatatgaataatcataataatattgatccacttatacttgatggaatttcatcggctataaattcatttgacaccgaagctagaaaccaaataatgcaagaacaactacgtatcttcttcaattcccaagtaaaaatttagatttttccgattaactaagtaatttagccacttccaacaattggatctcgtttgaacgcagtctactcccagattgttgatatacgtgctcaagcaaacataacaattgcacctggataccttcaacatagtattcaacaaattgaaaatcatcttgccgattccttgctttttcttttggaatggctccacgatgaacaaatgttagcagaagaaattgtaaacagtgatgaaattttgtcagatgagaatttgcctgagtttgatgaataatttgtttgtttgttttatgcacacacacacttggtcggagtccttactccccagtgttgtgttttaataaattcttcaaaatatttttttcaaaattttaacacaaacatatactgtttatgacaaaaaggtaggtaggtcttgcacatatgggccacctcatcgtggtgtgcaagtctagtacccaacaaaaaaaatacattgttggtgaagctaacagccctttaggtataaataaaattgaatttttagaaaattcattcaatagaattttaaattgtcttttaatactcacccaatagaacattgaggagtatcatcattatgaatttcgacattttccaaacatgttcatgtcttgtgaaattgtcccaaccggacttgaggaaatccatgcatataaaaggtggagaaatagacaattagcgacacttttgtaatcaaaaattaagacaaattttgctgctaattagtaggaatgcaacttttagtgacgaaaaatctcgaaatacagtcatggtcatatgtttatgatcactctctatttggctaaaaatcttttgataaaaaccgaagatgaacacataaatgcacagtctcttggcattttttgtagcatcccaaccctttagggattttgttcgaaaattttcccgatttcaagccaattttgggttttcagatcaccatgaaggagtgatctgatcaagttggtgtaaaagacttttttgatcagcataaaaagttagattagcaagtattttttcagaatttttggcccataaaatattgattttat

SEQ ID NO: 12921 - DNA, 768 bp, Heterodera glycines
gccacgcgaaaacgaccccgaccgatttttataggtttaaaaaataaaaatttaattactaaccataaaatccttgtcttcgcttcatgcctctaagagtttcaacatttaccccaattttctcagcaattttctcctcaatttttgtcacttttaaatgtggatatttttcaattgccttcttctttatcattaaaaacatttgaacaaatttttccctttcctcttttgtatatttttgaatcacttaaaaaacaaaataaaaattaatttgaattttcatttaaatttaaattttcaacaaaacaactgataattaattttcaaatttaaattttcaaataactgaatattaattttcaaattaaatttaaaaaaaacaaagtaaaattatttttcaaatttaaatttttaaacaactctcaattaatttaaaaatttaaattttcaaaaaaacaacagacaattaattttttcaaatttatattttcaaaaaacaaagtaaaattaattttcaaattttaaattttcaaaaaaacaactgacaattcatgcccaattccctcttccattcataaattcgatcacgtgcgatgccaattgtgcagctaatttgttgctctattctcatcaattttttaagctcaggatttttgtgggttttcaaaatgccgctttcattgcatcaaattgtaaaacaaattgtcggcataaatcataattgtcttcacatttaagctgatggcataatcggcatcattatgccgt

SEQ ID NO: 12922 - DNA, 3625 bp, Heterodera glycines
ttaaattttcaaataactgaatattaattttcaaattaaattttaaaaaaacaaagtaaaattatttttcaaatttaaatttttaaacacttacaattaatttaaaaatttaaattttcaacaaaaaccaactgacaattaatttgtttcaaatttataatttcaaaaaacaaaataaaattatttaaaatttaaattttcaaaaaaaaaaacaactgacaattcatgcccaattccctcttccattcataaattcgatcacgtgcgatgccaattgtgcagctaatttgttgctctattctcatcaattttttacgctcaggatttttgtgggttttcaaaaatgccgctttcattgcatcaaattgtaaaacaaattgtcggcataaatcataattgtcttcaacatttagcctgatgccataatcggcatcattatgccgtaaaaaatttggtgaattttcttcctccatcggttcgaattcagtcgaattttcatcagtttgaacttgatcagattccgtcaaatttgaaaacattttgtctccattttgatcattttgactgttttgatcggatttgtccaattcttgttccaaatgaaaagcctgataaatattgttcccaatataatcagtgtagtcggatgttttgttatagtaatttgttggaccagttgcattagccgaaaagatgagaaaaaaaagaaaaaacattttacaaaaatttctaaaaaaatcgtaataataattattaataaaaatttaaatataaatgttgtaaattgtgtaaataattttttattcataatggtgaattgattaattttgcacatggcaaaaaaagccacgctttgtaaaaaaaaaagcagaaacgaatacataagcatatttccgtttttaaggtaaagatttgggttataattttggagctttttttgtggggaaataaaaaataaaattccttatccttttttttggccataatcccgatcaaagtaacgatatttctgccccgtgttacgcactgacttatccaccagacttatatttcggatttgaactgtataattttctataattgggtgcttcaaagatgctatgaagttagtcaaaaaatcatcaaatgaaaatattttttggtataactttctcaaaagaaaccaattttaaaatcaaaaattcccatttgatggttttttgtctcacgcccattttcatggtttttgattaatgtcccagcaccgcttcaaacaaaccgtgctaggatgaagtccgaataatgcaaataattaaattgaagcaaaaaaaaattatttaaaatgttcaagcactattaattaatcaatgtttccacgcattgttttattacatcaccatttctttagaaagttcaaaaattaggaattggatacataatgagtaataagaaatgcacagaataatagccagataaattaaggcgcctttcggcaccgccgacgccccaaaatgcgtcactttattttttgttaattgactcaaaaacggcgtaaacattaagaattgaacaatctttttttgaatttaaaaaacacattaatgaataaaatcagaaataggttgaaaaaatattaataaattggctaagcatcgattgtttcttaatattattaaagaatatttacgtaccacagtttaagatcaatttatttttatcattttaaataataaatttataatatttacggttaaaacatgtttttttaaattatataaataggctttacaatttaaataatgaatatataaatatttatagttaaaatatgtttgtttttttaaactaggtgcttgctaatacattatattaggcattataatctattattcttttaatgacgaaaatggatttaaaataataattgcgaccggaagaaagtttcgtatttatgcagaaaattaaatttatttgaaataaaatttgtgtattacaaagggagctctaatttctacatgataatatgaataaaatataaaacaaattttgggccaaaaattcataaacaaaattcctaaaaaatttaaaccattaaaattccaaaaatagaaacattcccttttttaaaacaaaattttaacattcggattttttttttgtttgtttgttttgatttaaacccaaaaatttttggcctagaatatgccataaataattattcataataatgatttcataataatgaaaatgataatgctcgtcgtctagtagagataaagcgaatcgaacacgccaagacccgccccgatgccgccctcgttgctggatgcgcacttggtacggatcatctggccaggctgtgtgtactctaccagggtgcctgccttggtgtcataaacacagtaggtgtacacgcccaactccgtgatcacatcgctgaagatcggcttttcattggcccaaatcaaataattctgaaaattaaaaaataatattgcattaattttttttgttattaattgtataatttgtatttttattaactttaatgattgtataattattttagaatttttttttttgtaagaaaaataattttaaaaaattggtagctaaaaaatgatattttgcaatattctttttttgtgagttaatttaaatgaaaaaattatattttattttttaaagtacgataatttgtgctcaaatgcgttgaattgtcatcaaaaaactcgttagcttatgttagtttttacattttggataaatttccaataaatcacgcattttaaaggaaatttaaattattaaaatcaattttctttttaattgttcacacctgagcaaccagaggattcaatcgttccatcagaatgtaagcggcacgttgttttgacgtgaattttttcaatctgtccacaatttcttgttcccaaaaattcttgccaccgccttctttgttcggcttcatcacataacgctcggggtgggcaatggcatccttaattaattgggtaaaggcaacataaaatgccaccaaatttttggaccttttttaaaaatgctttttctttaatttaacattactgatttcatagaaattatattttacttttgttttttgcgaattttggaaaaaggggcgaatgccgtaattctaattatgattcattgcaataattcttaataacatatttgtctaatttatcaaatgcattcaatttaatgataattgattttaataattttcatataaagcacatattaatgggaattttcttttcataatttttaataaagcaatttatttggtattttagcctaaatatgcatttaaatttttttgttaaattgatgaaattatccatttattttaaccacctgaatcactcttttcgtttcctcatcatcaggattttccagtccccacattttggcgaatgttttgcgaattgctgtgaccattggcgcatcttcagggttcgggaaaaagcgctcaaccattcccggcttagtcagcacctataaaaaattgggtgttcatttcaatttatataaaaaaaaaattttttttccataaatttatctgttgtaatattaaaggaggtaatttattagaaaataatatcatttattaaattcattt

SEQ ID NO: 12923 - DNA, 1308 bp, Heterodera glycines
  misc_feature (1188)..(1189): n is a, c, g, or t
aaaaattgaaaaaattggtaaattttttgcaataaattcattttatccagaatttttgtttttggacaatttttggtattttttccaaaattttccgtctttaggtttttcgccctggattagaaattagccaaaatagatgtcagttttatgatcatggaccccaaaaccactaaaaaatatacaaaatgaatttatttaaattaaaaataagtttttacgcgataatccgaatttgtgcatccatctgtaaattattgttgaactgtagacaccaagtttttttgaaatttcattcacattttgatattttggttgtccattttcgtccaattccttttgcattgcaaaaaattggtgaacaattgcaattcgtcgatcattttgtatgtcttttttcaaatcttaaattggattaaataaacaaaatgcatttattacattttttaaattaaaaattgttttacgtgataatccatatttatcaatccaatggtaaattcttgaatgtgttacaccaataattttcgcaatttcattcacattttcatattttcgttttccattttcgtcaaattcattttgcatttcaataaattgatgaacaattttaattttttgttcatcttcctctgttttcaatgattttttatcattttttcttctaatttttaatattttgttaattatttccaaatttttctcctttttttctccacattcgtcataaatttcttcaagaaattgatcaatttgcttttgatcagttttgatcagaatagacacaaaagcatcatcattttccgatggcaaaacattgcccaaattagcatcatcaacagaacgattagaggagtcaattagcgaatcagtttcagtatttgtccacaattttgtagaaaatgatggcataaagagaaaaacagaagaaaataaactaatgaagagcttcatcagcataaatcacaagttaattacttctaaatgtgtaattgttgacattatattaccattatcttattagaaaattattcaacttaatctcaattgactctcagaaacttccctagtaattagtaaaatgaacaaagaatgtatattcatattattaaagaaagaactcaaataaataaagtaacgtaataatgaaaaattatatatttttttattaattatgttaaattgttnngccatacattgctacattaagcaatgaatatgcccataaaagccctataatatgcaaatgaataaaataaatataaaatattcatcaaaatatcaatatatgcaaaaaaacattaattt

SEQ ID NO: 12924 - DNA, 2888 bp, Heterodera glycines
atcaaacaggcgcgccatatgtttattcttttttttctcttaaaaatttcatcatttgctgagcaaacatatcgcatttactatcttcaattcaatcactcaaaatttatttttggtaaataaataaatatttgtttaaattaaaatttgattttttttttggcatttctgatattttatttaataatttttatcggaccacttgtccggtctcggaatgatttcaacaaatttataaataaattattacaaattaaacagtcatgtcaaaaaagtgttgtttcatcctctttttaggctgataaaaaaagatcttttacatcaacttgatcagattacccttaataaaatcaattattcaattcaaaaaaatcattaaaaacaaattcttttaaataaattttctaatattattttaattattaaattatcatattttttaaatcttaaaattaatctcagcagtgaattttatagtccattgcttgttaaaatgccgccgtctgatctcaacgcgtcaattgctaaagtgcaaaatgattttgcactcaaattgttgcgcgaatttgccgcgttttacggcagcgcttccgcgtgcatttcacctccggctgttgcggtaacacttgcgctgacgctgtccggtgccaaagacaaaacgtcggaccaattaagccaagtgttggcaaaaggtgccataaaatgcgacccaatggcatttagtcacatgcatttttggaaaatttaaaatttgaaaacctcaaaattagctttttgggattttaatttttgaatgactaatcgcattaatatatttttgactaattttttccgaagctttattgtatatatctttgtatatttgaaaaagctcatttacttcttttttttattgcataaactaacaggaaaaagtctttatctgttttaaatctgcttggtgatgatgtgtgctggccaaaaaaatttttactcaaaaatataaaaattcattaaaaatttacaaaaatatcaaaaactcattaaatttagccccaaaaatatgaaaaaattattaaataaacaaaatttaggaacgccaaaataccgcattttgccccattttggcgcccttttgaatttgctgcatggagggggcaaaaaatatgccaaatttactgtcgaatcggtgtgcaaattgtgcttgaagtcggacattgcgttgtcagatgcgttcaaggcttctcttgacaaatattttggtgctcaccttgaattggttgattttggtgagaacatgaaacaagtgttggccacaacagcaaaggcaaattgaatttgtgcatttttaaaatttattttaatgaaaaaaatgtgcaattaaatttttatatcgcatttatttaaatttgaaaatgaatttatgatttttaaaatttattttaattaataatgtaaaatatttttgtatctttttaatatttcatttatttaaatttcttttaaagaatttataataaaatttaaaaaaatattaatgtatttatatctttataaaaaaattagtaccaaaaataaatttataaaataattttacataattataaaaaaaattgaaaattaaaaaaaaaactttctattaaatttaattttggtgtagaaaacgaaaattgaaaaaaatctttacgataatatataaaaatgagattttttaatatacaaaattttattttaaataatcccaaacaatgatgcaaaatatttgtcaagatcaacaaaattgtggttgatgcttctcatggagcagtcaaagaaattctgaagccggaattattcaatgctcaaacaaagtaatttaaaatattttaaatttaattaaattttttaaattttctttatttattttaagcctccttctgttgagcgcattttatttcaaaggcaaatgggcagaaaaatttgatccggatttaacacagaaaagggcattttttgttggaccaacagatcaaaaagaggtcgtcgttaatcattgtaaatataattgctaataatttttaaactttattgtaggtttatatgatgcaaaagacgcatttctttgattattatgacgacaattcggtaaatttaattaattattttttaaattaaaaattgataataaagactaattaaaaacaccaatattatttgaaaccgtgaaataaaaattcattaaaagttattggcatttatttagaatcttaaaattaatgaatttgaaaaataaatttctatttaactatatttttatttaatatcaaaaaataagttttatattaacaatatttttttccattttaattataattaaaatacaaattaaatttgtctttctttacattaattaaattgatcaaaatatgtaaataattttattaaatttaaataaattaaacaggtatacaaaaacaaatctgattataaagagaaaatttctgtttttaaggtccaactcttggcaatgcaatagtgatgaagcatcaatgtacttagctttgcccaaggagcgttttgggcttgcaaattttctggcaaatttaaccgtcgattctctgttcgaaatggcacaaaaatgtcgaaaagtcaaattgaatgtgagtttaattcttttaaatttaaaatatttgaattaaataatttattaaaaatttattttaggtggcagtcccaaaaatcaaattagaacaaactgttgaattgaatgaaccgttaaaaaagttggggcttggtaaatggtttttgaaaatgcaaatttccaagcaattgctgctgatgtgccatcattatctgtttcaaaagtgctacaaaaagctgtgcttgaagtaaatttgttaaattaataaaaatgttgttataaagttttg

SEQ ID NO: 12925 - DNA, 1173 bp, Heterodera glycines
aaaaaagagatagccatttttttggaccgtccataccctcacatatactcaaattcggcccggaaaatcattttagagcataccaactgatgacagccactgtcatgtttccaaagagatttctattaccagatgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccatagagatttctattaccagattccaaaaaaagagatagccattcttttgggacgtccataccccacatatactcaaacggcccgaaaatcattttagagcat

SEQ ID NO: 12926 - DNA, 925 bp, Heterodera glycines
  misc_feature (858)..(858): n is a, c, g, or t
ttctatcgatatgcaaaaattggtattgatttaacaaaccttaaagaaaatttacacagaacgaagtaaatattgttttttacatcataagagtgtttattattgcatttccattaaaattttggtcaagctccttttaattattttatgagtttaaatttttatagtttgccataaaatattgctgatttgtttctcttttctcaacaatttgcggtttaataattaaagacgctaaaaaatggcacaacagcaagcgataacgaagaagagtaaagctatacaagacgaaattttcaaggccgaattaaacaactttctcatgaatgtttgaagaaaatttgtgttttttaaaattaaattacatggaatttgttgggtaattcaattgtttttaaacagtgttatactttttcaaaacgaaactactgtggccaatttaggagttggctgaggacggttattccggtgtcgaggtgtgtcgtgcgccctcccgccatggcgacacgcagtgcaccccctccaccattggcactttcttcttcagttgaccccaaccttcactcctcctccgtcccgccaccaaccaacgaatgctcaattctcgccaatccatcgctttctgtcgcccatttgtcgtcgtcggtcggacgaacgacggaccgaacgcgtaaatttgggaggaacaaaaccgacttttttcgaaatggggcgacctaagttttcttccccaattttccctattttcaaatttaatttttcaatatttaagcacataattccgaggcttcgaccaacaccaattttttgctcggactttctcttcgcaccaaaacagcagcaaatactacgcctacncgttccgccgtggacaagcggctcaagtcgttcgagtcgaccaccgaatgggccgatctgatcgcag

SEQ ID NO: 12927 - DNA, 2411 bp, Heterodera glycines
atggtggggggtttggtgccaccaccatttctttcgtcagttacaaaattatttttctgttcatgcgccgtcaatgcaaatggtgccaattaaattgcgattaaatatgatatttttattaaaaaagtttttcattagcataagctctttatatataagcaaactcatatttatcttttcataattctaacacattttttttccatttttgtttactcataactcagaagcgcaaaaaaatttgattacagtgacagatatcgattacatacattcctttttcgtttctattcacataatgtgtcagttttgtcattgactcccccccccctttttttcagcaaatcataacaacaatgtttggatggacaattacccattttttgccatgctcattcgccccgtttcgatgcaatggttgacaaacttttcgatggcaatttcaatttcggcaagttttttttaattttttttttgtaaaagtcagtagttatttagggttttaatgtttttaatgattttgtgtccaaaaacggacctctaattttcaaaattactcagaaaataaagaaaagtcggcaagttttttttttcgggcatttagaccatagggcgtgagttcaggaaaaaattggtaaaaaaataaaaaatattagccctattgatgactttttatgaattttttaagctggatttgaaattttactaaattaagccaataataggattttcttttgtaaggattttgtgccaaaaactacccttcattttcaaaatggctctaaaattttttttccaaattccgcgtatttttattaaagtgtccgctttttagggtttttggtaccacattttttgatttaaaaaataaattttttaatgatttcaaatttttaatctttagccgatatttcggacatatttcgtccatttacaatcaatatttcactcttgatttttttgtttttagattgattttcaacgacatttggatggatattttccccctttttgaccgtcctcaactcggtctcaaattggcattgcttttgtcacgtttcgatgtgctggtggacaaacatttcgatgccaaaaaagtgaattatttttaagggtttttgttgtattaaggattttgtgccaatttggggcctccgattctgcccgttttaaaagatttttgcacttttaattcttaacttttcagcaaccaaacaacaatgtttgatggatattttcctttgttgaccgtcttcaacttggcctcaaattggcacttctttcgccacgtttcgatgtgctggtggacaaaatttcaaacatttcggttggaatgtaaaatttttttatactaagaaaaatgaaaatttctttgtttttaatttgaaaaaaaacaataagaattaccaatgcagttatatatacaaagaggcagaaatttttcattgcacatttaaagattttcaaaaattttaatagttttttatgtgttttttgaaggattttatgcgtaaaatatttaatggcctccaagtaggcaagtttttttgtgtgtaaaaatgagaatgtttcaattttttaaattatttttttagggttttttccaaaaaaacgaacttcaattttcagaatattaaagtggtgatcattctccccttttgatcgtccatatcttaagagaacatttttttcttaaaattaaaaaatcttttttttggaaattttacatttttaatttaattttttggccctttttattcattaaaaaatctttttttggaaattttacatttttaatttaattttttggcccttcttattcaattaagcctaaaaatgcattttctatgaacaaatttacatatttaactaacattttttcaaaatttcaccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagtgtacttgcaaatgtgccgccaaatcgggctcggagaaaccggagagcacttctggattcctccgcagttcctcgttaagagcaaggaagagctgatagattatgtctatcctaacatgcaacaactccttggcaatgacaaggagctgctcaa

SEQ ID NO: 12928 - DNA, 1017 bp, Heterodera glycines
caagtgagattctttcttgaaagaacacgaaatgtctatgaagacaaatcgcctggcggcataaaatatgagcgtttgcagttcccaataaaacctgcattcgctatgaccattcaaaaaggtcagggccaaacaatccgcactgtcggcattgatctggaaagggaagtattttcccacggtcaattgtatacggccttctctcgggcaacggacggaaacaatgtccgtgttcatgctcccaaccgggaaattgatgcccaaggccgagccaaagtgctgaatattgtagctactaatatgctcaagttacaataattggcttagtccagagcagttgggcacatggtttttggagagatgccaatcccattcccatctgcactatgttgagtgcgaaaatggtgagaagcttggatccgggacatggaccggtcagccctctttagggcctacaggtgaattgccatttagcgctcaacccaataacgtgccaacgcctggactaagggagggaggagggccatgacgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagtggacataattaaactgactgaacgaagcaaccgtttgctttgtacgtccgttaaagctaaatgtcaatttggtaaatgaatttgtcataattattctgggactttttatatattaataatgcagaggtttttgagaaattccattaaaaaatttatataaaattttagatttttttgtatttttgggtaagattttgccaaagaatcaacaaaaatcattttttgttaaaatttctaaacggtaattttccaagcggctttattttttgtgcctatgaattaatatgatcattcactga

SEQ ID NO: 12929 - DNA, 2032 bp, Heterodera glycines
ttttactttaatgaattcagaaaataaaaattttcccaattatttcacagcaaaagcctaaatattaaagtaatgtaaattaattaatttcatttaattgaaaaaatgttgtccatgcaacataccgcactttcagatcttgcttcaacatttcgttcccgatcacgagaacgatggtggcccaacgatgacataacaaataaaactcaaacgggaaattcaaaaaataataaaataataaacaaatttaataaggtaaatttaaaaccaaaaattgtgaaaatcgtaaaagacgaaacgactggtgaaaattaatttctagaatgttctagcgtgtatttaaaggttctggctttttattctggtaatttcttcaatcgataatttagtgttctatttgtgttctgatttttcattaaaaagttctggtattaattctggtcatttctaacaaattctggaattttattcatgttctggttttctatttacagttctgaaattattgtggtaatttctagcatattctattattttattcatgttctgatttgtcataatggtaattacatcgacgccattatttcttttgctgtctgtctaacttgaaataagtactatttcttcagttctgaaatttctttggttaatttctagaatgttctagtgtgttttaaaacagttctggtattttttctggtaatttctgcaataattctgatattttattgattttttataacagttctgaaattattctggttaattctgcgaattctggtttttcatgttctgatttgttataattgcacggcggccattatttcttttgctgtctgtctaacttgaaataagtactatttcttcagttctgaaatttctttggttaatttctagaatgttctagtgtgttttaaaacagttctggtattttttctggtaatttctgcaataattctgatattttattgatttttttaacagttctgaaattattctggttaattctgcgaattctggtttttcatgttctgatttgttataattgcacggcggccattatttcttttgctgtctgtctaacttgaaataagtactatttcttcagttctaaaatttgtttggttattttctagaattatgacgaaaaagaggggagtgacattaattaatttaccaattaattacactgtaatcatcgaatgtcattattagactaaaatataattaacttttaagcttgtgcccgcacatcgtaacattctttcggcatcttccgaagtttttgagacgatgtaacaaaatgaagcaacggaaaatgcaaatggcaaacagaaatttttttggaaataagcgataagcaaaaaataaaattaaaacatgaaaaattgatggaaaatatagaaaaatgaaaatatttattattttaatttctttttagcttctgctgaaaagaatgactttctgcttgttcctgactcgatgctgaagcgtttaaagtgatgttgcgctttatttattaggacgatttgtgcgaattgaatgggaaaaatgcagtcgaattgctttatgcgggtgattaattaacatatgaatttaaaaattacccatttttaattagccttaaaattcaatgtcatcggaattttgcagaaggaattgagccgaaaatacagtgatgccgtgtacattaattacggtgagcatcaataaaaaattaaatttctgaaaaaaattatgaaaaaatattatgctattattttgggacaaggtcgtttcggcgccgccgtttcggcgccagcccttgtttttggactataacttttttctttgacaaccaaatctaataatcttggtatcattctaaagcccttcagaagccctattagacctacaaaaaaccaaaaaaaaaatttgacctgtaaagaagttattaagaaaaaatcacaaaaaatttgacttttttgcattttccgttagaacttttttagtaagcgactaattcgctaagcaattgcttacaaaaagcttc

SEQ ID NO: 12930 - DNA, 2143 bp, Heterodera glycines
caaaaaaaacaaaacttatgccgataatcgaacctaaagataaactctgttggccattagcactgtgttcccaatttcacgcttatttgtgtctcggtcttaatatggaaaacctaaatttttaaatagtctattttttcaaaaaatacttaacttaagcgtttaaaattttttcttcaacttatacattcataatcaaaaatttgaatcatttttttcgaaaaattttggttaaaaaaattgattaatataaaattatatattttttgcttttcttttcctagattgaatatttttcaaaaatactgaaagaaaattgttaattatatttcacaaaaaaacataaattacaaacgatggcagtaaaagaatttatcaacaattttggcccaaggacaaagagtgctggggtttctccggatttatggcttttgaggttggcgggagaatgaatggctttgcagcagagagatttattaggaattaaaaatgtataaaagaaaatttttctgtatacacgtctttaattaaagcatgaatgtatggaaaaagggtacttgattcatggagagaaatatggcacgtactaaatattttttggagaattttacactcggttcaaaaattgttcaaaatcagtaggtttttattttaatttcttcaagtattaagacatcattaaaggtatatagaaaactaggaaaaataaagaacagacttcaaaaagggcaaattccttatatgtgtagtaatgagatattttcgagaatgctgtggaaaaaatgactaaaatttaaattaaattcattctccagtaatttgaatttctattaaattaatgattattattggcatttaaagtaataaaagtttcaaatttaaaaaacaattattttgccatgaattatgttcctaaattgtcaaaattcttcatatttctgatccaactttaaaaattcttaattctttaaaaacccattggcttttaattgcaaaaattggcggtgaaaatctgttaacaaacctgaacgaaagataaccttgttttaaaaaaaataaacatacgacaagggtaaggttttgcataaaatcatgtataatagggacggcacggaattctgattttcgaaaatttttaaccctcgcaattccgatttccgaagatttttgggtacttggaatgccatccttgatgtatcaccttttgacactacagtgccatttggtttttctttttattattgtatgtaaaaagaaatatctcttatttgaaaatatattttcatattttttatgtgactataagctatgaaatataacataattcgaggcaaaattctcaatcgatttttagaggcataacttggtaccatttatagctttttcattagcagttttgcccagaaacacttcaattcccaaaattgttcgcttaattggaattttgtcaaagcatttagttttcaaggtaaaaaacgaaaaatttcatttcattttggcattttgtcctattgactgttttattcttttcgggatcatgccattcttatgggggcagcataacagaaaagttaatgcttcctaaattgaaatttctccactgatttgcaatttttaaacaatttttttcgtcaatctctgcaaaaaattcatccgatttgaacacagtgtccgcatttttgtcaatgtaagacaaacaacaattagcaaagtcctaaaataaaaaataataaaataatgaaaattggcctggaccgggtcgtttgccaggcttttctggaaaaaaattttcctcacctccaaatcgaaaaggcgagcctgggcataagccaagaaaacactgcgtagttttgaaattggaatttgcaaagaccggtcgacaaggccagtgatattgtaattttttggctaaaaataatttaaatatttttttgtcagactaaatttaatgatcaaaatctttgtgataaaaaacgggacacattgacaacggtcatttttaaatccaactcaataattttttaatttgtctctgagttaaataataatttgacatcattttaaagtaatctcaaaactttttgcgatctaagcaaaatgctgacccaaaaatatgcaccaaatatgcacaaaaaagctgaaa

SEQ ID NO: 12931 - DNA, 3924 bp, Heterodera glycines
ttagtccttttcaatgccaattgttcccgagtcaattcgttggtctgttcaaatggcacaaacgaatcagcataagacgaccgaagaaaacaaataacgacaatgaaattgacgggggaagaagcatcgtcaaaagcctaaaacgcaaaaaatgaaaaacaaaaaaaaatttattaatggctaagcaccgttttaaatgcttcaattttcaacggcaaatttcgcccttcaacgttcaacggcacatttcttcctgcaacgaattcctggacagcacatttgaacacctttggcacatcgtccgggtggggagtgaaaagccattttgccagtgcctgtccacgcgacgccatggcactgtcatcgcatggaaattcggcgaaaagatcgtcaaaagtggggaagacaaagcgaagagatggacattcggtgaaaaacagtgacggaacgatttgtcgcaaacgctggaaaggttccgtaatcaattccatgccataaatgttttttccgatgatgggcaaaatgttgtgcaataactccaaaatgcgatcacttttgaaataaatggacagataaattcgagaggaggcgaaaagtggacgaaaacggtggagaaaagcgatggcattggagtcgatgaaactgaaaatgaattgggaaatgttttgatggtgcgtaggattttttaatacaatttactcgttcagcgctattatcatcaatactttatttgatgaaaaaactcatttttaaaaaatctatttttggtcaattttttgtgaattaaaccagttcaaaaggcggttttttggtttttccgcgcctcgggactattttttataatgattggaggcaggcctgtagccagaaaaaaaatttccgaggggggggggaagactttttttttgcgtcgataagcgacgtcgtgaaatttcttttttaaagcttttattgaaatataacaagaaaattatgcagttttcaaaaaatatcacattttttcctgaaaaatttttcacttcgtgggtggggggaggaggattccccccttaactatgggcctgattagaagtcattaaagattgattggaattcattttgggcggtttttagcgggcccgattctaaagttttccaccaattttacgtgatcttgatgcatttgaatccgatgactttgcgtggcaactgaatgttcggaattggcatcggttttccatcgtaattggcaatttccatttccttggtgccattttctccaattttacgtcgaattcgaagaaatttcaatgcccatttgcgcgttttgaagtgttcatccacgtaaaagtcaaaacgatggctgaccattgcaattccaaggccaagttgagaaggcgggagcaaatcgaacaccgccagccaaccgtcgccggaaatgaaactgagaaaaggaaaacaaaaattgaaattggcatttttaattttacattgcttttgccattttttcctctgattctttttgaatgtctgacattttgttgaggtaaattattaagacagaatttcggcacttttgcaatcagttggcaacgattttgtaagcttcaaaaatttatataaaaataaatatttgcgtatacctaagtcatgaaagaatgatgattacatagtatggccgcaacttttagttaaaatctcaaaatatttaacgaaattagtgaggaaaatgccaaaatagtgacgaatggtgacataattttcagcggtgtaaataagaagggtttttggtgtccccaatcacgaatctttcaattattttgatcaattccgatttcctaatctaaatttgaacaaaaaatcataatttgaaaaattaaaaatttcgatttttattcgagttcgggttaaggattagaaattagtcaaaatacatttcagattcgtgattagcgacctttaaaaccccggataacaaattagcatggttttttatattaaaaaaattttgcaaaacaaaaggtcctccccccttttgtttcaaaatcggtaacttttacagtagcgcccaagtttttctatttttcgttgttaaccaaatccaatatcttggtatcatttgaaagcttattatgtttagaaattttcttagcctattgtttcgcgattagaaaattaccaaaaaagttatacatgaaaaattattcattccccattatttcgtctctctcttcgactttctctctgacaatgtcttccaaaatgattctgtacgttttgcgcattcctgtgatgccagaaggaacggagtgtggaagaaagtgggataaaggacctgagagaacctctaaaagaggcgcccgtagctcagttggttagagcacggcacggattgctggggtcgtgggttcgagtcccaccgggcgagttaccttttatgttctacattccttctctattttgccccttccttctcatttttttagtctgtacggtgtgccaatgttggttggatgttgcgccattctttggatgttttgggaccgattcaaaaaaccaaaaaagaaaatgtaaaaataataaaaaaatcttaaaaaattgaaaatttaattttcagtttcatttctgccgacgcttggctttccgtgttcgaattgcttaagcgttctcaactgggccttggaatcgcacttgtcagccaccaatttgacgcaatggtcgacgaaaatttcaagacgcggcgctgggcgctgaaatcctttgaaatttggtgcgacgatggcgaagatggcacgacggaaatggcaattctcaattctaccaaaaaactcgtcgggagttacagaattcaagtggttcatctctttgaaggcaaatcgttaccaattccacaagttcaattgccacgaaaagttagcggtttcaaatgcatcatcatctcgtaagattggccaatttctaattttttgccaacattacccattcatttatagttacatcgaccgcaatgccatcgcttttctcaaccgttttcgtccgcttttcgccgcctgcccaatttggccatccaaacgaacaatgatcgcattttggaattgattgtgcacaacattttgccaatccttgaaaaacatcttcgtggccttgaattgtccttcgatgttttccaccgtttgcgtcaattcgtcccgtcaattctcaatgattttccatttcttcgcattgtctctgtctatgcttccgatctcttcaccgaatttccggccaatgacaatgccatggcatcggatggacaagcgatggcaaaatggcttttcactgcccatccaaacaatatgccaaatgtgttgagatgctcgttgaacaaggaagatgggaattgggcttcgcggattgaagcattcaaagcggtgcttaccaattgatttatttgccatttttacgattttttgggtttcactgacctgacaaaaatgtttatttttcgcccaattcatttttacgatttaaatggaccaatggttacagtttagatggcctgattcttttcagaaaatgtgatttgaaaaatccgtttaaagtgcactttggctttttgtgatgaccccaacatcattttgtttttttaatcatttttttcacattttaggcatttgcctcggcttcatcttccgtcaatttcattgtcgtgctttggtttccgcaatcatttgctgactccgtcgttctctttgatttgaccaacgaattgactcatgaacaattggcattgaaaagaactgtctttaacacccgctttttgctgatccgttctccaattgtgcgagacgaaagcaaatggacaaaatgggaagaggaagcgattggctgggaattttttgatcaatggaacagaattgacattgaaattaatgacgaggagcacatcggggacgggtcagtcag

SEQ ID NO: 12932 - DNA, 784 bp, Heterodera glycines
  misc_feature (772)..(772): n is a, c, g, or t
gtttttgggctataacttttttagttgcaaaccaaattcaataatcttggcatcattcgatagctttaagtgtcctctattagtctgcaaaatttcgaaaaatctcgttaaggttaaaaaagttatggtcagaagaattcaaaaaaccagattttccaagtttttggctcgaaataacgatttttttttttttggaatttttcaggctaatagacttggcagccatatctgaggctttagcctcattttgtggttttttgatagaaaataataaaataagtaattatttaaattttcacatcaatgggaaataaaagaaagaaagaatcatatgctttccttacaattattaatcgtcataaaaatggtatataaatatctcgaacaattacattattaatcatttaatccttagagctaaaattttaatatctttagctttaaaaaaaaataaaattcaatttttttgataagatttcgataatatgcttactaattatgtgtaaattttgttcgcaaacacaaaaaaaagcattttccaactatttaaaaatttgttttaattcaacctatccgattattgaatttcattttaaatcattaaaacaattttatataaagtaaaacaaaagttaccgaaaattatccatgtaattgaaatatatgaacgagcggggaagcctttgagggaaaaactatggggcgggccggatttgaaccggcgtctctggctttccggaccagtgttctaccatcttaactacccgggcgnaccttttgggga

SEQ ID NO: 12933 - DNA, 3312 bp, Heterodera glycines
aaattcatattaaatgccaaaaaccaaaaatctttctctttttattttttcccatgcctgcgggccggacaaaagaattgcttgcaagaaattgctaatgacctttctgctattgagtttgaacgttcaaatcgtagagtcccctcaagaaaatcaaattaaaggaatttcagtggacaaagaaatttgtgaccatttttgtgcccatccatgccagccgactaatttaatttttccaaccgaagagagaaatgcaactttgggttggacttgtgtacacctaaagccaaaaattgtccctcaaagttggtcctcatttttctcgaaaaatgcttggacaattggcggcatcatttttactattgccggcatttccttttgtgtaattcgcgcatatttgtggtcaattgaacccgattcaattgaaattaatgtttgaaatttcttttcaaaatttgcaatttccccgcttttgactgcgtttttaattaattccatatgaccaaagttttgcagtgcccccccccattttttttctctccgtgccaaatatggcagccgacggaaagcaattcatctcccgtcccctctcccgttttttgctcttccccgtcgcgacattagctttttgcggcgatgaatctcccctgccgctcgggagaaaaacgttttttgcctttttttttcccattagctcgccgctgttgtaacatttgaaaaaataaattgcattttttgctgtaacgcccatcgtccactcggacccgtcgttatttaaggccggctcatccttcagaaaagccatttcttgtcttcattctcatttttcctccgctccttcatttttttcatttttccatttcctttttcaattttcaatttttctttttttttttagatgcaaaaacctactccttctaaccgccccaattcctctgtctccaaaacccttgcctgcgggcttgaaaaaattgtgaatttgagtggaaatgagccactctcggtgccggtgctggcggatcggagtgatccgctgggactcaagtcggtccaacccgacgcgttgccaatggagagtgctgagggcaccaaggaagtggaaataatggaagtggatgaaatgagtggagaaaaagggaaaagggatgaaatgggtaaagaaaaggtgaaaagtggtggaatggaagaggaagaagaaagtgagggcagtgaaagtgaactgctaggagaaggtggatttgacaatttgcaattgaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccgagccgatcgaaatcggcgatttgttccgcttacgtaagtgtgagtggacgaagagcgaaacaggatgggaagagcgcggagattggctgtatgaagtgaccggacggctgaactaccaagccacggcaacggacgtaagccaattgcgccagcgcatcctcactgaggccgtcggcattttggtcgatgtgcaaagagcccgtgaccgacacgtcaaagtggccatggtgtcagcacctgagctgagctgcgtgatgcgcacctaccgtcgccacttcccggccgatttcacggatacgacatccgctaccgctccgttgtccgtcttcaacttcggcagatcaacagtccgccatgggtgctgtattcacagcagtttgcgtatgttttgccgtctgattttggtaaaaaaagaggcgatgaactgctcgttcatcacgcaaacgtcattgctagcgttgagcctgagccaatgggctatgagttccctttcagtgccgaactgagctgggcgaaggtccagctgggtgagaaggtcatggcggcggctgtcgcagcgcagtcgttcgatgtgaaggctgatctgcggaagcacactctgttcgtcgagccggtcgtcatcaatgagatctcgacaagaagcgtgatcatccagttcgtcatgccggtgccgagcatcgaagagctgacggaattgtgcaaaatttgggaggtcgatttggcggtgggttgcaaagtcaatccggcaaccaaggcaaagccttgcgcgcatgggtatgtgctgagcatcgaaaaaagggcggttatgtcgggggtatgagattcagtcacaacatatgcgctcaacattatgctacttccttgcggtgatatttttttgttttattaaaatccccaaatgtcgagtccccaaatgtcgggatccctaagtgtcggatccccaaatgtcgttcggtccccaaatgtcaggtccctaaaagtctggtccccaagttgcaaatccccaaaagtcgggtagccgaactaccgacccttccctctccagctccccactttgctcgatcatataggatcaattgttgcctcaattgatccattaatcttcctctcggggaagcttcttcttccctatctcataattaagcacgccataatttgatttctgctgaatttaattaatctcatttctttgttcattaagcttacatgttgcttgtatttctgtttctcttctcatcagtagggttcgaagttgtatgcactaaaaaatgtcaaatatgcgcataaaatatgcactaaaaatcccccaaatatgccctaaaaaccggaaaaatgcccaaatatgcactaaaatatgccttaaaaattacccaaaatggcttttaaccctcaaaaaaaatgccaaaaattgtctataaattaagaattgatttgaaaacaccaaaacaaggactaagaagcattttttagacaattgcaaaataattgaatttctaaatttttgaatttttattatatgctaaaacaaaattacattttctatataaataattttttttcttaagttcttacagaaaattaaaaattttccgatttttaagggtgtatttttttaaaaattcccaaaaagtcgatccttagggggtgtatttttcgcttttttcgcatttttcttgtgaaaatttgccaaaaacgaccgaaatatgctctaaaaacgcaaaaatggccaaatatgcatttattctcaaaaacccccaaaatatgcttttatatgcactaaaaaccttcaccaaatcaaaaaattttaactcataaattctatttttaatcccctttcttcataccatatacacataaaaaacatccaaaatcatacaacttctaacccta

SEQ ID NO: 12934 - DNA, 1743 bp, Heterodera glycines
tttccgatggcactttttgtgccatttccttttcatttctatggcatttcattgaaattaaatttcgattcgctgcccattggttgcgtttggagtttcaattatgccatttgttcagctgaccaacaatcgccatccaatcagcagacattttttgtctcttctgccgcacagtcactcaacgcgggcaaacagccagacaaaatgccaagcaaacacaaattctacgaatattacacgttgggatgcatcagcatgcgcactgaggtggcgaaagaagcaattaattaattaaagtaattaacgaaaagagtcggcatacggtatggcaaattctgtagaaaagcgtcaacaattttcttattcatatcatggacgagacaaaaaaatcataattaatttaattaataaagattttgaagcaaatattcgatggaatttgaaaatttttttattcatttcagtgaatgataaccaaaaatttatttaaatttatttaaaattttcaataaatgaaaaaattatcatggcaaatgccaattgggttctaacaaattcaaattccgctcagagtttggcattgtgtgtggctgtccaatttctgctgaccaatgccttccttatttggctgtctctgcagggatggcacccgtattggcgtttggcactgccggcggtgttcaacgcgggcgcttcgctgtcactgatttacgcctggtgggcggacaagtccagttacagcttgctgttcctcattgtcaatgtgccaatctacatttacaaattcaaactgtttttgtgccctcctctccccccagggtttgtccatttgcgcgttggcactttctctctttgcgttgctcctcgccgagacggacccggctttgctgaagcagttgatcaacaacaacgacgagacggagacggaacagcaccagtgggacaattacgcatatgaagaaaaaacagtggtgaagacgaaggacggctctgagcatgagcacgtgcgccaaaatacaattggtaattaattggtggatgaaatgccgggggaatgatcccaaaaaagcgaggatttgtggccaattagagagggagggccaggttggcttgctcgtaatcctcctgtcgtcaagcccagcttgaaagtctcgggcttatctcgggctggattcctcccacttttttctcacgttttctcacaatttttttgccaaatttccctcggcgtttagcgactgcgtggcgccactacgctcggcggttggagctgagcggttggctgcgcgaggccgagttgtgcctggtgctgttggtgattttgctgtggattgcacagggcatcgtctgccacttttatcgttacgcgaaattgcgaaaggtcgagaggtttgagcgcgcggcgaatggatacggcgcaggcggaactcggccgagcggcacaaatttccgaattcccgtggccacgctccgacgtattcagcacgtacagcagcagcagaagcaaatgcccagcggatcagcagcagcgccggggaaatatcgaggaggaaaaaagtgatcggaagggattattgcactaggtgaagccaggtgagggggggggtccgaaaatatggattgaaaaaaatcgataatcaaagtactcgtacattgtagtttcaagtagaattttttaattgtaatgcttgcttctttataattattaaataaggtcttttatgtgtacattttatgcaaatg

SEQ ID NO: 12935 - DNA, 1248 bp, Heterodera glycines
gggaattatatggaaatccatattttttttctggactgtgggggggcctgaaatgcacgaaaaacatgtttttagctggtttgaagcttctaggatggagttccatatgcatatttttccatatttcgcgatttatgtccatatttccatatttgtccatattatggcatttttatccatattttatgcccatattttggaatttttccaaaaaacctctattagaacggcccccagcagctaaattggcctttttgagcccaaaaaccggaaaattttccaaaaattattttttcgccaaattttctcgggaatattgaataaatttaaattttcttaaaattaataaatttatgtcaaaaagaagcaaaaaagataaaatttcacttttctggttgatttttcgctaaaaatgagtaaattttggctttatcgtgattttttcttctaaaatgatttttaataccatatttagccatttttgaaggactttactttatattaacaaatttaaagaaattttgggaaattataccctcaatttgaaaaatttatgtccatatttttgccattttatgtccatatttcgcgatttttggtccatattttatggccatattttgcgattttatatccatataattccccgccctaattataaatgttcgtttataaaattctcaaatttttaaatttccattaaaattaaatttcaatggaaaaagcagcgaaaaaaagttaaacaaacaaaacaaatcgtacgctgtgtgaacatcaatcgcctatcaaatgatcaaattcaccacagaaagcaaacaaaaaaaaaatattggcctaaaaactcgaagaaaaattcacagaatgctttgacaaggaaatcggaacatttactgccaaaatggaaaatatgagaaaaacaggcgattattgtgaaaatttgcattgaattccgaaaattcgaatttaaattcgctttggctgtcccataaaagtgggggatttgccttggggcaaatgccttctaatttggccaaatctgtgcgtccgtgtctctgtcaggctttgccaacacgtcaaattgcacccattacgagtcgagcacattattttgccggccgcccccgcctccgacgatcgtttggccgcgggggggggggggctaagcttatcccgaaaagatttatcgatccatgacgaggggagaagccgaaacgtagtaagagggggggggggagaagcgactgacaa

SEQ ID NO: 12936 - DNA, 2120 bp, Heterodera glycines
  misc_feature (2018)..(2018): n is a, c, g, or t
  misc_feature (2052)..(2052): n is a, c, g, or t
  misc_feature (2087)..(2087): n is a, c, g, or t
ttttacaattttatttctagaatcaaaaaaatttcgaaaccattttttaaacgaaacagtgcacaaaaagagaggggagggtagaagacgagagtaattttttgtaaggatcgcaccccatcgaatatttccttatttctttttcataactgtccaaaggtgactgctgccattgactcttttgtagtccttaaggtacttggactttccacagtaaaatgtggtacaaattttggaactgtccctcctcacggtgggacttaaaaacatggttaagccaagttcgaaacttcagaggagaattttaagttttgaatttttacaatttaatttcttagagtcaaaaaatttcggaaccaattttttaaacgaaacagtgcacaaaaagagagggagggtagaagacgagagtaattttttgtaaggatcgcaccccatcgaatatttccttatttctttttcataactgtccaaaggtgactgctgccattgactcttttgtagtccttaaggtacttggactttccacagtaaaatgtggtacaaattttggaactgtcccctcacggtgggacttaaaaacatggttaagccaagttcgaaacttcagaggagaattttaagttttgaatttttacaatttaatttcttagagtcaaaaaatttcggaaccaattttttaaacgaaatagtgcacaaaaagagagggagggtagaagacgagagtaattttttgaaaggatcgcaccccatcgaatatttccttatttcttttacataactgtccaaaggtgactgctgtaattggctcttctgtagtccttaaggtacttggactttccacagtaaaatgtggtacaaattttggaactgtcccgcctcacggtgggacttaaaagcaggatagagccaagttcaaaacttcagaggagaatttaagttttgaatttttacaatttaatttcttagagtcaaaaaatttcggaaccaattttttaaacgaaacagtgcacaaaaagagagggagggtagaagacgagagtaattttttgtaaggatcgcaccccatcgaatatttccttatttctttttcataactgtccaaaggtgactgctgccattgactcttttgtagtccttaaggtacttggactttccacagtaaaatgtggtacaaattttggaactgtccctcctcacggtgggacttaaaaacatggttaagccaagttcgaaacttcagaggagaattttaagttttgaatttttacaatttaatttcttagagtcaaaaaatttcggaaccaattttttaaacgaaacagtgcacaaaaagagagggagggtagaagacgagagtaattttttgtaaggatcgcaccccatcgaatatttccttatttctttttcataactgtccaaaggtgactgctgccattgactcttttgtagtccttaaggtacttggactttccacagtaaaatgtggtacaaattttggaactgtccctcctcacggtgggacttaaaaacatggttaagccaagttcgaaacttcagaggagaattttaagttttgaatttttacaatttaatttcttagagtcaaaaaatttcggaaccaattttttaaacgaaacagtgcacaaaaagagagggagggtagaagacgagagtaattttttgtaaggatcgcaccccatcgaatatttccttatttctttttcataactgtccaaaggtgactgctgccattgactcttttgtagtccttaaggtacttggactttccacagtaaaatgtggtacaaattttggaactgtccctcctcacggtgggacttaaaagcagggtaaagccaagttcaaaacttcagaggagaatttaagttttgaatttttacaatttaatttcttagagtcaaaaaatttcggaacagaagtattatttaaaatcaaaaataattttagtaaattttttacattttagtttcaaaaaaacaaacaaaaaaatgttnccaattttgaaaatggaatagtgcacaaaagggnagggatgggtagacgaaaagagaattttttagaangggacgcacccatctgatatcaacccttttctg

SEQ ID NO: 12937 - DNA, 1220 bp, Heterodera glycines
  misc_feature (6)..(6): n is a, c, g, or t
  misc_feature (16)..(17): n is a, c, g, or t
  misc_feature (28)..(28): n is a, c, g, or t
aaattntcggaaccannattttttaaancgaaacagtggcacaaaaagagagggagggtagaagacgagagtaattttttgtaaggatcgcaccccatcgaatatttccttatttctttttcataagagtccaaaggtgactgtgttaattggctcttctgtagtccttaaggtacttgtactttccacagtaaaatgtggtacaaattttggaactgtcccgcctcacggtgggacttaaaagcatgatagagccaagttcaaaacttcagaggagaatttaagttttgaatttttacaatttaatttcttagagtcaaaaaatttcggaaccaatttttaaaacgaaacagtgcacaaaaagagagggagggtagaagacgagagtaattttttgaaaggatcgcaccccatcgaatatttccttatttcttttacataactgtccaaaggtgactgctgtaattggctcttctgtagtccttaaggtacttggactttccacagtaaaatgtggtacaaattttggaactgtcccgcctcacggtgggacttaaaagcagggtaaagccaagtttaaaacttcagaggagaatttaagttttgaatttttacaatttaatttcttagagtcaaaaaatttcggaaccaatttttaaaacgaaacagtgcacaaaaagagagggagggttagacgaaaagagaaatttttaggaagggacgcaccccatctgataattccccttttctgttccataagaggccagaggcgactgtgttcgttgacaagtaattgtccaattaaggtacttggactttccacagtaaaatgtggtacaaattttggaactgtcccctcacggtgggacttaaaaacatggttaagccaagttcgaaacttcagaggagaattttaagttttgaatttttacaatttaatttcttagagtcaaaaaatttcggaaccaattttttaaacgaaacagtgcacaaaaagagagggagggtagaagacgagagtaattttttgaaaggatcgcaccccatcgaatatttccttatttcttttacataactgtccaaaggtgactgctgtaattggctcttctgtagtccttaaggtacttggactttccacagtaagatgtggtacaaattttggaactgtcccgcctcacggaaaagtaaaagcaggatagagcccaagtttaaaacttcag

SEQ ID NO: 12938 - DNA, 2127 bp, Heterodera glycines
aaaaatgcaaatcaatttgtcaccctcctccattttcccctctttttcagatcaatttcggtgatcggtgacaattggttgtcctacgattgggttgaaagcgatcagccgatggaccaaattgagtaaaattcattcatttcaaattgtttggcactttttaatgcttttcccctttgtttaagtaatcagcaagagcaaccgatcatcgatgatcccaatgccacgcggatgaggagggcttggttgaccaaatcagcggcgcggtcgcttcactgtccacaatcgatcttggccctgtgtacaccgctgttggcaacggggtggactactttgggcacctgtggcagtatcgggtgagccaaaaatgccaaatttgaatgatttaattggatttccaccgccgtttttcagctcttccgctttgccttcatccttctgtgcatctactttggcatgggcttcatggaacggttggctgtcgcgatgacctccgcatgcgtccgctgggcttggccaccggtgcacttcatgctcagctcgtcacggggaacgctgttctatttgacggactggttcgcatggatggacgactttttgtcaagttgggtgtgcgacatggccaacaggtgcggttttacggtgtgatgggggtgggcatacagtcggtaccgtgtcaacactcctaatccccccaccattttcagatactgtcaccaatacggtgtgatgtgcgacagtcagtgttcctttgtcagccggacgcagcgcgcagctttcttcaccggacgtcggttctgatggatgatgcgcgagatgaaatgcggactctactaaatatggaaacagaatttcaaaatcgacaaaaaatgcatttaaatattaaattgctcaagtttcacaatattaagatttgacgcagaaatactaaaaccctcactcgtctcaatgccattcatggccaagtgagcgcggagtgccgtccgttccgcgctcgaccggcacagcaaacagaacagccatggcgtgtctcgtggtccacagcgtggcatttgaaccaacaagcgtttggcgaacagttgagccatgccaacccggtaccaagtgctgagcacgcttcgatgcccaattatctcaggcaatttgtccaatacgccgcatgccatggcggcaccaagcccattgattttgccattaatcgccgactaaataattcacaaaaatgtgtaagaatttaaattgtttcttttaatttaaattttgtatagccaaacattcattgactgattaatgatgacctcaaaatgtataaactgtaagctccttgtgtacccatggtttgccaaactttgcagatgtgaaccaacgcgagggtctcgtgcaagtacaaatccaccatcgccagcatggacaatcggaaaaaggatttatttgttttggtaggacttggatttaattaatatttaagaattatttgattttttttttattaaaccttatttgagtttaaactagcgcaagtgtaatcaccaaatgtgccgagcaatttttcttcaccaaccgatgatagtgtggtaatgccaacacattccgagatgtcttctatctaattttttttaatgtttaaaatttgaaaaaaattttgcatgggtctaagattataattgaaagtgtgctaaaccgaacccgaatttctggatccaggaagactgaaaatgggagttctcgtctttattttactaaaatcccggactcggatcaggaataattcttgtatctaaaaactaatattcacgaattccctacgggctaaatttatgtttgaaaatattactaatatccatccatgctttttgcatccggccgcaattaattcaatgtcaccagatgggcatccatatgaatgtgtgataatcactgctctgtacaaatagccaaaataattatttattattaattatttattattatttatttattgttttaattattcactgaaaataatcggtcgtaattaatgaaaattctgattcagctttataaattttatatttgtttaaaattaaatgttttatgaaaaagtttattttgataacacaaatttgagaatttttggggcaaatctgt

SEQ ID NO: 12939 - DNA, 1934 bp, Heterodera glycines
ttgcacattaatcaacagaaatgggaagttcaaagacaggaactgaaattattcacaattatttttaatgatgtcatattattggtcattagtgtattgtgagtgaatatttccacctccaatttatcattttgcgcaatttgtgtaagcgaacggccagcaaatgtctcatcgcaattctcggagcatttaacacatttttgagtagaaatgtgctgaagaactttgccataatggcgaatgaccaaaaagcgcaaatttttcagtcgcgaaagagacaaaaaggcagccaaaatgtcaatattataagcggaatattcgaggtcttgaagatttggacaacggtcaatcagcgtcagcaaagcctgtggacggaacagaaatttaatagtaattataaaactcaatcaattaattattcagtacctcagtcgtgactttagcaagtcgtaatattatcagattagcaagaaatcggacctacccccccccccccccattctaagtttttttttggaaaaaagcgccaaaaaagtgcatatgcggtaaaatgagaaaaatggtcacttcgcgctactaatagttttagaaaaaatcttatttttggggtccgaatcttagtttttgcctcatctgtccttatttttaaaaaaaaacttgcagccctgattaaaatggaaaattcattttccaatttgtaccctccaaaatcattcaaaatctacaaaattcttttgcaatttttctctcaatttttgaattgtttttcacttgatattttcctttttcttctttttttaattgcttcaaatgttctaattattctcttttttgttcagtatttggtcccattttgtggtttgatcacttttggtaatattttgatcattttgcatttgatcaattgattcggttccattttctgtattttctttgccgaatattttattaaaatttggtcggattttgcaggattcaatttcaaaagcaaagaaaatataaaaaatattatatgtcataaattcattttggaatatcgaatttattgcattaaatgaatttgtttaattttttgttcgctttttaatactaatattaattttatttgtattttctcttcaataaatcgttgccaattttaaaattgtcacgtaattccggcggtaaaatcaatttttcgctcagatgaaaaaagacttgccgtaaaaaaaaaattaatttgttataaattttatattttaatccatttgaatttactcaaagcttcggtgggatgtaaattatttttgaatttattagatcagttgtataaattctaagacattttgcaaaattgtagaccatctagttaaaatttaataactcatttatatttatggcaatttgacattaattatttgatttttatttttcaaaaatttggcgcaaaattacataaagttaaatttatttatttattaaataaaataaattcgtaaacttcctttttttaaaaaagactttcataacattttcacccttaatatggacatagataatttacatagaagcttcaagccacgataaaatatatttttgtccgtttaagacagtccatgaaaaaaaatatggaatttcattataattttacgtcccagtcaaaacgtttccaagattttttcgtgcctggttttctgagttgccgctcgtaacagcagagaccaacttggattgtagtcccattcatcagcagagtcaacaaacacgggattggcaccaacattgaggacggcatttgagacagcaacaaatgttatggacggcatcaaaacatcggcacccggtccaatgttagctgagcgtaatgctaacaccaacgaggtgaagccgttgcagcacggaacggcaacctgaaaaatttggaaaagtgccaaaattggggccctcaaaattgg

SEQ ID NO: 12940 - DNA, 1920 bp, Heterodera glycines
  misc_feature (1813)..(1813): n is a, c, g, or t
  misc_feature (1830)..(1831): n is a, c, g, or t
  misc_feature (1851)..(1851): n is a, c, g, or t
ttaaaatttaaataaggatatttcctaacaaaagctataaaaattatgatgctaaagctcaaaatccataaaattataactcattacaataaattataattagtttctatgcttggggtcttcccacattctgagaaagattattaaagaaatttttcactgcatgatacaaataagcatttaaaagagttttctcaaggaaaaatacgaaagaaattaatagtaaagttcatgatgttattacgaaagctgtaatcaaattctttactttaaacaaaaaataaatttaaatatattaaaatttttctaaatatgtttatcctggtattatatataaaattttaagtctataaattactaaataatacataaattttttccagtatagcattgaaaattttaagcaatatattaatcaattattggtatattgcacaaaataattttgaatttgtatctttaaacgatcaaaaatccactacatgccaaaggaaagaataaaaatgtttattattactgacagaaatatgcaaaaaaattaaattgttatgatgaattagattttaaccaatttgagaacccctataaatttcaccaaccttaatcaatggaaaaagcataattttaagcctgatgtatgaaaatatgtgcgaaaaattccgaaatatgtaagaaaaagtccaaaatatctagctttcaaaataagaaagtacctaaaaatgagtcataattttgcaacatctgaaataacatattaaatttattttcaaaataaattctttttaaaatttaaaaagtataataattattggtctggttttgtacaacaaataaacaaatatataactctcaccaaatattaacactttctaatcaataatatgcattcatcaaaaaaacttgaaattaatcttaattaaaccaaattgattttaaaatttctaattcgaatgattaaaatatcaaaacgatagtagaataatatgagaggctttacagacaaattttatttgaaattaaccaaaaattaaatgaactagtgaaaacctttatgctaatatagcaaaaaaaaaaatactaaattactttttttaatgaattaaatcaaagagataaaagttatcgttcataatctgtcgaagcaacatattttcttaaattatgactgaacataatacctgttacacgcaccttcatcggcaagttggacgatttctgaggtggctagtcaagccccaaaaaaaatattttttttacacccaaaaattatattaaaaaatgaaaaaataaattctgaggtcaagggtcgcaatattttgcattttaattctaattacaaatgtttaggaaaataagctttcattaaaatcttcgaattatttaatttaaaaaaataaaattgataatgcatatttttaaatgtattaatcaactataatagaaatgctacttgaaaatgaaattttaattagatttattacttacatataaatgaataatccttttagacgaaaatattgaaaaataagcaaagtaaacgtaacgttgtttaggttccaaaataggaaaaaatagaacaataagttgcttaaacttttaaataatcataaaaatatttgttttttttgtaaatcagttaaatgatcgaatataaaaatttaaggaccttggaaaaacttaaaattgaaaaatattgaaacataatataattaatatttataaaggaattatataattaattactttatacaactaataattgaataaatttaaataataaaacacataaaataagtaaaacaaaaattcgtanaatttatttgttaatannatttgcatttttataaatanatctcacgataaaggtaaatatttttagattaatgatcatatcgatattcgtaatgttagctcaattct

SEQ ID NO: 12941 - DNA, 3434 bp, Heterodera glycines
  misc_feature (3314)..(3314): n is a, c, g, or t
aaaaagatgattaacataattattccaaaaagattttcataaaatctgtcattccaaaattcataatcatagcacattttaccttaaaaaataaatcaataattaaaaaattaaaatattgaacaacgaaaaaacattatttgagaaatttttaaaagagtttaaaattttattcaccaaaatccatagggaataatatcaaaattttcgtcgataattccttttttttgaacgggtttgtactctttagtcattttttgggacaatattttactgtctctagatggtccaaatttatcataattgaaatattttctcttttcgtcgacataatttaaaaccatttctttaaagtcctcgtgtttgaatttatttttgttgttaaaagttatccctaaataactatttaattttctatataaattagttttttacctctgattttagttttataccaaacttgtccgtcactttcattttgaaatttaatagagtattgcttactacccccagaaatgaataccaagattttatttccgacattttcatgagacatttcgcttaaaattttttatataaaaaaattgaaaaattcataccccaaatattctccaaaagcaatgggattattacacttttggtgcttgtaaattacactatctgaattattaaaatataaaaaaatttttgattaatgggacctgtatcagagtataagagtttattttgcgggttagctgccaccttttgtaaaaaattgtataagactattctcgcctgacttgtcgtcctataaaaaaatttctaatcagttttattatttttttcaataccatagagcaataatttgaatcaaactcttcaaaatggtaggcccttaaaaatgaattaatattttttttgatttattgtacctgtagaatttatctattttatatcctaattccatagcataaataacaaaaaattaattattaaaaattttgccctacctaattttagttcaatactagtaaaaactccatgtagtactctttccgtgtctgtatgcttacattttttaacgtttttcacaaaaacaaaatcgggttttgcccgttgacaacatttagagcaattggtaaaaaataaaattgaatcggcatggaacggtaataatggtatttttaaatttttgggtgggattgcccgtacttttagtaagccttaaatctattttattagtgtatcaaagacttttttatactgtcatagggaatgtcttcggggtattgccacataacgtcatgggtttttgatatgattattatgggtgtttttactgggtatgaagtaaaataattaacctaaatttaactatatgtcaaaataagaaattattaaaaaccgatgggtaaagcgaaattatgtccgctaaattaatctccgtattttcttctgttttaaaatataaacaaaatgcttgtgttcgcccacccgcaaatgcttctcgtgggtctattggtcctaaacacttaatttagaaactataccttaactttcaaacctttatcggggatcatgttaaaatattttttcatttcagcattatattttctttatctcgtggatttatcattctttttacatcgcattcctaaattgatttttttttaaataaaattaattaattttattaacccatatttcttcgacttttaagccatatttctttgaaattttccttagtttgaagagtctggctttcgtttttgcaaaattttcttccgctatttttccattgggacatatttgaaaaggttttaaacattttttgcatcctaaaagataatttaaaaatgaaaataatccaatttttaaccgtgaaaaacgcatccctaaaagtgtaattcaaaaataattaattttattttttagtacctgaaattctataatcttcttatattttccacatataaaatcaacattgaaccctttaaaaatataatttaatgattaagttgttttttaaaattaacctccgatgtttagttctcccccgtttcccgcatgtctcgctttaaccccatttttaaacataaaccactcgaaatattttatggcaaaaactttgattgttctttttttcaaaccccccccccccctcagggactattgctatttgtttcacctttagaaatttcgcccgataaattttaatagccgcccccgcaattgtggtcgaagtctaaattctattttaaaaaatgaaatttgttttctaaccttaaacacatcgaagccattaggactaagttcatccattgttatttctataaaaattttacgcattgctaagagtgcctttagcaatatttcggtatcctgaccacaataaattttcaattgatcctctgaaattatttatttaaaaaataatataacttttttacctaataaaaaaggcgtatcgttattttctttataccttttttgaaatttttcgaattcatcttttttcattgaatccgggtaataatcttccatggggggtagtgttggatttattttacctttaaaccataaaaaattaattaataattattttttaccataatttttttttgagttatatttgtgtgggaaatataactttggagtgcagtccaacccaaatgtttttggcaaatcggataatttattctgtgacatcagctaaaaatctctaaaaaacaaatttcccaactttatttgataaatttttagatctgaaataattatttcaggtatatatcccatttcggttaatgcgcgcaaaataaagtgcgcatcgtaacgccctaaaattttattataaaaatttttaattttttgattttaccggcgaaatgagcataacaaatggtttcaaaatgtttaaacgatagcacccattttaaaaactcgaagacgggttcacagttgtcaaccgtacaccatgtgtggtgtctaattccctttggcccgcaaatatcacagtccttgttttccccatcgcaatccgaacatgtaatacgagccgataaaaaaatgactttatgttcaaaaatcccctcatttttcccattttctattaaagtatccgtctaaatttgctaagataattttttgtttattattttacatactgaacactctgtgtcgtagcttatgatacgataacgtggcagatttttcggaatgataatcttcttaatataacaaccctctgattttgaatgttttgttttacatatattacaaaatttcgaacctaaattagtaaatttctttatttattttttattttttaccgncaaatatgtttttcctttgtatttgcaggtaacggaatgttttattttttcacgaaatgattgttcacaataaacacagtaataatgttttatatcaaaatttaggttcgtaaaaatata

SEQ ID NO: 12942 - DNA, 1994 bp, Heterodera glycines
ggaagatttcttgtttcatgttgccaacaaccgactcccttacatgcagattttacgattcatgttgcacaagcggcccttttcccatttcatgttgtcaactacagaaaaaacaaccagaatatttcacgtttcatgttgcctacgaccgggatatttctcattgatgttgccaactaccgaaaaaacaaccggaagatttcacgtttcatgttgccaacaaccgaaaaaaacaaccggaagatttcacgtttcatgttgcacaaccggcagatttcccattcatgttgccaactacagaaaaaacaaccagtatatttcacgtttcatgttgccaactacagaaaaaacaaccagtatatttcacgtttcatgttgccaacaaccgggagatttcccattgatgttgccaacaaccgggagatttcccatttcatgttgccaacaaccggaaaaacaaccggaagatttcacgtttcatgttgtcaacaaccggaaaaacaaccggaagatttcacgtttcatgttgccaacaaccagaagatttctgcatatttgggcctttttctttttagggcatagactcgcaaattgcgaaatcataagccatgcaatttcatcatttattgcctatgccatatgaatattaatattatttgtgcatcagtgggcgtaaacggaaattaattttaatcgatgtttgaatgttgttgacattcattctttcggcaagcgtttttttatgttatttaaattatttatttttttctgactggcacagtggtagtgagcagagatggcatggaattccgatttccgaataaatttttttcagttgatcaaagcgcaaatgcatttttttaaatttatgcctttttaattttattggtataccttcgaattttttaattgtcccattaaattgttcttttgaatttaattttaatattttcgcaaaaataataatttaattgacttaaatattttttagaatataatgctgaatttcgattctctgctactaattttgttcattttttatttccaaattcctttttcactttcggttgacaatgaatgccgtggtgtcccaactgatcaaatggcaccacttaaatacgcttccgatcagtggggaaagccaatggaaatcagatttgctgatgattccaaaccgagatttaacgtattcaaaaagataattttgatgtttttttttggaaattttatttaaaaaatatcaaaattttattttatctttttgtatttttagacaattttttttattttgaaaatgacttaagaatttttaagaataaattgatattatttaagacacacagtaattcaaaattaaatttcaatattctaagctatttagttacttttttatatttttaggacgtatttaaatgtttttaaattattttaatacctcttttcctaattttggataactaaaaattaaattcataatatgaaaaacattcactattgttggttttctttttaataatttaaaaaattataactaaaatatattttttcagattcgttttgggtttaccacggaaatgaatgaaaatttgcccaaaaataaatgtgtgcttatcaaatgttttgacgaatttacagaaaaaaattattttaatgtattaaaaattgcagaaaaattaaatgagaataattcgacgaatgaacacattatcaacttaattgacttgtaaacatttaaataaataaattttagttagaattttaaataattaaaaataattaattataaaatgtattagtggaacgattgatgaatcgaatcaaataacaaaagacgggggatttgtgaccatttttgagcttggaaaaagagatttagaggagcaattggaacttttgaatgaaaattttacaacagaaaacttgaacagtatgattaaagaagtgatgaaagcactaatggaatttcaccggggtaattaaaacgaataatgagt

SEQ ID NO: 12943 - DNA, 2906 bp, Heterodera glycines
  misc_feature (31)..(31): n is a, c, g, or t
  misc_feature (70)..(71): n is a, c, g, or t
  misc_feature (73)..(73): n is a, c, g, or t
  misc_feature (85)..(85): n is a, c, g, or t
  misc_feature (106)..(106): n is a, c, g, or t
  misc_feature (2732)..(2732): n is a, c, g, or t
gggatgcgatttttaggtaaagaaaaaatcnccagaatttaggtacttaatagggtaaaaaaaaatctcnnanaatagggtatanaataggtacaaaaattccaanaataggtaccaaaataggtaaataaaaatttttattaacgattttttagtggaaaaaagcaaacaaagagggaaaattttggttctacatatctctttgtaaacgaaaatttaaatatattaatattttcttagataatattgacattttaaattaaaaattttgtcaatagaaaaaataaataaattttgggataaatttttgagaaatttttccaattcttagggtgcatttttgaaaatttttttggtctattcttatgggtatattttttgattttattgcatttttgttaagaattttttgaaaatccttaaaataggtaaccaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctagtcataataaagaaggaaaattgtgaatttccagttccgttatagagtaaattttaaaaattcaaaattttggactttcgaaaggccattttttgcataacaaatatgaaaatttatatttgaataagttttagttggaattcatttggatttcaagacagataatttaatagtatctgaaagaacagagaattgtagcacagaaataaattcgacgatcaaactgatcgattttaatggtaacttttgcttaattatcgcagatttaaatcattacttttttattaatatttttattttttgtcgctctgttgctgtatgttttttaaatttatgattatttataaacaactaaaagataattttaatgctattgtattaaagtttgaattaaaattttttattaaattattaaaataaaattaaaataatttttattcaattaaaatcaacttttattaagctttaattttatttccttttaaattaagaatccattcaaaattgtaaaataaacttgttttatttattatttcaaaattttatgaaaaattatattaaaaatatattttattataaaaaatatctcttttagttcaaattaaaaatgttaatttattaaaaaataatatttttattaattctttttattttttcaattaagaatccgttctctatttggatggacaaaaaaagggaaaagttgagaaaaattttaggggttacactaatagttttgctgcgcctgagctgcttcaggttataattttttatttttctttttttttaccacaataaacttattttcgaaattggctaaaattttaaaattagtaaatgcaaaatttttttcctaatttaattttaacaatttaaaatttatttaaaaactatggtcttatcattttagaaatcagctgatgataccgagggttatgttgaggtgactatttcaaaatttgattataaatttaatttaatttaaatattgccctatttttgccaattaaaaataaatttatttttactgtaaatgccaggttaccccaaaaatggacatttggtcggcgggaatcacaatttttgaaataacactcacaaaaatgttgggacatttcgaagcatggcataaagtttcattggttggcgaattgtttcgaaatgccaaattgaatccgtctgatgccatttttatatcggctggttcaaatgtttggtggcaaaggtattggcaagtgatttgtgccattctgtccgtgtgggacgaaatgccaacgattgcatttcttttgggggtaagttggagaatatgtaacttaagtcaaaaatttattttaaaaatccatttataaaaaaggcagcaaagtttatttaaggcaaaagtctaaataaaataatttaaaaaggtaataccgtattttctctaattatccccccccctttctgagggggttgaaaaataatttccccgtctccatttataccccggggggacaaatagaatttttatttattcgaaaaataataataaaaattaattattctaaactgaaaatcgtttaaatgtcttacggcactcgaaataaattaaaaaatttttgaaagtgtatttttcaattttcttgcctttttcttacagattattttcaaaaatgccaaaatatgtgctaaaaaaaatccaaaatagcccatatctttttatgtgccaaattatttttatgtttttataagtcgctctaaatcaaaaattgttcggagaaaattccatttttttgtgtttctctcgccataactaagcggtaaaaaaaatatgtaaaaacataaaatccgatctatattaataaaaatgaaaaaagaaagtttttgaaaagagaaaaaaattaaaaataaaagcaagaaaaattgcataaagaaagaatttttgattatttaaacacaaccgaggcaatgaaagttaaatttaatattttttctcgataaaaaaatttcatatttaaaaattttccttattcgaaaaagctataaaatattttaatattcattaaataaacaaaaatgagtttttttttgattagattttacgtgttttcctccctaaaaatcctttanaaaaatttttaaatgcctttttcggaattttcgtgcgtttttttcaattttttggtgcctattatagtgcctttttcgcgattttggtgcctttttagacggtctctaatcataataccattatttttagaaatatgtaagcattgagccgcaaaagcgatgactggcaaagga

SEQ ID NO: 12944 - DNA, 3289 bp, Heterodera glycines
aatgttggatttggattacaaagaaaaaagttatagccaaaaacatggtggggcccaaacgtgccggcccaactgaggtaaaccgtaaaaagaatttttttttttttttgagaatttttctccattgaaaatttcaattaaatataatcacaatttcaacaaattgttaataattttaaaacctactaattagcttttcacattcttcgtcacagttcccattctttgacgcttcttcaatttgtgtggctgcagaaagtttggcgcgcgttttcacctcatcccatcgtaaaagtagtcccaaaatcttttcagcaaactttttccactcatggcattcatttaaatgttctctacatgcttcaaaatggcattctcttctatgtttttggcaattttctttgcatttggcattgtggcattcggcattatgctcttggcattttgcacaaattttttggcattttgactccgaattttctttgcaaaaccagttgtcccacaatggcgttcgtttcaaattgttatctggcatttcatgaatagaattccacgctttgtttaattcgttttcaattttttccgattcattcccaagcaaaaaggtgggaaaatcataaaaataaaaaaatgaatcgaattcatctaaaagtctaaaagctttttcgtgaaaataaaaaattagaattaaaaaacattaaaaatttttaaatattttccaataaatacatttaaatattattatttttattaatttattatattaaaacatttagaatgagctttttcttcaatataaaattatatgaattacataaaatatataaatatttttttaaaataaatgttttcatgaaaaaagatagaaatttctttgactgatttgtttcataaatgatttgttcggctttgatggatatgtttaaaaaggagaaatttggctaaaccttgtgattataaaaaataaatatttctacgttgtttaaatgatgtcatttccgtgaaaattgcccaattattaattgatttttttcactaataaaaattttattaataataaaaaaattttgattgtataatattttttaaatatgaactgaactataaactacaaaaataaatggatttaaacctcataaaatgccaaatttatcaaactctaatttcaacaattgcaaactaagttatttcatgattttttggtaaatctcatctgtttgtagcgaaaattttcggaagcgaacaaaatacttaaaaaattgccaaattttcaaaaaattactcttttgtgctgttttattaatttctagaacgttgattcttaggggcgtatttttagatttttttgcttttttcttgtgaaagtttcctaagaatggccaaaatatggactaaaaacgcaaaaattgcaaaatatagaatattcccgaaaatcccaaaaatatggatttacatatatgaaaatcttcaccaaatcaaaaaaaaatttaaaggagaaatgctatttttcaacccctttcttaataaatagtatatgcgcagaaaatttatttttattccacatttcatggttatttgttcatttttattgtaatatttcaaaatttacacccaaatacagtcatggtcatatgtttaacaacacttcaacatttttgatttaaatagctataatattttaatttgattataaatgtgtagtatgtcttaagcttttttgttgcattttttctgggctttccaatgataccacttcagaatatgcatcgacgtccgaagactggccgaactcccaaaacaacggaaagacaacggcgtcagcttgttcgactcgtcaaaagtaatccaaagttgaccgctgcagatgttcgacggcactcagctgacgctctcggagtccaaatttcacacagtacagcccaatgcattctccgaaagcaaaatctgaatgccagacgtccggcacgtaagccactattgaaagagtgccatcgaatggcccgtttgaactttgcgagggcacattcgcattggacggtggcggattggcggagggtgatatggtccaacgaaagcaaatttaatttgttcaatccggacggggcaattcacgtccggcggcctccggggaaccgtttcgaccccaaatacacacgcgggacaatgaaatttggcggtggtggcggtgtaatggtctggggtatgacggaaaaatttgaccattttcgtacgggatgtacagggtgctttaccggggtgacacactcggcccgttagtccgaattgagggtaatttgacacctgaaggataccgcaacatcctggaagaccgaatgttgccgtttgcccgtgaacgtctcgctccaggatggacttttcagcaagatggagcggccatccacacggggcaactgctgatgggtcccattcgacttctccctggcggtcggcgtctgcgtttgccgggctgatttcgcttgaatggagttcccctgcttcgtccccgccgttgagcaccgatttgtcacccattgaaaatttgtggcactttgtgaagcgaaaaatcgccgggaggcacttccagtcaaagccgcaactctggcaagcagtcctggaggcttggaattcaatcccatttgacacaattgacaatttaatcagctccatgccccgacgtatcgaatcagttattaagtcgcgaggtgcaccaacgaaatattgagttatatggaattatattttgtgttgttaaacatatgaccagtgctttttgaggataaaaaattttgagatcaaatattatttgctacagaaaacggaatgtgatcatttctatatctttggatagcccattaaatggtgtatcaaaaacgtaaaaaaaggaaatcgatatttgttttatctaagcatttttgcaaaaatttatttgaaaattcttttattttattggtgttgttaaacatatgaccatgactgtattttacgcaaccaacatttaattagttcataattaggaatgtcataggaaaatagattaaaaaaaacatttatgaatagtaattttaaatttctttttttcctcatcatcatatgttcactctcggaaaaatgctcttgaaacagcctaattagttgccaaattagcaacaaatatcatggcaaaaagcacaagtgtcatgacaacaggcatgacaacagtcatcataacaatggcatgtccaaaaatcatgacaacaattctaaaaacatcggatttaaattaatattttaatttaaatatttctaaaat

SEQ ID NO: 12945 - DNA, 3488 bp, Heterodera glycines
  misc_feature (1414)..(1414): n is a, c, g, or t
  misc_feature (1427)..(1427): n is a, c, g, or t
ataatattttgcctgttcagaaacacagtttgaaaatcttttcatatactcaatttcttgaacaaattttatttgtttattccatatttttttttgatttcatttttaataaaaagtatttcatgttcaatcgttgtcatatttttttcaaacgagtcataatttaattttaaattacatcttatatatcttattcattctttataaggctccaaattatcgattggactctattttcaagctccagaattttggtatgtgcacgtcgtgcttacaggtgcaatcgtgtggattcaatcaatgaagacatggctctttcttctagctttgatgcctgatcaaaacttttcaatctctcaaactcacgccgagcagattccgctttatccgattctgaatttaccttgtccaaaattgtgtaaatttcccaaattgaatcagagagcttaaggaacaaatctcgtacaccggaagcgtatggggccttttctcttgtttttattgtacgattcagagcacctctaccggatttgacatactcttcgatttcttcagctaagactacaacctctctccacgatctctctgtctcttttttggaggcttcgagaaaaattgaacttgctttttcgttctttgtgttcatttttatttatttatttctattttctatgcctaattatattttataggcaatgaattcgtctctaaattctgctgggggccttggcttttcaaaatttatttgattttctcgcattatttcttttattttattggccatgtttccaattcccaaatctggctgtgaataagagttacgataagtctgtccaatttcatgcctatatttttagctatttctattgattgtttgacatcttcagcattttcttgacacatcactgggtcctttctgtctagacatttttccatgcctttttaatattttttatattcttttcctcattttttattttatcaaattgtgagtgtatttttcttactccatttaatagtttttcatgccaacatatgatttcagattttcccgatttctatccttaatattttgagcttcaacaattgtattatgagcagaaaatgaaaagtctttggcctcattagttacctaattatatctttaattgcttcttcaacagcccttctggagatatccaattgctgtttttcttcttttgaaagacaacaacaaccctccccccttaccaccaaaaagaataaaattaacacagataaaaaattcatttttttttaattatcattaaagatttttatttatagttttaacgaatcatctttatcttcattctcttcttaaatgttcatcttctgaataaaaatacaattttaattcatgggggtattagcctaccgctgtggcacgaaaaanagttgtcatttcnacagaaatcctttcttctaaaaggttgacgtcctgataggattgttgccggcgcataaactcaataaaaacaacatccgccgtaacttgtcccagtgggcgtccagggattatcaccggatccgataaggcgcagcaatacaagtacacggtcattttctcgattttccacccgggctcttccgctttctttgcttcatttatcagttttgttaatatttttttaaaattttttttcagaattttcgtttggcgggttttgaagtaaaacgttgaaacatgttgttttatggccatttttggttttcttttacatgggtttcaacttcttcataatacttccctacttccggactttttctgaaataattacgtctgtttttagaacgacgcgtttctttcgggacttgttggaaattcttagacatcttaaaaaaagtaagcagcgaattattattatgaacaaatataccaaatgtaaaatcattaaaattattaacaagagataaaatatcaatttaataatacccaaagagcaaaacatttaaatattgatcgagcattctgctatcccttgttggcccaatcttctctggatagcgaaacacttttttaactccttccttgtagcccaagaccattgacttgaactcctcataatccactctattgtccttattcaatgtaaagccccggattttcgtcttgtaccagatcaccccatcctttttcctcctaagcttcaaggcgtattgttttggacccgccgacacatactccaaaatgtcactgtccgaatattctcgagtcatctcactgaacaaatgtttataaaattttttaaaaattatgctgttaccccaaaaatttcccttccttcaatggacatttccccttcggatgagcaaaagctagagaatctaaatttaaaattttatggaaattatttccctgaaaacacctgtgtcacaatacaatggtttgcacatcttctctttgtaaacctgctcaatgtattcgtatagctttatccttgcggcactcgtagtccacagagacaatacgatattagacaccttatgctccctaataaattctggttttttgttgaaaatcattcgtacagccccttcatccaacataatcggtgtcgaaattcgatcgtatcatctttcaccatctcagcgcactcctccatgctattaacaattttcgttgaagaaagtgtattcctcatcgaaaactttccccacaaactgttcaaccccttaatttctatttgttttttttttttgattttatttgttttcttactaatttcgcaatcatcccaagaccagagttaaaggcaatttggtcgtagtcaaggctgatgtcatacttagccttgtaaatttcaatgaatgctctcttttcatcttcgtttttcacatccgacggccagcctgacgcttccactgttattttaagaaagatccgaataacctttgaacagttggctgtcaaattgttcataatgataggccctgaagaatccagttactctatagcctaactccaatgccttccgcagttcaatcgaggtgaaggtccccgacaatgcccttttttcctcggggtggttaaactttttcacattttttgccatcatcaacagtccgtcgtagggaacatcatcgggcgatgtccaattcacttcaaaactcctgctcaccacaatttttgagacgccaacaggatatggggtgtcttaatcaaggaaataaacagaaaaataatcaattttaccataatttacgaatgggtagagacttatgatatcaaacattgctatctcaacttcatctgttgcctttgcgtacaggcaaaaaggcattgttcgccctcccgcataagcgtccctcggattgattgggcctttgtcggacaccccatcgaaaacttcttcatcgttctgttccgctttaaatcagctttcacatcacattcctaaaaaatttttctaagaaaatgttttttatattgagataccccaaacttcctccactctgaagtttttaca

SEQ ID NO: 12946 - DNA, 1951 bp, Heterodera glycines
ccgaccacaaacatttttcgactctcagggcacctagcgcaacgttctcatatgaaaagagcaacagttttttgctctccgtcgctcgtttttgtccgaaacaccccaggcgcttgtacactgctcatgttttttgaacacagaagtttttgtcacatacccacgacaaaatgtacaaaggcagagattgtcgcgggaagagaaaccagtcacacccgttttttgcacatcgcccgcgggccgacgtcgcgcaaaatgcacattatttttttgtttgtcatttattttggcatttaattttgttttaacgaatcttttcaaaatatttttcaatttgctttttttattattagtgccgtaataatgatggtaaacacgaaataacgttttgttatgtattttcaatttcctgttatatgtggcgaaatattttctaattaattgtttgtattttttacaaaaaagttctacatttattcaaaattgccatataaaattatttgttttattttttagcaaaacgactttttgaattttcacaaatttttcaatatttcttttattttctttcatctgcttttcatttattcaattttcaccatttcattttttatctgtttattttgaatgcaaagaagaaaggaaggaaagaaaagcgctgcgcccaggcgcgcatggaccggccgcacacagtgcggcgcatttatccgaaaatttggaacaagatttgcggcctgatactactgttaaataaaaggttttaataaatgtttaaagtatttaatggaaacactaattaattcaaataaactgaaaaaagaagtttctaaaataaacataaataaaataattataatgcaaatcgaatatataagacatcaatattactaaattaaacgatatataaaatctaaaattgaaaagtatactagatataaaaaagcatttttgtgttttgtcaagaaagctaccaagtggatttaaagattttaaaaaaattcaatcttaaaaaataactcataagcaaattcataattaattattagaaaaatgaacaaaaataattattaataaaattgcaaaggggaaaaaacaacaaggataaaaagaactaggggacgcaccgagaaaggacataaaaattaatttatcaaaattaactcccatcaaaagaaacgaacttataattgtcataaaatatctgaaagaattattaacacgaaatttgtataaattaacacatataaaattatagaaaattaattcattaaatgtaataaattaacatttaattttgttaataatttttttattccaacttatatttagacataaattattattcatttaataatttaaactttgaaatctataaaaattttatttaagttaacaagaatttaaatttatgaatgttaatagatttcttactaagttgaattaacggattgtaaatactaaaacataggaagctcatcaagaaaaaaaagttaacgaaatatctacacaagaccaatattaaaatacaaagaattaatataggcatcttccttgaatgaataaaataggcatgaaatgcccaaaataaaatgcaaattttcagaactttttcatataatttttttttaccaatttttgaactttttgaaatttttacgaaatttatttttgaacttcctcacaaaaaaaagaattttgaagttaatttttcaaatagctaaaatgttattcttagttaagtctaattgagtcattttttgcaatttgcttaaataggtttttctttgattttttgtctgtaatgataataaaacttctcgattctcgattttcggcaaataaggaatattttttcccatgtcaaaatgttggcttctcgatgtcttgatgatcaagtaattaattaacagaatatgaaaaagagtaccaatgcatatttgaataaaaatag

SEQ ID NO: 12947 - DNA, 4193 bp, Heterodera glycines
agattttgttcgcggtcagtttccggaatggaaatctggacgtcttgaaaacgttgaaagacatgattgaaacgcccggtttggccaagaaagcaaggcatttcaagatccaagacccatcaacccgcattgcattgattgatcaaatcttgaagcagatcagtgacttcgaatttgacggtgtacttctcgacttcaccggtcattcaaattaactcattaaaaaaattaattaggataattaattaaatgctttatttaattagtattattggtgtttaattattttaattatcatttttgtgttaaaaaagtgcctcaattttaggcatcaatttgtcaatggatcagattggaaagcatcttgttgattttcttggcgattttctgctgagaaatgcccaagaatacataaaccgttcaaagatgaacaaagacgctaaaaaactaattatcagtaattaattaacaattagtatatgtataataattttaaattgcttttttagctgtacgaattgaccacgacgaaattgaccacattcaaaccgaggctttttcacgcctcaatttgatggaactcatttcatttacgggcgtaagaactgaatcggaccaagcggaattagttgaaaaattgggtaatttaaataaagatatttttgtttaaaataaattaaaattttatagaagacaaactcagtgttgacagaaaagtaatcacggacaaaatttgtgaagtacaatcaccgtcaagacgattcaaaagaggcgcagggtaattagtggcttaattaatgcttctaatgatacataataattaagttattacacaatttgcaaatttagtttccctcaggccgctttgaacgttgggcaagaaaccaatttttcgtcgcgaaggcatattaaacaaaccttttagaataataaatgtattggtacattttagaaataagcgatcaccaccaccgtcgcccaaagcaaaagcaggagcacacggctcacccaaatcaccaaaacaagcaaagcatggatcacccaaatcatcactatccaaagcaaagcttggaacatccaaatcgtcaccatccatgacaaagcatggatcacccaaatcgacaccatccaatgctaagattgggtcaccaaaatcgtcattatccaatgcaaagcatggctcacccaaatcgtcaccatcaaaagcaaagcctggatcacccaaatcaccatccaaggcaaagcctggatcacccaaatcaccatccaaggcaaagcctggatcacccaaatcaccatccaaggcaaagcctggatcacccaaatcaccatcgaaagctaagcctggatctcccaaatcatcaccatcaaagaaaggccatgtatcaccaaatgtatcaccctcaaaaggcaaaagtcctcaaaaactactgtcaccaaaagcaatgctgcaaacgcacaaaagtgcaccggtatcaattaaattataccttaccattagagcaattaaataattagcatagaaaaatagtgatataaccaagcataataattctcgagcatcatcaaaatatgttcttagagcagtcagtaatcattaagtttgaacaccaacagcgccatgatccaaccacgaaattatcaccaatgaatgccaattttcgggctaaacactcaccaattatggcacagacgcactttgatcttaatcacacacgcaatcggccattgcataagcattggtcaacaaacatgcctggctcggcttacgctgatggacaaatgtcaccgcttcgtgcttcatcatcaatcgttaacattgtcgaacttcaccgacttccgacgccacctccgagacatggcttaaatgagcaacaacaatcacgaattgtgccaatgaagccctgcttttcacgatcaaagtccgagttgccggcaaaagtgctgtcatcaccggcttcggcaataaatgcaaagaactggcaaaacctggcacactcatcagtgagtagtgatggatcagatgatttcaatttccggatgaaacatcaccaatatcaacattcaccggctgtgccaataaattcgcttgcaaaaagccaaagttatgtgactttgccaacatcgccgccgccgcgtttcaatgcgtcaccaagtgccgatcagcaaaaaaagcattttgttgcgatgccatcatcgccgagctatccgcttccggttccatctcctaacactggcaaaatgccacaatttctgccaatggcagacaagtcctattttgcatatccgaaaagtagcagaacagcaaatcgttcatcgggctcaccactgctcgggcccaaaccaaagacactgatcatcgtccgcgattcatttcctctaacatcaccaagcaaaagtaaaagtgccagtgccgtggattaccaacaccgttttgagcagtttctttctccaatcaaaagcaagaatgccgccgctgtttaccatccccaaccactgcctttgccaccaaatatgccgtcaacttcatcgacccctattaaaataggccaacaacattcatcagtaattccaaccagaattggccatcattatccatcttctcctaatagaattggccatcataatttgccacaaagtattagtaaaacgcaggtaccgttaatgatgtagtattgatgctcgagaattgtagaattaatagatttgatcattaattgactggcataaaaaaattccttaaattaatcattttcaaaaaatcacattgttaaagcctgcgttggcccacatcctggcacatcattcgccccatttgccggtcggaagtgagctaagtccagctaaatcactcgacagccatcaccaacggcaaatgccactgtttgcgggcaaaaaatatggccaaaaccaccagtcgcctcatatgtcaccaacaaaactgtcaaatggtaatgtctcaccaccacaatcaccatcacatcgtctacaacaggtgaaaataatggaattataaaattacagaatttctgattggaaactccgtggattctttagggggggggcttaatattaaaggtggtagggaattttcaattcaaggagaggctccttattcagacgggcttctaactttgaggggctttatcccccccccaccgcgcactccctcataaaaagggggcttttaattaaggaggcttctaatatggtgccaagaccgagagcctgaaaatcataattctaccatgtgcctgatccattattaaaataataataattgttaaataaattatatatatttaagattatcaagcggcattcacagacaaaggatttgtccagggaaaaagtgcaacgacaacaacaaagtccgctgttacagcacccatcaattcgcgccctaattggcctgcccaattcgccggctgacgaccaaaacccgcctccgccattcacgccggaacagcacgcgctgcttatggacaccgtactccgtccaccgtccggtcttccgttcgagagtccacgatcagcgccgtcaccgcttgagctgagcgaggagcaacgcgacaaactgatcgatgccatccaaggacgaccacagccaggacttccatttgaggatgaagcggaacatgaaggactacatccggcacaccgtgtcaattcggcacatcttgaacacgttttggatgccatattccgtaagccgcctggcctaccatttgaggatgatgaagaggaggaacacagcagcaccaacatggtgggtatagttggatgaattttcccttagggttatcccgcatttcgtaaaaatcgaagttaatcgagtgccaaaagcagaaaatttttaataatcggaaataaaatggggctaaaatgaaaaaatattttcatgtgcttcatttaaatttcgtaattttaattttcacaattaagcatcactcaattgccggctatgagactaagctattcaagaaggatgaatgctgatgaacgatgaactgataataataatttttagaattaaattgtatttgtaaattgataattatcggtagataaattgagcacaaaagtcgccatctaattttggggattaaggtattgtgtgaatatttaagaaatagcaaaacatggtaacgattaaaaaatccaataattaattaattcactgattactttat

SEQ ID NO: 12948 - DNA, 3113 bp, Heterodera glycines
aaaaaaaggtcgtcgccggggaatattgggggccgacgtaagaaaaattggtcctggcgcaccccccccccccccccctgcgccaaacgtccgacgtatgagggtctgactggcgcaccccttgttcatggattggggtgcgcctcaaaatatcgccgcagaaatttaaaaaaaaaattttaaagaagaaaatctgaaaatttttaatatgaaaatttcaagaaaaaaatcattgaaaattttgaaagatttttcgttaaaaaacagtaatttatcataaaatttcaacaacaacaaaaaaagcgctgaatttttaaagaatttttttctttaaaatttcaaagtttgaaaattttcttttaaatttctgcggcgatattttgtccgggtgcactacgtttcccccccgagtagttactagtgcagattttggcccctaaagttcgagcccccttggctgcgaattattttttagaattaaaattcatctatccaaaggtgtgaaccatttttttttacatttttaaaaaaatccaaaggtgtgaaccatattttttgcattttttaaaaaatccaaaggtgtgaactatatatttttggcaatttttaaaaaaatccaaaggtgagaaccatattttttgcaatttttaaaaaatccaaaggtgtgaaccatattttttacaatttttaaaaaatccaaaggtgagaaccatatttttttgcaatttttaaaaaatccaaaggtgagaaccatattttcttacaatttttaaaaataaaaaaatatgaaccattttttaaataaagtgtgaatcatttttaaataaaagttgtgtgatttaaaagaccattaagaaagtaggtatatttctacccctattcagagggaggaggggtggggtaaatgactcaaagccttttagtggattttttaacataaaccttacggcatttttttataaaattgttttaattacgaatccagaattctctgtcagaggggtggtctaagggtattttccccttttttcgctgctgataaaaaattaaattaattgttaaaaataatggctgaaatataaagttttcaaaaacctaaatataaagacaccataatttaattttttaaaacccattaaaaaagagtagacagatttctatccctattttggtccttaatcataccgtatttataagatgaggggggtaatcctttcccaaaaaaacctttggtggacctgttactctgtgcctatgagatatttttaacaaaaacaaaaaagtatttgttttttttatatccgaacataaacaagtaaaataacaaagaaattgaaccgtcaaaaaaacttgtcccctcatcattacaatgttttcatccagtagagatactgaacgaccagtgtggcgaagatcaggaccaacacgatgaaaattcgttctttccacaaagcacgaagaagttttcgagaatgcggtacgggtgttgttggcggttgctgttcctcaacaatgcgctcaaaactacctaaatttacaattaagaaagagtaaaaaaaattgtccactcaacataccattattacccatttgcgtagatgaaaattgtaatttttgtaaaaattgtatagctataaatatgaatatacataaaatgagacaaagttgcaaataaaatttgaattttaacaaaacatcaaaatattttacagttttttttagcgaaaaacagcctagtaccatttaaccctaaaaaacacctaataggcatggataaaaaaacgacgtcaaccaaaatgaaaaaaaaagtaaaacaaagtttacatttttcaaatcattttttaacgcaaaataataacaaaacgccacgccacattaaaaccatggcggataaaaacattcaaccttttttataaaagatgggcggtgttattattagtgagcgcaatgttaaagttaaagtgtgaaacaataaaaattatgagggagggacaaaattttttaataaatatatcctttaccataaaattaaccaatttttcataaaaatagataaaatacgacattaatcaaaatcagaacattcttgataaatcataacagatcaaaaccgttgcatataagacattttttacctaagtttttttaacatcgtttaattttattaaaaaaattggctgacttttttttgacattttattaaagttgttttaaatttgaaaaaatgtgattgatcataattttttagattgaacaaagaatgaggaccagagcaacatacatacacaaatggattaaaaaaatcagatgaaaaagtaattaactatggtttttttaaatattcgtttttataaatataatgtaaacaaaactgctcaatgctgaccagcaaatagggcattttaccattttgggtgagattgtatttagccttaggttttaacaatttgctaattggtgtaatgaataaatcaacaatggtttatcaatgttctgtaattagttggtcaccggaggagaagcataatttgtaaatgccttcgtccgaatttggcctcagcgcacttttcaaagggcgcctttttgatgtggggaaacaacactcaaaaagggacgaagttttgtccaatgctttgctgggcactttttcgttgacaattcgaacattgggccccgaatgggcgcattcgcaacgcgacaaaaagggagagaaacggcgacggaaggcaaattcaaagggacggcagcagacaaacgctaaattagcaacttaatgaaccgaaacaaagcaattaactgaggctagcagatgttaaatgacttttttgaataaaaaggtgttacattccccgttcaaaaaaaagaaacgaaacgacggcctatgaccccccgccccgccggtgagtacgagatacgccgcaacccctagttcaatacccctaattattggattggcttttcgtgttttttttgccccctagattaaaatgccggccaattccccgcccccctccccaatgttcttttctcacctgtacccattccgtgtgcactgctcgcatcgctcgcacttttctccttccttcaattcggccttctcaaaaagtcggagt

SEQ ID NO: 12949 - DNA, 2798 bp, Heterodera glycines
  misc_feature (2722)..(2722): n is a, c, g, or t
  misc_feature (2736)..(2736): n is a, c, g, or t
  misc_feature (2772)..(2772): n is a, c, g, or t
gaatccctacttatatgttcaatgactattgtattttcataaatttttgtatattttttaatttcactttttttcctgtaaagtgacaaaatgttcgcctattaacagctgactgatcgaggtgatcagcagcaacatcacagcaacaattacccccgtaagaacaggattttctgcctgtcccccatttattcacttttcgtccgccgattgagacgaccgaagcagacgaatgaacaatttgttgttggttgatgaacacatgagaaacaatgttttgctgcgcgtgtgaaaaaggaaggcttttccggctcaatgcatgtgaatttgtagtgatttgaagcaacaaaaaaaatcaattatcaaaaatggcaaaatatattttttaaataagcttttgtacggattgcaagaaaattaatttgaattttttttaaattttttaattagaagtctgcaattatttagctataaaaaacctgataaatataaatttaagaaaaaaaaattgtaaacacataagccatgaaatttttgaaatttttttgggcagacaaagatatctaggcttgtctttttcccataatgaaaatctttttaaaatataaattcaagaatattttttggttcccaaaatttttcactttaggttgttttttctaaagttaaaatatgagacacttgcttttactttttttttcttaattgattataattcattttcgccttttaaatttgctaaaaaatttccattcttttctgtcccccacctccctctaaaagaatttcgctgtttttcactatttaattagctgtttttattatttttgccactactaaaattacgcataaatacattcccaattaatttggtcctaatttaccaaataatattccataaacaatatttattattgttatttgtgtgaatagctgccccaatttaatatgtaaatagtgcacactccgctcaatttcatccactcactcactcacaatactcatcaacacgttcaatgggtggatgggtcggtcggttggttgccaggtgcccaacactcaccgatatccatttttggtggcactaatggtgctaattacggcataattccctctccaccttctcttctgtgaatgattttgtgcacgcgaatgttgtatgtttctatgaaaacattttctacaaattggaaatcctttttaataaatgcctaaattgtatttgatagttaaggcaaataattttaagcggatttattaatggcaatctcaattttggtgtattttaaatatttctcaaatattgtaaaacaatttagcatttttatatttaattcaaaatgacaaaaattttattttaaattattttcgttttttaattagacgagagcccaatttttaagtgtttaaaaaagtcaaattttattctttttaactattttgtttaaatttaaaatttgcaaattaattttcattttctttacatatttatatttttattttgtgttaattcatttattttgtgcatgtacaatatattcatcctccaaaactggcttaacagcacaaaaacacccataaattattcacacatttcttcgactctctcctctccaatattcatcatcctggcactcctcccttccccccccccccccccgtccgttggttggaagagccaattttggcattttttatgccagcagctttaacgtaaggatgcaaaatgtcaatgacatgggcatcctctgctgccggataattgaaagttttttggatttattgaaggaggaatttgggaattcggaatttctgttttaacaaaaatttatatatttatttatgttaaattttaaataagtttaaatttattctgaaactttataaattaaagaaattatgttttaataaattttatactattcaaaaaaatgtttccttttttattttttcctttttttgtgacaattgcttaaaatcaatttttgccttaattaattgattaaataaaaatcgcttaaacttgcacgattttgcaaggctaaaattttaaagattagctttctgctttcgaaatatatgaataatgaattattagatactttattatgcttagaaaaagctcaatcatttcatgtcagtttattttttactttgaacccattctacttatgtgtcatgtgttttttggcaactgatcagctattgttcaactgatcggctgggtgatcagcgatcatgccgactgatcctcgccttcgctctttatcaatgcttttgctgccattcccgtgatcactcacctgacataattagcaccaatctaattaggtcttgaaaggtaccaaatggctttttcaatgcttttttgatcgagtgtcgctaattttagaaagaatcggactaatctaagaagcatataagctatccaactgtggtatattggaccaaaaaacttaaattacacttaaagattttattgctcagttctaatgtttttcctatttttttaaatttccattattttacaagtttcttcaaactggctatatttaaaatttcttgactacgttccgaagactctaataaatcaattaaattttcaatatgtagagttttcgctttttcaaaaattaattcccaactcattttattaataaccgtatcactaagcatacattaattagctaattgccttcttttgataatcaccgtcccattntctctgctgctgantttgtgggtcaccaatgccttcgctatatcaacaanacttcaccacccatcacaacaatttt

SEQ ID NO: 12950 - DNA, 2486 bp, Heterodera glycines
  misc_feature (59)..(59): n is a, c, g, or t
  misc_feature (76)..(76): n is a, c, g, or t
  misc_feature (106)..(106): n is a, c, g, or t
  misc_feature (108)..(108): n is a, c, g, or t
  misc_feature (131)..(132): n is a, c, g, or t
  misc_feature (134)..(134): n is a, c, g, or t
  misc_feature (146)..(147): n is a, c, g, or t
  misc_feature (185)..(185): n is a, c, g, or t
  misc_feature (239)..(239): n is a, c, g, or t
  misc_feature (256)..(256): n is a, c, g, or t
ccccccccccccccccccccggcgggtggaggcaatttgccatttttatgccagcagcnttaacgtaaggatgcanaatgtcaatgacatgggcatcctctgctgncngataaatgaaagtttttgattanntngaaggagaattnngggaattcggaatttctgttttaccaaaaaatttaaanttttatttatgttaaattttaaataagtttaaatttattctgaaacttataaanttaaagaaattatgttntaataaattttatactattcaaaaaaatgtttccttttttatttttttcctttttttgtgacaattgcttaaaatcaaagtatgtttttgccttaattaattgattaaataaaaatcgcttaaacttgcacgattttgcaaggctaaaattttaaagattagcttgctgctttcgaaatatatgaataatgaattattagatactttattatgcttagaaaaagctcaatcatttcatgtcagtttattttttactttgaacccattctacttatgtgtcatgtgttttttggcaactgatcatctattgttcagttgatcggctgggtgatcagcgatcatgccgactgatcctcgccttcgctctttatcaatgcttttgctgccattcccgtgatcactcacctgacataattagcaccaatctaattaggtcttgaaaggtaccaaatggctttttcaatgcctttttgatcgagtgtcgctaattttagaaagaatcggactaatctaagaagcatataagctatccaactgtggtatattggaccaaaaaacttaaattacacttaaagattttattgctcagttctaatatttttcctatttttttaaatttccattattttacaagtttcttcaaactggctatatttaaaatttcttgactacgttccgaagactctaataaatcaattaaattttcaatatgtagagttttcgctttttcaaaaattaattcccaactcattttattaataaccgtatcactaagcatacattaattagctaattgccttcttttgataatcaccgtcccattttctctgctgctgattttgtgggtcaccaatgaccttcgctatatcaacaaaacttcaccacccatcacaacaattttaagcatttgcgcacagtcccacccacccaccaaatctgtgccctctccctgcccaacccatcgtcgaaaacgtcgaaaatcctcgctctaaattcattctttttcaaaaaataaatttgcgctatgtgtaaaaaacccaaaaacccgtcatccatcaattctttccccccccccccaatacattcatttctttacccatctgctgctcactcggcttggtgatgatgcgctcgctgcatgtgcatgtgcacccatcgcccattcttttgcgagaaaatgccgctaccgctccccccccccccccgcctctccactttatatttattgatactgcttgggcttctcctcctatctctcctctctctctctctctgctggatttcaaaaaatgcagcattttcagttataatttattctcattttttctgcagctaatgcttgaaaataaatgtttttctcgtaaattgtacattttgttttaagcacaaattcgtcacagggatcactttttttttggatttttcaacactaaaaatccgcttatgaatcatattttgggcattaaaaataaataatcatgaacagctgctgggttaatttagcgggtgttgggtatgaaattgcgtcattttattttgattgagaaatatgtgcgggtttttttggtggttctaccattttttcgctagatttggactatttcgtttcaaatttatacattgggctgcttaaaaaacgcattaaatattttgtttcattttttttctttgaaaattggcaatgcgagtatcgttttttaatccagctaaaatttttaaaatataaaaaaatattttaactaataaaaaaaacccacaaaatgagtttaaaagcccaaatctggcaatcctgccccttattattcattgtaaaattcaattttcttacttaactcctcacctaacatttatcaatatattcccttccaaatgattgcataaatcatatggctttcttttcgcaaattatctctgatcagttggccaatgttaccctattctaatcgcgattgaatactgatcaaaaatgattctttgttctcaccgcgatagtccataaagaggtggccaaataacatcccccctctcactttccttcccattaagtcgagagtccaaagtcctatcagtgtcccgtcaacggaacggacggaggacaccaaacattggccagcaaagcgaagccgctgctgggctttgctcggcgttttgtgtgtaatctgtggccggcccatttcggcgccggacggtggtggccgggcggtggtgtcctgtccgtgcctccttctcg

SEQ ID NO: 12951 - DNA, 758 bp, Heterodera glycines
tgttctgctgatgttgatgggcttttcacaattttttggcgggctgtgccgttgggccatttgccaacgacgaaagtcacccgctttcccccccccccccccccccctcctcacaattaaatccctgtttttttgcctctgtgatgctctttgaacaccacacactgttctcgtgacaaccacggccattgtggccaaaatcacattttgagtgtggatgagtgccctcctcattttgagggctataaaagcttcatccgctcgcctttcccaaattgtctctggcattcaaacccttttttttgccattcgcttcgacaaattgtcacttttttccctttgcgaattcattttaaatataaaattattttttaattacaggaataaaaaaatacttttgctgaaacatcggataataaaaaggcggcatttttattttgacccttcgcttcgcttctctctctcttttcccctcatccaaaatgccattcatcggaaaggactggcgcgctcccggtaatgaaaatggtgtttgaaataatatttttattatttttgtttaaaggtgaagtttgggtgcgagtcaatcacacctctggctgggagcaatgcaaagttagacaattattaattatttttaaaacattttcaaatatttttccgatcttgccagtgcgacaaaaaaagactttactggaaaattaaaaaatattggataaggacaattaacttttgtttattatattttaatgatatta

SEQ ID NO: 12952 - DNA, 4103 bp, Heterodera glycines
  misc_feature (8)..(8): n is a, c, g, or t
  misc_feature (28)..(28): n is a, c, g, or t
atgctttntgtgccacaacacacacacntttgagaagaatgcccgcgttgttgatcagcaagttcagtccgcctttgtccagcaattgcttttggacttggccaaatgccgtccgaatgcttcggtcgtcgctgacgtcaattctgatcagtcgcaatggtccatttttgtcgtgcagttgttgcaattccttaaagctctttttccctttttggtctgatttgtgaggttaaaaatttcaatttcccctaagggttcgtccactgaccgcagccgaatcgacgtccctacaaccggcgaacacatttttcagtccaccaaccgccaacatttccttcaccaatccgagcccaatgcctcggttggcgccggtgataaacacattcacaccaagcggagaagacatcgaacagaaaacaaattgaatcaaaaaaaaaaagaaataaggagaaatagcagcggacttttatgggaaaacactcaaaataatttaaaagggtaaaagtgtattcagaaaacctaaacatagaaagtggacagaaacaaagaataagcagaggaatcagtccgtcttcgccccccccccctccgatcattcgtcgccctccgtttgttcgttcagtgcctccgctggcccatcgtccttttctgctgatgcttcttctctttcgcgccctccagaaaagtgtcgctctccgctcggcccttttggattgcttttgcaaacatttccatgaaaaagttgacggattcaaccgagtcgtcgttgccagggattgggtagcacacgtagttgggctctgatgcacggattattggacaaattctttcatttcctattgccactcaccgctgttcgagtcgacgatcgccacggttggaatgcacattttggccgaatcgaccagtgccggatgtgcttccatcgcgctagtcagcgtgttcaacagaatcacagtgtcgggcagccgaatgggccctccgaagacgctctttgtgttggtgaatgtgccgggctgccaatggcgcgtgtgggcgtactgtcccaattcgtcggccattgtctccaccattagcattgaggacctgaaaaggcaaatgccaccaaatggaaagcccatcgggaagcagcacttattggtcgagacgaagagaaagcgaccgcccaaaaaagccacagatcggacaaattccaacgcctttagcagataatgccgagtgatttccaagtcaaagacgcaaatgccaagacgttctgaaaaggaaaaaatcggaaaacaatttatacccaaaaatgatccgatgggataacctaaaataggggctaattggtatttccgaactcatttgttcggcgctttatttttttcccgactaactgtaaatttttaagaatttatgacaaatggctaattacagatatgtcccttttaatttcccattctttcgatgccatttacctccatacaatgcccatttcatattatcgttgagagtgccaacctaaaaaaccaacttttagtccatcgacacatcaacaattccttaatcgaatgtccgaatatcagcgaatgattgagattttcataaaaatttatgaatttacaacatcaaaaagaacggaaatgttattctgcaaaatgttctgctttttttggaaattagtaaagtttagttaattttaagcatttgaaggatgaaattactttatggcccaaatggacacgcgcgtcaagcattcttccgacggtcacttcactctcaaaaggaatttgggtcggaagagcacagagtcgggtcaatgtaaggtctgaatttgttttgttaagaccagggaaaccgtaccaaatgggttaacccattggtgccgattcgaacttcagttacatttttaattccacccccgactgacttgagaatcgtcggactgacttttcccttcctcagagtttcgatgtccgggagatatgccatggattgttgtggttgtgccatcgacactttctgctcaaatgccattggcaccgacgccatccagcgacaatcagtcattgtcctcattaaactctttaatgtattcacaggttttatcattgagtttggaaaagccatttatggaatttgtgacctgcaagggacaataacatatgcttgagttcttacatttcctggctaattttgaaaagatataaaaaataaattaattaatattacaaaagtaattgacttccaccatatttcttggacaatttttatttcggatgtcaaaatgcaaaacaatggattaaagcaatgtgagaatgaataatagaacattatgatacgctcttttagtgagaattaaaaacaacaaaatgatctgtcaaaaattatgaatgaatgaacaaatacagaaatattaaaattattcctttaattactcgtcgttagaatttaagccgtgaaacgattagacaatacgaaagttccgtcgccccaatatgaaagctgaaaagagatggaatagcttttcaactgctgtttttcacccacaattctgttcaattcgtggtggtcaaccagcgaaatggtctgtcgctttgcgccttttttcgccaaaagtcggtgctcctttttcggcacttggttcggtttgaaccgtctaaatgcgaaacttccttttataaagtcatcctataacaaagttctttttaactcactttaatgcggcaaaattatttttccctcgcttggccaattcgtccgcttggtacacgggctcgggcattgagaccgccatgttgacaatctaaaaatggtgcaattttagagcgcatttattcggctgtcccttttcacctgatgggaatacgaaagtgccattatcagtccctgcagttcgtccattttgacacctatttcgttctccaacatggcatattccaccggtttgccagtcccctaaataaatgcatttcaatttccattttgatgctttgcaattgccttgagtggcgcgtgcggttgcaaaaaacttaaagggcgaaatatttttttatattcctgtaaaaaatcgcacaattcggtgatgtccgctcggcatttttcttggatgatcgtacccgggtacagattttttgagaaaggtcgtccgccttccttcggctcttcttcgatgaaaaactttttgaagtgacgcttggtaccgataatcatgacgaactaaaaacggttcattttatgggttgggtcagccaattcggactttgggcttgtatttcgaatcgaactgtcgacacccttctttaatcgccatcaactcctctttacatgcctgaaaaggttgtaaattatgaagagcccgttcatgaacggaccatcgcaaattgaccctccgataaaccgtcccgaaagacaaaaatgtatttcgggcgattctgtgaaggacgatgattgtccaaattgtgaaggatccatttcacacgttcagtcaactttaaatggctcactcaaattcaccataaattcatttgaatcatgtgtcacctgaagaccgtctatggcttcgcgtctggcttctggaaataacaatttaaaaaacaaaaactaactgtcgaaaaccttgaaaaaagtaatcgcccacgaaactatgaggatctgttgccatattagcacaaatctaattttaaaaatatatataaaaatacaatgctgaggaaacaatcaaaccccaacacacgaagggtccagcgaactgagttgagactcgccctgggcagccaacatacgccgagtttgagcagacataggcgctaaattttggtttacaattagtatgacgacaaaggttaatttatatacttaccaggatgggcaacatcgtagccaagcttaattggattgatcaaattgtgcgatttgtttaaacaatttgctcaccacaagaacatcaccggtctccaacgcaaaacgtttcccggactgttcgatgataggcacgtaatttagtccgaaattcttcatattcaatttgttcagaatgttttccaaggtttggcgctggttcttttttaccacatccttcacgatttacagataaagagaaggaattgagtgtttacact

SEQ ID NO: 12953 - DNA, 1916 bp, Heterodera glycines
gaaattgtgaataattctcagaaaaatggttatctctttttaggacaattttctatctcgtaaccccgatgctaaatggttatctctttttaggacaattttctatctcgtaaccccgatgctaatccgttcctgagagcctcttcaaaattttttccattaccgtaagagctgcagaaattgtgaattaattctcagaaaaatgactatctctttttaagacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgagtttgagcagacataggcgctaaattttggtttacaattagtatgacgacaaaggttaatttatatacttaccaggatgggcaacatcgtagccaagcttaattggattgatcaaattgtgcgatttgtttaaacaatttgctcaccacaagaacatcaccggtctccaacgcaaaacgtttcccggactgttcgatgataggcacgtaatttagtccgaaattcttcatattcaatttgttcagaatgttttccaaggtttggcgctggttcttttttaccacatccttcacgatttacagataaagagaaggaattgagtgtttacactcacaagggccttctccaacgttatgtgttgcgtcgtcactttgtgaatggcctcagaaagcttcaaaagtccatgggtgtctttccgcctttcgtccaccagcagtatgaattgaattcggttgacagtgcatcgctcgaacatggccatccattcttgatccgagttctgtaacggagtaaagggagggacaaggtttcttattgttgacaaaaatatgaattaaaattggtgtttgaccaacctcggggctgtcgaatgagacgatctccggctctgccatccgaatacctttgtccctgcccatttcgcacatacgccgcacaaaatctttgacgagattcgtattctgacgagcacagagcacaagccaattgtccaactcctccgcagccaaatattcagctcggctcgcgtctcgacgccactcgcccttgggaacaaataaatgatttcattatgtgttaacaataaatcttaaaacttttatcgcatccggaagaagcaaagtgttgcgtttgaagcgaatttgaggcaaagaacggactccgaccacaacctgacaatggacaaaacaaaataattcattttcatgcgatattctgtcatttttaaaagcgcaaatgcatgtttaaaatagaaacccataaaatttcagtttaaataaatggattgtattcgtttttctggtcatatgcttgccctattggatttttggtcgatactgagcccaaatgcacgaaggacggggttttcatcagtgaacaatccgagtgcccttgccctttcccaaatcgctttcattcgttcgtttggtggcattgaattgaagcgcaacagttgatccatcagcttagagtcggtcttttcccgcggaacacgcttaaagaaattcaaatgaaatataagacaacacgtaatgagatagacgatggcaaagaaaagaaaagttggcccaagttgtgtctgacttggtcttccatgacatccaacaattccaaagggaacacttcggcctttttccccgcaggtataggattattctgaaaattaatttgaaaatgacaaattatcatgtaaaatgttgagcgtaccggaataacaccagggaagtccacgaacttgagctggatcttccagaacttgaagaagtattggggaatggacattcgctcgggcggccctccgtttccctctccacgtcaatgaaaa

SEQ ID NO: 12954 - DNA, 1141 bp, Heterodera glycines
atgtaaaaattcattttccttagactgactcccaaattgctgaacggactcgagttcaacgagcgcgtcactgtccacattgtgcacaacggacccgaaattgaacacggcgatgtgagtttttgagatgggagggatgacaaaaatttaaaaaaaaaacaatttcgggaattccctttcaaaaccgaacgctctcataaaattggttaaaattccattactttgcccttttgttcccatttttctccgtcattttttctcacgggacaattgggcggtctttttgtcaattaattaattactaattagtttttacattactttcccccccccccccttacaattagcattgggatccggagaattttctggctggggccaccaatgggcaccaccagcagcggcagcccgagcacggacaacagcggctgccgggcggccgtccccggcaattcgtccgagcgacggcggaagacggggagggggaggatgaggacgaagggaccgatcactgatcagcggagaggcgccagaggcactgtgatcggcagcggatgagtgaggaaaagggaagggatgaaagagcgatggatgttgggatggctctgatcatcaatcactcactcactctttccccggggggccaatgtttcgccgtctttccgtttggcatttgtttctgtgtgttccctctccccattctctgccactttctctctgcctctgctctctttctttgcctcctcccatctcacaatggtttctcgatgtcacttattataattctctcccattgattgatctctcctttttttggcttttccaatcattttttcggatgactctaaattttttattaaattaaatattttcattactttatgtttatataaatacatttgattacacaaaccgtctaattttggtaacgctttcgacgtgggtgtgatgggttttgctgtccctcccctccgaatttcgcttaatttccctgcctttcaaatccatatggcaaacaaaagcaaaattaggcgcgaggggggggggcggcaaaaatttggccaatttttgacctatgcaatggcaaattgggtcggaggaggagaacacatttccattatttctattttttggctgtttt

SEQ ID NO: 12955 - DNA, 1338 bp, Heterodera glycines
  misc_feature (79)..(79): n is a, c, g, or t
ttttatttttacctcatttgactttgacctcaattatttatttaattatttttcactatttttgtttttttaaaattcncgtgatcatccatatattttaatttgctttttgtggtggtgttctcggaaagcgttcgtattgccgggagcaatcgaatgccgcagaaggtggccaacacgccgcgcgagtgtgtgcgcgtgtgcacaaatttgttggtgagttacgaacgtgcagcagtgatacagtactttccataaaacgatataggaaactacggtattttttttgtaaaataatttctctctgacgcattttatgggatgtcgtttcattttcttctgatataaatagtcgagaatgacggattaaaaaatgggttccgttccgtgatcattgatcagttttaggcactttttacgtataatcttcatcgagtttataagatttaagcaaaagcattgaagtgccttctctgattttgtgcttttcctccttcagcgagcctttcacccttcgagaattgtgccgagtttttggcattctccgactaccgcttggagacggagccccgcgaagtctttgacggattgcccgcctcagtcgagggactgtccgcatgcattgagctttgcgtgctgtccagcgactttcgttaatttaaaattagcactcatcacagaaatgaaattgcccaagcttaaaataacgatttatatgagttttttgagatattttttcttacttgatcaagacctacattcttaacaaaaattatttccgaaaatactcgaaaagattaaataactttttttattcgaaattactctcgaataaattttattcaaaacttattttttaaacgagaaaaattctcatattaatggtcaaaatcaattagcagcatcattgataattggtttttcagcaataaaagagatggaacgagcgaattttcttttccacgtcaacttcataattttcaatgtgcccatcagaagctgaacaaatcgctaactgaaaattaacaaaagcatttagtcaaaataaatcgtaaaaaaaaagtatatattttttaatttaagatttagaaataaataaccaaaatttgagtcaaaaaatatggaatttaacgctaataataaacattaaaattcactgttaaggcagcactagcgacacataagccgtccaaaccacgagaccaacgacaaccaaaaaaggcatttcccttgcacaattttaggaaattttttccgaatgaatattcctgtttacgtataaacaaaaataattttggaaacgataaagttttttaatttaaaggctgacaaatgttt

SEQ ID NO: 12956 - DNA, 2055 bp, Heterodera glycines
agcgatcgactcaaatgagaatagggcgaacgaaatcttgaggtgttgggtgaaaatttggaatgtgtttgaagagtgaagtcgcttcttcgttcgaatttgcccaatggcgaacatggcccaacaaaattcccttctcttttgccaaaacgattggaattaattcgcccaatgaaggcaattggatgcggcgaagtgggtcctgagttggcaaattggtgaaaatgtcctccaacgaaatgcacgagcaagcgctgtgctcctccacgcctgagcaatgcgagctcaaagcaatcggcgcaacgctttctgaaaataaattctgaaaattaagtgaattaatcctgatttttccttttggttttccattttcgaagatggcacaaacacttttgcgtttttgcttagggaggaaactttcgtatgggatttcaactgggaccggtgacaagtgctcaattggcactttgatcggttcgtcgttttgcctatctattgggataacaaatgctgcagttggtgtgagtgttttgatcaggtaaggaccataataattccatgtaagttttttatggtcggttttcaccgacggacgaaaatagaccatcacacggtcaccggcactatatttccccaactgaacgttcggttttgaatcaaaatgacttttttgtacccgttgtgcactgttaatgtttttggacgcctcattcaaaatcatttcgtagttttctcgaaaaaactgtaaatattcgtccaaatctacagtatataagggatttggccttttcggtgcatcaatttttgatggaaaacggagttgtctgccaaaaaataatgttgatggcgaaaatccggtactttcgtttggcgtaatattgtaagaaaatgtgacataaggaacacgtaaatcccattcccagggacttgtgcacgttttcctcgtcatttcaattatagtccgattaagtcgttctgcaaggccattagcgttgggatcgtaccctgaggttgtggaccgggaaacaaggagtttttcggcgatttcctttaaaatggcattcacaaattcccctcctaaatcagaatgaattgtttccggggccccgaattttaaaatccatttttccacaaattcctgtgcaacagtttctgccgttttgttgggaattggcacattttctgcgaacctcgagaaatggtcaatcattaccaaacaatatttgtttccattacgcgttggaccgagttttaaaatgtccatacagactaattggagtggtctaattgtgacaattggatttaaacccgggtgattttttcttggtatacgattgtgagcacaaattctacaggaccttgaaaaacgttggcaatcagaatacatgttaggccagaaaaaatttaaagctttaagacgcttaaacatctttttcccgctctggtggcctgcacatggtcccgagtggtgttctatgagaagaggttcccggaattttgctgggacaaaaagttctgtttccgttttttcatttaagtgaaaagaattccatcatcgacattaaatcttccaagggaatccattaacctttggcgaagtttttgatcagttggtaagtttttatggtccaaaaactcaaagataaagcctaattcagaattgttcacttcttttacccattcttcttttggaattttttcgggcaataaattgtttttctgaaccaccatcactgaaattgtcacactctgattttcatttttatcacaaaattgaaaaggggcatcacttgggaaagcccttgaaagtgcatcagcgacataattttcttttcccggactgtaaataacttctaattgaaacggggctcctaattccatgatccaacgatcaacttttgggttaccaactgaatttttgcttcggaacatcccagggagtgctttatgatcggtgacaacaactgtcgggagccaagcaatgaattgtttgaatttttgaacggcaaatttaattcctaagcattccaaactggtggggccgtaatttgactc

SEQ ID NO: 12957 - DNA, 2474 bp, Heterodera glycines
cgtaaatatattgctctcgctaatctcggtaccggaactaaactaaactctctgacgatcaccgaatgcgaatttaagtataaccctagaaaattcaatgccgcagttatataatgcacagatcccatcaaagccacggcattattatgggaatccgggaaaatgatatgtctggggacgcaaagtctgatagactgtgaaaatgctattaaacaatttatagaaataattaagggctcggggtgtcctggggcttcttacaccggacacacttcgacctttaaattcggacgtgaaattgaactgaacgagtttcgaaaaaatcgtcgtgcattttatgaaccggaaatattttgcggtttaaatttcaagcggggtaaaagcatgacagacagcgttaattttctggaccggtaaagtcgtaattacgggaactaaaaacaattctgaaattgaggaaatgtatcatgatattctcccctatttgaaaatggctcaaaagaagttagggagacgataaaaaatttttcatttattgggacggtcccccaatttatagttctgttgggtatttattttgttatcgattacttcgcgcgacgccggctcgcggcgcaccggcggggcggagaggaaatgcatggttttggcaaattttcaaaattcagaaaaatcatcataaaaaaaatctcaggatttcatcgtaaaaatacacttaaaatatttaaatttgtcataataattgcgtatttttaattgttcttaaagcttacaaaatattcagaaaatttctttttatttatttcaaattttaattgttgtttttatattttgcattattaaatgattaatgacctttgcgcggcggccgacctaatgggcggcgggagggagggaggggcggctgacggagagagggtggtggagaggaggggcaaaagtgcagatcaatattggtcaaatttgaatttaatgatagaatagccgcaacatttttaattatgcggcaattaaatagttaacatttttattttgtaaggcggctgcttcaaagggtttggattgtgctgacaaatatcgactttattttatggcggaattcgggattgtgagcgggcggcaacttcaaaacatttaaatagctcgggattttggggaaatatcacgggcggcaacttaaaaatcccccaataggctcgagattttgcggtaataatcctaaggcggcaacttcaaaggaaaaacacccattcaataggcttgggattttgcgcgggcggcaacttcaaaggaaaaacaccccttcaataggcttgggattttgcgcgggcggcaacttcaaaggaaaaacaccccttcaataggcttgggattttgcgcgggcggcaacttcaaaggaaaaacaccccttcaataggcttgggattttggaggagtcgttccggtacccgcgccgttttggagccttatactactaatattatatattttaatataaataaagaaaggtgggaaaatccaagaaggactttgatataatttcaccaaaagaaataagttagattaaaaccataatattattggattttatttttggccattaaaattaagtcaatttaaataaactttttttaaatttaaatagatttaattcttctcaaaaaaagaagcctaatagcagtgaaaaaagtttcaagaagctttttccaacagcctataaagtgctaagtcaaggaacaaaaagtggagatcaggcgatggacaaaaaagtgcaaaaatcatttatctgatttttcctataattattttatcactttttaaattacaaatatgttaaaatttattaaattgatgctaaataaacattcttctaaaagttaagttgtatttcgaataaaagaataattaaaatttacttaatattaaataaaaaattttaatattttaaaattaattacaaatcgactactattaaaaaatgaactcaaattagaggaaaaaattgaaatatcctctttaactcaatctagattgatttggcctaagcctatggctaggctttattttgtaaaatttgtagacagcatttaatttcaaataataaaaaattcaaattaatctggctaatgattttgttaattaagtaaattctaatttttcttttattctaaatacaacataacttatagaacaatgttgatttatcattaatttaataaaaaaattgataagaaatcataggaaaagtcagataatttattttttcactttttgtccataccatgggtttttacaaagcataaattaaaagtaatatcactttaatataaaattagagactatttaggaataggaactaataataaataatattgttttgttatcaaaaaaagtaaatgtaataattattcattatgtaagaacttgaaataaaaaaaaatcaaaaataatcattgatttaacaatttctttta

SEQ ID NO: 12958 - DNA, 2064 bp, Heterodera glycines
  misc_feature (1916)..(1916): n is a, c, g, or t
  misc_feature (1940)..(1940): n is a, c, g, or t
  misc_feature (1948)..(1948): n is a, c, g, or t
  misc_feature (1965)..(1965): n is a, c, g, or t
  misc_feature (1969)..(1970): n is a, c, g, or t
  misc_feature (1973)..(1973): n is a, c, g, or t
  misc_feature (1997)..(1997): n is a, c, g, or t
  misc_feature (2017)..(2017): n is a, c, g, or t
  misc_feature (2028)..(2029): n is a, c, g, or t
aatatagatattttttcttttccaagtattttatttgctaaaaattattttcaataaataaaattttcaaattcctaaactttcattttaatatttttgttaaacattgcccattcgtatagttgtagttctgaagttgttcaatttttgcataataattttattattttttcttgtttatttcttttttatgaaaatttttgagaatattgacttataaagtttttgtaataattgggtgatttaattattgttataataataaattttaactctatttaaaattattataaattgcttcttatttttcctaatcgtaaaattaaatttatttcagtcaggaaaattccaagatctttgaattacttttgcactttgatgcaaaagcataataatcaagtgtaaaatttatatttaaaattattgtttaaaaatgttttttgtatattgaaaaaaagtccaaaaagcaacttagatgcttccagtttccattaggttaattatttctattgtttcatgatgattttatttatattattgcaaagtaaatgatttagtaatttggtgcgatttattcattttaatcattttgttaattttgacataattactctttgttcaatattttttgcttattaattagactgtagaaaattacttttgagaatgttatttctttgtttcttagatatttttatttttaatttttgtaacccagagtctctatggtcgggacatcaaaacggcaagagcgaacgcccattatctggttttaatgcgtaacccttccggacaattacaagtgaggacactggggtcacaactgttcccaaaaagactgaattatttcatggatgcatatcatgatgcgaccaataatcaatttagttatctcatgattaacatgcacccaaattctgaggaggaatatgaatttaaattaaattaaaaatgtataaatttagctccgaagtgaaggagaatacagcattcctaaagaagcttgtctccaccagatcagaacaaaagaagaacgaattaatcgaaaacgctacagctgaccaaattttggcaatcgttgaaatttgtgcaaatatattgagttttagttttaaactaacgaacaaacaaaaaagaaggttggcacaatacgccgatttttatagagaaattgccaaatctcgttcagagaaaacggtaagaaaaaggatacaacaggggagtggtatagccctgggagctgtcttgatacctgtcctgagttttttagcccaacatttattagaaaaaataacatcatgaaatttgcaaagaaaatgttaatgattcccgaggcggaatatttggctctacggattgcgatgaattggctctataaagaaagacgtacggtaaaggggatacttgaaaatagaccacagaaggtggtgattgagaatcatgtacccggtccgaacgctgcaccatatctaggcctcaataaccaatccaaaccacaggagaccgatgaaccacggaaaataattattcctaggaaaagacttaaagagcaaactcctgatcctgaatcagataatgatacacttgaggagttaactccggaaccccaaacaccatccacactcaaaacacccgttccgaccaaaactattatacacccgacccttttaaacggtttttttaggtacgtgaaggaaaacaaagatttatttaaaattacggcggccggaaaggtacagtcgaacattgatactgaaggatccaacagtaaaagacattggttgataaatcaaaagtcatgtggggacgtggaaggaaaaaggcaataaaatctataaaaacacccggcatagtgcgagagaagaaacccttcaaaccactaatatgggcaagactgtagagaaattttatcgaanatttattttaatttaaaatctccnggcaagtntttgctggaattcaaanattnnttnaatgaggccaaaaagattgacccngaaatacaaaaccgatgacngttaataattnnctaaaaaagcagaaaacatacacgattcacaagcc

SEQ ID NO: 12959 - DNA, 1564 bp, Heterodera glycines
ttttttatatttttaatttagaaaattttcaactaaaaaaacaaaattgcaggtgtttttgatagcactctccaaggatatgcgtgtccaatttatgcgaactattcgcaaaacggtgttcttttgtaatggcaatacagcagcagcagcaacagcaacagcagcactgcaaacggtagccgactcataccagtacagtaaccgaatacggtatgtcaatgtccatgctactggaagaatcaatcggttcaatggacaatgattacgcagcagaaatttgcggaattagattattttttgacacaaattcttttgataattaaagagaattaattaatttacaaatttgacgaacaaagggctaatgaggacaacccaacaaactaatgatgtcgtacacttgtctcaaatatgtataaacaaaaaaaaaacaagaaaattaaaccaaatttattttaaaaccaataaaaagctaatgagttataattcaaatatttaagcaatgtaaaaaaattaaataaaataattaattatttaatttactattttcagaagtgtttttatgcttttgaagtaacgaataacggtcaaatttaattttattaggttattagaggttaaatattcatataaaagttttttgaatagattttaaatgtatagacagataggcatttttatttgtgttttttaaatacaatttcgtagtaatatttaaaaataaaaaattctattagttatatttgaaatccattttttgtaactttatagaaattttaatttttcaccgttttatttttcactttgacagatataatccaacaccttgtcatgcatgaaatatccaaattaatattttcctttctaattttattaataattatttaattaatattattatccatttttcgtcttcatcacattcgacacttttgttcttctgctgttgtttctgcttttccttgctttttcttctctgaatttttttttgtatttgtgccaaaatgattaattggaaaatgaacacctcaaactttaataaaagaagcgttttttaggtgccgtggacttcctcccttgaggaatgctttaaattcctaaataaaaaatgattttaattaaaaaatattaaaaattgccaaaaaattccaaaaaacctttgcacaagcacagtttgcttgacttaattgttcgcatcctgttgaacagctgcccgtacacagattcccatcccatgaacattcttgcaaagtgtccattgggagcaataaaagcagcaaagcgaacagcagaaattgtttggacatttttgattgtttaaattatattttttgatcaattagaagtgattgggatggaatggaaaagtgttttgctggaaaattttgtgaaaattctcaaaaatttaattggaaaaatcccaaatttggttggaagatgaagataaaatttaaaaaaataataattttgttatttattcggtctttattatactagaaaattttaaaaaattctcaaaaatttgattagaaaatacaaagttatttggcgcaacttggaaaga

SEQ ID NO: 12960 - DNA, 1640 bp, Heterodera glycines
  misc_feature (49)..(49): n is a, c, g, or t
ataaattaaaaatgatgaataagcaatatattttgaattaaaattgacnaacgaaggaacgaaaatttctataggcatttcaaaaattttttaataaattaacgaatacaaaaatgattttttgaatattgaacaccggcaaatacaaagcaaaaaaaaagaaaagtgcaaaatgggcaaagaaggaaaagtgaaaataataattttttaaattaatttcatcggatttttataccatttttaaaattaaacgaataaaaaaaattctctttttaaatatttaaatttaatattaattatgttaattaatttaaacaatcaatgcacaattaaactccgtttgtcaaaattttgcaataaatttttccataatttcaaattattaacatatttgtctaaatccgatgaattgacagaaacagtaaaatgattgatttagtaatcggcaaaaaaccggtaattcatcaaaaaattaacgacatcatcagagttcggcacagatatttatgcttaaaatggagtctcaaattattatttcggtaatttattgaaaaaaaattaacatgtgtgaaatataattaaggtatttttaccgaatcaaatattgcattttctcatttttattgataaataatttagtaattattcttgaatctccgcaattcggagcctgtttatacagtagcaatttcgtaaaaaatttaggtttttgttttttaaataatggttacttgggccgggaaataaattgtggaagattttgccggtagatcaagtctataggctaaagaacgctgaaccctaaattatgaatgatcccgcgtgagaagtaaatgattaatgaatcatacagtaattttttaacttttatttttgtgttaagccttggaaaagctaaattgtaattaaataaaaattatagaaattaaacgaacaatttgctaaaattacaagcgaaatttgccgaggtaattagtggcaatactaattatttaattaaattagtaatttaattgttcctttccaccacttttcgaactcgtaaatgaagatggttgctccgccgtcttcaagcagaacaatttgatgttgtacttgccgaactttacaaccagtgtccctcggcacttttccatcgaattggcgccaaaacaaaacttggcactgtagcggtgccgttgtatcaaacggttgtccgtccctttggcatcccaacgctgagcagttacgtgacaagtgagtgaaagtgccaaaggggggaaggcatttaattcattaatttaatcatttgattaattataatttagaaaatagagtgtcgaaaactaaatttcaattttaattcattggattttaaaaaatcataagagaaactcactgaattttttcgttaaaatttaatgttaattttttaaaacatttttttattacacatatatcattaactaattttgacatttgtttaaaacaattaaagctaaaagctgaattaaaaataatttacaaaaaaggtttattcacgccattgaatggaggtcacaaaatgaattttgtggaacgatttgtgaattttataaatgatttgtacgattggttgtatttgaacaatgtgatggcttcgtatgaggtaagcaagaaaa

SEQ ID NO: 12961 - DNA, 1206 bp, Heterodera glycines
ttttaccaaagcaccccttatttttaaaatgattcatacataacaattagcggatagcacacaaaattaggcaaacattggatacgggattcgttattgccaaactggattaccaaaaaatatttcgagagtttttaccaagcacccctaattttaaaatggatcatacataacaattagtggatagcacacaaaattaggcaaacattggatacgggattcgttattgccaaactggattaccaaaaaatatttcgagagtttttaccaagcacccctaattttaaaatggatcatacataacaattagcggatagcacacaaaattaggcaaacattggatacgggattcgttattgccaaactggattaccaaaaaaatatttcgagagtttttaccaagcacccctaattttaaaatggatcatacataacaattagcggatagcacacaaaattaggcaaacattggatacgggattcgttattgccaaactggattaccaaaaaatatttcgagagtttttaccaagcacccctaattttaaaatggatcatacataacaattagcggatagcacacaaaattaggcaaacattggatacgggattcgttattgccaaactggattaccaaaaaatatttcgagagtttttaccaagcacccctaattttaaaatggatcatacataacaattagcggatagcacacaaaattaggcaaacattggatacgggattcgttattgccaaactggattaccaaaaaatatttcgagagtttttaccaagcacccctaattttaaaatggatcatacataacaattagtggatagcacacaaaattaggcaaacattggatacgggattcgttattgccaaactggattaccaaaaaatatttcgagagtttttaccaagcacccctaattttaaaatggatcatacataacaattagcggatagcacacaaaattaggcaaacattggatacgggattcgttattgccaaactggattaccaaaaaatatttcgagagtttttaccaagcacccctaattttaaaatggatcatacataacaattagcggatagcacacaaaattaggcaaacattggatacggggattcgttattgccaaactggattacaaaaaatatttcgagagtttttaccagcacccctattttaaaaagggatca

SEQ ID NO: 12962 - DNA, 3612 bp, Heterodera glycines
  misc_feature (20)..(20): n is a, c, g, or t
tccggctccgcacttttgtncaagttcggcaaaaaattcttccgtatttaatcagcgggcaacacatgcgaaacagttgctcggcactatccgcgtaaatgtccaacattttcagcgttgccattgtttgtgctcgcactttggccattcgaattttgtgccactctttcagcttcggtcggtctttttcttcgttctttttagcgacatctaacaaatattttacgccaataattgcttcatatttgcctatttttgccaggtcatcctctgtcaaataagctttgtacaaatttcgcatttctttgtcttcgtttgattgtgctgcgaaaattaaaaattaattgtctaattaagcaaaaaaataattagctaattacaccaaataaatcagattacttacgattttcactgctttgaatcgagccaaatgggatggggttgttgttgatgaatgggaccaattctgagaattgtgccaaaagttgtaagactgagaaagtgccaaccactccgatgttatgagaatcggacaaaaacattttgaaatattccctcagataaggcaaattctcacaatccttttcaaccaaatcattggcagatgggtccaatttctaaacgaaagtgcactttaattaattgagaccggacggggccagcgcctgccgggttgccgagattaccgaacccggtttttttggacaaatcgccaagaacgggagtcctggaacacaaatccctgtcccggccattgataattgttaattaattacgtcgtatttaaattgtaattttaatttaattgcgtacgctcagtgtcgtcagtgcgcctcttttctgagctgcttctcctccttttgttgtcactcccacaaataatttaaaaaacattttcatccaacaaattttccgcattttttcatcgtcatccttcagcggggaaaacagttccaacccggccacttccgcttttaattgggccaatttgtccaccgatgtgtgatccttcacttttgaactcattgctaataattcaatttcttttattgaatttaaaaccgtcgttttgtgttggaaatataaactgtcaatgccaatttgccatttggcactttccgatggcactttctccaccaaaatggccttgtacaaacgcattaaaatctcatcggaacagacggacccttcttcaccatcttaacaacaaaattttgaattttgcaataaaattaaaagatgcttcttctttttaaaaaatgtaaacgcagagagttaaaaaaatgataaaatttgtcaggtggccccccccccgaattatgtttttattatttttaaagggatatatttttaaaattattctttctgtagctttattttgatgagaatacacgaaaaaaggtcatttttagccgaaaatatgtcgttttaacgtcaatatccataaacttcaaaaatgttattgcttttatatagaaaatatttacgttgaaaaagcatttttttcatctttttattcaattagaaagaattttcaattttatttttttgctctaaactttcaatttattaatattctacattttttcttaaatatttatttaaatatttccgttttgtaaatatatgtaaatcccagcccttcttataatgcaccattttcagctgatgatgattgtgaagatgaagatgatgatgataatgggaaagcacttaaatatgaaattgggtcgaaattttggcaatttccttcttcatttgtcgaaatattttcagggtcatcataaatgaaattgtaattcatcaacaattgcttaaatacttcagagtttccacaaattatttgttccagacgattttggtcaattttaatttctgaatttgtttgagttatttttatatggaatattaatgacaaaaacaattcaaagaaaaagttaaattaattttataattttaatattggcatttttttaaattttaaactcaaattctgactgataacaaatttgctgtcatctttttgatatatttttgtaattaaaaaataaaataaatattaatttcccctgactttttaaaaaatgctttacctttcaattgtgccgtaaattcagcttttctcatcagttctccaatggcattttcatgcaaaataaacaaaaactgcaaaaagttttccccctcacacaaattttttgaattaagcgttattttatcgccaaaaattgaatttttcatctcaaacaaaacaaggattagctgagtctcgttttggaggagctcatccactgaaagcgcttcccttgcgccgttcatcaaaagttccaattcggccaaatgattgtccaattgttcgctttttccgtcggcggaagggcgcaaaaggggcgcatttttcttaaagctaaaaacaaaaaaaataacataaataatttttattaaaaaagaacaaaattatttttaaaagtaccactgataaaagaccaaaatgttcagcaaatatttgaggcgtgtcatttggttttgttgttccgtttggacatccatatattttaggtaatttctgatttgaatttccattatttcttcgtcgttcaattctaaaaaagcttttctttttgtttttgcccttttaattccaaattccgcttttcctaccgatgcgtaacatttgcttcacttttgggtgtttgctgaccaatcggtcgtattcctcgtccttttctccgcttttccatcctcctccattggcatagaattgcctcactcggaatttgtcgcccctcccgtccaattggcactgctccaaaaagtggctgaacgcgttgcggttgtgggctccgctctcgtacagtctgaccatgttctgcgtgtgttgctcataaaactgtgcccgaatttcccttagggcatcctttttggcccaattcaaaagtgccctcgtcgtcgccattttctgcgcttttcctcccatttgtggcatttcgttgcactccgatgacagctgagccagccaatcgtggactaacaacaaagccatggtggaggagcttctgtcagcgatttcgattaaaacattgggcaatttgaggacccatttttgcacagaaagcacgaaaaaagttcgaattatatttgacacttctgagtttggcaggtgcaatttgtaatgggaataaatggtggagaagagttcgattattttggcaaaacaaaagcgcattgaaagtgccgtctccgccgttttggcatccgtcgcattttccaaaaacatttttgtgtattccgacgaaagttgagcatcgtccacaatgtctgtgatggcaaaataagtcatttttagtttttgttgctggcaattgcaattaccaaaagacagtgccaacgcattttggcgttccaactccaaaaacagcgaatgaccgaccaaattgcgaattgcatttttcaactggattatttcgtcgcattttgcttcatcgcgacattttttggccattttacgcaaaatgtatgtgaattttgtctcaatttttatttttgtttcatcaaaaaattccgtaaagatgattcattaagaattttaattgatatactcactatattaat

SEQ ID NO: 12963 - DNA, 1327 bp, Heterodera glycines
  misc_feature (1256)..(1256): n is a, c, g, or t
ttcttaacaattcatcatttctgcttctgtttcacttggccgatcattgattgcatcacgaaacacgaatgtcgattcgattccactgatccataaagttccatccaatcgcttccttctcccattttgcccatttgctttcatcgcgcacaattggacaacggatcagaagaaaacggccgatatcgtccatccatttgaatgtcaattgctcccgagtcaattcattagtgagatcgaagagcacaacggaattagcaaaaggcggcggaaaacgaatgacagcgatgaaattgacgggagatgaagcattggcaaaagcctaaaatgagagggaaaaacagttaaaaactgaaaaattcaaattgaatgccgtacaaaatatttttgtcagcgaacaccaaagaccgtaaaaatgccaaataacataaaataaatggaaatcaccgctttgaagtcttcaatcctcgactcgaaatgcccgtcatcccaacgcaacaagcatttgaacacttttggcacatcgtccggacgtggagtgaaaagccatttggccaacgcttgtccatccgatgccgcggcactgtcatcgcatgggaattcggcgaagaaaccgtcataataggcattgataatgcgaagcgatggaaagtcgtcgagaattgacggcacgaatgtacgcaaatagcgaaaaattgcggcggacaattggatggcacaaatgttggtcgcgatcattggccaaatgttgcgcaaaatggactcaaaagtgtgatcattggtcgtatagacgtcgcgaatggtttaattaattggacaggcggcgaaaattggacgcaaacgatggagaaaagcgatggaattgttgttgaagcaggatctgtgaaaattaaggaatcgtttacaaataggaaacaacaaaaaagcatcatcaccttattaaaatggctttgaatccgacgactttctttggcaacggattttgcggaattgacatttcttttccatcgtaattgactattttcatttccttggtgccatccgcttcatattttggcaaaagttctatggatttcagcgaccatttgcgagtcttgaagtgttcatcgacgtaaaagtcaaatcggtgactgatcattgcaattccaaggccaagttgtgaaggcggaagcaaatcgaacacacaaagccaacaatcggcggagatgaaactgaaaaaagggaaaacaaaattgaaattggcattttaattttanattttacattgcttttgccattttttcctccgcttcttttcggcggtctgacattttgttggcgcaaatta

SEQ ID NO: 12964 - DNA, 917 bp, Heterodera glycines
atgatttttttgttggccgattcctggggacatggggagcacagcaacaggatgcaaatttcatgaaaatatcggaaatttttaaaaattttttaaaaaataattagtaatgtttgtacaattccatattccccaaatgaacagataaattctagaaactccaggaaattacctattgtcgattagggaaaatcctaaaaaaaactggggctttcagtccacccccaccaccaccctaattaggtaattattatggtgtttttgtcaaattgtgctattattgctgatcacgaacgaatctgccatttttcaattttactttgatttttaccgatggatttcggtttcaggaaatcacaaaaatttattcctaaaatatacaacagtcacaaattcaagtccgatcattcaaacaaaacaaaacaatttggcacaagcaatgtaaaattaaattaaaatgccaattttcgagtcgaagtgacaaaaaggcaacttattcacaattgtatttttatataagctctttttgccatgcctgccgaccaattttaacgagacgtaggaaaagccgacgaaagaaaattactctagacaaatataagtatataattgtgaatgaaataaaagtgcaatcgatcgaattataaaatgtgattatggatattatttctctcttaaaaatgtgatttggttgggaaatattaaatataaagctaaattataattagggccagcaaatataattaacatattaaaatagttatattattaattaattaaaatcattattcggtactgaaatgacccgcctcttctgatcaccactcatttgcctttttgtcacttcgacacagcaccgatacgacgaattatcgcattttggacttaatttggtgcaacatttggccaatgctcgg

SEQ ID NO: 12965 - DNA, 413 bp, Heterodera glycines
  misc_feature (47)..(48): n is a, c, g, or t
ttgcatgggcctggcaggtctggtccaaattgggcttaaaaattaanntcttttccttagtccacattcggcttaaaaaaattaatcttttaaaatgcaaattgtggctcatccctcgggatttgttcccgaaaagatgaatcaatgggtggtggtaatgattgattgctttttaaaaagtttagactttttttgccaatttgggtttttaattttgaaaaagcaacaaaatgccaaaaatgtgtttccttgtccaaattggcctaaaaattaatcttttaaaatgcaaattgtgacgtcatccctcgggatttgttcccgaaagaatgagtcaatgggtggtaatgattgattgctttttaaactcaaaaaaaagtgagcaatgaatgatgatgtgccggaggggggggggg

SEQ ID NO: 12966 - DNA, 3317 bp, Heterodera glycines
  misc_feature (50)..(50): n is a, c, g, or t
  misc_feature (3185)..(3185): n is a, c, g, or t
tgcccatcatttcgttgatttgttggaaaaagttttattggcatcaatcntgtttatacacaatgctacgaaaattgttgaggaaaagcgtagcaccaattttcacaaaagattctctatgataattcaattaattgactgatcctaatttattttaaatggcttttatgactgaatgataataaaattattgggattaatgagattggctttgttttaaagggatggaaaataatttgtctttttaattttttaaaaataaataaataaaatttcttttaatagtcctattggcaggttaaaatttacataaaacccacacagccaagccacaattcagatagatgttaattggcttgaaaaagggggagaagaggacctaatcaaaaattcattgaatttttgtggccattgaaaaatgcgcgtaagcgaatggaaagggtttctaatccccgcaaattcaaaagaacaaaaaaaaaaaatttgtccgaataataaaaaaataataataaattgcttttgctaacaacaacaattgtataattagtgaagaattgctttgtcgataaaaattctcttggaataattaagaaattaaaaaagaggcgcttttgtttattatgcaaattttgagaaagacgtcaaaaatagaaaaataaataattttttatgaaaacaaaggatttaaaattgcactttttgaaataataaaattttaaaaaatggtaaatgagtaaaaatgcaattgaacggactaataataattatgtaaaaagccaatctcacataaacattagcatggattagaatgttgttttgattcagaattttggcggggcgcgggcgggcggaagattatgagcaaaatgtcaaaaaggcatttcaaatgggagacgtcagagggggtggggtggggggaggaagcggaagggtgccgactttgcccggtcgggggagggggagggtgccgactttgcccggtcgggggagggggagggtgccgactttgcccggtcggagatgagtcggcgatgtccccgaagacaaaaatatgggtggaccaggggggaggtggcttttttcattgccgtcgtcggcggaggaagcggcggcttcttcgatgcttttcctattcaaaaaagcacaaaaaatgaggaacctcgcggggggagaaaaagggggcacaaaacttccgcctgaattgccgcggtcagtcgctgacggatgctccgccgccttcgccttcggcacaggcacactaatggcatttcactgccactgccgggttagttgcccttgggtgagcccccacccccggggcataaattaaattaaatgaaagcaaagggaataaaaggggaagggagggagaagcagcaattggacacttcggagtgtaatataaacgcaaaaatgagcaataattacatatttgattagatgaaaaatggtaaaataataaatactaaatgaatgtataaattaattccaaaaatgttcctcattttttaaaaatttatataaattttctttttttttaaatataaaaatattctaaattttagctaataattgaaaagtattttaaaatcgattttactatgaacaaaaatacaaattcatataacttaaattataatgagttaaatcgccctttttggaattagagtgactttttagcactttaaaaaaccctaatttggcatatggaatgtaaaaaaatttaatgggtttcagtacatatttgaatatgacaaaaaatttgttaaatatatgaaagaattttgtatcagagtaaaaaatttttcgagtttttcgtgacggaccatgtaaaataataacaattttttgaaaaaagtataataacaaaaaaaattattgatttgacagaaacttttgcaatattttttcttaaaaaaatttaaaaagcatttttttcgatggattataagcgggcgaataattttgaagaatgaatggcctgcctgtgcctgtttagtagtgtttttttatttttggcatttttcgatcagttgaaaaatattttggcaatttttgggtttttagtagtgctgttcgagaccaaaattttacgagacgacactgcagaaggggagactttcattgtttggatttgaataaaagattgaagcatgacaaaataccgtcgctgaaatatcgatggcagaaaaaggtgcagtaaaaaatttaaaattttgaaaaaattaaaagaaaatattagcaaaaaaaacaaaaaattttcacggaattttttggtaatttcttgaaattcagaaaattttgttttcaataacatttgggttttcaaaaaaaaatttttttaatgcttcttgaattgaaatttttgaattttttgaggaaatgttatatcccggcgaagtccccgcgacgatttgggatgcatttgaaaaattttggtccctcgcctggtgaggattttgttaaatttattaaaaaacctaaaagattggttgccaggcgctgggaaaacaaaagcaaattattaggtgagtaaaaaagtattgaaaatcgagatccgcctcaaaaccccgagaccaagaacataaaacccgagacttttcttggaccgagacattcgtgcaattatttttgaaaaatttattaaccaagatgcaataaaatgtaaaaaattcgcctaaggatcaatttgaaattttctaaaaagtgctatgtttaaaaaatttttaagcttttaaaatttaattttttttttcaaaaatggcataaaatgaaaattattcaataaagcgtttttgctgaagattttttttttggatttcattcaaaaagattttttttgtaaaaaacgtcgttttaaaaaatcttttattacttttcgccactattttcatcattatttcacaattttttgccattaattaattaacaatttttggatttgtcgccactaaaaaacagtgccgaagtcattacaaaatgaaataaaactttaatattttacataataattaaaataaaatagtacggcttacaaatgatggctaatgaatggatgctaatggacttttccttttcatattagtggtcatttttgaaggtgtcggcaaatatttgctattttttgcacatttgagccgcccattcaacaaaataagaaattcataacagaaaacagaggacgncaagtgagcttatcatatgacagaaaaagaagcttatgcagagacaaaatgcaaaacatatttatttgttttaacaaattattctcattcaattgagtgcgcttttgaaacggaaaattcgggggggggggg

SEQ ID NO: 12967 - DNA, 3857 bp, Heterodera glycines
ttgaattccgcgggacgccttcgcccgcgcaacactttcggaagcgttaagccaatgcttcaggtgccgtcccagcaaaatagctttttattttgccatggaatgagaaggatttggcattttcttgactttctgtctcaaattttcgcgacttttgtggcgcagcaaaattcgaatcatcacaaaacatttgaatattttcacctttttctaagaacatttctcgtcgaaaatcctttctgcgtgatgcttcgccatttcttttggcctccgacccccagcggaagcgtttgttcgccgttccgcgcgcgcaaaacgatttggaagcggagccgatcagatggacttgtccgttcgatttgatcttccggtcctcccccccccccattatctccctttcctccccaattatctccctttatcccctcacattaggccccatttggcccatcttcgccctctttcacttttttcccgcttaaattcgcttctgtcgcccgattcgcaactcgacggattcgcagttgaccgaaatgtggccattttcactgaatctgtcgtatgcatttcattttttattttcatgccttttcctcatttagcgtaattcgcgcgacactttcgtttttgtggccaaattccgccctaaaagaggggccaagtcttcacagctggccgagtcccattgtgtgctcaaattgtcatatggtgccaaatttggagtgatcagcgatcagacactgaaagagctgagagacaaaggcccactcccatcgattggtacaaaagaaataaataattaatatattaatatttaagttattttaggatgggatgaggaaaagacataccctacggaaatgccaaaaccggcggaaaatgtggcagcaacgcaagacgaccaatcagtcgaaatcagttctgaaaagacgacgcatgggccacggggccacgtaatttccctgccgaaggcacaaacggcgccaataaaagcgacgacaaaggtcagagagatgggaaaatttatgaattataattggacaaaataattattaattatcgtaaattaattttccataaaaagaaagttaccgtcgatcgaattgagcccttttggaaggcagaagcaaagacagaaatgacgacattgaaaatgccaacgacagcagaagagaagaaaatgcgattggaagagaccgacggggaagaggaggagggggacggggaatggagcaacgattacgaacagtggcgagaccaaacggcgccggaggggcgccacggcgacggagtggcggtgccgttgagagaggacggaatgggtaaagtaaaaaataaaaattacctaataatcaattaatttattatttcgttccttttaaggccctgctctgtttctcgccaaaatgtcaccatcggcgggagacaaaagtgccaaagcaatgggacaaatgaacggcgcagggagagaagcacgcggcaccattacggcattgctttcatcgtcagtgcttttggcattgactattttgttttgatttaaacaaggaattatagccgtttttgcaatttgaaaaaagcccggtttttatatattttttaaatattttaatttttgttttttattttatttcataaaatttaaaatgtttatgaaacataaatttgttttgttctttaaacggttctttcgctgctccgtctctttaaatttaaactgtgaattccatgctgccgtccaacagcgatcgccgttcgtccatctgacaattttttatgaatttaattcaatttttaaaatgccgcccatttttgagtgttcttttcccatgatttaaatatcgtgccgtccccccccccaaaaaaaaattcttccatttttctattttccttaattttctcgtaaatttattaaattttcccaattacctagttgtgttttgcttatttccccaaatggcctctccttttacttgtccgttctccgctgctgacactgatgagcttttcctcccctccctttgcgttttttgaaaatttttcgtttgcgccgcgggcgaagggaaaacgaaaaaagacggcgaattctttgcatttggaatttgcagctgctgctgctgcgcgttgttctgagtgcgcttcgccgtcccttgcgcggcgctttcgcgcgtccgcgtcgacgcgtttggcgtcagaagggcggagccgggggaagtggtcggcgcattgagcaactcttcaaagttggcaataaaatgggcatttcgattcgaaattgccaattttgggaatgaaatcgttggcattcgatggaaagtgccaattttgaaatgccctccccaccaatgtccgtcttcagctgtctgatcaggtcgacgttgtccgactcgatcaatcgctcttttgtcatgtgcgaaacgattccacagccgaacccatctcccagcacattaacactcgtccgaattcggtctctgcaaattcataaagggaggtacaataggcgaatgcgtttaaatttacagtaaccaatcgacagtcaacagtaagctcaggtccttggtcggcaaaccaacagtgaccagaacgatcagaatggtatcaaggccaaaaattgttgtcattaaaaggaaataagttaagtttgtgtttaccagccggtacagaaccagacccaatggatgctaccgtagttgtcacactgtaaaagaacaaattgaacaggctcataattcaatggttaacctaattgtcaaaagttccaacgccgtcaatttgatgttgtgaagctgtgcaataaaaatgacagccaccgcttcgtatagtgccgtgccatcctacggtattataaatgccgttttcggaatggatgccaaatggtcattaatcatgccatggtgatcgttgcgccgagaggcagcacgaaccgagtgactcgccgatcgattcgcaaattttgctcgagggcacgaaaagtgacgggaagggtggcaccgctggagggaaaaacacacagaaaaaaagtaacagaaaattttgaagcccttttttcaccttgaagctgttccaaaagcggtggcgatagcttggagctgaaaaggaaaggcttttcgttttgaattagcgccaaagcgggcaccatgccagtcatgaattcgaacggactttggcgagtgatcgcataatacaaaagtggcaaagtgagcagcgagtggatcatcagcccacagatgacggtgaccacgtacatggccaacgcctgaagccttattggttttaaggcttaatgagaagggaatgcctgcgccgtttccgtcaaattgtcaatgtccaaaatatttttgcagaccaacgacagaatgccaattgggtagcaccacattagggcggaaatccaacgcattatcacctgggggtgaatttgggctaattaatggcctaattctcactgactgcatcgagcacaataaaaaagttggtcataagccgcgcctgttctccgagaatactcaaaatgacgccaaagccggtgcagaagacgatcagcccgagaacgttcacttcgttggtgtactccaaaatctaaaaagttgccctttcctcccattaattaattagtcaatttccaatttgctctcccaccggtttcatcaacggttcgttcgtcgtttggacggtcgtttgatttgtggtggaaatgagccaacggagggtaacatttaacggtggcatagcctccggcggaagtcatcgcgcgttgcgctggcactctcgtcggtttcaccggcacgtaattggtctgcatttgctggaaagtggcctaaagggggcgggcgagaaaaggctagacaatcgta

SEQ ID NO: 12968 - DNA, 4206 bp, Heterodera glycines
aaattaatataaaaaaattaaaatttattttttttaattcaaaatgattgatttattttcattcataaaataaatcaccaaaaaaaaccccgaaaaaaaacaatttataattagtaaagcacccaaaagatgaatgtaattgaaaaagaaaagttgttctatgtttcaaaaataatttatttaaatttagataaatatttttatgaataaatattaaatttaattaattattaatccaaatccaaaataaagtgccattgtgttgtgcaaatggagttcagcagcttgaagtgatgttgaaatgttgccatacaaatgatatccatttttgtccatcacacactgttcaatgatcacatttgggcccatctaaaaaaattaatttaattgattattaaaaaaaactattagcaataaattcatatattaaaaaaactctgaaacacccataaactctttaaaaataatttatatattatatgaaatttgtaaaaataaaaattttttttttaatatttcaaaaattatacgaaaaatcctcaaaatataacatcaacaaacaatttcaattataaaaaattttctttaaacacattgaatattctaaagatcacaactaaattaatttgtaaaattaattttaaaaattttatattaatttattaattaattaaatttttgaaattaatttttaatagtttggcacaaacttcgccaatatttccatatcgcaatgcgccccggtcattgttcaataaacgcgaaactcgcaacgaaatttcatccaccggcttggtgctgatcgatgctgttggcaaaactgcaacttcggccaaaaaacctggtgcaggtggcataattagggagacggataattggttgttaattgactatggcattaccgtaatcgccgtctgcggcggtggcacgcaaatgtatgccgagaaatgggttttgggttgcaacactaccggacaaatcagatgaagcattgaaaatgcgtaacagattggatgaactttaatatgtaaaaacattttaaaaaattttaaaaatatgtttaataaatatttaattaaaaattgtaaaaaatttaaatgctaataaaaataaatgtaaacattgccagacagtaatgatgagagtcatattggtttgaaaaactcaaatatttttccaaaaataagcatttttaatcttttttgtataaaatacaataaatgttggtggagcgggctcgaaccgctccatctcttttcacttcctttttggtagaaaataaataaaaatataaatgttgtggagcgggctcgaacctccatctcttttcacttactttttccttttattatcttacaaaaaaccactgagccacacacgtaaatatttctcttaaaaatctacttttaattaaaacaattatttgtcgtgtaaaatttgtggtcattgtcacattttcatttggtatactattcacaaattttgcgaaccctctggcgccgaattaaatgaataaatttaatataaaaaaaattacaaaaattttgtgcccgcataaatatgcaaggcgtccggcctcggcacgccagccggcccctggtagaaatttgcttgcaacagacggaagcccaacggacgttgaacaccaccaccagtggtggtggtggacctggaccaactgctgctgaacaccttcacacagtccactggatacgaatcgtacttgtagtacagtaggacacgccctgagacctgtgcatttattcgattaattattatttttatttaaatatattgtaaaagttgaaaatttttttttaattgtttccattatccggtggaatgaaaatgcccttcgaagaattaatgccacaaaaattcatttaaaattcacaggattcaattcgttttatccgttttagaaatccgaaaataggaaaaagtaattaatgattaaaaaaaaaaatttttaaagaacttttataatttctctataatttttcaaggatttaatcagggctaattcttcgttggcagcataaaattttaatatgataaaattaggttaattttataagtgtagaaaaaatctttacaatttccaaatttcttaaaattttcagtttttttttttataaacaatggggcggatgcctgttgaaaccgcgtattatttcaaatttttatggcgaaaccttccaaatttttttttgatttgtgcctgaattatattttattgttcgccatttctcaccttcacttgtttgctcattgaacatatgttaagcattcccggcacatggtacggtattgtgattgggccatacggtacacgggacgaatggcctgtagatgaagcagctgcagatgtactgcttgacattgagtcgattgtcgactgcgaaatgcataaaataaaattatattaaatttttcggatttttaaaatttaatgaacatttttttatagttcgatcacagatttaattggtcctgaaaatttaattggttaagttgttagttgttcattgcctccggcctcagaaaaatctacgaaaactttagcctcggtttaaattatacaatgtcaatacaatacaactcgttgtccattatcttcttcaccgtttcacattatctcacaatttaatccccccgattttattgtcacagaaaaaattgtttaaaagcgtaaatttgtaaaaacgaaaaattttacctatgttttttttcgaaaatttttgttttttgtttttttcttcttaagcaccgattaaattatccatcatccattatcttctttataatttctttattttcgcaattttattgtcaccgaaaaattgatgggatgaaatatattgtgtttccaaccgatttggacccattaaaaagcgtaaattaaaaaaaaataaaataaaaacaaaaaaatttagttaaattttttcaaaattttcacgccgagtttattgtccctgaaacattgatggtacaaaaattttttgtgttttcaaactaaaaacgtaaattaaaaataaaataacacaacttgcaaaaattttatttaaattttttttcaaattttacggatttttaattttttccaatttaaattttattcaatttaattgaacttgttttgccattgaattcaattcactttacctgtaatgttgtggccaaaatgttgacaccgatgccgcggttgtccgaaatgttcaaacggctcagcacaatgttgttgctcgggtggagcagctgcagcgcgtgcatggacgaattggtcacattgacattttgcaacactggcgcacgccgaatcacttgctaaacaaaacattaaattaaatttgattaaattaaatatttaaaaaaaaattaattaaacatttaatttaataaataataaaatttgatttataagcacacttaacaagtatcaatagttatatgggtgctatgacgttagtcaaaaaccatcaaaatgggcgttagtcaaaaaaccttcaaatgaaaagattttttgatataactttgctcagaggcaaccaaattttaaaatcttgatatcattcgatagccctaagtgttttctattagcctacaaaatttcaacaaaattcattaagtctcaaaaaaagttatggccaaaaatgttgaaaaaacttggttttctgagcttctcaagtcataacttttttcaaacttaattaatttttctaaaattttgcaagataatagaaaacacttagagctatcgaaaaatatcaagattttaaaatttggtacattttatgccaagttataaataaatttctgacaaaaaaattttcatttgatggtttttgactaacgtcccagcaccgattgaacgaattgctaccccctccccactcggccgatccttcggctcccacctggcatgaatgcagtggttgttgttgcaacggaactcgcccttgttgcacgcctttttggtgacgccgcacagcgcctcactttcgtcctcaccgccggcacaggtcacatcgccgtcacaaagccacacttttggaatgcattcatatttgggcttaatgagttagcatatttattaggggacgggacgaaatctcgccgccgaaatctcgccgccgaaatctcgccgccgaaatctcgccgccgaaatctcgccgccgaaatctcgccgccgaaatctcgccgaga

SEQ ID NO: 12969 - DNA, 1123 bp, Heterodera glycines
aaaaaatttttttccggaaaagcctgccttcaggcccgcagtgcacgtaattgaactgctcggagttgatgcattgccaatcgcttaatgtggcagtcagacgaagtgcacagctctccaaacggcattcaaagcctacaattgtgaaaacatttattaatttttaaatttgtttaaaacattttttcatattttttttttgaaagttggaaaaattataaatgttagaactgaaattatttaattataaaataaataataatttgctgaaaatataaattttttttgttaaagaagaagacaagattttgatataaaataaaaattaaatttgaaatttattccatattttttttcaaaaaataatattttaaaataaataaaattaagtttgaatttgttcaataaaaatttagtcgctcgaacaaaattcttgaaaaattaaatattttaaaattttaattaaattaaattttttcattataaattaaaatattcgaatcaattttaaaaaataataataatttaaaaattagattaaattaataatttattagtataaattaaattgctcgattcgaatcaaattttttcaaaaaattaaaatatttttataattattatttaattaatttacgctctccctcaacctcggcattctcgtggttccatgtatgtcttcagaatgcgcagttgtggattatagtcccattgtggtgtaagccaactgtaagcattttgcgggccaaaccctaactcacggcagaccacctgttaaagataactttttgaatttttgattttttttgcctttaggttaacttggactgatcagaaactgatagaataaaattgaaagtcagggactgatcaaacaatgtattgatcaaattaaaatagaatttagattattaatcatatggctccatctgatcaaatattaaactataatacgaatttcggaatgaacagtaccagtgaatgatgatcaatcaattatgaggagttaaatgcaattattattcaaatcactttgtctgattagatatttagattatatttctcaattggattcaagagctgatcactctagtagtgatcaggtttgactttaagtgatccg

SEQ ID NO: 12970 - DNA, 4732 bp, Heterodera glycines
aacgatgagtaacgaaattagtggggtgtccaacgatgaaaaggaaaactccagcttaaccatgcttaaatttgtgagaatatgagggaaaaatgaaaaaaatgtaaagcgacgaaaaggaaaccttaggcaatccacatttgtccacctaaagggaaggcaaaatcgtggtgaaaaaattttattttgaatatttgaaaaaatgtgcgtttttgacgaacctaccaaaaaaaaaatattttcttccgaaatagttggggttaaattaattaattaactttcaatatcattagcaatgtgtgataatggaaaaataaaattgctaaacaataatttcaaatctttactctttttataaaaatgtgttaaagaaatggatttgtttgacaaaaagttgtgttaaaaatttaaatttcaaaaataaaaattttagaaattgcatatataaattttgaaaatcaaaaagttttgcaattgttaaaaaagctccttagccattattttgatgtttttaaagtctaatcgggatttttacataattattggcattttttgagggataaaagccatttttggcagtttttaacgcatattttagtgcagagttaggcatttttcaggtttttagggcctatttatggatgtcagtcgcctaaaattttttatttttaaggaataaattttcagaaaatttattcctagattaatatattggctacattattttaacatataccaacgtagtttgccattttcaatccgaattttcattttacataatcatttaattgattttataatgaaaatgtttccaaatggctaatttgctctgtttttagttatgttttgaatataatgaagatatttaacatattaaagcggctttattgctgataaggataatacgcatttttaaatgaataagatttaatgagctgagtatataactttttttcttattgaatcaattttaataaattttcattcacttgaaagcttttaagtttatatttaaaaaaaaaattttttttgtcagtaatgcataataaatttttctaatgtaagtaaatccctgctggtttaagatcttctgttatcaaaaatgaataaaccatgctttgacaattcggcctttattttttgctgagctttacaaattttgggcacttcttttgggattaagcactaatcccgaaaacgagtcaaatgaccagaatggacaattttttaaaagcttttcgtttgaaattcattctttatttgttgctgatgttttgcaacttggcatagcggcgattacaaagaaaagaaattcagaggggggggggaatttgggagaattggaaaagctaaacaaaataaaaaaaggaagggaaagaaaggcagtgggaaatggggacggagaagggcaccgggggaggggagggcaatcgctgctgtttttctgctttttcttcttccactgatcagaatcgcttttcttaacgtcttcgtgtgccgtcctcgaagaacactccgccgtccacggcacagtatttgggacagattccgcgctctccggggtttccaggctgtccgggttggccgggctggcctggggctccgccattgcctggctgtcctgggcctccgggaggtcccttcgggccgggctgtccggccgcgccgggctgtccaggggctccaggctgaccgggctgtccaggtgcaccagcctctcctgaaacaaggcatatttcgttgaaaaataagcgaatgttggtctaccaggtgggcctgcaggagcgggctccgttggcggtgggcttgcgggttgtccgggctgtccaggcgctccgggctgtccgggttgtccgggctggccattgggtccaggtgggccgggctctccgggttgcggctgtcctcctccggtgccgggctggccgggtgctcctggcgctcccgggggtccaggtgggccattgttaccgggctgaccgccagggcacggggtgcatggaggctgaacatgcaatgattaatacaagttctagacctcctggaactcgagattgaacccgcatttaccgggtgcacttgctcgcaaggcgtctgcggggtttgtccgggctgtcctggtgagccgggcgctccggggtttccgggtcgtccaggctgtccgggttggccgggttggccttgggcaccgccggagcaacactcttggcagctaccgtatgcgctacgcgcagtacggtttccggcgaccagcagaggcattcccttcagctgactgacttcggaccaaatgtctttggcattgtgctgaaaatggcacttttagcacttcgaactttgtgccggattccttgcctggcatgagctgagctcagagtccattttcatgcccacgttggacacgtaactcttcagcattggcagtgtcaagcacaccgacaaaagtgagatgatggagaaagaaaccgtcgtgtaagccacgaaacggtaagctttgacacgcccttcgaagtcggccatttttttttgcaaagttttctacctgaaggggggtaggaaattgttaattggttgggacaatgcttaatagtgagcggtgcggcaaaaaaaaggtagggaaaattaatgagattttcttgaggacttttgggatgttttaggaaatataatttgggtatgctaataattgcttcttgaggggccggctgatttttctgttcgaattcaagaaagctcaattttcggggtccgttatgaaaggaatggggccgggtgcctttttgggtgtaattggaaccattttcaatgagtgagacggcatcaaaacctgattaaaagactggacaattaattaatgataattattgggggaatattgagacataaagtgaaacttttgtttgaattgacgagactccaattgctaattggaatatgatggaatatgactgttcattccaatgagtggtgatgatggggtggaggaggcccaatttataggggtgtcgcgatgggatggggcgggggtacccttttttccggcacataacaaatggcctcgggcgtggggacgggcagggaagacgtgcccaacggcaaatgggactggcccgacatttcatttcgttggctgttctgctgctgatcacagttcggtcgtccgtccgtcgtctccccgccaccaatttttgggggtgtcactttcgcttcggcgctgtgtccttattttttttgccctttcccccatttgattgtttcgttttttaacttgcgcaggccttctctaatgcagcattttaattaataatttttcatcgttcaaaaatggaaaatgatgataattagtgattgatgaaaaataattttatgaatattaagacggaaacgtaaaatgatgatttgttaattgcagtaatttaaacacaaaaatgcattattatatgaatttattttaattttttcattatataaatttaaaacatttttaattttaaaaataatttttcaattagttgaatttttagtttaattcgaaattttgcgattggcctttttgggacaaacagatttttggatctcaatgttggagcctgcctgatttatgagtttgaaatctcacattaatggatttccatttatttgtaaggaagagttgtggttggacggttaaaatggctgatgagtgacattttgccatcggacacttcgccacccgatatttcgctatcaaagccaaacccgaaatttttaaaaataaaagaaagtgtcaaaacggcacctgaaacggcactaaaaagcgccaaaaagacataaaaaactttcgagatacacttcatgaaaaagctttccaaactttatctcattgcaattttttgagaatcattaaaagttttgttcgaacaccagacacagatttgaacaaattgtcgagagtctaaattttcgaatttagcacttttggtctaagaacggcttaaatgatacaatgtgatacaatgtttaattgcacgattgatgatggcttccgtttgtttccgtgtatttaaatcgattttgaaccccaaaatactgaaatcgaaaatttgaacattcaaatacatacataagttatatgtagaatttattttaaaatattagtatcactgacacatttttactgatgcatttcaggtgccaatcatttttgtgaccccctgaaattttttttataatattttttctaggttaattttatggaatttatagaaatgggtgtcagattttcgataattcccaggttttacacacatttttaaaaatgttcaattatttttcgaaaaatgggggggggggggaggggacaaagaacactattgccgacgacaatacagtagtttactggtcaaaaaatttcacaaaaaggataagtacccattttccgggagccgtttttcctcttttagtttctcggacaatttcgcttgaattcgacggcaatttgcgacttttttttactgaagatccgccccttatgtcgccggcacagaatgccaacgcgaggagcatcgccagcgaatgcagctgccatcaatgaggcatttggcttgcatccctttttcgtcgcttttttgatgattcagaatttgagcgattttttttataactgtgagaatgacaagtttcttggctgagtgccaatcatcgatagtagaaggcatttattagcggtaaatctcttcgctgtgatcacgtg

SEQ ID NO: 12971 - DNA, 884 bp, Heterodera glycines
  misc_feature (16)..(16): n is a, c, g, or t
ggcggcattcgaagtntggactaatagatcgtaggcaactcccccgagttgtgcgaattgcggtgacaaatttccaactcgtgctaatggtcgtggcaattttcgaagtcgtgctaattgccggagttgtgttaatggccgtggcaacagttggagttgtgctaatggccgtggcaactttctgagttgtgctaattgccgggattgtgctaatggccgtggtaactttctgagttgtgctaatttccggagttgtgttaatggccatggcgacaattggggttgtgttaatggccgtagcaactttcggagttgtgctaatttccggagttgtgttaatggccgcgctaacagtcgaagttgagctaatggccgtggtaacaacagttgggcaccgcgtctcgctcaggttggccactttctttttaatctccgccaccgcttttgccgtctcacgctcaatttcctcctcgcgcgtgtgcacctccaaaatggcaacatggcgtcggtagtcctcgttgatcacgcacttgcgcttcacaatgtccaactcattctccgcttgtattaggccatggcttttctgtaacatgaaagcgattagggagttaatcaattgatcatttggtttaaaaacggttaaattaggtgagttcattttccggttttggcaaatgcctgtgccattgatggctgattttttgataaaaattttttttttttaggtataagaatcggcgatttgatagtttttctcggcgcatgaaaaaattaccaaattgaacaagttttgctgaatgtgttgcgaaaattcatcccgggacaggaaacgctaggaggaattgcaaatgcaacgataatacaactcgtaagtgtggtggaga

SEQ ID NO: 12972 - DNA, 2968 bp, Heterodera glycines
gatttgatagttttctcggcgcatgagacaatttacaaattgatccagtattgttgaatctgtagcgaaaattcatgccgggacatgaatcggtaggaggaattgcaaatgcaacgaagcgccaactcgcaagtgtggtggagaaactgttcacgcgagtagaagccgcccttgcatgagaagcagatgaacctgaacactctttctcaattggacgaatatgagcattgatttttttatggtaccgtaattgttaatacagtaagaaaatgtaggagctttgtgagttaagggacaacaaaggcttcactccttcagcatttttttgaaaaaatttacaaaaaaataataatttgaaattgaaaacttgtacaagcaaggtcgtatgcaaaaattttttttatagaaaaaacttggaaaactttaaaatatcctatttttaatttgcatacttttaaaaatattttaaaaaatttttaagaaaaaattcgggttaaaaaataataaaatggaatgggcagagcacagcacacacacagaaacgcaccgatcaaaaaccagatgatgcttttccaatcggtgcttaaccaattgatcattattgttttggcgacaacaattcgtcgattcgttccgatcactcgacgcaaaagtgatagaagcaggcagcgaaggtgatgaggacgacgttgtcgtacaaacaaagccacagagaaggcacacattggactgggcacattcgtagaccatgtgacgaaacattgcggcactggcacggtaccgttggttggccaaactgaactggatgaagtagtcacaccaagggcattggacacgatccttctgtgtaagggggaaaaatgtaataggtaaaactgaggaattgatttaataggcagcgatttgtcggttccccgctttacgtttctcgccgaaaaatactcaaaaaaattttttagaaacgatttcaagaaaaaaaaaaaatcccagcaaaaattttccaaaaattcgattcattcacctgttgaaaattcatgtgaaattcgatcaaatgtttcaagaaatggacggggtggtcgaaattgcgtcgttttttcggcttattctcctgctgctgctgttgtttttggtcttcctccatctgttgctggtcctcctccattttattgttgctgttttgtggacaaacagtgcactgtttccattgttcaggatgagaacggagatgacgaccgaacgagtcgaaatccttctcaacagctgtgcacatgaagcagacaaaggtggaggagcatgctgcaacacaacacaatgcttcattaacgaatgccaggtcattgaacaactcgaaaccaaaactcaaaaaatgcgaaattcgcccgtccatagattttttccactcataaattcaaaatttcatacatatttttatgggaagatagaatttttaaatgtcattttttagtttgagttaaaaacgcactgcgcaccgtgtccctctttaatcaatcaaaatgcatggaaaagcccccccccctttaccggcagtaacagggtgtgccgttgtgtatctcgatgatggccctccacttgcgtgttgctgctgctggtgttgttggggttgttgctgcggttggcacttttgctgttgctgctgttgtggattaacagtcgctgctgttggcgatgccaacaacgcctttttctttggcctgccccttttgcgatggaagtgccgttccatgcccttcatgattacttcaatttcgtcgtttgcgattgcttcgtcgtttggcttttcctcctctttcacttccaccggcagcacttcttctgctggtggcacaatgctgttgctacagctttggctctcctttttgtcctcatcatctttttcctcctcctcatcccgatcaacttgaaaagtaagggaaattttgtatttaaaaatgattaaatttaaaaaaaagtgccggcgatgagccccattctttgactattcagatttgtgagtacattttcagattatttgaattgggatccaagtttttttaaatttttctttaaaatttctaaatttcaaattcgccaaggaatccgtatcgttcaaatattattttttcaaatttgaattgactcatcatttaccctttgacttccttcgcgtgtacgaccgcttccgccttggccattcctcctcatcctcctcctgcgccttcgtcttcatttttcgtcccccttttttcatcgccaccgtttttcctcctttcctccgtgccccattcgcattcattgccaattccatgcttcgaataattgcctccaattttgttggccgtcccctcttttttgccatctttttgggcgacgaacgtttttttggcccatttcgaggcaataatggcacggcaaaagcggcttcttcccgatggtctgccaaactgtcttgttcattgttttcctcctcttcgtcctcctccatttggtcagcataatgaatgattgtggtggtgctacttccattgtccctttttgtacgctttctcgtagaccgtctcaacacatttgtcaaaaatgactgatcatcaccaacaccatcattgtcatcatcgccatgaacatgccgattttgttggccatcttcgccaatctgctgctgttgctgctgctgcaccaccaccactttttgctcttcttcttcctcatcatttgctactgccactgctccgtttccgtttgcttttccatgctttttcaccggtgacgatggagcattgtgtagtgccaccgaattatccaccatttgctgatcgcattcggcatcaccaccatcttcatgatcatcattttgcttcacttcatcatgttgatcagacaaatcgttgttgttatcgtgctgatccatgactaataatggataattgtggtctttatcatcatcatcttcgctgatttcatcttcctcctc

SEQ ID NO: 12973 - DNA, 905 bp, Heterodera glycines
tttattttttaagcaaatttgtcccaaaattaaaatatatatatatatatatatatatattatattaggaggaaaatcacgaattgttttttgaaatgtattaatatttttgggattatttaaaaatggataacaacagaaaataaattagcagcagatttttaagcaacattattgtataaatacaaggacaaaaccaacccatggagaaatacaacccaaaattttgtgacagaaataaatttcaaaattaaaattgatggttagtgaatgttaccaagaaatgttttactaaaaaaaaaaaatcggactcaccaccatccgatgttttgtcaagggatgaagcggtgccgccgctcttttcagcctcgttgcaacattgtcctccttcttcgtctgcttccattgtttgcgtttggccccgtcgcacgtccatcggttcctccttcaactcctcctcttcatcaacaatttgtcgtcgttgtccccctccgtcaatggtggtgccgtcggtgttggcattgtttttgttttttgatggcatttcttgggcaccaccatcgtggtgttcaacagcatggacaaccagcgtagtgtacagagtgtcggcactgatttcgaccgggcccaactggttcagtttggcagtgccactgcattcactttcaaactccgacatgcattgaggcggttggcctattgtaggaggaaagcgagtcaaatgagtggttgttttttttaatagagcaaaatttcggcattttttgatttttttttttgggggggggctgaaaatgccaatttttactaaaaataaatgatgtcaaatgagtgagtttgatttcaaaaaatgagctaaatttggcgttttttgactttttggaggccgaaaatggccattaaat

SEQ ID NO: 12974 - DNA, 4912 bp, Heterodera glycines
aaaaaaataataattttttatttcctttttttgaaaaaattttggagtttacatgaaaaattgaaaaaatgcttaaaatatttttaaaaatattagaaaatccaaacccaaacatattttttccgatatttttttggaaaatttctcaacaaaaattcaagaaaatcaaaaatacacccttaagaatcgacctaaaattttcaaaaaatacactcctaagactgacctaaaatttaaaaaaacaaaaattggggcaatggtaaagttctgtggtttcttcgaaaaattatttaaaaatttaagaaacacattttctaggctggaaaaatgtgctgatcacgactgacggattttttgcaaaataatttattttatttatgattttttatcaagtactagatttttccaaaattttaagaaattagtcgggcgtaaaaaacacacatgttgtatagctcaaaaagagctttcgagtgagctattgaatgtatggagaagtcatgtttttagttatttacgattttttgaaatttaattactagcccttaaaggtcatatgagacgggggtctggggttcgagcctgcttggctgtgtttattaaatttttaaacttatttttcgaagaaaccacaaaacttattgccaaaaatggtaaatttctcaaaaaatcatccctcaaattttttttcttaacaaaattatgtcactattcgtcattattttggacttttcgccattattttggcatttttttagcatttttattatttgtttttttttttttgaaaaaaatggtttgataaataaaaattccatttatccccccccccccgggtggggggggggggtaaatgcggacggggggattattttctaacccctcagaaaggggggataattggggacggcgggattaatggagacgggggggggataaaaagagaaaatacggtatgtagaatttttgattttatgactatgcattcatttaaatcaatatattttccacaaaaaaaaattccaaaatttaaataaacaattctttatttatactcaacaaaacattaacgaacagcatttaataacccgaaataaaaaaatgattatccaaaaaataaataaataaattattcatttaatatgtaattcattcaaccaaaagatttgtctattatgtaaaaaaattttaaactattcttttgtttaggaagctgcaatggagtaataaataaatttatttaccaaaactatttttaaatttaaattcaaactaattttaagggctttcccgaacacgagactcagcaggcggttgggccttcacccgtttctcgtcttagcggtggtggtggcacaccaatagcgactggcgaattgcgccaacgacaaattggcagtgccgaactgcagcagccaacaacggcacccgctattctcggattgaacacgaatgtgtaaaagaggaaaagaaattgaagaatgccattattatcgcatgtttattaaaattaatttttcattttatttatatttttgtaataaatttagagtccagattaccatatatttttgagcatttactttaaagaaaaaagctaaaaaaaacattcgaagttttggtcttagaacgacttttttgctcttttcattttttagggagtttagcacataaaatatatttcggagtctaagcatcttttttttgcttctcgccaaaaattaaaaaaatgcattaaatctagaaaatcttgtttgaagcaaaaattttcgaatacaaccgtaacaaaacaaaaaacaacaaccatggccaagtcttcgttttcggagtcaaccatatgctgtaacaattcggctgactacgaaaaggaggagtgcgaaaagaagaaaaataaatcattaaaatattacaatttacataacctaataagcataaattggatcattgaattttttcccgaaaatgtgcccaaatttgatttccaaaatatagaaaaaaaacaacattgatggggtactgatcaaaaagtgaatttaaccaccgtgatcagcatccgccttcatagcgacattaagataccaaaatttgagactctcatcaggggaattgggtctgccctatcaattgcccgaaattgtgaatgtgcgcctcagtagctaaatggtagtttctcaagtaatgggtggacgagtgggttcgcttcccacccgaggcctaacattttgcctatttctcattatagtaaactctaccaactaattattatgatatagtaaatcaccatcgcctacaaatgcaatttgcagcttctactcaaaaaataggcgtataaaacggagaaaaacctcaaactttgattaaaaataatttttcgataattgttttcatcaaaatagataagaatatacataaattcattaactcccgcgggataaatgaaaaataatttttttaaattttataattataaatatacaaatttaaacaaacaaattttgtttatcgcaaaaaattgttattttaaaatttattaagtcaactcttttttgtttatgaagctgcaattaacaagcagttaaatgttcgcctgtttctccccaatcgagtactaatgagatgattgaaaagtgaatgtcattttcggacgctttaatttgttcatggtaaatgaaattgttttgaaattcggattaaaagattttttattaaattattagaaaattttccagaagaattttgagaaaattcgcaatttcgcgttttttggaatttcgcgtttcgcatttaattttatttcgcatttttgctttctcaaaattggcgtttcgcattttattaagaatccttgaaagaaaaaaatttggcgattcatcaattcgagaaaatgtaattaacttttttcgcctagtcaaattttataactcatatataatcaattgctcttatgaaattcaattttcattgaaaaaaattaagcaccaaaaaaattggtcaacttttttaacatttgttagcacagcttaacaatgacttaattgaaattcggcggaaactcttctccaccatttgaatgaacgtggatttaaactgcaaaaaggtgaacaaattttaattagataaagtgcataattatcggtctctatccgaaaattagtgcattatttaatggcaaaactcgccaacaaattcattcaaaatttttttaatttttaaaattattttctaatcattaatatttaattcctaattatgttttatcaaacggtgtgccttcttttgctgttgagcgcatcgaatgatgttgcggtttttggacaggaagaaacaaccacaacatcgactagtagtacaagtacgagcacaactagttcaaccagtacatcgaccacaccaactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgaccactcccactacaacttcttcaaccagtacttcaaccacacccactacaacttcttcaactagtacatcgaccacgcccactactacttcttcaaccagtacatcgaccactcccactactacttcatcaaccagtacatcgaccactcccactactacttcttcaaccagtacatcaaccacacccactacaacttcgtcgactagtacttcaactacatcgagtacgacttcgtcaaccagtacatcgtctacatccagtacaacttcatctaccagtacatcaactactccgagtacaacttcttcagcaagtacatcaaccagcagttcatcatcaaccacgaccaaaccatcgtctggcgatagtggttctggagcgtccaccagctgtaccaacgcggctggggacagagcttgcaatgcttacaaaaatagatgcggccaattttcggcatggctgaaaaagaattgtgccaaaatgtgcaatgcatgcacgtcatcggacagcagcacttcaactacaacctcaacgtcgacgtcgacttcaacaagtacctcgtcaactacgaccaagtcatcgtcaggtggcggttcttccagcagctgtaccaactcggctggtgacagagcgtgtaacttttacaaaaatcggtgcaatactttggcgggatgggtgaaaaagcattgtgccaaagcatgcaacgcgtgctgaggatgaagaacgctgacagatgaaaatgagacggaatatgattggggaaaaattcttttaattttaaaaataatttaattttaacatcgtttaaattctgggcataaagtataaatggtatttttgaataaataaagtatgtattgttgttaactttttttagaaaacaacttagagaaggaaaaaataagaattctaaattaggtgttacctgtcgataccaccgggtcctcactactctaattattttatttgaaaaagagtcagcgaaaaatgtaatgaaaaaataacaaagaaggcatcccagtaaaattatattttttataattttttattaaaaaattgatatatggtgatagaaaaaataaaaaagaaaaatattgcgatttggagaaaattcaaatttttatttaattcccgggagggaaatgaggagtcaatgaagaattaatgggaaatcagcaaccagaagaacccgtcgaaatggggccagaattgatcaatgagccaattcggcccaaggccaaattcagatggccgaaaaatccgcctattcaaattcaacgggctggcaagacgccccgagcatcgacattggctccaacttatttgttgtccatggtggcgatttccttctttttggggcaccggttgccga

SEQ ID NO: 12975 - DNA, 1214 bp, Heterodera glycines
tcctcctcgtcaagttaatgcgttcaggcacagattctaggctcggcatttggagtctgcaaatcgcaatgtcgaatataaatacgtataaagcagttccagaagcttaaagattgagtgtggaaagaaactaacaacacgagtgtttctgttgcattttatgaattcaatcaactaacaaaccttatttattgtgtgctgatttgattatttcaacaaccctaaatttttggtttctaaaaagcactaattgtaagagagtgcagaggagaaaaatacatttcttattttggcgtacacttttttaatgttttggacaaaaaaaaaaaaaaaaaaaattaatattgcgcaacggccgctctttgtccctttactatgtactatcttacaaaaaccattccgcacacatgcaaatcttttttggaacttgaaagcaaaaattgaaacgctgtgtcaaaggtgacaaaaaaagaagacatttacaggatctgttattgttgttttaaaaggactctgagaataaaatctaaaaatgggaaccaacttaaggaatatgaaaatgcattcgcccagaatttccattcaaacaaccgatataaaatgtaaaaacacactgtttctcttctttaattccaaccataaaaatactagagcaaacaataaaaattagcattatagtaacgatgccaacatcatctttttacgccattttggccaattctttgcctccatccgccaattcaccaactcatccatcaataatcttcgccacggctcaccacttctttgcatgtcggccgtaagagaatggtgtgctcccattgagccgtgtaacagcctttctgtagaaaagtgaaaaaggcgttaatttgccatgggatttggacctgatcacagagcggaggataaggcgcaacaatgtccttctctgaaaagtttttgttgccaaagtgtgcaatagaagctattacaaaccgcaaaggtctctgagtgacatcaaatatttggtttcgcccagtcggtccaaccaccggcgacaaaatgccaaagtcccgaagttcttgttgattgtggcaagaagttttttgctacgcgtgagtctgaaacgatttagcttatacaaataaaaacccattttttacgcattggattaacacttcacctgagaggaatgtgctcctcatggagggcgaatttctcatgtaatgactggt

SEQ ID NO: 12976 - DNA, 3831 bp, Heterodera glycines
  misc_feature (3230)..(3230): n is a, c, g, or t
tcacaacgtcggagggtccaagcactgtctcatcaccggcgttgggcgtgtagtgagcggcgcaatgattaatggagcacccggtcgggaaggccaggccagcctccagtcccgactcgttgatcattcgacgactgtgcgcttcaagtcgctcactgtgatgcaatttttagcaaacaaaaacattaaaacaagaatatctaccaaatgtcgatcagcttcatcccgggcttaatccatgacttcacgtactttcgcgtttgtctgtgcgattctgcagcacgtcgaaaatcgttgtaaatctcttcgtaactgctgtccaaagcctttttctcttcgctggtcatccgattgatcgccgttctgtcgtctttgtcacttcgatactcgcaaatctgagcgtacggttttggcatttttccttttcagaaaattatacctgtccttgggggtacttgtggtccgtaaattgctggtcaatcggtttgagtgcattaatcgccgccgtccaatcctgggcctcttcggctttttccaccgcaccatcggcctcattttcagcatgtttttccgtgctttgaccacttgcacctcctaaatataaaactcaatactttaaaaaaatgactaaattccgaccctttccccttttcttggccgcctttttgttagcttcgttcgtctccaactcaaagtctttaaggatcgcgtcgatgtcatcagcatcgccagctgaaagagcaacaacatgacaaggtttagcctatggcaactgaacaataacccgtattctgagatttgctcccggattttttgttctttggcattcctgaaccaatatttgtctaaaagcggtccataaaagcaaaaaatataaattgaaaaaatatatagcaatcaaatgaatatttaactacgacaaaaataaaatagcagtaataaaaattttactcggaagtgaattcagtaaatacagacaaaaaattaggatggacaataaaatcatgaatcgtttcaaaattgttttcaaagtttgaaaagagtttttcaatcgcttcttttctcttcgccctgatgaagcggttgttaaagagcttctttgccgcgtaacccatccagtacatatttgtttggggccagaatgaggcccaatcttcgctaaaaatattctttatgtaaaaaaaattcgtttctctccacctgaccgccgccttcatcatcctgtagacgtcgtattggtagtcgccaccattgctgacaccattttgctcgaaaaggcccgtgtcttggctgagatcaacgaagaacagaacaccctctggttttgggaaaacaaattaatgaaaaaattaaagcgctttgagaaaaatttaagagtttactttttttcatacgcgaaatagaaaagtctattattgatgcgcgcaccccattcgagacgacatcgattcgttctcctcggtacatgtatctttaacaataatattagttcccagtgtattgcttgtgctgcttaccgaattttttcgttggccgggcactgctccacgagaatgttcccggcgtgcagatcccggtgctcgaactcgagaacgtcttccgcgatcgccagggacaaggcgatttgatggaagatggagtaacattcgcggccattttttatctgcgaaaaaaacttttcatttcaattttttttgaaagctaaccgcatacgcctccaggtcttttcccccataggaaaggccaatgacaacgaaatggagaccttcatcggcataaatgtctggccgttcgttctccgacaattcgggctttgccttcttgaaggcatcccaggccttcagcaatttgcacgggaaacatcctaaacggaaagaagtttttgcattcacaatcagagcattttgattgtgaacattaacattccacaaacccaaattagccaacaaattttaagtgcctctccattaaaaatacctctgacgattttgctcatgcgcaattgtgtgaatgatggcgtgacaaagccactgccggtgtcctcggatagctttgtaagctcgttggtgatgaacagttcgttgaagatgaattttgctggtttcaggtagtctccattgacgagcttcgaacactgctcctcgttgacagcgaatggaataaccttagaaaatatttgaaatagtgcaaaaaaaaagaacaaaaaaaccttcaatgcgatgaatgcattttccagaagtcctttaaagacttctccaaatgccccctcgccaatttttgaccatttgtcgaaagaactaaaaaaatgcatattcgaacaaaagttggaaacaaaaaattaccatgtcgagtcttcgaattcgttccacgagaaaacagcggactgaccacaaagctcgaggaaagcatccaattctgaataaatatgactatgttagtaatacaaagcaagtcccaaataaagttaaaattttaatttccaaatttcttctatcatttacccgattcccacggatttgtaggcaatgctttgtctaacgacttaaattgaagcttcacaggtgaacgagccgaagtcgagaaagttgttgaagacatcgaagtggaggaagttggtgaagccaatgccgaattttcaatcgagtacattgcgtgcctgctttgttcctccaacgctttggctaatgcgcctgtgagcacaccaatttcttgggcactgcctccagcagaacaacgactgttttccacatcagactggtcgatctgtaaattccatttggtactaagaaattgatacaattatgagggaacattttcaaactcacatgtttgagggtagtcccttgcttaatctgttccatcatgttgtcccgtaaagtcggtgcgtttgttggcacgggcgttcgttcagttgatggtgggcccactttcttcagcttggtgccttgttggatttgttgcagaaggtcggaacgtttattgttagtcggatcgacgaaagacgcctttgattcagtgctggtggaaggccatgaattgtccggcagagttggctttgattggaacagtggcggtgggggcggaggaggtggtggaggaggaggagacgccaccgaactcaccgctgttagcaccgactgtctttgctgcggagatgctaccgaactcgccgcggttggcaccggtggactttgctgattatgggaaaattcaaatcggccatccacccnaattgttaaaatacttctttttgctgattaatgaccgtcggtggagttggcggcggcggtggcttcccgcgactgttcttgacttgggattggtgcccaattgatggcttggaaggcggttgaactccgccacccaacgacgcgcccaaaaagcgttgcggaggagaaggcacaaacggatgagtgtcaacgacgggcgaatatgccatgattgcttgcttaatgaaaccaatcaatgcatcgtttgatactttgtgaaaaataatggacaaacctgttggtgtgatccgaaatcgttcatagaatgcatgacattgttggtaactggcggtggtcttgggggtggctgatgccgagtagccaatgttggattttgtgcaaaaaacggtgtgttttgtgaaaagcctccaatattttcgtttgggtatttgctttcattcgccgaattcaccgcggtttgcaccgatggaaactgctgaggaggcgccggtggactttgctgattatgggaaaattcaaatcggccatccacccaattgtaaaatacttctttttgctgtggaatgaccgtcggtggagttggcggcggcttcccgcaact

SEQ ID NO: 12977 - DNA, 1022 bp, Heterodera glycines
  misc_feature (40)..(40): n is a, c, g, or t
  misc_feature (983)..(983): n is a, c, g, or t
ttgatcatgatcacgcactggagggtgaaagcgatgtgcnggaaggtgttgggctggttgacgaattttgaagtcgcaaaatgtcacctggaaaaatttatcaatttaaattacgctaattggctcgtgtgcgcatgaatggaatctgaccctggggaacagcctggatcttgaccagtctcgaccggcaaccaaatcggccagcacatcaaagccccaataggtgtaattggcgggcaccatgaagtaattaatgctgaaattttgaatttttgaaaaaaaaaattcaaattattaattaaaaaaaaattgaatatgtacaggcacagttgaacaagcgcagagccaagattaaacaatttgaataaaatgtagaaaaatgaaacggagctgtgcgttggcttaacacttttccagtccacgtggtcgggcattgtacggcctaaattttaaaaaatttgtctcctagttatttagaagaagcgacggttaaattttaaaattttatcaaattttcaaaactcatgttccacctcatgttccacaccttaaaaaaaatatttttcgtagaaaaaattcattaaaaacaaatatttttacgtagaaaaaatttatttttctctagaattccactagcatgatcatctctgatcacatgagaattcgacacccaccaccaccatcacaatcatcaatcaaaacaaaatgtgccaatgccattatgccatgccaacccaaaacggaccactcccatcatggtccacgatgtcaagcttggcaagcatgttgtgctgcaacacgcaatggatgcgcacgccaatctgccggctcgcctcctccttgtccttgcgcgtgcccgccttgcactgcttgtgcgccttctgcaccaacaagttgatgttcaggcctgagaaaagcagcataattagctattctaactaatgatactttatgttgctcgagagtaggcacactttacatcntttgggcacggaatcccgactttctaactttatggcgcc

SEQ ID NO: 12978 - DNA, 1433 bp, Heterodera glycines
ggggggggcgggttaattggtcgatgatgattatgatcatcctccattatgcattatgtaatgaatgttgtccccaaaaattccccccccccccccccctccggctattttcatcattgctattttatattccatcgataaagcgttttcccatagaagcactactacaagggggggggggcgaagagagtctggggacggattgaaaaaattaatgttcaacgaatcgagcgaaataagatgaaaatatcagagactgcatgtaattactggatttcatgttatgaaaatccttagctcgtaattacggaaactttttttttcaattacggaatacagtaatccaaaatgacggagtgcctcaaatgccgtaatttccataactgtgattgagtgcagccctgccgatgaaaattttcgaggaccaattggcatttgtccttttacgaaacatttttttggcaacgatagtaagccgatttaatcaatttggctgattaattgacggttcaatgggaaaatggtaaatcaatgactaacaaatttaaatgatctgaccaattaaaaggctactagaattgctttgatatcaaatccgaatgattaattaactaaattgattgatgcaatgatgacaaaacatttgtgcgcagtgtcaatgcctgcggcgattatcatgatgccattgcgcacccaatggcattttggcgagagcatcagcaaatccaatgatgagcgcatggagtggatggaaatttgctgatagaaactctccgtttttggcattccgagcgctcgcagccgtttgagtccaatgtggcaacagaccttttctaggaatgttgtcctgttttccaactaacttgtaacctctagagtctctgtttagagtcttgacttgataaaattatgacttatgggtctcgagtttcgggaaatttgcggtctcgcaaatcgctggagagtgccataacggggccagcagcaggtgctttggtttgtgaactttcaactttttatactaattattttatatcgattttgtccagcataaatctaaaattgtcagaagcgcaatagattttacaggtgtaattgtgaaaaaatgaggacctcattttaatgtatatgtaaatttttgtttttatacattttcgacatttttttatcattttctgtgtatattttttccaaaaatccaaacccagcgaaagggactccctggtcccccgctctcagctgaaaaccacccccaccaacacccccaaaagggggggacaaacccctgcgtgaagatcccctgaaacccaaaatgattgacggttttaaaaaaaagagggggggggggcgccccccccccccccccccccccccccccccccccccccccccccccccccccccccccccccccttttttttttttttttttt

SEQ ID NO: 12979 - DNA, 1955 bp, Heterodera glycines
  misc_feature (28)..(28): n is a, c, g, or t
  misc_feature (1937)..(1937): n is a, c, g, or t
ttttttgcctttatgtatttcatttgcngatttccgatgggattggatgcccttttgtttttgttttattatttttgtgtgtgtgtggcgttgtgttgtgttgccattgtttttttttgcactctttttcggctgctgttgatttcctcttttgctaatttattgctcctctctttcttccttctcactaatttagtgtgtgtgtacataacaaataaataccaccggcgacggtgcggtaaattggggcgcaaaataacgccaaattaaggtcatttaggtattattatttttgtgaatgtacagcagaggtctactgccattttttagatttttcaccaaattttgagggctggataatttttttaagttttgtttcaattaatatcaattagtacgggaaacctcatcaataattccatacttttttttccggcggcgcttatcggcaccacctgcgccccccccccccccgaaaacgctccgaaaaaatgatgtgaaaaactaaactaaaaaaataaaataattactttaatgaaaattaattttttaatatttgaatttaatgattttttctttcaaatttccacttttaacttttaaataaaataaattagcagaattagatgatagattattgttcctaaaaaagtgtcaatttgggtaaacctaaaaaagtatcaacgagagtagtattaaatttaattaagtcaaacataattaaattgaactcaataatggagaaaactttggtttatctttccaaataaagaaacttaaatttgcttgtttctaaaaaaagttatgaacgaattaaaaatttatggacatgcaatcgcccaatatctcaagattgtttaatttgatgaatttgaaaattaagttttttggtagtttcctgttttgaaggcacactctatttaaaaaaaaatagaataaaatttcaaatttaaattctatagaaaaaatttgaggcccctctggtttggtcgatttcgctttctcatgagtcaaatgtcgtgtatcaaaatcttgtatttgcaaaaaaaggcttcttcacacaaatgtttacatttccgattaaataccagcaaatcgtgccaaaaaaaaactaaatttgcaaatgccaatccctccgcccccaaaaaatgctctaatgcaatttttggcactgccatttgctctcctcggcgctggcactactatatactaactcattcctgtcaaaaatttgctgcttcgattcccaattcccaatttaccagtcctctcccccccccccgcatttccctccaatagagccccccccccaacacagcacagaataatagtcagtcacagtcagtcagtcatctgagccggttggtcccgtgagggtgaattggtgggtgagggaggaatgcgaaggagtggcggagaatttgggggggggggggacattcgtatcgcatcccaccccaaattttatgggccaattttgtgacccatccatccccccatcccccaatatcccttcccattttccaaaaatcgcatcttttttaatcaccgattatgccaaaagtacacacaaaaaaataagaattttttttttgttgccgccaccaaatttgccttcacttccacaaaaaatgatttcccataaccaaaaaatttttttccaccaaaattttgtcattttcatccatctttttacccagttgccaaattttcagtgcctacacttgacaaccaatttttttggcaccccatagggcttcccttccttgttctctcctcattgtgccattcatttcctattcctttctcctccttgtggccaactgaggggggggggggggggggtgggctgagggtgcgtgggatatatctgtctttgtcactttgtccccccggctttcccccctcccccaccctttgtcactttgtccccccgngcttttccctcccccccc

SEQ ID NO: 12980 - DNA, 6628 bp, Heterodera glycines
ttccatttcgctgtcatatggtattctttttttgttgttgttagaatgcacttatgattccattagattagtcgaatatattcagcttcctgagccaaaaagccaaatgttggtatcattaaagaagaaaaagttatgaaaaatctaatggattcaaagtgttcggagcatttgtttgtcctgctctcattaacttaagtaatttttcttcccaggaagtatatgcatgaccgccatggtattgtcaaagtatccaagcgcgaattgctttccattgacattgcaagagcatggtaaggccgactttgttattttattcattgcccaaaccaatttagcgaagatttgcaaaattacatcccaacgggtgtgctgctgaagtctgaattgcgcgacaaaatgtcactttatctgctcgcccaattgtcgtacggaatcactttggtgttccaagcgcatgtcaactatttaatcagtcagtctggctttagcatttattaaaaaaggttaaaattttcagccgaccttgaatcagccatcaaatcatttgctcggtttccggaggaaaacaagcgagaaaaaactccgcgcaagtccacgggccgtaagcgtagacttgccgaacttgacggagtggtggaagcagtgatggcagtgccacggggcatggagcaggaggatatggaagaagaggacgacgaaggggcgaaacgccgacgcatttctgcgccacggaaggcatcaaaattggacttggcagatccggtcggtggaaggcaatttgttaacaatgcacttttaattcgttctccattttttagagtgcttatgtggaccagcaacttcctgctgctcgcgatgtgaacgaccagtcgatgctgatggatgagagcagccgcttggacgacatgttcatggaccagacggttcagccggcattgcccccgcccgattgggtagctgagccgaacgattcgctgccgtttggcgagtcggcggagggagttcgtcgtagcagtcagcagaaggtgtcgatgatgagcattttgatgggcgaggacactctgatggaggaagtgggcaagacagtcaccgtggcacccaatttaagcgcgttgcaaccgcctgttgaggttggcatttaccgactgcatttgaaaggcaatttcactccccgaactttgccatcgctttgctgttggcctaaattgcaaggcttattaatttaggttaataattgaattcttcaggatctcgaattggaattgcccatggaaatgacgcgtgatccgatctacaaaaaacggtccaccgatgaacagcagtccatcgatgtcgttgccgattctgacgatgtgcgtttgctttccatgccgaatccattccaactttgccgtttcagcgcctccaattggatgctctgcctgacattgaccaccagccaaagagtgcccatccgaagaaaaggaagcgccttttggtggacgaacagctccaattaggaaatgtgagatgagagggagcggcagaaaatgaagtgaaaatgcgcaatgcgtttcagcaagaaatgatcgaccgttttaacaattacggcgatttgttgcgcacccgtgacgacttgcacagggaaatcattcagcccgacaagcccaccctttcgcaactgctcgacccgcgtccctatcacatcaaaggtgtggctgtacttttactaaaatcaaaattcacattcatttagcattgaatcccgaacttttccctctgtttgacactgtccgcgctgaacaccgcgaacgaccgctgacctttgacgaagcgcaggccatgacattcgaagttggtccttttttgagttcatctccctcttcgtctgtcttagtctttcccacttgttaaaggatatgcaaaaacgtcgtttggaattcgatcttcagtcgtggcattccaacgacgaaccgacgccgctgcggcaacgcgtggaagagagttttggggacgcaggcggagagcagagacgcgaagaaacgcaagggaaagagaaagtgtcggtgagcgatgcattggtcgaaacggcggacaaagaaaaagagggggtaagtgagcaaaagcaaagaagaatggaccatcgaattgaccgtttttgaaactgcctaattccattgaacttctacagaccgcagaattggcagcacatcgtccgtcgtctgtgctggaaggggaggcaatgcgccgtgacacgacgggggaagggaaccgacgaatcaccggtcaaacgattagacttaatgcccaatttactaattggataccattttttagattattcatttggacagcttgggaatgagtttattatggccgatttggaccgaactcagccgcctccgatggacgaaatagtggcggacacggaacttatgcaggagtcggtggtgacgaaggaacactcttcgatgggaccattggacgaacagtcggtggacgacaacaccagagatttgtacaggtgggagagaatgctgtcaacgaaattgaaaacaacccccccccctcccaaaatattccactgacaatgaatcaaccaattcaattcacaaccatattttaacccaggatttcttctttaaatccttataagttagagaaaataatttaaaatttcttattaaaaaaatcagaaaaaacgtggttgtaatcccgacgatgcttcgttaagccgtctcaaccgtggtggtgttgcgtcgtttgaagagctgctcaaaagcgaatcatttggagagactaagagacttccgattactcgtgcggttgtcgcccggaaattcttcgcacttttgagtgagtgtcttcatttgaggatatatattagttttatgatccgaattaaaaaatactaattgaaatttaattttgcatgttttcagatttgctcaaacatcgcatggtcaaagtgcgtcagcgtaaaccttacggagaaattctgatccgagcgcgcaatttggagaacgacggagaacagccgagttttaccgagcatttgcagtgaattgagaaaatgaaacacataattattatttaactctctgcctttgattttttccgtttatgctcattattttgttaccatttcatttatttgctcaatctctccccctcaattgttaaacaatccctcactcttttcctcgattgtgccaatcgtcatttttgtcatgccaattttcttgctttgtctgcgcaaatacaaacaaatcttcggaaataaatatttttgaaattgtttaacaacagaagagccaaaagaaagggaagggtattccgttaaaacctttaaaaaagcattctaatgtttgaattgtccatttttatcattgaactgcgcattttcttttggtcatttcccatcgttttcttcgccgtttccctttgccttctcctcggcttttcctttttcacatcgccgctttttgccgcatttccatccctcggggcattcctcgtgacttttacaattcgaggcatagcatctgccgagctatgaaggcaaattgaatgaaagggtaatggattagaaaccggaccagacatggccaattggagggacaatcggggcgggcacggcattctgaagccgaaggggggggggagcatcaaaacaaccgttgaccaaaagccatagaaagttggcacactgaccgactcttcggcatttgagcagcacacagccccacccatcggagggacactccgagtgatcgatgcatatctgaaacacaagggcatcattcaccgcttcttctctgttcgcttggcattgcctcggcacaattcgcgcaacattcggtgtcccccgcggcgcattcctttcgcacgcaaatgaaattgcttttgcagaagaagccctcggggcaattgccactgaagaagcagcgacgaacgcatttggtgttgacacaggcgaaccctgggaaaatggaagagcaatgactgatgattggtcaggggatggtgatcggaaaaggcaaaataatttggcattttgtccctttgggtcacccgagggacagtggccgggccccgaataattgcatctgtggcccagcgagtcgtcgtgccgccccggagtgactgtttgttctgccgaagcaaccgaaaaagcggcgacgaacaaagcctgttgtagaaaaaagtcagaaataattttcggcattttatcgacggaaaattgccaaagcgaaggtcagcgaattggcaaaggcggggaaatggcagcggaagacgggagacattccaacgacaatttgtgaacatcaattgcaacgatgatctttgcaagtcacttaaatacgccatttttacgttattcaccattttatgcgctgaatcatttcgccgattgactaacgcatcgacggaaaaaagcctcggggggaaaggccacaaatagcaaaaaaggcattcatcagcagacgaaacaaatgaaaaacaatccgaagaaagagaaatggcaatcaaacaaaaaaatagaaatattatttcatttaataaataggattggacaaaatgaaatgaaagtggcctatagaatgtgtgactgttctcggtttgcttttaaagtgccattcttctgtgatcgtcgcttttcctcctcctcctcttcttcttcgttgcttgtccctctcatgagtgaaacctttcggacaatcccatcgcttgtccctccggcgtttcgagcgcattctccaacaatctgcccttcgaaaatgagaactgtttgtacatggtcctgaaaggggattaaattttagtgttttgttcggtacagtaagcccgtgcctttgttggccatgccatttcctacggtaacttgtcattttcactcactcatccgcaatgtccaagccaccggcaccctttgtctgcacataattggcaaatgagctgctgaagaaccaccgtatgtcaaagcgcacgtcgggcggaggagtggcgaattcactgacagaaaaatagcggagaaaagtggaaattggggcaccaaaactggccccaggggtaccacaaaaaggcagcaaaattggaattgcataattctgtcacaattaagtggcgaatcggcttcatagcgaatccgcccaaaaaacattcaccggcacttactacatataccacatggaaagcaccaacgcgccgtacagcttcagccggagctttccatatgcgactcgctccttgtggagcatcgatttgtcccaaaatgcgtttgtccgtttatagaaatatttgagcacttgacgaggagcggagaaacgcatttcaaccgagaaatgagacaaattggcaattaaaatgaattagcaataaaaagtgcgacggaacggaggaaaagcattattaaaaagcaaaatcaaaaacatatttttgaaaatggatgtgatctgatcaataatgaatcgtaaacaatgggaaaagtgtgccaaaatgatcggactttttccccctctaaatcacatggcattctccgccgacgagtgcctgtccaatgcggcgaccaattcggcggcggtcggcgccttcccttccggcgagtccaatgccatggccatcagcacatcggacgggtgctcaccgccgtgggattgcacctgaaaatcattggggaaagaaaacgcattaacgacatattttacaccgtgaaacttcaattaaaattttgccaatgtcattcactattatttttggcattttcctctgtcggcaccaacctttgcccatttgagaccattgcgtcccgaaaggggatcgtcggcgaaaagtcgctcataaatcagagaagcgcccgcccgagcgaccaaataggaataatattctgaaaagggggggggaaggagcacaaaaattgggtgggaaacgcagcgcgactcactggcgccataagtgaacaaatgggcgattctgaaaagaaaggaaacgaatgagccgatggagtcataataatacattgaaaaattaattaaatattcaacgaccacttaagaaggcaatcactgacaattaattaattaagcgccttttattttcaatttttgcctgtgatggtatgcgatttggtccccgtttttcagcccgggcaacgccttgttttggagatggccgaacagttccgtcgtgctcatccgtccctccgctatctctgccgcgcgttcgccgtgcaattccaagtcgaacagcgcataaagggcctaaaaagtttaccaaaatgcccaattcgtttggtggattttgttagtccacttgtcgcgtcgtgtgcagggcgtcgaacactctccgcgagttggcaatgccttccaaaagctccgtcgtttcatcggttggcgcccggcccgacgaatctcgccaaattttttggagtacctgattgtgagacataaaagccatgccaaaattaatcgacactaatcactcactcgtgggtcgttgaagaaacactccatcaaattggagggcacttccgcaaaatctgtaggacaccgagtccctaacaagaaaggaaattggaacatttaattgccgactaattgagcactaaacgcgtgctgaaaacgagttcgacccaaaattgaatgca

SEQ ID NO: 12981 - DNA, 3877 bp, Heterodera glycines
atggactctctttcacaaatttgtacgatcaaaaatttctagatataataaaaaaaatatgatattgtatgatgggatgtggtgggcgaactgacaggaattgagcgcaactgacaatattcaaaatgatgtcaaaaatggaatccgattaaataatagcataaaattggtgagatcagttctggtttgtctggcaaatcgaatcttttctaaggtctgtttgacccaatcgtttccctttttatacattcatttcccattggcccattggttggcgaatttggcgccttcgcatttggaattgcgctcgaaccattcgaccgcattcaaagtggtcggttttgtcggagatgactgattccgatttctgagcaaacgttcacagagggcgcactgcgctaaatgaatcaagaaggattagtcaaaagtcaatccaattcataacatttgaaaataaggattcgaatttataagttgaattaaaaatgaacataaatttcttatcatatacggagaagaggggaaggtcagcttaaagaccataaaatgaagatgagttgcctccagtccgttgtttgtacgagcgatggcagatgttgcctgtgagtgcatgttccaaagcggaattggaaaatgtggcgcacgaacgatttcgtcctcccacgctggaactgaattttttattaaatttaaacggatgattgattaaagattctgcctgaaggagctgtcaaagtcggtagcgggctcaacgaatattgaacaagctgctcccgtggactcacagtggttggccacgtaagagttgatggtgccggtgagccgatgccgaactgtattggtgtagccgcatagctgtgttccgaattgatggtcgaaattgttgtcccgagtgcagctaaaaattaaatttttggaaataaaatgcataaatttaaacaaacaatgattgccaatgggtgaaaaattgagtggattatctccaaatgcgttaacaccatccaacaactggcgctgtgtcaagccgatgtttgttcgagagaagtaaaggaagaacactggcattccaggaggagaagacgcctaattgagaaagctcttctgataatgtcgggaggcaaaagcggcaaagagagaacccttctggaaaaaattatgatttaaatctaaatttaattttttacctgaatgtgttgcgaactgcctcaccatattctgtcttctcgccgtacaaatgcacgagaccaagtcgtttgaagttcctgtacaggctttgcccgtagtggaacatgcagcacttaatcagtgccgtggggaaaaccgcgcggacggccgccatttcggctttttcaaagtcacaaagaatttcgccatgcctaacatttcgactgtcatacaagacgatgtcttcgccacgtttttcgcgtaacgttgctggaatgacaaaggccagtgggtcctgcacgtcgacgtttcccagcaactttttcttctcacgccgcatcatttcagtcaacgcattgttggagctcatggcaacaaaggcttcatccgttgctgatcgcctcactttagccaaaagtcgtgtgggcttcagacacggctcggccaggacactttctttgattttctgtcgccttgactctgcctttaacaaagcattaattatttggttttaaatttatacaaacttgttgtttctgaggtgctgggaggtggttgtgttctttttgactcaaggttccactagctccggtttcgccgttgtttgtgatgtttatatatgctgagcaactgcgatttgtgcatctccagcgatttcctgagtggtgtgtaaaacgaaatcctgaatagtttggaaatttattttttattattttttgcggcgcttaaacatgccgttcaaccataggcaatcggtcccataattggtttttccgcgctcaaaggtcactgttgagagttcagcctctttcaaattctgttgttcaacgctgtcagaggttgttacggcattcggttcaacgagttccactcccaaattcacggcctcctcagttgcgtttgaaatgtctgacaaataacgcttcttccgacttttttgtagactttcaagtttattacgaatcatttgttcaattaatgaaaagaaaaatctgaagtaaaaaaagagcacatattttagacaaatgagattttttcttatccgagtggatctagggttaggcaaggggctatataaatgtcgtattcgtattcagcgaccccgaaaagcctaaaacagacccgttttccggctttttatgagctttttagacttttggacaattcgtgggtttttactcttttggacaattcgtggcttggacaattcgtggcttggacaattcgtggcttggacaaaacgtggcttggacaattcgtggcttggacaattcgtggcttggacaattcgtggcttggacaaaacgtggcttggacaattcgtggcttggacaattcgtggcttggacaattcgtggcttggacaatttgtgggtcagcgcatattttatcatgaattattattgtattgtaagtttgaataattatatttttacccaataattttcaaaattagaaaattcggttttataataaaaaaaaaaatttacttgatcgactacaaaattttgaggattttttttttatcgaaaagagtatgatcggggcagtacgaattggcctaatatgagatgggtttttgtcaaaaattgctctcatcttcaaaaatggcaaacagcaaaaaacagacaagacctaaataacacaagaaatgttttgtttttttttggctgcgcatccaatgccattcttcaattagcatttccgtcggcatcgttggttacctgtcattattttatattgtaaaataaactttatattcaaataagaaaacatttttttgtgtctgggtctactagttaaatcagggctgccatcgtccatcctccgtttccaaggacgggtatgccgattttcaaggacatagtggggaaaattcatgaaatccaaggacatttaaaatttttattatatgcaatgaaaaatggttaaaatttattcaaatggtttgtatttttcaccggaatggattttttccaatatttttttgtttccgctgatcattttcctcatttccgcgcacgagagatcaaagttcaccttcaccagtagcaacgctttgactgattcaacttccaatagatttctttctttggtccattgactgcttgccagtgaaaaaactcgttccacgaatgcattggatgtcggaatctttaaaataaaaattcatttcttttttttatttttaatgaccgagaaagctgcactgacgattcgatacaaatttgcataggcctctgttgcaccatccgcctcaaaaatgcccttccatttatcttcggctgatttgagccaaaattcttcgggaatgtcggccaatgtttggttcacagcagacacttcatcaaacagttcatccaattgcgctatttcgggacaaatttgctcagcaagttgcacaacttctgcataattcaaaggatgattttgtaaatttgtccatgaaatattttttggtagtaattggagttggaaccagcgatcaatgtagttgagcacaattttgtaaaaattctttaaaaaaatgcattaataaaacaaaaataccaaaaaattttacgcaaaaatgtttttcaagttccgttgatcagcagtctctcaacgcaaaatgtcctccaaaaaatgccttcccgagtcccaatttgccattgaaaaatcggatcacaatcgggaacgagtttttttttcggcatggattacttgcgtcaat

SEQ ID NO: 12982 - DNA, 5141 bp, Heterodera glycines
ttaagtatggtgtccacggtgttgtcagtgatttgtcgaattgggatgggtatgtcgccgccagtcaaaagtgggctgctgatgatacagccgagatgagttggttttactccgcgctgttcgctttccaagacggcctcatcaatgcaacattggaaaataccggcaagcaatccttcgggattcgctgggacgtcctcgatgctgaacttcgatttggccttgacgtattggaagcgtggcacatgttccaaactgttttccaattttttgacgtaatccttcgcgggtttagccgatgatggtcctgctccagcttgaacaccatgacgtggctttttagcaggaatggacagaatataatcaatggaaaatttagaggggcactggaagttgcgattttccattttaaaatctaataaaaatccataaattttttaaaaaatattattataatgataaatatgcagtgaaaaggagtatttatatgagcaatactcatcaaaaatacaattggtcatgaaaaatatatgagaaaaatacacaattatttgaataattgattaaaaaaaaagacaatatcaacccatcttgacctgatgagcagcgcactgccacccatgaagcacaagacgacagggcacctaaacggctcaggaaattagatatgtcaaaagcatgacctcaaggtctaaaagacaaattaacaaaattttgctgccaggataaacggagctctgtaggtcgaactaccgccctggttaacagcaaaattgaaaataaaaattatttaaaacctagataagagaataaggaacaaatgaaaaattctatgtctttacgcgcttttaaagctgttgtctccgcccatcaatcgataattttcggcgaaacaatgcgcatttccctcgggaattgcatatggtgacagatgtttgtaatcaatcgataattttcgacaccttttcaaaatttccttaatggtgtagggcattgccttccaatatcatccctttctccgtctagaaccaatccctaatagcattcattcgttcactttcatttcctatacattaaaaaaaaatgcccaaaatgaacaagcggttgccacatgagcttatttgggaaattgtcgctgcaattccgataatgtaccttttcggaggagtttcaaagaagccaggtaatttttcaaaagtattattaaacaatgtaaaattaaaggagctacgcgtccgccatccggcatcaccgttgtcaaccgggcgttcgagatttttcgtgccaagcggcatttttacttcttaaaaatagttggtaatatttaaaataacaataaatctgaatttttagatcgatcttgctcaaaatttcgagaggctctgtgcactgaggaagttaccgtgcggagaattgttcatccaatttggattcatacaatttggtttcgaaaatgaactggaggacgccaagtgtttcgccgactttttggtgtatctatattatggacgatctggccctaccgttacgacgagagtcgtgacttactcgacggtaagaaaaaatataataataatattaatattatttagccgattaaaattggagagctattcggcgcaattctgacgcatgtattgggaagcgcgaatccgctgaccatgaagaagcggactgcaggcggttacctgttgcgccaacattttccgcggcttctccatctctcggcaacagaaatggcatcagatggcattggtcaactggtccgctccgatgggatggaaatgtaccggctgatgaatctgcaccacaaaggagatgttggttatttgattattattgcaacatctcaacaccccggctcgtactattttaatttttcaatcgaataagtgttttttttttgtaatgaataaataattttcaagttataaaatttgttatttattaattattttattaaataggatcattgcatacatatcgggacacgtactggtattaagcaaatcaagaaatcggtcaaatgaatgtcctagcgacatgtggtaaagaaacacaatacaatgggcgccaaaagttgaaagtaaagaggattgataggggaaagtgttcttccttaatcccccggggaatttgcacaaaaaagaagactggacggcggatgggataggctgggcgaggctgtcaaaatagagtaccggtgcatccatccccatcgcataaatagcgcaccaatgagagccctccttgtggtgggggtcccggttcacaacaagcgctgcggggtactgtagtgtggagggaggcggcaattggtcacaggcgaagcagccccgaaatgctcgctctgtccgacgattttcgctcaaaatctttgtgatttgtatgctgtccatttttcaaccaaaaaattgagcaaagttggtgcaacacaagactgatgataagcattaaatagagagtgaagagggcccaacaaacagcttgatggaaaaagttttcctcttctggtctatctttacacaattggataagtggtggaagaacagcagcaacatgttcatcaattaatctgtcgctttttggtgaggtaattgttaatggtgcagttgttgtactgacaatggcagtggtacgtttgaataaagacaatcttcttaaatattccgagtattaataatctggctcgtgttgatgtcgagacaaagtcaaattttttagataaccagagtatgtgttttcggtatgttgttctcgcaatgatgatgatgatgatgaaacaatgggaagagaaactcggagcaagaataaaataaggcccaattttttagagaacattttatttattttatggaacaaaatgatatgacaagcggactttaaatagtggtgtctgtgcttattgatcggtttttgtccaacatcaccagtgagtcacattctcccatcacaacaagcattattcctccgtcgggcactgggtgattaaattttatgctcaccgctgtggtcccattctttatcagatcaaacaatgccgcctgatcgtccccgctattggtcaaattgaaaacgtaaatgcaatgtgttttaccgtattgggaaaaagttatcccgttgctctccgatgagttagcgaacccaaccgcttcgttcatgtcattgaatgggcgaacatatttcccacttgggtaatccaggtcatagggcgcttgggggtacgatcgtccattagcaacaatggaaatttcgcgcacattaaatggttgaaaattgaacgggctgcgcctaattgtcccaacatagtcagcattggccaccagacccattgtcacacgacgggggatttggtccatgaacagattagatgtaaactcataacggccctgactgatgaacattgacttcatcattgtcttccttactgcataacgggcaggcttcacctccaactttctcgcaatgtccagcgccaacccatccatcagagacaccttcttcacatataatttcagtccaagaatctcgaaatggtagcggggtgcacccgcgataggcgaaattaacataaagtcgttgtcgttgggcaaaatttcaatgtccaattcacaaaaattgatcagatacaatggctgattgaataggtcagtgtctattttggcaatgaattgagctacgttgctacccgcaaacaaatctcgtcgcgctgtgcatccgcctcccatctccaatgtatcatccgtgtccctataatagcccattgcattcagatgggagtcttttgctgtcgttgaataggagagttcatgcgagaaatatgttttgtaggccattaaagcgttggcattgaaaatttcgcgcccattaatactcatttttacgttgcgaatgaaggtttgtccgatcatttgaattggcgcaatatttatatcatcagcatttaggttaatgagttgtccattagcgttttccttccggattcgaaactcagtgagcaaatagcatttggacagatcaatatagttttgacttgaatgaagtttgaagtggtatggtgtgtcggtcagagggttgctgggcagaagctcaaacactttcgatgacgacacactcacattggtcggcagaatacggaaaaagtccaaagcattggtgattgagttcacggagtcgttgtcgtttttgtgaaatgccattatttaataaagtccaaaggcgtccgatcgaatacgctttttcccctgctttacaataggtcgtccaattagggtttgatgagcagacagatatgctctctttctttttatacccttttttccgcttccaaactgttttggtaatccccctttgtcgggtacggtatcaatccctttctttccttcactgacaagtgcctccttaaacggtaccccctcattcccgactcgttccagcactcgttgtccagtgctcagtgcctccaatcctactgtagtgccaacacggcgaagaattggcaggaaaaatcgccacagtccacgaaacacatctccaacgcctgctcctcgttgaatatcgtagccccgctgaaagggactggacccccgaaagtagtcgaaatcgtctttctctagcccgttaccgtattgcacatactcatcatactgcgcaatgcttgggtcaaagacaatgtgtaccatttattaaataattataaatgaaatgtaaaatgaatggaatcaaaaatttatcacttttttaaatatcaacacgaccatcgttgtgccataggcgaatggcaccagtcggcctttgtccattgtgcgcagttcaatctcaatctcgtttatttcccgaggtaacactcgcgcaaatattggcgagtcataaatcttctcagtgtactcccctgggatggcaccgctgattgacacaactcggagcaaggagctcaatgaattgccaattatcatgttctcggtcaatccttttgagtatactgcaaaacttgagatgccgccgcgcaaatcatacccgtatttggccacttcatttgacaccacatgctgagggttttcaaagccgagcacgtagcccaactgtggtgaaaaagacaaataggtgatgatctcctccattgaacaccaccttgaatcgtt

SEQ ID NO: 12983 - DNA, 3408 bp, Heterodera glycines
ttttttaacattgtacgcaaaatttcaaagaattttcggggtgtgccattttttcaattttttttagaatatgatacaaatggcaaaattcggcgaaaatggcaaaaaattttttagttttccaacggaaaccgaaaatttaaaaataatacaattgctaattacttttgttgcgcgacttttcagcatttcttcaatggccgccaactttacgagtccattatcaatttgtttgccaaatttgtcccgctcaatggcaattgtctcctgtaaattgaacggaaaaaaagaaatgtgaaattcaaattggtataaaaatgtttgacaaaatccatataaaaaaatctaaaataattattttatacgatttgcattcatttccaattgtaattagtcactagaaaaaataaattggtaaaaaaaagcccataatcaaacgaacgaagaaaattaaattttcatttttcatcgattgattttctattaccatggcaggcccgtaaccaaaaaaaaaatattggtgggaagaacccgaaaatatttttttttaatcatcggacaaaaattttttctcccgtattatttttcagaaattttcagtgtcgaggagaaaaaaacaacagaatttttggtcgtttttcgccacaaattataaaatttttgctatttgggtgccagattttgaagggttctgacggtgttgataagcgaagcggcggaaattttttgaaaaatttaaagaaaattgttaggaaaattgtgcgaaattttcaaaaaacatgcacattttttcttgaaaattttttcatactcgccaaaaccacgcgcacatgttcactaattttttttttttaaataaatttttgaggaattgaaaaaatattttaaaatttatttccatagcgcatattagaaaaatgttgcacaaaaattttggcactttttccgaaaatttttgagaccaaaatttgcaacactttttcgcactactccttcaccaccaccacctgcacaatctgctgagtctccatgtcgtggatttgcttctgtgtcctgatcactcgctccaaatgttcggcgtgtgcaagcgccgcccgcttcagttgcgcgtccaattcggcttcatccgactcattgcgctgctggttaaatgtgcaaaattgcggggcaataattttaataaaatttataaaaaattttggaagatttctaaaatgttttcttaaaatttcttagaaaaatgggagggggagggggggcggacaattattcctaaattatttggtaaatccaacaggaagtgacaaacaagtgcactggtttctcccatccccccccccccgcttatcagtactccataggttttcaaagaaaattccaagaaaaattttttttcttggaatttccaaccattttttttcaaaaattttccttaaaaaatcacctgaaaattgttttcttgaaattttatttaaaaaattcgggggaaacaatacggggagaatctagcagttttcaaatatattttcttgaattttttttagacaaacgggcaggggaattgaatgaacccctcggcattcgagcatcattccctgtcgaaatggcatttttttctgaaaatttcaaattttgagaatttttaaaaacatttttcaagggaaaaataaaaaattccggggttcggcattggttgaaattgaatgagcagaagcagtgggccaaattcaatcaccacaacaggtgcatgtcataagcaaatctcacaacaccgttgagccgacgaggtgatcagtttgtgttgcgccagtggtcatttctctgttccgtctccgctcaatttccaacgccattttggaaagactgaacgaacacataatttcacagacataaaaaaattgcaatacacattgtcgaaattttgaagtgggtcggttagaaaaaaaatttttttttctttgaacgcccatatttttttttctaaatcgtcaaaaatcgcttagcctttgcctagaagaaaattagtaattcatggggcggactcgaaccttcaacccttttccattgactatactacaaaaaccactgagccaactagactaatcacaaaaaaaaaaaattttttttttaaattttcctaatcgtgcgaacctttcgtccaatttccgctgttcttcgaccgcttgcgcaattttttgcttttccattcccttaaattttcgctcaaaattggatggatttcggcggggaaaaagaagcaaactttttgtgtgaccaactgttgctccagctcagcaattctttgcgcgtttgccaactttgaaaaatgaaaatttttttcagcaaattttctcatttcgaaattacctccgcctttctgtgccctttgtcgacttgttttgactcgttttcatttgatgaacgtactgaaaacatggtaaaaaaaacaattgggtggaaaattaacgtaaaaatggcacgtttttatgccaatttccctctcctcgtcccattttcccatcggaaagccccccggtttttaatgtgaaaattgttatcggtcacaacccttttaccagcaaaatctgggctaaatcttgcaaaattttactttttttttttgaatagttggctcaaatgaaaccgatttgtgcacaatttacgactcaaaactaaaattgggaccaaaatcgaactcgagaccctaaattggcccgaaaggatgcaatatttttgttattagtcatccttatggcactttcgggagagaaaaaattggggaaacatttttcaaaatgcaatttccgtctcacccaccattcgttggcattcggtcgacaaattgttgcgtccattgtggcaactctggcagagtgccgtgccgaacataatgctatgaaacaaacaaaagctgcaaaaaacaaagtagagaagatgtgtaccgtgccgacatatgcagcaccgccagtggcaccagccaaaacgaaaacggcaccaattctcgtgacacgacgccagagtgggtggggcattgcgaaataagccttttgctctgtttagccaattctgctgattagaattttttgttaagtttttgttttggattatacccagggaaaaagggtattttggtccggtttcttggtaattaatagagctcgacctggacctgtggatccaggcctggatttttcctggatccaggtccaggcatttttcggcaacccgtatttttcctggaactggatttttgtccgggtccaggtctaatgtgaaaaaaaaaatccaggtccaggcaaaatatgaaaaacctggatttcctggacaaaattttagaatttattattccaagtgactgatgtttttttcaagttttcaaaaatgattaaatagattaaaagctgatta

SEQ ID NO: 12984 - DNA, 1329 bp, Heterodera glycines
tgttccaatttttggcccataaattcaaaatttgaattttcgcgtcgatcctcgcttggtggaggggcgattcctggggaggaggggagggggcgcgctttggggtgtgggccggtgccgtaggtgtaaggcctatgttattttaattaaattttattttaaattaaattttaactattattttaaattaaataattcccaaataattatttcccatcagtgggaggggcgcactcattgagagaagagatgaaatttattatatgaaatgtgaaaaataaattaaaaaaatgagaacagatgggaggggagggattagcagtgggggcaatgcggtgtgcatttttgtttccaatggttgacgattaggcgctttcttttgtctcgttcggtgtgcttcggaacagaggacgcggaagaggaagtggtggatgaagaagcggaagagcaggaggacaccgagctgaacgcggttcccggtctgctgtcttcaaacagaactgcctccgctgcatgaatttgttgtggtgaaagcagtttgtacgcggcgcgtacacattctctaggaatgcgacgtgaacacgttggcgtcttattggggggggggggggggtttacatttataggtaaaagtgggtttaggctaccgtttgcaaaacatcgcacaacggttgaggcgtcggggcatcatcgaacgggacaatttggagtgccggtgccggagggggcgcaaatgcgtgctgctgaccgaattgaagagaagggagttccaaggcgccctgaagccgaggaaacggcgagttgatgaaaaatggtggaaaagcgggccgcagaggagacatgttgtgaaaatgcatttggagcacactaacggcattgtcgacaatctgcgaaatcatcggccgaggtggcagcagcagttgttgttgatgttgtgccgggaacaattgctgcggttgttgttgttgtgccgggaacaattgttgcgggtgttgttgtgccgggaagtttgtcaattgttcgccgtcaatgtccagctcaatctccacgtctgccggtggggcttcggcggcagccggtagaacaacaacggatgccggagggacaacggcggcggcagccggctgtacaatggcgggtgccggctgggtagccgcgggaaagaggcgctccttaacatgtgagtgagcactcattttgcgctaaattttttggcacattaccacatcaacacgctgcccattaattattccaaataaggaaaagtcctcattcccacgtccattaggtggaaaaacgctaaatttttgtaaattatcgaatttatgc

SEQ ID NO: 12985 - DNA, 2375 bp, Heterodera glycines
atagaaaagtgattagaggaagaaatggtgcaaaaaacgaggacttttttcgctccaattgggcggacgaatcgaatagcaaaaaattcacttttatatattagtaattattccaaaataggcgcaattatagtaaatagcaatacaaaaccgttcatcaattgtgaaaaatataataataatttatatcataaatttgtattataaagattttttaaagaattttcaacaaaaaaaaaacaaactttttcagtagaaaatttttggttaaacggggaaaattagctaataatttatccattctaaaaatagttaaaaaaccaattagtctccgaattggtacggttttggcgaaaaagttttttgaatcaaatgccattttcggccagcagagctcatccatcggcagcgattctcccacaatttgtattgtgtgaagtgaatggtttaggtaagtaatgcgtcgtccccaaatgcccccgggaaattattgagtggcttattgcgccaacggcacggagggattagtgccaccggtacaaattggccgggcggggggagggcagggagatgagctgctccgataagtgggccatttcgagacggaatttgggcccaaaagtgggaaaagccctcgggggaaattggccagggacaaataaacggaaattacgaaaggaaaaacaaatttaaacaattttccagtaatgtttttttgtgatagcgtaattaattaatagccctgcattaaaatataattactctcctttctaattaatttaattggtttatttattttaaaaaagagaatatattcttcttcgggttttattggcataaatgaattaatgcatcatataataataaaaaacggataaagctatcttcatgattcacaatttaattttcaaaaatcgttaccgtaatctgtgcctaataaatttcaacaaaaaatgaattgaatgtttcatattgtgttttacgctaatgaggcaacaatcggattacggtctgatgaaatgaaatacagtatcagactgaagaggaaacaataaataatagtgaatgggttcaatttttgttgcctctgttttggcgttccgtcagcacttccgccgtttcactttccgccgtaggcatggcgaacagtacgccctggtactgtaccccattaatttccatcgacaccaccatggacgagggatcgttgcccgaaaaagtggctgttgtcgccggaggcaaattgccagcggacgaattgccatcagtggcattttttgattctaaaagaccgcggggataataaacccgaaaccgaattaaatttgagaaatttatgattgggttcgaaaacaatttgaaggaaatgccctcggcgaatttttcaaaattaacaaaattcggtaattaatttgggaatttaaaatttttaatttccaaaatcattttttggaaaacagccatttcgtttcgtccaccttcgccgttgttcactttgatgttgaaacgcaacgcattttttagcaaatcgccaaacgggccgaggggtgacgcaacggaagtgccatcgccgcaggcgatggcattgtttttcggcacatttatcgacggggcacggccaacggatgccgaatgaggcccttggtcgctcacttttcgccttttctcagctgaaaaattatccgatcagcaattttctttgttacagtattccttcctttttggcactttttgccaattttccctccccaaattcgaattttcctcacttagcgccgcgtccgccggtgattgtctctgctgctggttggcggaggaggtggcaaaattggaggaggaagttgaggacgatgatgccgcggtgccgtcctggtgttgttggcactttcctgtttcggcattcgcttcgttttgccgttgggcgagcgtttgcggtgacgacgaacttcgaccattggcaagttcaattctgaaaagtgaaaattggaaaatttgaatggaaatttggatcaaatggatggactttggaaatattgagtcgaattgttgccgctgattctcctccccattttgaagcaaaaattggaatggcatcgccgccacaccggcaaattgtgacggcggttgcgcaacggagggcgcccggctgctgttatccccgttttgatgagcactttcctcctctgtcgttgctaaattgaaaatatttgattatttccaatttgtcagctaatcaaacggttttccgatgttggctaattactcctaaatatataattacggtgagctaattatcccgttacgattggttaattagtcttaattggtcacacatagggatcactatgccaattggaattgtcccttattgatga

SEQ ID NO: 12986 - DNA, 1754 bp, Heterodera glycines
ctgtttcggattcgcttcgttttgccgttgggcgagcgtttgcggtgacgacgaacttcgaccattggcaagttcaattctgaaaagtgaaaattggaaaatttgaatggaaatttggatcaaatggatggactttggaaagattgagtcgaattgttgccgctgattctcctccccattttggagcaaaaattggaatggcatcgcagccacaccggcaaattgtgacggcggttgcgcgacggagggcgcccggctgctgttatccccgttttgatgagcactttcctcctctgtcgttgctaaattgaaaatatttgattatttccaatttgtcagctaatcaaacggttttccgatgttggctaatcactcataaatatataattacggtgagataattatcctaattatcccgttacgattggttaattagtcttaattggtcacacattgcgatcactatgccaattggaattgtcccttattgatgatcaattaggctgatgattctttctttcacctcgtgccatcgtcgccattccgtccgttgccgtgccaccaccaaaactcagcaaatgttttccaaagaatgccgccgcgaccatcggaggcggcggcggagcggtgccaaacatttgctcaaaccagcgcatttgctgctgttgcatatgccgttgctgctgagcttccgccgaattggcggacgaatgacggcccctaatgagcaattaattcatcaatcattaattaacgggcaattaattagtcaaggcaattagcagatgataattaaaattttaaataattccctctcccattttaccccgaataattgtgctggtgatggctgttgttgttgtggttgttgctgccgttgtggtgctgtgcccccgcgggcgttgcgcccgcggagttcgaagttacgccggcggcgcccggcggcggcgggttgcgcctgccctcgcgtttgtttgcatcaatcgctgcttccaatgctgcacggtcgctgaatttgtgtattttgcattcgtagtcgtacaaatatttgtcatatctgaaaaaagcaacaaaaacatgattttgtttattttgctaggcaaagtgatcagaaatatgggaccgtttccttttggtctgattagtggtgatcacaaagccaaaaaaagaaaggttcagacagcaattttgcaagtcaaaattaactgaaccagaaagggttaaaaaaaagtcaaaaataaatgcgcccaattcgaaaatcggcgcaaaagtggtaaaacctaaaagggtaattagtggccctgagaataaggcccattaaaaagctagcgcgccggttctttgatcagcaaatgtgttcggattatgtccgcttttctaatcagcctcaaggagcatccgatcaaaaatacattagcaaaacaaattgccattttcattcattcatttctcactgtgttctgagagtgaacgcggccgaagtgatcgaagttggcaaattgagccctttggcaatttcgcgccacaatttcttgttgatcacctccaccagtccgccgtggtgcaccaccagcctgtacagctcgtacaggtccaacacctgcttggccatgatcggaatgcgtgtcaccggctttcctttagtcaaattttgacatgtaattagataactaaataatgagtggcaccgtgttggcgcataaattccaagcaaagagccagccattccttccggttcagatcagtgggcgaaa

SEQ ID NO: 12987 - DNA, 1373 bp, Heterodera glycines
  misc_feature (1322)..(1322): n is a, c, g, or t
  misc_feature (1343)..(1343): n is a, c, g, or t
caatcggatcgaaaatcacagatcagcccaactatcggtcggcacggatcaaaatggcacaactgtatttggaggtgaagcatgataagcacaagttcgccttgtgctacaggttgatcggcagatttccgtgtgctgcagagcgtaaaactcaatcattttttcactgaagggaccttttggagcaggacccgagcccgcagacattcgaactgtcggcgatattttcctatttttgattagcccccattatcggctttaagtcttggtgacgcctacatgagcatacaggagccagaaatggcaatcgaagcgtacgaaacggcgatgagacgagcgccaaaggaccaccaactggcggagaagatcggaaatgcatatgtgaagtgccatttgtacaacaaggtgggatggggaggaggctgatctgatcagtacagagcagagttgtcgcgggacgagaaaaagagtcaggattcgggtcggtacagctaaaacctttcgggtcgggattcgggacgagaaacgggactcgggtcgggacggcattcgggacgagattcaggtcgggatagccaaaatcagtgccgttaagccgactcgctccccaattaattgcttttcctttaaaagcattccttcccgcccccccccaaaaaaaaatcggcgccatttcttcaggcaatcactttctatgaagcggcggtgaaaagcggtcgccacaatttgcgcattcgttttgcggagcaactgttccagctgggcaaccttgagaagtgcaaaaaagtgctgaaggaaatgttggaggaacagggcgaaccgatgggtagcaaaaaaagcaattcaaattttggcgttagttttggcaaaatgaaaaactcaaaaaacaaagaaattgcaccgatgcgcgaacacgttgcctatctgatgctgatgtcacgactgcacattgaacagaacgatttggagcagtcctgcaaggatttgcaacgggcgcgacaattgcaactgaaagtaatcgcccgaggcactgtcgctagcaccagagatggcattgttaacatggcggaggagaagcagctggcagcaaagttggcacacagccgggggcacattacggctgaccgttatcccccaaaaatgccattgcagcatttgtcaacagattgccgaaatgcatgccaacaagcgggactggaacaagtcaattgaactgttcaaagaggcgattggacataatgaaaaggacgtgaaagtgcgtggcgaaaataaattttaaaattaagccggggattttgtatttaagaaaaatccgaaatatngaattaatatatattttttanaaaatgccaaaatattttttataatactga

SEQ ID NO: 12988 - DNA, 4330 bp, Heterodera glycines
  misc_feature (1325)..(1325): n is a, c, g, or t
  misc_feature (4308)..(4308): n is a, c, g, or t
agtcacataattatgcgtcagtttgatgctttgcccactcgtcgtgcccgactgaacgcctgcagtgccgagttcggttctccgatgtacctttttgagtggattaggtgattagtgatcggttgatttagctttataaaagaacagttaatcagtgattggggttacaaccattcgatcagtcccttgcagtagttgaaccccgcgtccaccgtcgcccgtgggttgttctccagcgcattacggagcattttttcgccaagttcaatgcttccttggcgccatcccagctcaatgtagcgtgccaatgcatggtaatggtctgtgtttgtttgttgtgttgtccccttttgccattcatcccctccccccccccccctcgaaaattaaaaaaatagattttttaaattttcggggggggggggggagggaatgaatgccaaaagcggacaacacaacaaacaaacacagaccattaccatgcattggcacgctacattgagctgggatggcgccaaggaagcattgaacttggcgaaaaaatgctccgtaatgcgctggagaacaacccacgggcgacggtggacgcggggttcaactactgcaagggactgatcgaatggttgtaaccccaatcactgattaactgttcttttataaagctaaatcaaccgatcactaatcacctaatccactcaaaaaggtacatcggagaaccgaactcggcactgcaggcgttcagtcgggcacgacgagtgggcaaagcatcaaactgacgcataattatgtgactaatgtgatcaaattgctcaaggatttggaatggggtgagagggcattgtacaacatgatcgagatctgcttgaatcccgacaacgagataatgggagcggatttgggggagcagcagcaacagctgagccctgaggagtgagtgggcattaggaaaatagagttggtcgagaattggcaattctcgatttaagcgagttgagaatatggtaattttcggcacaactcagtctaggagcggtattttcccgttcaagatcgagaatttgcacttttcgagtcagaaatgtaaagagaagagacagttagtttccgagtcaagacgatcgagatttggctgttttcgagtcaatacagtcgagaattggcattttttcgagttaattcgtcgagaattggcagttcttgagtcaagataatcgagaattggcatttttcgacttagcattaatgattaaaataagacgtataatcagcgattttaagcgcacatgaagcaaacgagtcgtacaaagctgccgaccgtttcttcnaagtttgcgcattttgataattaccaaaataaaaatgatggacccactaaaaattggaaggaattgcgtcacaaatcgatgatggaccgacgctacaaactcacgcagaatttcattcttttggccaaccccaacaaagcgaacacgcaaaaagcattggccaatttcacggagctttgccggacggaagggatgacggtgggtggaaaaatggggaaaatggacatttggccaacatttgttgtcggaatgtcgaatttcgattggcggtttccgacattttatgctcggaattcctatttccgaaatattttcagctgttggaatgccgattgttgaaattttttgagggcatcggcgtcgtacatccctagtgcaaatctcattttttggtaaatgctctgaggattatccattttttgaggaggatgatgccaatctcagcgcgggcgcaattcttggcacggcgcgggcacttttaatggctcaaacagacgccaaaggcaaaggcgcagctcaagagaatggttggggcatgcgtggaatttggaggaggcggaatatttgcagcaatgtaaaaatttgggaaaatgaaaaagggatggtgaagcgacgagactcgagaccaagactttggtgaccccgaaaccacaaaaatattagacttttttgggtcgaaactcgagataacctgagacgacaaaaaagcaacacgaaaacttctcaaacttaagacatggacttgacaccgaaaccgccaaagtgttagacttttttcgggtcgaaactcgagatcgagatttgatcctgagaccacaaaaacgcaaaatttttcacgggttataagattcgagatcaagtcttttctcgatagagcgttttttgacccccgattaaataattagtttaattgaccatttatgggcatatgaacctttttgaggtgcaaaaattggggaaaagcaaatgggaggacggaatgaattggcccaacccccaaaaaaaggttggcttctgctggccgacatttacatcgaccaggccaaaaatgaccaggcagtggccattcttcgcagtattctccagcacaatgccgttggttttgccaaattgttttttttctcaattttaaaaattaatttttttttttgttagagttgctcaaaagcctatgaatatatggggttagtgtgcgaaaaggaacaaaaatatgcagacgcagcagcgaattacgaggcagcgtggaatgtgcgaaaacggagaaacccgagcattggtggggggggggggggaatttgaaaaaatgggccaacattggcattgacacaatttttacaggatacaaattggcctacaattacttcaaatgccatagactcttcgagtgtatcgaggtagggggatatgtgtttatcataaaattagggatggaatgaattcagaggcccaaaagaatttcgaattcctaggcctaagcaatttcagaattttccatttacacctaaaacaacaaattattaattaaggtgtgccatgccgtcctcaaacagtacccgacctatccaaaaatcaaaaaagaaatactggacaaggcacgagcaaacataagaatgtgaaatgataaaaaagaatcgaaaatggaattaaaatggaaaaataaattatgtttcatcaaaaagcccacaaaaattgaagaaaaacaaatttaaattatatttgacgttaattatcgcgaaaaccggttttcttagaagcagaaaaataaaactttatagaatgtaaaaaattaaattaaaaaagaattatttttattcgattacaaagccaaattacggaatacataaagcattttttctaaaaaatcgggtgtttttaaaatgccttcaaaaaaaaaacaaataaaactcaaagaataggccaattgttttttttattaaaggaattcgaatatctggtttcatattgcagtatgaggagcatcaataatgaaaatgattcacatataattgcatcaccgtcaattaaaggcaaaatttgtgaattttttgggaatgatttttggtcattttacggcaattgaatgttgcggactgtttgttcatattcggaagttgtgttcggtctaagctgtcggcttgatctgctgttggccaattcaatgctttgcgggagcaaatggagcgtcacaaactctttggcatcgcgccaaatttgggcctaaaacaaaaatttaatttaaattaaaatgccctaatttgattggtgattgattgattgtttgcctgttttcttgctgttgaggcaatgaactcgttggtcttgatgcgcgactggcggtcaatggtctcgtcaagagcgtcctcaatgatcgccagcagagaaagggtctgaaaatcgaaatattattttaaaaaagattaatgaattattggagggcagatcagcattgatcaggcattttgaaaataataaatgatgatcggcgttgatcaggtattttgaaaatactcaatgaattattggatagccgatcaacaattgatcagtattttgaagataaagccttgatcactcttcaaaaaatccaatgaccaaatgattcaaaaatgaaaatattcaatccaatttaaactaataaatttagtaatccctaatttctgcctttttcctgtgcttaatctgtttattttttcggttaatagttttgatcgggcacctcctcttggctgatcagactcagcccactgctgccggcactcgtcgcgccatgtccaaccaacaacgcatgcgcatcagtctgtgttgctttcgctgacgccgtcgtgctgtcattctgatatggaaaaataattttaaatattttaaaatcattttaaataaattttttaatacaaatggccagcatttttacgaaaatttattgtttttaataagtgaccattattggcatttagtaaaagtgccaattttaattattttccgnagaaaaactttcggaaatgtaa

SEQ ID NO: 12989 - DNA, 2723 bp, Heterodera glycines
gcatatgaatgcgtttatcgttatgtgaaaaaacaattttgtccccatttttggtctttccattggaattgatgaccactggtcattggtcaccaatgcatcctatggctgctcaattgtaaagtgtattactttttacagattgttgccaaagaagcggagcagaatgacgacgaccaaccttcgcccatcacggtcggttgttctcattgaaattgggtaatccgtccgaccccatatgaatgcgttattaacaatcgtttatgagaaaaaaaattgtccacattttgctctccattggattgattttttccgttgttcgatttgccctcttccaacccgcgaaaggggaggagagacccacccattcaccatctctgctgctatagccaccatttacccaaaccaaagctaaaattattcccattttcgtatatttgttaccctgaagccatggactgtcccaaaaaagttaaacttccccctgaactcctttcggagttggccaattgccttcattacaattttcgctggtatggcatccgaatttctttgtcctttgaccattttctcgccaaaaatcaaaataaaattcgtcacaataaaattaaggtaatgagttggtcctctgcattaaataattggaaatgagaacaaggaaagcccattacagagctaattagacattgggtactattttttaacttaagcattttctcttgggtcctttttcaaatccgtttatgttttttccaatgcctttattaattaattacaattatactcccaattaattgctcttgcagaaagctgatgaagaaattcgagttcttgaaaaagttattgccgatgcgcaaaaagttattgccgatgcgactgctcgtctcgaatattggaaggagcaccgttctaccatggtctcctttttttacatttttcatttctatccaagtgactaatttattccaaacacagcatacgatgactatgccggtcttgccgcagcaaagcgaaagtacgagtcaacagcccgtcagttcggtactgtaacttcaaaaattgtaaaatttaatgttttttttttgaaaaattttcaaagttgcaaaaatttttttttttgcttggcggggaaaccatgcggggaactgagcccgggggggggggaatagctgctcccgattttacattggcccttggtcagttcagagccgcctactttggctttcttttcttatttttttgtcaaaattttaggtaattttgtagtttgtccccccccccccttttttgaaaatttttttttgccttaaaaacatgtttcatcaattaaattcatataacaaatttttatttagccgcccattgatcctccgattttggagaaagaagaaaacggaggggagccagccgcaaaaagaacgaaagaataagaagaatgaaggaacaaaagggaaagaaaagggcacggcaaaatttgacagaaaatccattgccataatgtttttttggattgtttaaataaagcgtaaattaaatgattttaaaataaaatttgttgatgtaattttctcgcattttcttgagtctgaagtataacaccaggcaaggcattccgagctccaaaaattttcaaaattctgaatttcgtgccatccctggtatgcaccagccatttggtccagtggtagggaaagggacaaatgggcgaaagtttccttttattttgggtacaataattggagaaagaaatggattcatttgccataacttttttctgagtgcaaattgacaaggaataattattgcataattggcgactctttgtggaaaatgcgcaagtgatacggtatttccaaaatgtaagtatactgtagttggtataccgtaggtagttttgtttcctctccatccaagtcacacaaaaattcagatcaccaaaactgactgcccatccctattttgtaccgtataccattttttccattagcaccatacataattttatcattttttgcactgcctttgcaccgagcgaaccggaggaaattcaaattcagagcgtgaatttctgaatatctggcaatcatgtcgatcattggtccgaaaatttttttctgtaaattctaataacatgtttataggggtgttttgaggcgctgagcacgaacccggcctccatttcgaccattcagaaaaaaattaagaaaaaatttcgagacaaatgatcgacatgattgccaaactcttttccatatgccgtaattgtgccgttaatttcggcgggtgcgaatttaacttcggggaccttttttccaatttttctgcgttcgacaccctttcctctcacgttcaatgaattctgctgaaggattcgtttcaaattctcgactattcccgagtccgtccttatctgatcaatgatcagttggtctctgtttgggactcaattggctgtccctcttacccccaagtggcacttttgatcagatcattgatacttaattgcaatttgttcattttccagttggacttgcgcatgccgatgctgcactttctgcacaatgcggtgcccgccctgtttctgctcgtccgacttgcgctgtcgcccgaccggcgtccgctggtgccgcgactgctctgtgccattgtgcgcgcaccgctccgctcgctgctgtggcggcccgtcgcagcacaactgttggtcagcgcgttgtccgcccgcg

SEQ ID NO: 12990 - DNA, 2236 bp, Heterodera glycines
aaaattttcttttcgctttgaattttaataattgctctttcttggattaaatttttgagatatatgactgactagttggagaaaatatttgaaaatttaatttgttttcaaggtaagattttaatttttaaattggtttttgtgtaattcataactaaaactcaatctattttttaaaaagcctttgtttttcctcaaattgatctacccataatcaacctcaggcaaaaatttcaattttatttttttaaattaaagcacaaaaccccaaaaaagccccctccccctcattagattagccagttgaagctgatgggggaggtgatgagtaagtaatttgtggaggagtgagggggaggggtcgagaattgatgatgggaggggtggaggcacaaggattcttaaacgagtcgagaattgagtgcctgttttgcctagtggttgccgtttgtgagtgtgcgagtgtgcgcgctgtgccaaaactgggagggtggggtggaggcataagtgtcgtggtgcccctgagggcggaagggaagggcactttcttcacttcgcgtcacgacggcactgttttgcctgaggggcgggcaaaaatggggagaatttgtggcggggtgggagagaggcgccgtcggggatggcataattgaattggggcgaagaaagtgaacggaagcggggggggggggggggagggccggccgaaaatgcaaaacttcctcaactgtgaggatggaaaaaaggggatgagttaaataaaatgatgaataaaatagcaaaatgtgtgatgaaacaaatttaacacgctaaaatgaggaattttagttatgaaaaattgttaaaaatagattcaaattcattttaaattttttaggggttcggttgtttattatttataaaaatgtattaaaaaaaattaaaaataaaattatatatttttacaaaaaagaagtaaattgtatttcagcaggtgatcagtttattatgtttgacaaaaatataataaagaaaataataatttgattaaaaaaaataaaattgtaattttttatttttccaaaaagttcaatttcattcatataaaattttatattcattaaaagtatgtcccaattcaacctaaaaattttcaggggatcaattttttatcctaggcaaaaatatagttgaaaaacttaaaattttacccatttaaaagttttctttttattgttttaaataaacaattttcatttttcaacgtgtaaatattaatttattaattaaattaatattttttatttaaataaatttctattaaaaataaatttgaagaaactgtgacaaagatggaataatgatggagctaaaccgcacaattaacgacgaaacgatatggcataaaaaatttggattggttgagctaaaagtgcgctgcgcacttataaattttaaaatgagacggcggcgtttgaaaatgaaatgaatggggacggaggaaagccgaaaagccgcgcgggaacaaaaaaaatctctaagtaaaaaattaaataacggagaataattttatataaattattaattgatatgacaacgaattagttaataaattaaattaaattgggcaattaattagcgtccaattaatagaaaattaccgaaggttcttaattaactaatattacattttctattatttgttatgctatccaaaatagaaaggctctaatgtatatttttgaaatcttgaccacagaattaatttgttttttaaaatctcccactatttttaaattaaaatggctcttaatttcataactgtttaccgaaaaactcaaaaggaataccaagctgctttatttgtccgataaaaggtgcataattcataaattattttacaaacttatgtgcataatcactttcatttgaaacccaaaacctaaaaatccaagttctaaaaattattctcatagcaaatccaaaatagtgataacctagctacgattatggcactagaattattatttacgagctaaaaatatttttcatacatttcctagtgaaaaagccacataaaagggttaaaaaaaaactaaaaagcccatcctcactaatgaccctcatcagtgtccattaaacaaatggagcgattaatttggggcgctgacaaatcattaaattatacaataatgggacaacaatagacgaaacttaggggatgatggtggtggaaatgtaataaaatttttggtcg

SEQ ID NO: 12991 - DNA, 2633 bp, Heterodera glycines
taattttttttaaatttatatgctctaggaagagggaacacaattatttagcgaatccacaccaaaaatcaatggcatttggtcaaataaaatgaccaatggaacgcatgcctcccttacgcttactccgtttctttcaatttttccgtctctctcactcctttttttctcacttacactctctctctcctctctctaatcccattctctcacgcacagacacacacacacacacacacgcgggtcaccgctgtctgccatagcctataacacagcacaccattaccccccccccccccctaaataaactgataattctgatcgtcaaatttacatttttcaataacgacaagtggcgacttgtcgttattgaaaaatgtaaatttgacgatcagaattatcagtttatttaggggggggggggggggtaatggtgtgctgtgttataggctatggcagacagcggtgacccgcgtgtgtgtgtgtgtgtgtgtctgtgcgtgagagaatgggattagagagaggagagagagagtgtaagtgagaaaaaaaggagtgagagagacggaaaaattgaaaggaacggagtaagcgtaagggaggtatgcgttccattggtcattttattgaccaaatgccattgatttttggtgtggattcgctaaataattgtgtcccctcttcctagagcaaataaatttaaaaataattaatttcattaaatgtttctaaattaatgttttcctccccaattttcagtatttgtgaaaaacaaatgtcacggaagcgtaagacggcagcggaggaacagcgaaacaaacggaaaaagcggagcgaccggaaaaaggaaaacggcaaagaaatggtgggtttgaatttcgggaatgagaaggggaatgggactttttttaaaacaaaatttggggtagtttaatgcttcccattttttaaatttgtaatactggggcgccgcaaaaaaaaaaaagtttttctggcatacatttcttaaatctttacagctttattgccgtcatccaccgagggccatcctcgaaaagcaccaacggcgagagcagcagcagaatgccgtcaacgaccagcaacaacaacaaaatgagcagcagcagcaaaatggacacaatgagcaacagtttgacgagcaacaacacgaacagaatgatggcgatgagcagcagcagcaaaatcagaacgacggaggagagcagcagcacgcagaacagcaccagcccaacaacaacaacaacaactcgctcatttttgaggaggaggaggaggaagaaatgacaaatgccgacgaggaggaacagcaaagcggaattgaggccgatgagtcgacgcacgagcaacaacaaccagaagaggaggaggacggcaatgaaggcgaacaccatcaacacgggaatgatcaacagcagagggaggaagaagtgagagaggggcagtatgagctcgaccgagcatacgcgtgctacacgcacagcaacggccaacgagcgttctacgtgaagtggacccgtaagtaaaaattgattggattaaaaaaaattggaattgttaggaggggagcaaattggctagacgataaaagatatccccccgtccccactaattttaatggtcaaaattttggaaaatttacttgtgagggtgactaagggatgccgcccgaggctccaaattataaatggatttaattacacccgtatttgtcggaaacagcgagcggttgagttcagcttgctgaacttcacgcctaattgtgactggtgaatatcccccgcccattattcgcccctcccgggggtaacggtcgagtttactggtgacggcggtcgcttgcagaacttcccgtcccctgggaggggcgaattgtctcatccccttttcgtttactttaggggaaacggttgagtttaggcatgcgacggcggtctcatgctggaacttcccgtccccctttggtaaacgaaacccgaaaaatttctaaattgtaatgttcttggacggcatccctttatagtccttgcttccatgaagagggcttaggcacaaaaaaaaatgttcttgataggttggcggaatcgcgaatggatattgtcagttgattcatcagcaggcgagctcactaatcaatttatgttgacgtccgggagtgatgcgactttggatgcgttaggaggccaatcaattgcgggcacacatgcagattggctaaacaaaaatccaaaatttcagaaatgtaaaaaaaaacttttacatttgaaaaaaaaaatttttttgtttaagtggcgcacaaatggaacactggtgcggcaaaagcatcagaacacgacattctatgggcggcggacacggacaagaggacacgacagacggtatccaattttgtgttgcttttcataataataataacaaacaacaattcccagaattatagcaaacaacaattttcaggcggagaaacaattacgtgcattcatcgacaaatgtatgtaaggaagcgaggaggttgaagaaacggcattgaattaacatattttacatttaaaaatcaaaacatttctcacaactataacaattttcataacacatttcacactcttttctcattt

SEQ ID NO: 12992 - DNA, 2675 bp, Heterodera glycines
  misc_feature (2653)..(2653): n is a, c, g, or t
ataacaaaaaatgaaaaatgaaaacgaaaaaattaccggttctccaaggaaatactacaaaattaaaatttatggaaatttttttaataagacaaaatcaaaaaacgaaaaaatgtagtctttgttctggacagttcttcaacaaaatatataccaatcggggtaaatttagaaaaaaaactcaaattttagaatagaaatgccaaaaaaaaattaattacaaaccgatttagggaattggacaaatttttgaaaattttggttcatttgattattgtaatatttaacattgtaatttttattttgcttctggcttttcgaatcccattttctttacaattaaataatatttagtcattagaacataactttgaaacagcgtgctgcatagcaaatttcatatccatcaaagcaataaattttaattgtttggccatatcctttcgcatcgagccagccaccaacgcatccttgccctattatttttaatgtaaaaaacattaaatagccaaattacagaccatggtttactgtaaaaagagaaattacccaaaaataattcaattcatttgaaaacatttattaatactaatttgcctaattagaaaggaaataagagtcagaaatcattataaaggaccaaaatttataaaattactgaagaataggaaaaataaataaacgcaaaagaactgaggatggccattaattgatgcataaactggggaaatagagcgcattaagagctcatttgtcagaaaatgatatcccccctccctccttttaatagagaggccctattaaagattattagcgagcacacatggcatgccaattaattatcaacactcactttttttggtgattggaggaggagtgttcagcgcatttgcccagtcgacacccttgttacccaatgaacaatcgcaggtaacattctcagatctggtcgttttttgcgtccgagcccgttcattatcacattcattctccatttcggatttggcacaaccccaataatgaaaagtgtttccaggctgatcccctaaaaaatggacagcaaaatgatcagaccaaatgtttcttgttgattaaataatttgaaaaaaagttcgacttcagtaccaaaatccatccctcttttcatcattcattttccctattttgcactactcaagtcattttttgcatgagaaaatggttaactttttggtatttttcaataaatttttcaaaatgattcagtagtccatgcaaaaaaaaaaaataccggaaaatttgaattttaaaattctaaaaaaaaaatctggttaatgcataataaatccattgacatgctgtgcaggtgacagtgtaacagtgctgaaaaccagctttgcatacaccctttttgttgcggtacacggcaccagacaattcttcggcaaatccttttttgcagaacaatgctttattaaaaaattcatttttttattttattaaaaaaacgattaccaaatgaacgtggcaaaagccagcagatggtagtgccaaaaattataagtgcaatttttgtgttcattttggtttgtaaattagttgagctgctgtaataaataagttagcttgaaaaacgattaataattttgataaacaaatttaatgcttcaaactcgcacttaaaatttttttttgcaagaaattctctcaaagaaatttttttttagaattttttaagaaaacaatctcaaagaaagttaataaagtaaaaatttttttataaatttaaatttctaggaataatcgtttgtcgagagaatttaattggtttcaaatttatttgaattaatggcacaaatagattataatctaaaatcacattaatgcattttttgttttggaattattttccaatgcaaaaaatgattgtgaattgatgattggacttgttaatttgtacgtccatcagtgaatattattcaattggttctgatgcttttctatccaatgtttaatggaaaataatgatgaatcatgatataggactttgattagaaaattaacatcaaaacaaaactcgcactatataattttttgggagaaaaaaaataacctcaaagaaagttagaaaaataaaaagatttctggaaacgggggggggggggcaaactgcttccccgtggacacttcgacagtgaggacaccgacaatgaggacaatccggcagatgtggacgatcggacagtgaggccaataggacaaaaattaacaatccgatagtgaggccaataggacaaaaatgtctgctgtgatttataattgctaaaaatctccacaaaatgccaacgaattctgtttagtttggccaaagattttttttcagtattgaaatgacttttttgtagagcaatagtaaacacataaagatttcggcgctactttaaaagctttagattttgaaattttttcacttttttggtcttatttgggatcccggcaccgaacttgaacaaaaagtcgactaaattcgaacttcgacttttgttagaatttgggttcggggtttggaataggcccaaataattgtcatattcatgttcagcgacctcgaaaacacccggttacggctctaatgcactttatgagtccaatcgacattgtatgagtccaaaangtattttatgagtcccaatcaa

SEQ ID NO: 12993 - DNA, 944 bp, Heterodera glycines
tcatattattacattaattagactttgtgctttggaatgataccaaaaagataggtttagctcaacccgaacaaagtttattgtataaaaacccggggattttgtcactgattggactcataaagtgcattagagccccggttacttggctttaggactttttaaaccgaaaaaaaaatttgaaaaaaaattagaccaaaaaagtgcaaaaatttttcaaaatgtaccgcttttaaagtagcgccaagatttcgatgttttggtgtgcataatgtgtgcggtgcgattagccccattccaccagccgaaatggaaaatttaatattttatgattaaaaaatatatttaattaacactttaaatatttcgttctcattgtcaggcacttacagaaatattaattacaaaactgatggtaccccaaaacgcatgagatataccatataagtcagaataagcataccaaagaaaaaaaatttatattttcaaatgattttgaaccgtttatgtatgtaccttcaactcgccatttttgattgtcaattaataatctttgttttcagttaagaacatagagtgataaaaaaagcagcatttttaattgtctctctccgaaatatttaataaacattaaggattaatcaattttaaaaaattttatgggtaagttaagatgtttttttgtgaaaaatgaaggtctttttgtttttaacttaaacaagaaattggcaagatttcaattcctttcccgcagtcccgctttttttgaatccccgttttcctttcctaaaaatttttctcagcctaactataccgtatattctctaattaaggccctgtctccattaaaggctctgtctccaattatgtccccctttctgaggatgttgaaaaataatcccccatctctatttatccccccgggggataaatagaattattat

SEQ ID NO: 12994 - DNA, 2120 bp, Heterodera glycines
tgaaccctaaaaattcaaaaagaatgaatttttacgtcacaaattataatttacttgcctttcggcgccgccaaaccaggacaatctttttaattttgttttaaaagggcttctaaaagggtgagattactgaaaattaatgaaaaatttttgaaaattctaccacagctctgaatctgccattttcccccctatttttctatcttcctcccgcggctcatattttgggatttttcagctcaaaaaatcatgcaaagctttttattctgatcataagttactcttaaccaatttttagattggatttttttttaaataaaatttttacaattaaatttttttttttgcaaattacggattacgccaaattacggcctttttggacctccgcaatgacggattacggatggccgtaattgaaaaaacgccgtaattacggatttccgtaattgaaaatcagttacgtccagccctgatccctgctgtataccgtatttcctaaaacaaaagccgtcccctgaaatagaagcccacttcgagggggttgaaaaatagaagctctagggcttattttaggaaataatgtgtgtaaaaagatttgctttttattttatttacgaaaatatgttttcagctgctaaccaggaattagctgcacaatttttcgctgaaaatgttaagccacggttcaaatttgctggagaagacgaagaaatcgctgtgaatttatttgacctgaccagaagtctgattgggatttggaagttttattttaactcaaaagaaggcaaaaaatataaatggaaactgagcaatttatttaagtactcatttgaaccaattttgctaaatgagaatgaatttaagaagaatgaagagggaatggacggaagaaacaaaacagcagcggaaagctcatcacagtcattagcagctaatgagcaaacgggcaacgcggacaatgatctgctgaaattaatggaagacaaatttaagaatttggtgaaaaaaatggcaaaaattgcacaaaaaatgaacaaaacatggcgcacttccatttatttttagccgtattaaacacaacaatttatcatggcacggattttatcgaccccatcgaaaagagaaaaaaatatttttcaatttttttatgttgttgtatgtttttttcccgtgtattttgaggaaacagagaatttgttggtattttgaaactgcaaactctaacattaaactgaaaaaatttgaggacacttcggccaaatgagcctgacaaaattagtgacggtcgtaactctaatgggttaattaataatccaatcctatttaggatctttgactcgacttttcagttgcctatcatgtttcgcaccaatttccttcctttttattcaactcataacaatattgccatgacggactattaaattgggttgtaagtaatcacaatcaccgcaggaggagtcgaacttataacttcctttaaagcgactttttccgctgctttcctgtccaatagaatttcaatcctttttcctgtgtcatgccatgccgttatgcaggagaagcaggacaaaatgtacattgtttcatggccaaacttgtcttatttatgcttaagatcgagaatttcaaatatccaaaacttttttttttactgccgtctgaggtgtcaagatttccatggaaatgttccgatcaaccttttgcataatttcctttttattcgcatcaacaattatacatagtagcaggttttttgatttttcttggtgacataaaattacgatttattattttgaaaaaataaacaataagtgtcctaatttgtaagccaaaaagtgactttacagtgccgtgccctcaccggaagcaacatgagaagcaaaaaaagagaccgattaagaaaaaaacggcaaatccgacaatgcccaaaaccatcacaatggcaacccattcgtgggcacccaaatgggtgaaagcgccgaaggcaacggcacccaaaattagtgcgctggtcatggcagtgacgcattggccggaattgtcaccgccacgcttctttcttctcccgttcttgatggcatttttaggctggacaataatttcatgtggaaaat

SEQ ID NO: 12995 - DNA, 1814 bp, Heterodera glycines
aattatattaaaatttgccaattgtgtataaaatgaccaatatgttttcggcatttctttgttttgtcatcgaggaacgaaatttttttcaagtttttgatggttttaattttatcaaaaccttgaattgattcctccataaatttctttaaataattaatatattcctctggttgttccgtatttttaccctcttccaattttttgcagaaatttttgagaattttttgaaaactttcatcaaattttatggccaaattttcacagcacaaaatgccaaaaatgggtttttgatgccattcaccaatgctaaattcaccatcaaattttttgtttttcattcctttaaataaaatttctgctgaatttaacattgccattccgtttttgaacagatctaaagaatagggcttcgttatcaatttcattgaaaaatcataattttggtttattcttaaaagttaaattaagtattcttttttttaattaaaaaataataattcttatttgtttctggtattttcgcttattgtataaaacactatccaatcgattttttaaaattatttttgatatggaaaaaactttaacttgaagctgtattctttttttctattacctcgttggcattttggcatctctggcacttcttcatgactcaatattaataaaagcgtaaatacaaaagatatttgtttgcaaagtttttgaattaaaataaaacatgttatattaattatttcaattttaagaaagataatttgataaaagaatttatattacggctatttaattatataatatagccaactcatgagcatatgaatatttttttccgttatttgccaacaaaatcaccaagaattaatttccgactgttattctaaaatgtctcttcctttttttatgaatttttatatttttaatgttataatttttaattgaaataaaaaaatttttttttttcaaaaatatggaaattttccgaatagagggataaattttcaaaaatttcttcaatcattaaattatagtaaaatacatctaaaatggctgaatacgctataataacttgttttagaaggaaaaaaagcattttttagagaaacccgagcaaaaatctgaaaatttccatttttttgtttttttatttttgaattaaatttaccaatttttaagaaaattgaaaatttaaacaaaatctcgagaagattttgcgaaaaaatgattttttttgaaaaattttccggtctctaggaccaaaacggccaatttagctgatgggggccgttctaataggtttttttggaaaatgccaaaatatggaaataaaatatggactaaaatgcaaaaatatagaaacatgggcataaatcgcgaaatatggaaaaatatggaaaatatttatatagaaatccttcctagaagcttcaaaccaagctaaaaacatgttttttgtgcgtttcaggcctcccacagtccaggaaaaaaatatggatttccatataatcccgagctctaataatgaaagagcgtacttaaaaattaagcataaaaaataaaaataatgattggaatttgattaaaattgtaaggaaataaaagtgatgtaaataaaacgaggaaaaaaattacagaatatctataaacttagacttttagttagtttgcaggaaccgcccacttcgggtccgccactttggcgtaatccattttggtgcccattatgaatggcttttttgggtacacatatacaattgtaagcactacaaaaataaatttaatatcaatcggttcctctaggatccgaattt

SEQ ID NO: 12996 - DNA, 734 bp, Heterodera glycines
  misc_feature (719)..(719): n is a, c, g, or t
gcatcggcggcatcgccagctcgaagtccaacgacatggtttcaggtgcaaaattcggccatctttggacaatcagttgaagcatccttgtgtatatcacttcacactttgaagtgagaatgcagtacgtaatcggaaaatccaacacttcgcttaaaaatacaaaaaaaatatatgaaaaattaggcttttactttgcaagaagaacacaaatttggctgaacaacggtggggccaaactgaaagtgccatcagcgtacacatttttcataatcccagtccattgcgaagtcgaagagcgagctaacaccaaaagcattaatatagaattatgaaattttattattttcatttcacctttgaggtcagcttccaaacagagtgatgcagcaggtggtacactttcgtcatggcaaacacgttttataacctaaaataaatgaacaaatcaaaccttggcataaaaattcgcaaaaattgacctttttttgccgcagatttggtcggaaaagcagttaacattgaggttgctgtcgtcactgagttggtaaaaaactaaagtgcacactcatgttccagcttctgcttgtttcactttgttttaatttcctgattggaattgtctatttgtatttgtagtaacaaaaaaagttttttattaaaagtaattaatttatgggtgaaaacagctaaccagactaaaacgaccccctgactanaacggtcagactaaa

SEQ ID NO: 12997 - DNA, 4023 bp, Heterodera glycines
  misc_feature (3985)..(3985): n is a, c, g, or t
ttttcaactttatctgcgccgatggtgggttttggtgttggatttccttgcgcctttttcaacttggcttggaaattgcattatcaaccgtcgatttgctttttacgttgatgaacacttcaagacacgcaaaaggatgttgggcaaaatgggaatttgccacaaaattggagagaatggcaccaagaaaatgcaaattgacgatgccgatggaaatccattgccaatcccgcgaaatccgttgccgaacaaagtcatcggattcagacgcattcagatcaagtaaaaactgattagatagaaatttttcataatttatctgcacttttcagttacatcgatcaaaatgtcatcgaatttctccaccgttttcaccgtcttttccccatttgttcaaccactatgaacattaccactgaaaatgtgcgcattttggactactttttgctccatatttggccaatgttctgcgattccatgcatctgatgcttttgaacaccatcctttttcgccgcttccgtcaattggccccgtcatcactcagcgattgtccatcccttcgcgttgtgtggttggatgacggcactttccccgaatttccgcccgatgacagtgccatggcgtcggatggccaagcggtgaccaaatgggtgttgacgccccgtccggatggtcagcccaagttgctcaaatcacctgttaattcaccggatcaatggtcgtcaacgatggaacagttcaaagcggtcggtgattatcacggggcattttattcgttttttgcgcttttttgtcccatttttaggaattttccaatgcttcttctccggtttccttttcaattaactttctgccgtcttctccgcttgactccgctgtgccattcgatctgatcaaccaagcgactggggagcaattgacactggaacaatatgcaaatggtttttggctcagccgttgcccaattggatgggatgagatgaaatgggacaatgtgtggaaggaattgattgatgctcgaacgaacccaattgacattgtgatcaaagatggtggatacgacgacgggtgaacaaaacaattttaaaatgatcagtgcttttatgagtctaatcgacaattgagcaatgttttttcttcagttttctcgacgccgcttcgcccgggccaagtgatcactgatcagcaacagaaatgaatgaattaattgatggttaattgatgcgattatgttaccgaaatgatgtgggcactttgccatttcaatattgtattatgtccaatttgtctgtctgtatttgacctttgcttgctcgcaaatgcgtccatttccatggtattttatttatatgtgataattcatggtgattaatcgtggataaaatggcaaaatcccaccccaataaagcaatgctttgccacaccaaattcttgttgaccttaggccaagtgatggcaggatatgcccaattaaatttaaaaaaaacccatacttttgcgtagagttgagcggtaatcggtaattgtaaaaaaaccggtaccggtactgaccggtaatgcaaaaaccggtaccggtaccaactttttccaccggtaccggtaccggtaaaaaccggtaattttccaacgtaaaaatttttggacaaaatttttcaaatacaaaatttttattcagttttcgcgcgagtgcctgttttttagcattagaattgttcagaagtatatgtatattgagggtgaccaagtttttttttcaaattcaggataaagaacactaaaattcagatgtagacctcaaaattcagattattgcaaaacaagggatcagcggccaattttccaattttgcgaaggggtctccggccatgtaaattaatgtaaatcaatgaccttttttgctttcaacaccgcttttttcgcggcacgtttttctcaagacttttggggaacaaggagggccggcggtgccgataggcgccgccgggaaaaattttgtattttttaatgcgatttgttaacagaatttgtaaaaaaagaccaattgattaatttttgggtttttaggatgcttaaaatgaaagaaaaaaagttggaatattttttttaattaaaatttcaattaaaataatggtaaagaaaatatgaagaatattctatcccagtggggaattgaacccaagcgagaaataataaaatcagaaggtttagccacttgaccacttatgcatatgaacaaatgctttaaatgaaaataaataatttaattttttttttctcaaaaaatttctccttcttcaccattccctactcttttctcacccagacccccattcttaccagtgcaaatttttaccggcggtaccggtactagacaaaccggtaccgatactttgatttttgaaaaaaccggtaccggtaccagtaccaaaaaaaccggtaattaccggtcggtaccggtaccggtaccggtaccgctgaaccctacgtacaaggcaaatacaatagtaaaatattaaataatttttgtataattgaacacatgcaacttttagagtattaaattttaaaattgtaaatgaattcctatttttggttttttggtaataataaataggggtgaaaaatacatccctatgaatggaaaatttgctcaaaaacttatgccaaaatttattatttttttaaataaattttatttttattttaggcgacaattcaaataaatttttattaaaaattataaactttaaataatttttaaattttcaatatcaatcatgaaataaaattttaaatcattagagtaaaattaagttcataggatggcccctaaattgccgaaaaaacaatatgaatgatggatgataaatttgaacgttgcttttagacaattaataattcaaaaaatcattatcatataaatttgattttgtgctcataaccccaggtggagataattaaaaaaaaacttttttgacaataaataatctcattaaaaataatcgattaaaaatgaaaaaagaaattaagcagtccaaataattgtaaaagaaatgcatattataatgttaatgaataataaaataattaacttacaaaattttgtagcaaaagaagaaaaaaccaaaaataggttgaattttctgagaaaattgaaagtgaggccaagaaaaaggcaagtaagcttcgttatgagcaaagcgggagtcgtgaaaggcaagcaacgtgaaaattatgaaaaatttgcttataacacattcaagattaaaaataataataaacaaactttaattatttaaataatacatatctcttttagctaaagaaatattatatatatatatatttttaacatgacatttctaaaacgatttatcagaacgaactcatatgaagcaaacaattaaaaataaataaataattcaattagcacttctccatttttagcaaaaatataaaattaatagctgctgcacaaattcgcgaaaaattataattaggacaaaaacaaataatttttataaaattgcaattttaaataatttcagaaaaatatgcgcaaaatttaactcatatacacacatgaaaatgagcaaaatcgctcaagtcagcaatcaccatcaaacggatctttttggttcttgccctttgggtatgccaattttatttttattatagtatgaaatacaatgaatattaatattcgggagggatgatgttatatttctctttacttgataccgatttttgactcagacctttttataaattcttgatttatttttacattattaacatcgcctcaaaatcatttcgtaatggtctaaatatttttttgaataaaaaaacacgaaattaatcggtaaacagacgacgttcgaattgcccgaaccgtgtaggggatcaactcttctttaatcatttaatgaccagcatctcactttgaccagtgtaaaaataaaatatgatacctttgaaagccanaaaaaaaagtttatttagttttgcagtctccattccat

SEQ ID NO: 12998 - DNA, 2240 bp, Heterodera glycines
  misc_feature (26)..(26): n is a, c, g, or t
  misc_feature (1137)..(1137): n is a, c, g, or t
agaattcgaaccgttactgcacgatntagtcccagagctacgcccgttgcaccgcctgaaaaatgggaaacgtttttttaaaaaaaacaggcctagaaaattttttttcccaccggtggccatcacatacgcctgcaacagttgcgagttgctcaacgcatcgcccgaacggttggagtagttagtaattgcgttgaaagtctgaaaaaatcatgtaaaaaagaaattttctgaatttttttttatctacctggttgacgaattgccagccaaaaactgcaggggttgacctgaaattttaaaacagaattttttacaatgcttgtaaatgaatgaaacgcgtgatactgacttgtagaaagtgagcataccgccaaggctgaaaaaattttccaagaatttcgttggggggatttaacgcacattaatgtgacgaccggcactcgtgcactcattcgtcctaacagaagcaccttttcaccagtgtctggatggaatgccgagtcgtacaaatgtttggcacgccacagctcatcgacggacaaattgtcggagtaattgcctgtcctggaaaaaaatgggggaaaattagtggaattaatgccattttagtgaatatggcttaaaacatagaatttcatggcgtaatgatggctaacagagatgaatcaaaaatccataagcgatttttcagtattttcaacaaaaatttttgagaggattctgaaaactatggaattcaggttattaaaatcacaaaactaaatgaaaaatcaaaaggattttgcttttggcactttgctttttagggcccccgaaaaaattgaaaagggcggaccttttatagagatttggaattggttgaatagatgtcagattcattattagcgacccgaaaactatagatatttacataatattagtgctgctcgagagtctcgctctcaagaaaagtctcgggtttttggttgaccgccatcctcattttaatgtatggtttttcaatgttcttcgatgttaatcttggccgacatacaatcattttttccgattgtgtattgtataaacaagaattttgcatttaatttaaaaaaatatgcatttttaaaatttaatttcgtgaactaataaatttantttgatatttaggaaaatactaatgagcaggaaaaaaaatattttattaatgggtggaattattagaaattaaaatttttttattaaccaatgttgggatgaatttttaaaataatttttattgaatcatccaaattaaaaaaaaaaaattccggactgactcctgagtcgaaatttgtcgatttttttattgagtctcggtttcgttctcgagtctcggcgtcaatacccggcttcggtatcggttctcgactatcggaaaatttcgactctcggtcagcccaaacatttactgtacagtacttgtttgtgttggacacagtatttcttggcacgaatgtcttcggtcaaatcaaggcgcataaatgtgtaatttgtactcctcaaatagcactccaacgagctttgagccaccccataataactgataattttaaataatatatcttttttttttaatttgcattaattataatttttaagcattttattgaaaagctaggtaaattttgtaaaaaaaaaaattcgccaaacggaggacaaatccggaaatattatatatatataatttcttaaaaaaagaaaatttttcatggtaataaatttttatcagtttttgagccaccctttaataactgaattttttaaaaatatttttatatttgcattatataattttttaagctattgaaatgaaaaacttggcccaaaaacatcaatgttttcgcctttagtcatacaaatttgcttaaaaaatatttttctttaacttaatgaataaaaaaaagtcaaattttctttaaacattttttttaaaataattattttcttgcgcagcatttttatgcataaaattgggtaaatttttgagaaaaaaaaattcgtaaaacagtggtagacaaacccggaactatatatagaaatttattttattttcacccactttttcaatgttttgttcatattttgaacaaaaaacagcaccataatgcgtccaaaattgggtggacatttgcccatgttttccctctttaaatatggcgtttttggcccaattgtcatggcatttggcaaagtgtacaacaattttttgttttgaattt

SEQ ID NO: 12999 - DNA, 3412 bp, Heterodera glycines
taggtaaattttgtaaaaaaaaaaaaattcgccaaacagaggacaaatccggaaatattatatatatatataatttcttaaaaaaagaaaatttttcatggtaataaatttttatcagtttttgagccaccctttaataactgaatttttttttaatatttttatatttgcattatataattttttaaactattgaaatgaaaaacttggcccaaaaacatcaatgttttcgactttagtcatacaaatttgtaaaaaatatttttctttaagttaatgaataaaaaaaagtcaaattttctgtaaacatttttttttaaataattattttcttgcgcagcatttttatgcataaaattgggtaaatttttgagaaaaaaaaattcgtaaaacggtggtggacaaacccggaactatatatagaattttattttattttcacccacttttccaatgttttgttcatattttgaacaaaaaccagcaccataatgcgtccaaaattgggtggacatttgcccatgttttccctctttaaatatggcgtttttggcccaattgtcatggcatttggcaaagtgtacaacaattttttgtttgaatttttgttttcttcaaccgacgaaattcgcaacggacgatattggtggaacagtgtaattaagcacaaaattgttgaaaatgatccaatgatagccaaataaacaaatgttggcttcatttttctcatcattttcatgtcagtgcgcttaaatttaaaaaaatgttattaatatgtctggatatgtaaataaaatttttttaaattatcttttttggacaaaatttattagaaaagggtgaataaggaataaaatattataaaaaggaacaaaacagcttaaaataacaatttatttatttaaaaaattattttgagactgatttttaggaggattatttttcaaaaaaattcttttgaatttttgttcaagaatttataattaatctcaaaatctcaaaatatattaaaaaaaaatgaaaatatatttgaaaaaattttgattttttggacatttcaaaaaatttccttaaaaaagcctttaaaaaaatagcgaatatatacgggaaaaaacgcaaaaagaattcaaaatacaaaatatatataaaaaatccggttgattttaaaaaagtcttaaaaggtttgacttgagaaaaatcttatccaaccgattcaagaatttttttctcgacacttttgaaagttggtaaaaatttgttgaaataaaaattaaatacaaaaaattgtagaataaatgtgagatttgcgcgaaagctctctgctacacatttcagagatggcgtcgatttcgctgattgttttaaagtacaaaacaatgacagaaaagtgggttaattgcggaagaatttattttcatatgtttttttctttatcagctgaattatctaatggaagaaattgtgtcaaattttttaaatttacgattaaaattaaacaattttaattgttacattcatgaatttaatactcacaaattagtaatttaataggattataagttgttttaaagctgtttaggcgatcagggattgaaaaaacttaagtttgaggcccgattttggacaaaggcatgaatgtcggcgaactcttaaggtctcaggaatataaaatgctagaaaagagcaaatagtgacatttagaaaattacaatgagaaaacacgaaatacagcttttttcgagtaagtctattgcgttagtccagaatttagttagtcaaaaattcagtagattttaaagcttttgtttgctaccaaaatattggcattgacgtaagtaagtaaaaaaaaatatggcttaagaaactaaggatggtctccattaattggacgcgcagtaagtgattggacgcctgacttttggttcacaaaatttgtttttgaaaatcaaaaaggtccatcgataccgttttgactaattgcaattttccgcactttcgtcgcatcaccgggatgttgacacaatttgcaaatgcaacggtggcgaacggcatcaggctaacccaaattggtggcattttctgcaacaacaaaaaaaatgcttaaaatagaaaaattattggtaaagtacagaattcgaactaggtaattactagtgaagcaacttttagtgacgaaaaatcccaaaatagttaactaaaatagtgagtaaaaatgccaaaatagtgaagaaatagtggcaaaaattccgaaatagtgacgaatagtgagtgacatattttcagccaaaaattaagcaaaacgaactcttttcaattgcggctaattgctttcggactgcatcgatagaaattctctaaaaaattaaaaataattttgacaaatctgaggccaactcggctccagggacaaataggcttttaggaccgacaactcacaatgggaaaaaatcaaaaattctactttaaaaaaaataataaattgggactctcaatatggaaaatggtcaaaaatttaaaaaaaaacgctagctttttcaaaaatctaagtttttcgcaattcaaaagaaaatacaaataagtattttaaaaaatctaccttttaaaagacaaactttaaaaacccttttttaaattatcaaaaaaagctttcaacgaaaataaaaaatttttattgaaaaatggatttcatcatcacctagttgagttgattggtcctgacgcaattttgaaaataattataaattcaatttgaataattataaattcaatttgataattataaattcaatttgaataattataaattcaatttgataattataaattcaatttgaataattataaattcaatttgataattataaattcaatttgaataattataaattcaatttgataattataaattcaatttgaataattataaattcaatttgataattataaattcaatttgaataattataaattcaatttgataattataaattcaatttgaataattataaattcaatttgataattataaattcaatttgaataattataaattcaatttgataattataaattcaatttgaataattataaattcaatttgataattataaattcaatttgaataattttataaattcaatttgaataattataaattcaattttaataattataaattaatttttaaatcctttattcaattttgcaccttattggcccgccaattccatcccaaatagccgtcagtgcattcggaagcattcggcactttttcaaatggtgattgccatccattaaaatttatgttcattgccttccatccttaaaaatttttttcgaaaaatggggggggggggcaaattgacaaatttaagccttcttgggcctgaaatttgaccatttctcacttggt

SEQ ID NO: 13000 - DNA, 3079 bp, Heterodera glycines
ctccctggtggtattttcttaacacctttcaccacttccaccgatggtgctttgttagaattaaactaaatagggtgttggtatatcttcggtagtgtctatttcgaccgtaaatttaaaaattattaaaatttaattcctttcgagtggatttatacaaatacagtttctagttgttttttattactcatcgtaatccacagtaccccacctcccctcactttcgccttaacaatttgaatcgtcaacaaataaaatactcattccaaaaagggtttgaagacccaaaatgatttaggacaccgtaacttccaacaacggggggacggactcgccgaacaatgtattcttgaaaaattatgcataaacacagcgcctaaaaagcactcattcagtgccaatgccaactcagtccactgtcattccaaagtttggcatttggtcagcatcaccaccttctacaacagaatcgggccgttcttcttcccttccaaccagtcttttgtctgtgaacaatgacagttttggggaagtgccattgtcgaatcggtgcttttgtaattacggcccgtcggtgtgcgacatggaggacacttgcataaaagtgggtggccatcccttccgagtgaatttacccttcagcacacttcggctgcctgttttcacgcgattgtgctggtcattcgtttgctgtgagtgtccaaatagtgctgtccttctcctttaaggagtttaattctggcacgggtgccatcgaacgccgtcacttttttggttgtgctccactcgaaaaaggctcagacgcatcgcatcttacggttggcgacttctgcaggaaaaaaagcgccgactttttagtgcaacgcgtggcgttcctcccactcaaacggccgaaccgtcgcgtgctgttacgagggcaatttttgcaatcggaatttgactttgcccgactctccggctctcgaagtgagcaccggtctcaaattggcactttcgctccgcgcgcagttcgcccctcggcaccgcccttctcccgcctttcccgtgccgtccttcgctccatttgcttttcttctgtttggctttttggtcggcctttgccttttgttgactttcgctgttccctttcgctgttggcttctcaaaaagaaaggcattccccgggggaatcattcgccaatggcgcccctttctaaggcattccttcgggcgtcgttggctcctcatcctccaccgattcggccatcgcattgttgaagcagttccaacagaagcggcacagcccggcgcccctccagcgacaagcgccgcttgggtgccgtggcataattttccctattgtcgttgtcggatgtttaagtttcgagcaaagctgttcagcatccgtcgatggggtgactctcgtccaacggagtatcgctttggacctccaacttatggaagtgttcgcccgggggcgatacggcgagttgcgaaaggcattttacagggggacggtggtggcggtgaaggtaaagtcggactgacggaatgggggaaaagcgcaaaacaaacgcacagatattttatacgacggaggaggaatcgtggcagaacgagcgcgacatttaccagtgccaaatgctcaaccacgagaacattttgcgtaaggactccacaaaatgacaccctttgacttgtaacagaatttgtggcggcggacattctcagcagcgtcgagtcacttacccaaatgttcgccccccggcgttcgcctcaattcggcgttttttcaggcttcttatcaccgacttccaccctttgggctcgctttacgactttttgcgtgccaacggtcgtctcagtttggacgaggccctccaattcgcccttaggtgatttggtagttggaaattgcgggaaattgaacttcagcaccatttcggggttggagcaccttcacaatgcgttgagagggacggcggggcggagaaagccggagatcgcacacagagacatcaaagtgaaagcaattaactcaaacaatcagccgttaattgaaattagtctaaaaatgtgctggtgaagcggcgcggggtttgctgcgtggccgacttcggattggccgtccgattgttcgtttttttgtgccgttccattttcacatggatagtttcagtgaagatggacaaatcgttccccgaagtgtgaacataggcgttggcaccaaagttcgccattcgtccgccctttgctccattccttccaatttagcgttacatggcccccgaattgctccttggcacattaaacgtgcggaatttcgatgccttcaaaagtgccgacatttactcttttgccctcgtcctttgggaaattctccactgtgtccaggtcagcagcagaggggacacagaaggattttccagtttcaaattagaattgggtttttcgcaggtgtccgctgcttcttccgagtgccctccgtctttttcgtctgtccctccgccagcgtcgtcccttcccttttccgctccgtacgcatgcaccggcgttcgtccccaacggatgctcggcggtcgttcctccggcggttccagcggtttcgcctccagcggatgctccgccgatcgaaattttgcggcattttcaaattcgttgccaatgggtggtcaaagtgagcagcagcattttggagaagtaatgaatgcaataacagcatactgaggcattttgcaagtgatgatgatggcactttaacagttggaagtgaaaacggcggagaagacgagcagagacggagaggaaggcaagcggaggacggaggacagacaacaaaaagtgcagagagagcacagggaaaacagagagcagagagagtacagagagcacgcgcttccctttaagggaatggtgggcaacggtaagaagccaaaaatagaggcaaaattgataaaatccattcagacccgagctttgagcagatgcgtcaaattgtgtgcgttcaggtggcgaatccctccccctcccctaataattcacaaattttagaaactccgtgaggacgatggaaaccccaatggaatgacggcgccaatgt

SEQ ID NO: 13001 - DNA, 931 bp, Heterodera glycines
gaagaaagaagcagaaacagaagagacttttgaaaaaggaaatacccatctttggccttcgagatggcttattcatatgcttctgataaagatttgcgatttatcattcttaaattgaaatcccagtggtaagcagaaaaatttgaaaaaaaaaataaagggacgaagatggaaaagaaggaacagagagagaggagacgggagagagaaaatgaggaagagaaaaaagagggacaaagagagaaaagaaggatgagataaaagaggaacgaagagggaaaagaagggggagagagagagagagaggagacggaagagagaaaatgaggaagagaaaaaagagggacaaagagagaaaagaaggaagagagagagagagaggagacggaagagagaaaatgtggaagagaaaaaagagggacaaagagagaaaagaaggatgagataaaagagggacgaagagggaaaagaagggagagagagagagaggagacggaagagagaaaatgaggaagagaaaaaagagggacaaagagagaaaagaaggaagagagaaaagaaggaagagagagagagagaggagacggaagagagaaaatgaggaagagaaaaaagagggacaaagagagaaaagaaggatgagataaaagaggaacgaagagggaaaagaagggagagagagagagagaggagacggaagagagaaaatgaggaagagaaaaaagagggacaaagagagaaaagaaggatgagataaaagaggaacgaagagggaaaagaagggagagagagagagagaggagacggaagagagagagagagagaggagacggaagagagaaaatgaggaagagaaaaaagagggacaaagagagaaaagaaggagcaataaaggagggacaaagagagaaaagaaggatgagataaaaga

SEQ ID NO: 13002 - DNA, 1345 bp, Heterodera glycines
tttttatgtggataggtaaatggggagaattttgggtctcgggtgatgggaatagacaattacagagaaaaattaatatatcgatgttttatgaccaaataatattaatgtcaaagttgaaatcaaaatgtgttgtcaagttttattctcattatcagacaaaacataatatttaaaaagaacaaatgacaaaattggaagttggatggatgtgccggccgcttattctttcgtactgttgctgattttgagggagaattattgctggccattgttgttcagtgccccttggaaaagatggatgaattaacagggagcagctcgtttccccacatgaatttttttaaatttaataaattagaaatttcatattaaggaaacattggaaaagtctaaattttaaattcaatttttttgtttgccaaaaacaacatgcaaattcctatttttcgtgttgtgtggtcaaggaaagaactgacaatgactttaatggaacaaaaggaatgacaaaccaccgttctgctggtcgaggggcggctgaaacacaacatcatccagattaaaattcgcattcggaggcacttctaaaccaatgaatgccattttgacacaaatttaaatgccttttcgggcttaaagagggtgttgccaaattttacaagtaaaaccggagagaagaaaatttccgataaaattagcagttttctctgtaaaacttaagctcataaatttatttatttttggttttggtatccgatttgaaacaaacctgtcagaggttcaagttgttccgtcaattgatcgttcatatatcccaaaagggaattttcctccgtaaaacggtcaatggtctccgataattccgcatgcaaacgctgaaggcgctaaatttcagctggtttacataaggttataaaagaaaaaaataaataggatttgctggactttctttgtattggagaaaccaaatttcccaaatcagaaacttttaaaaatttgttatttcgccggaatcgggatccggtctaaattagccgagaacgcgattaagaactaatgggttcccggtccgcctttattccccgctgtttctttaataaggtaagaaataaaaacatacgttataattctgtccattgggattggcattggcgataaccgcagtcacattgaccactaaaatgtgccaaaaatgagcagattggtaaaacgaagggaaatgacaactcacccggctgtgcagcagcagcaaaatgagcatgattaaaatttggcgggatgccacctaaatcgaggaattctctgttagaatataaatttaactactttttaaggtataatggat

SEQ ID NO: 13003 - DNA, 2364 bp, Heterodera glycines
tattgctggccattgttgttcagtgccccttggaaaagatggatgaattaacagggagcagctcgtttccccacatgaatttttttaaatttaataaattagaaatttcatattaaggaaacattggaaaagtctaaattgtaaattcaattttctgtttgccaaaaacaacatgcaaattcctatttttcgtgttgtgtggccaaggaaagaactgacaatgactttaatggaacaaaagaaatgacaaaccaccgtgctgttggtcgaggggcggctgaagcccaacatcatcaaactcaagcaaagccggattaaaattcgggttcggaggcacttctaaaccaatgaatgccattttgacacaaatttaaatgccttttcgggcttaaagagggtgttgccaaattttaagtaaaaccggagaaaaaaagaaaatttccgataaaattagtagtttcatttgtaaaacttaagcccataaaattatttttggttttggtatccgatttgaaacaaacaagaactgacaatgactttaatggaacaaaagaaatgacaaatcaccgtgctgttggtcgaggggcggatgaaacacaacatcatccagattaaaattcgcattcggaggcacttctaaaccaatgaatgccattttgacacaaatttaaatgccttttcgggcttaaagagggtgtcgccaaattttaagtaaaaccggagaaaaaaagaaaatttccgataaaattagtagtttcatttgtaaaacttaagcccataaaattatttttggttttggtatccgatttgaaacaaacaagaactgacaatgactttaatggaacaaaagaaatgacaaatcaccgtgctgttggtcgaggggcggctgaagcccaacatcatccagattaaaattcgcattcggaggcacttctaaaccaatgaatgccattttgacacaaatttaaatgccttttcgggcttaaagagggtgttgccaaattttaagtaaaaccggagaaaaaaagaaaatttccgataaaattagtagttttatttgtaaaacttaagctcataaaattatttttggttttggtatccgatttgaaacaaacccgtgagatgttcaagttgttccgtcaattgctcatacatatatcccaactgagaaatttctacagttaaacgggcgatggtctccgtcaaatcagcgtgcaaacgctgaaggcgctaaatttcagctggtttacattgggttgtaaaagaaaaaataaataggatttgctggactttctttttatttgagaatccaaatttcccaaaccagaaacttaaaaaaaatttgttatttcgccggaatcgggatccggtctaaattagccgagaacgcgattaagaactaatgggttcccggtccgcctttattccccgctgtttctttaataaggtaagaaataaaaacatacgttataattctgtccattgggattggcattggcgataaccgcagtcacattgaccactaaaatgtgccaaaaatgagcagattggtaaaacgaagggaaatgacaacccaccgttctgttgctgtggcataacagcagcaaagtttggcaagaagcctcctaaatcgaggaattttccgtaagatataaatttaactactttttaaggcataatggatatgggctcgataaaaataattttctgttatcgataaagaccaaccccgctgctggggatttcggggcttctgatcacgcactaataacattgatttgcaaatcagtgattttgaaaagcatagatttagggtcaataattaattagatttgtcaaaatttctaaatatatgatataaactatggtaaataaataattgcaaatccgatattcatattcgtgatcagaagccccgacgaccccctggtttaatctttttgtttaattttcaaacaatgaaaacaaagggtgagctgacaatgcgcgcggtttgttcaccattaaactgctaaaattggacatcgttttaaaaaataacctgtcaaacgcacgatcatccgtagcaaagccccgttctgacgcacaaatcgggccctttcagtgttcagacgaacgatagagcgtcgctgacaggcaattgccgaaaacaattcctaaattttgacggtttcattggtgtccaaatcacataatccgaaactatgtatgtagttaaaaatttaaatttatttcttcctcaactataacaatcttttagcctaaaaaatcaaatttcattattctcgaacatctctagtaggacgaaagcaagaacgaagcggattgaataaaacccagggagtgctcatctggagattctaa

SEQ ID NO: 13004 - DNA, 2734 bp, Heterodera glycines
  misc_feature (996)..(996): n is a, c, g, or t
  misc_feature (999)..(999): n is a, c, g, or t
  misc_feature (1005)..(1005): n is a, c, g, or t
  misc_feature (1015)..(1015): n is a, c, g, or t
atgaagggcctttgctattcccaggtaaaatttaaatattccattttgaaaaataatttgacaaggaaatatacaattttaaattttccttgttttagtattttcatctttcccgaaagttggaaataaaatgccctatttttaaaaggttgggcctttatgctgtgccatgtaaattttcgaatttttttaacaacctttgtgtaattgaaattggtctctcattgtcttctttcacacatttcctcccattttaggtgatttgcggttgcattcgtggcgcgttggaggcactgcacatggaagtgcaagcagtgttggtcagcgacgttccggagcccaccgaactgcgcatcaaagtgcaccgggtgttgcaagagtccatcccggcgggggacgaaccgtagctgaggaattgaggataaaactctctttttgtgattatatcccatcaaaatgtttattaatttaattaaattttaaagaattaaaaaagacctttaaccgttgtaattggcatttgatgcacgaaatttcataaccttaccttttttaaattcttaaaattactttatttgttgtttaacagagatgggttcgttggcggtgcaaccaccgagcggtgtgacgaggaatctgacggaggtatggattacgggcgaaagttttatttttgaagcttttagtgttatttgtctgtcaaactagtaattttttgatcacttggagggtcgtattttacgaaaaaattacacaccaaaaaattaaatttaaaaaatggaagatttttttttcttcaaattccatgttcaggtgtttgtgtttctgcggaacaatgcccagcaagagcatttggtggaattgaacagccaacaacgtgtcaatttggacaccggtaaaaaggaattgccatttgcacattgtttttgttattgtatattgcgtttagatgacaaaatgtgcctgatcgccatcgatgagggtaaaagtgttggnttngggggnggaaagatanaggtttgggtcaacatgatcgacgaggtcaactacgaactgaccaggcaagtgttgtgcgcaacaaaagtgtcggttgattggagttaaaataattgccggatttttttaattgcggaagaaagctccttcgttgttttgccaaatgctcttgctattctttagaataaaagctcgtcagaccgcgcttcgagaattgcaacaagttcgtctcaacaaaatttatttgtttacgggaaatttcaatttttgcagaagcaattgaccgacttggacttttccgatgacaaaggcgcatcagcagaagcaggaaaagtggccgaactgacggaagagctcacggcaatgtttgggcacagcaaacggttgataaagtgagcacaaaaaaatacttgcctaattgactgacaatgaacccattcaattttgcttttattttctggtttttattaaaaaacaccatttgaacggatttttgcaaaaaaaaaattgtaccaattataaggctaatcgaagaggacgacacggacaaattggcatcatcatcctcatccttcagcaaattgcggcacaatgttgtcgccagtctgctgttggtgctgaactcgttgatgcatgattttcggacaaggtatatttgtttctaaagagtttcggacattaatgaaatcctgaattttcttttccattcttattcattgtcagccaatccgccttccttcgccaattggactcgcggacagcaaatttggacacttttgtgctcaaatcatcgacaaatgttgtgccaactgctgcttctgtttgtgccggtgacagtgggaccacggacggtgccatgacaagttgcacgagagacgctgacaagcaacagcaggaagaattgacaatcgaccaaattcagtacatcatgcaaaatgagcacgtgtccaaggagcgcgaacaggaggtgcgaagaacaacaagatccccatcccctgctgtttcccccgatttttttttatttctaacttattgttagaattttttcaaaaaaacctatgagcttttggtcattaataaagggtttttggaaatatattaaaaaccaaaagggggggggcccttctggtttgcaaaattttgtgttttatttgagtttgggttgtggattatttgtcttgacatacaatttttaagtctgacaaagagcggacccactctttcgaagcaatttgaaaagcgcattggttattcaggtgctcaaaatcagcaaatcaattctggaattgcatagcatgttcaaggacattgcgtcgatgattattgaccagggcacaattttggacagaatcgattacaatgttgagcagtcggcgtctcgtattacatcggcgtttaaaaggtgggttgttttggcattcatgacaaacaattcattgccaactgaccaggggcactcccaagtcccatctcttgtcagtaaccagaaaaataagaaaatttttctttttatttactaccatttttgtgaaatggtcgatagaattttacttttgttcaattgttacgtgattttggtaaatgtcctttttgagtcaaagagttttaaaaaatttatcaaactgaacttcttcgaagctgattggtgttcagggactttgtcttttgtgaattacatttttaagaaattttcagtgtccacaaggcggacaggtaccagaagaagaacaagaaaatg

SEQ ID NO: 13005 - DNA, 2064 bp, Heterodera glycines
  misc_feature (704)..(704): n is a, c, g, or t
  misc_feature (1918)..(1920): n is a, c, g, or t
  misc_feature (1922)..(1922): n is a, c, g, or t
  misc_feature (1926)..(1926): n is a, c, g, or t
  misc_feature (1948)..(1948): n is a, c, g, or t
  misc_feature (1952)..(1953): n is a, c, g, or t
  misc_feature (1955)..(1955): n is a, c, g, or t
  misc_feature (1964)..(1964): n is a, c, g, or t
agtttcgaaccttctaaacgcagtgcttgtttgtccttttctgcactaatactggagtatgtgtttctggttcactggctttctcaaccatgtttcaaagtctgactctattgaagaacttgaggttgatcctccgtcagattcatcggaactttgttggaccgtttctcgatctgattcattcaaatttcttggactattcatttcttcatcagattgatcagaccccgtgaaatataccgattctttgcttgcattgctgccagcttccactctttccgcttcctttcctttatatattttggtgtctttttgtctcatttttccatgtccctgactttctggttttccagaataatattgaaccctttcatggtcaaattgttctgaagttacactgtgttttttcggttctttgtttttgactcgttttgggacttcatgttgtccataaatatatcttgtactacttcggctgtgactttgttgcctctccaattttcggtgggaagtttcctcatcagtaatttctaatgaatttttgtagtagtattcttttgaatgcgttctctcttccttttccggttcatcttcattaaaattggttcttgtcctgactcgaccatggtctgttgatctgttggccgacttccgattggaattctccaaataagacaggtcagactgattcccgtattcttagnctcgtctgtttttagtttgtttcggcacttccttttcattatgagttggtctttccctaatacgaccctgactctgcgatcgagctgaattttgttgtgtttcatcgtagcctgtcggttggtaatttgctaaggcatctctctctgactcccttccgtcataagtgatcggcgaattttgttgtatttcttcattatactcaggttgatggggtgcatcattgtatctttgtcgctcccgtctgctataattattcggtgattcgtcattatcataataggtgaccagacgattgcgtcggttttccgtttcttcataactttcgcggtgagcttggtcttcataggagctcctgagtcttctcgaagctgttctctcatgtactccccgcatttccttatcgaaaaatgttggtttgattcgttcataacttcttgacaattcgttatcatttatttctggtgataaaagctcgttggcgcattctctatccgaaaagtattgattattctcatagttattaaatgaagtcgatgaatacgaattggagccttggccttcatataattcataattttctaaattaatgctatttaattgttttatgttaataatgtcaagaatgttagcaaaatttttgtgaatataaagtttttgccatatttatcaatgacttatttcccgacttgagaatcacacggaataatttcagaatctcttcccgcccttttatcttaattttttcctaaccaactaaattcataaatttactatttatttaaaatatatttttatttaattataagtttttttgaaaccagtctaaacaggtaggctggtcattttatgctgttgtgtgcccaaataaccttggctcaactattccctttttaaaccttgtcttcgtaatggttcaagtgtacacatcaaaatgccatggctttctgtcaattctttgatgtctctcatggctataattcgtttcatgtccaaatttctgccgtccaacagtggaattccattgtctctcgcacaatgcaacaagtagccatccaatggctgggtgggccaatcgcatttcatttttttcaaagcgttcaaatccaattttgccctcgttgagttttccatatggacgagtattgggtaacggacgcccatacaatgcaaaatgctagccaaattgctgacaaaagtgttctgagcacatccnnncnattnaccaaacaaaaatataccactnaatnntncaaaaattntaataaatataaattaatatgatggagtcatctaaacaaaagatatttcagcaaacttgagggaaatttgttttctataaccataaattataaattgtca

SEQ ID NO: 13006 - DNA, 1708 bp, Heterodera glycines
attcaaatgattaatttcctgagagaatcgataaaataaaataaatatttataatttttcggtttctgatgtattagccggaaattgtttacatgcatattaaattgagctggattaaaaaaaatattctaattgtttgttaaaattttaaataattggattaatcgtccgggaatcttcgcttctatctgtccgtaagtcggtcattttcggaaatgaatcaaattttcgaattttcatccggcggcacatgtcagcaccgttggacctaaaactattaattttctaaattaactgaaatattaagggtttgccgtgactttagaaatagggaaaggggccggcggtgccgttaggcgccgccgacgaatttttgaaacttttgccccgatttcttcgcagattttgtttatatgaaacaattatgtaattctgaaattttcaattttatacaatgtaaattattcacggaaaccgtggagagagagagagagagaaatgtaggtaacaaaaagaagagaataaaaaggttcaatttgcaattcaagattggccgacatatgcggcgctgacatttgcggcgctgacatttgcgtcgcagacatttgcggcgcccagtcaaagcgacacttgcggcgcaaacacttgcggcgctgacacttgcggcgcagacatttgcggcgcccagtcaaagcgacacttgcggcgcagacacttgcggcgccgacaaatgcggcggccagtcaaaaggacttttgtggcgccgacacttgcggcactcagtcaaaacgacatttgcggtgcagaattaaatgatcccaaaaaatttcaacaatttatttaagtcaacagaattgtattttaatagtttattttttaacaatgactaatttaacaataattcttgcaacctaatcacaaagataaaggtagagttgtttgccgttgtaacagcttcagaaaacctttcacttagcctcacccagcattttcaaagtataaatggaataatgtaataaaaatatttttataaggttcattatcgccattaaaaaagaggaagagcaccaacaaaaccgcctgaggccttatggaattgacccaactcgtgggattgctgaaaggcctcgcttaaaaaagattttcgaaatgatgaagcgatccgtcgattagtcctcgattttgacaataaagaaaatataaactatgatgatatttgcaagtcgaaaggacaattggttcattccaaatatgtccaacacgttaacaaatgcttaaatattttataatttatattcttaaatttaataattacggcttttatttagagaccggggttttaagtgctaaaaacactgaaataggtactaaaataggtgtgaaaaaagtggaaaataggtgataaaaacgcccaaaatgccaaaataggttcgaaaataggtgttaaaaattggaaaagcccagtgtctttatgcacaaaaattacaaaagtgactaatttttttataatttcgcccgcacactttcaactggtcaagaaaataaaaataaattttggaaatgttttttaaaatttatttccattcttagggggtgtgttttttcagaaatttttgggaccgattcttaggggtgtgttttccttttttattgcacttttgctatgaaatttatggaaaaaggccaaaatatgtgctaaagttcgaaa

SEQ ID NO: 13007 - DNA, 2365 bp, Heterodera glycines
aagagaagaataaaataacagcgaaatataaaaaaaacaaacatatttcttgacctcatttattttctacctcatttgcaactgcaaaaagtgaataaaaattatttttgcttaatttttgactgaaaattatgtcactattcgtcactatttcggattttttcactattttggcattttccaaactctttgttggcttatttgggaaattatagcattaatctaatcccgttaggaattgggcccccccccaatcccaaaaccgaacccgctaatttgattttccccatgaacagtctaatctggcaaatcgacccggtaaaaaattggacgactccaattccgaaatcgaacccgcaaattggatttgtcgacctagtcaaaaggtgacaaataacttcttattaaaaagttcatttaattttgaacattcaaatgcatattttgcagtagcattttctgccgctgcataaatttaaattcggagagaccaaaaaacggtgggaggggcggcggggggggacggactgacaccacccaacgcattcattcattcactcaattttgacagttccttcaattttgttttccaaattagctcgtcatccaaaaaccgtttttgttaaattctgtcttttatcggttcgttcgattttatttccctttttccgttagtccttccagttcatttttaaatgacctgctgtcccaacttgattggtaatttgggaaattctgggattaatccggcaaacccacccggcaataaattgggccccaatctcgaaatcggtgctagcgcgtttgttaaaaactgccaatgggtttgaaaacaaaaaacaggctatgttttttgcaatggtaatgcatatataataataaacatttaaaattttaaagtctttaaaatgaaatttaaccaaaattaatttatatttcgatagccctaataattctctatttatatttaaaattttagaaaatttcattgagtttcaaaaaagttctgaacaaaaaatgctgacttaagattttttgcaattttgtgaccataacttttttttatacttaagttaaaaatataagaaaattatattctgaaagagaacaattaaagctattgaatgataccacgaaatattaatttggttgaatttgagccaagctattaatttaattattttacccattttttgttttcaaacccattggcagtttttaacaaacgcgccagcacggttgtatccagaaaattccctgaattttcattttttaacgcattaatccgttgctgataaacagtgctgtcaaaaatatgcaaatgcatattttttttcctggattctgcgtagtctaattagtaggaaaaacactttctttttggtatttgcgtatgaaagtcgggacttttatttgcatattttgggttttttctgcatatttcatgcatattttgccactttttgtacatattttcagattttgcatattttgccatttttcgacaaatatttccgatttaaatatcctcttaggaaaaaaaaatttgattatgcctaaaattaaatccaaatcggaatggatgcgcgagtgggtcaacagtgagcttcactgccgaaaatcttgataaatttttgattttgcaattgcaaaaataatcgataacatttatgaggagtaaaattttttaaattaatttgcacccctaattttcaagttttttgtgcatatttggtgcatattttgcgatttttgtgcatatttggtgcatatttcacgactttatttgcatatttatgcgcatattttggccatttttcgtgcattttttgacagccctgctgataaataattgcctaatttaaatttaatcaccataaaattttcggaaaaattatatacacctaaaatgcaaaaaatacggattcctcaaagtttctgataaatgtcgtaggaccccgtcccgcgccagaaaatctaatatcgactgccgaattaataaatattttaatttttattgtttttttttgaaaattaatttgaaatatatatttggtatagcttggttcgaaagcatttgaagaagattgcaatgaatcaaatgatgcaaatgcgacaaatggttctgtgccacagcaagcaacagatcatgagacagaaaaaacgggagttattccaatgacattggataaaaaggcggaaaattcggaggataatgatgctgattcaatggcaacggaacaaatgcaagaaaattcggaggataatgatgctgattcaatggcaacggaacaaatgccggaaaactcggatgaagaatattcaatggcatcggaacaaatgccgtattcggatgatgatgatg

SEQ ID NO: 13008 - DNA, 832 bp, Heterodera glycines
aatgatgaaaagggcaaaggcaaaatgacgaggaattaatgataacattgaaccaaaaatggactatttaggtaaacaaattagggataaaattggtaaatatagctgtaaatttgagttgaaaataatttaaattcataaaatttaaattaattttcagcattaaattttttgtagataaatgatagcattttgaacaacttaatgccatttttttcgttcaaatttttctgcgcttttttaaatggagttcagtgaaagttctcaagttttttttcaaattctgaacaaattgcattggaatcagattttcgaaaaaatcaaaaattcgaaatttaatattagcttccgatatgatcaggcgaaaaaaaataatatttttgtgtgattttctgtgaaaaaataattttgaaggtaaaaaatttccgaaaaaattatcatgccctcaaaatgcagcaaaagctaaaaattcagtactttttgggcttaatctccatttaataaaccctaaaaaattcctaaattttagtgtccgaaattcgtcgcgttttttggctgagcatagaaccattaaaaaaaattaaaaatcttgaaatttatttaaaaaatcttaaatccatcaaaaaccctaaaaaattcctaaattttagtgtccgaaattcgtcgcgttttttggctgagcatagaaccattaaaaaaattaaaaatcttgaaatttatttaaaaatcttaaatccatcaaaaaccctaaaaaattcctaaattttagtgtccgaaattcgtcgcgtttttttgctgagcatggaaccatttggcatcacagcttctcaaa

SEQ ID NO: 13009 - DNA, 973 bp, Heterodera glycines
  misc_feature (870)..(870): n is a, c, g, or t
  misc_feature (900)..(901): n is a, c, g, or t
atattttgttacctccaagtcaaaaagacgagcctggcaaaaggccaggaaaacattggacagcttcggaattggaatttgcaaacacggactgaccaagcgatcaatgccgtactttttggctgaaaaatgcttttttgaatggcgctattccttttttccaaaaatttcacagcctcaaataggaaaattctcttcctcttactatttatatatataagatataactattataaattaatcacccaattaaaattaatttgctccaaattttttgacccgcgtaaagcactgcaattgcgttttccataagaagctacccccccccctcctttacaaccgccccctaaattaatttgtgccaattttcaccggcataaagcactgccatcgcgttgtctccgtccaattcactcaaatcgtccgagtaaatgaaactgagcatcactctgaacgccgttggctcaacgtcgggcacttccacaatggcactttcaacagaggctaattgaaaagtaattatggctagggatgggatttttagtgataaaaaatctcaaaataattaactaaatagtgaccaaaaaatgccaaaatagtggtaaaaatagtggcgaaaaagttccaaatttaggggtgtaattttttaaatagctgtttttaatttgaaaataatttaaaattaaggaaaaagattttattcactgattgcagttacaaaatattttcgtagcaaatattgaacaggaaaaaaaaattgggggaagaatttttgcgaaatttttccaattcttaggggtgtaattttgaaaatttttagttcgtttcttaggggtgtattttttgaattttttaggtcgattcttaggngtttatttttcgtttttattgcaattttgnngaaagttttcaaaaatgccaaaatagtggcaaaaaattattttagtggccaacttccgaaatagtttttttt

SEQ ID NO: 13010 - DNA, 3278 bp, Heterodera glycines
  misc_feature (3199)..(3199): n is a, c, g, or t
  misc_feature (3223)..(3223): n is a, c, g, or t
gcaggtcgaccaaacaatggggttaaaggaccataatcccacttttctaaacaggagggagaactcagaatttattgcatcctaatgagaaaagagagagagagagaagcaaaagacaaacaaagggaaaggggacggactgtttgagatgataccaacaaaacatgtgacgaatggcgttttttggcgttattttatatatttttaatttaaaaaatcggatgacatccacaaatttttgtgtgcgctgtgaactgtgaaagcccttataattcgaatccctaacccgactcgaaaaagtcgaaaatcattcaaattttatttggtaatagtaccgatggtacatcatttataccaatcgtggactggtaaattggacaccggaaaacaggacaccaaattcctaaaataaaccctggaattatgttgaaaataaatttgtgtacggtaaatggataataattaaggctttaaagtagattaggcattcaacaggtacgatgatagatcaataaggatgagatttttagtgataaaaaatctcaaaataattaactaaatagtgaccaaaaaatgccaaaatagtggtaaaaatagtggcgaaaaagttacaaatttaggggtgtaattttttaaatagctgttttttaatttgaaaataatttaaaattaaggaaaaagattttattcactgattgcagttacaaaatattttcgtagcaaatattgaacaggaaaaaaaaaatttgggggaagaatttttgcgaaatttttccaattcataggggtgtaattttgaaaatttttagttcgtttcttagaggtgtatttttggaattttttaggtcgattcttggggtatatttttcatttttattgcaattttgggaagtttttcaaaaatgccaaaatagtggcaaaaataatgacgaaacgccaaaatagtggcaaaaaattattttagtggccaacttccgaaatagttttttttagtggcaaagctccaaaatagtgattcctagtgatgaatagtggcactaaaaatgaaaaattttcgaaaaagaatgtgtttttcgtgcatttctcgtcgagttaaagccgcagaaaaaatagttaaaaaactaagaatcccatccctaattatggcaattagcaggggttaatttcaaaaaaaaatcaacaaatttttattttctcaccattttctgttttttctttctgtgagtcaaaacggaacattgcttcaaaaacttcggaagcgtgctttaaaatcagtttatgcgccggcagaagctgaaaaatttaaaagttgacataaattatatttcaaattgaaatattaaaaaaaactcgcctcttttttgtctccgtcccccaccaaaaattggatgtccgcgtcttctcccgagctaaccaaatgcttcatccgttcaatcggattcccctgctttgaggacgatgacatttttaaaaccaaactccgaaatttaaaatgagaaatcttatcgaaaaaagcttaaatcagtctaattgtaagcaaatatggaaatggaaatggagaggatagctttttgttagaaagggaaaatggctattgttttattttatttttaataggtttaaatcatggttcccagatcaaaattttcaaaagcctcatttggtaggtaaaaaagcctcattcttacaaaaattattcaaaacacgtttaaaatgttcaaatgttatatttctgattgtccgtgatcaatttgagcaattttttgggtacttgtgggttatcagtactcagattttcaaaaaaaatttttgtaataaacttgcaattttttgagattttcttatgccaaaacaaaaaacaatttgcaaaggcattgcacaaaaaattactgaaaaaatcgattttctccaaaatgtcataatgtaaatatgcaataaatgttttgaggaagggcgggggtaatctgaaggaaaggcgtcggagaggaatgggtaaaaaataaatttatcaagtgtaaacaaaatggtgaggaatggggatgtaaattatattttcaaaaatcgcaaaaccgtatttcctcgaatatagccccaggggctctattgttcaccctccttcaaaagggggctctattcgaaagagctaaatattgacattaagaaaaaaattacaacgagaaaatacgaaacagagcttttttcgtgtatattcaaaaataatttttttgtctggactttagctttttcgtttgtaccgaaaatgtaggcattgaccaagaaaaaggtattggccaaagtaattgaagattggacgcctaaagtgcacatacagtaaaataaattcacaatttatattcttcggccccgaaaacctataaaacaactttatttcgaaaaaatttaatttttttttctgagctccccgtggcctgaaatgcacgaaaaacatgtttttttttctactgtgttaagctacttttcgagtcattagcaactattttctagttttttatttttagcaactaaaaaactataaaattttgaaaaaaactattttcaactattttggcgttttgcccaaaatttgttaacaaaaatgcaataaaaaggaaaagtaccccccccccccccttaagaattgagtcaattcaagacttaaaattcttttcaaaaatacatccctaagaaatgaaaaattttcaaaaaatcatctccaaaattaatttaattattttattgatgataatttttgattttgaaacttgtgtctcattaatggtttggcataatttttttgctttttgaagaaaattttcgattttacacccctttcccctccaagtatttattttttttcttcatatttttcaaaattaaatttattcgatgggaattcaatcacaattttaacaattaaaatcgtaaaatatgtcatttttggagttttttctttacaaattgcactaaaaagttcaaaaatttccccggcagcgcctatcggcaccgccggacccctgttcctgaaaagtcttttgaaaagggcaccacaaaaaatggtgtaaaaactcaatcatatgaaaaggaaaaatggatggtagcttaaattagagaaaaaaaaaacaaacatttgtgagaaaaaacctcaaaagattgattttttatcgattttaagtgtgtgagaaaaatttttctcgagttncgactcgagaaaagtctcgggttntttgggtctcggtaccgagtctcggggtcaagtctaggtctcgggaaaatttttg

SEQ ID NO: 13011 - DNA, 3360 bp, Heterodera glycines
ctcattcggtgccgacattttgcgaatgaattctgattgttcggggtcagggtgaattcgttccgaagacattatgtggcccaagaaaagcaattccttttgaagaaatttgcatttttccagttgaatgtggaggccatattcattgaatcgcgcgaaaagttggtaaagcgctgacacatgttcctccagtgtctttgatgcaatgagcccatcatcaagataagcaaaaacgcctggaatgccactgcatatttggtccatcaaatgttgaaaaatcgatggtgccgatttgactccgaatggaagacgttgacattggaacaatcctcgatgcgtgctcagagcgcagagctgttttgattgttcgtcaagttccatttgtaaataagcgtcgcttaaatccaaatttgaaaagtatgctgctccgttgagtgccgcataaatgtcatcaggtcgaggcaatggatggcgattgagttcgcgtgcattatttaatcctgtagaaaaatcaatgcaaactcgggttttgccatttttctttttcactgccaagattggtgcagcccaatggctgaatttgattggcttaattgctccaagttgttgaagtcggtccaactcggcattaacggcttcggtggcgccgtgcggaattggcctcgctttgcaaaacacgggttttgcatccgacttcaaaatcaaatgtgcctttgcttttgtgcaatggcccaattcgttgctgaaaacatcagaaaaatctttctgaagtgccgaaatcagtgatttttcgtcttggatcactttggcctttggcattgcttccttttggatgattgtcggcttagtgttcacttcttggaacattatttccctgggaataacttccagcgcgacaatccatggcattcccaataagtcatgtttgatggcatcactgacgtatgctgtgagcatttttggttcgtcgttgcccatgcttacgatgccgaaaaatttgccttttatcggtactgcttctccgttgcagttccttgcttcaatgtcggcaggcgacaatttcggtttgccaattttgcaccacgttttgctggtgatgatggtggcttgagcaccagtgtcgacattaatccgtattttaacgccgttgactgtgatcaaaattcgccaataccagtgatcagcagttccaacctctgtgcaggttgtgttcacttcaattgtgagaactgatcggccttttctgatgaatggctggctgttcttttgttggcaaactttggcgatgtgtcatttcttctgacacttgtggcaaattgcatcattcaatttgcattccgatcgccaatggcctaaaaacccacatgctggacatgggtcagtcggctgtcggtgtttgcctttgtccacatttttagaacaattctgttggttgtgactccgttgttcagttttgacaaaaggttttgactttccttttgagtccttccactgttgaggacgtgtgtgaattgcgtttgttgcggcgggttgtgccattagcgagagtgcgctttcttttaccatttggatggtccgcaactcttcttcaatttgcttcagtgtgatgtctgtgccgtttttctggccatcctccaacattttcaagcacttttgccgcaggtcgtgatgctcatctcgaagagcaatgaccaaaataatgcatttgagttgctcctttgtgaggctcaaattcgcattttcacaggacgcattgatttgtgcgatcaatgaagtgatgtcctgatttggctgttgtctgattttgaaacattcatagcgtcggacaaacagcgatcgcgtttcggcgtacaaacttttcaatttgtcgagagtgtccgcccatgaaatttgatcgggttgggtcggacttacgctgtctcggtatttgttgtagtcctcgtccgataattttcccaatagaagacggacttttgtcgcttcaggtaagtcttttccatcgtcctcgattagtgtgccaaaacgtttgaaccattgttcaaatgtgtttccgctctccgcgtcgtaataaaatttcgaaattcgggcgtcaattgaactcgccaaattggattgctgaggttgttgttcgctggcactgcatttccaagcagttgctgcatccttgtttcggattgcgtaagcacagcgttcaaaatttgttccaattgtgccgcgttcatgtcgaatttttgtcgaaaatttgttgaattttcaaaaccgcacccagcggaaacttacaccccccaggtgatcagtttttttgtcgatgaaaaccgcacccagcggaaacttacacccccaggtggtcagtttttttttgtcgatgaaaaccgcacccagcggaaacttacaccacccaggtgatcagtttttttatgaatgtccgatgaaagccgcttaggcttttgttgctgactgcgccaaatttgttgtgtccttacccaaaggaacgacaacaaatataaacaataaagtttattgaagaaaaataaaataataaattggtgacggagagaggcgaatatcgattggctttatgccacaataaaattggagaatgaattaaggaagtccaaatgtggggaagggagccaacattaaatagacagaaatgggggagggaagaagggacaaacaaagggtcagagatcacaaatgtcaatggtcactatctctaacaatttgtcatgagaattggcataatccacgtcaatttatgccaatctatcgctgatggatccaataaatgggggcatggcccacgctgaggccaccattttaaatttggcatagcccaactcaaacaaattacatggcattcttttaaagaaattataaacacaattccaaattactaaaatttttaggaaaatgaaaacaaatctctttcttcaaattttcctaaattttcttcaattttccatttgtgtgccctccccctacaattgggacccaatgaacttggccaacaatgttcacacctttgccgagtttatggacgatctttacaaaaattatagagacgaaaacgacaaaatgggtcagtttattgatatgcgaataatttgcttttttcacatatttaattgcgttttggccgattcagaccgtttttggtctttttattggtccgctgatgtctcgttccaatgaaaaacacacactaaaatgtgttaagttgttacaaaaatggtaaaaaaaacgataaaatattgaatttttcctggcggatgattttttaatttaaatttttttgcaccaaaatatgataatccatttatcatttcccttggagtggtgaataattttcggtttgcc

SEQ ID NO: 13012 - DNA, 334 bp, Heterodera glycines
ggttccatcgtactttggcatgctcagatttacggctgttgttgcgttctgtttggccctgccgtcgttgatcagctccatcaatgcttgttcactatttggataggcattccaccgatttctattaatgtgttttgaataattcagtaaatctgctgttacgggcgagggcagagaggacagagaaggcattttgtggatgagagagaagggtttgaatgtgcaggagaagcggtcaacgggcggcgggtcacaaaggacggacgagcgatgagtggacgacggcgaatggcccccgggggaggggacaatgtcgagaggggcgggggggggg

SEQ ID NO: 13013 - DNA, 2558 bp, Heterodera glycines
agtgattagcaaaaaaagttaaccataaagcgggacccactagggtacctttccgttatgccctcccccataaaaacattagccatattagtacccttgttttcgccagtgaaactgccgcaattttgaaaaatataataatttttcttggcgaaatgtcttcagttcaaagtctaatgataataataggtcttatgggatttttggatctatgtacatgtacattttctactgtttaaaatttgtaaaatattccccggtgcgcctaccggcatcgtctaatccaaaagtaaaaatagcaattttttgatttacaaaatttggtcattttttggacaacatctgttaacaaatcgctttcaaaatttttactagggttgcaaccccgacgtcggggttggaaaattcgaggttgtcggggttggaagcgtcggggttcggggtcggggttgccaaatcgttcggagtcggggtttttcaatttttgccttataccatatagtcaaaaactttacattatttttgcttaaaatttttttattttcattaataatttatgtgtttttttaatttttttttttatcataaatatttttgtatagaattaatataaaacgcataaggcatttaaaatggccaattttcagtgaaaatctgtaaaaatagtcaagatttcaaatttttcctccggcgcctggcccccaattaaaaatagagggattttattcaaaaaaatgcccaaaattttttgatcgcctttcttttttttttgtttttcgaatcatcttttttttcgcggcgttctttttctaaagacttttaggagaaaggggtccggcggtgccgacaggcgccgccggaaaaatttttgaaatttaaagtctattttgtaacagattttcaccaaaaaatttatgaatttctgataattttttttttctcttggttttttgtcaaaattattttgaaatatattaaattttgatgatttagtcaaaaaatttaatgtttaatttcaactaaaggaaaagaaaacgtcaacaggtatcgaactcataagaaaagtactgtattattgttgaagcactaaccactagagcccggagcaggaccggatcctgcgcaggattttgcaggatcccagtccgcaatcctgcattttttggaaaatgcaggatttgcaggattaatccggccggatccggtccggcaaaaaattttgaattccaatcctgcaacaggatccgcaaatttgatttttgtgcgggatccggcaggatccgcatacattctttgaaaattttataagacggaatgtcaaaatttttgaataaatttataataaaatcaatcaaaataaattcaattttcatctcaaatttcacctagaatttgcaaaaaaatttcccggcggcgcctatcgacaccattggatcgacattagtcctgtagaattgagtcaaaaggtgtgacatttggtcatttttttggtcaaaatcagttaattaattgataaaattttcaaaaatttcagacggcgcctatcggcatagatggacccctttgttcctagtttttgaaaaaattgcgccgaaaaaaagcatttttgaaaagcaaaaaatagtcaaatttattgaccgacctaacagatttgatttccgatctctttttaccgtctgacccattcgaataatcttagtcgcccttttaatgcatcccgccagcccctaaaaatttctttttcaaaatgtcaggtattttttcttttttggaaatttaattgaaattttttcaaatttctaagaatccgcaatcctgcgcgggatcctgcaaatttaaaatgcaggatttgcaggattaatccggccgggtccggtcctgcaaaaatttttgaattccaatcctgcaacaggatccgcaaatttgaaatttccgggctctagttgacaaaacgtgcatttttggcatactgttgcccgccagtgtttttattcaaaataaatcaaagccaagattgcaaaattttttgcgatgattaccaaaaattttcataaaatttaaaaatcctgtctcaatatcgaaatctcagttcaggatctacatattagattacggaatgataatttttaaaattcaaatgacctgatatggaagtggatttgtgaaccaatcataaatgttgccaatgtccaacctcatcgggtccaacgttggtggaacttaatttaaaaataaattaattaaaatcattaaaaaatagtttttaccaaaataaatatagccgacatatgccttttcgtccattgctttgcccgtttggggctggaagtacacagttttggtgccccaatcgtaaatttttggcaaattacatcgtgcaactgacggattcagcaccatacaggtggcactcggaaaaattgaaaaaatagaaaatttagaatttttaataatattgaaaaataataaaaataaatacatatatattcttgaaaacatttgcattttaataatcagttgtctcttaattgtaaattcattaaaataaaaaatttatc

SEQ ID NO: 13014 - DNA, 2171 bp, Heterodera glycines
  misc_feature (2066)..(2066): n is a, c, g, or t
ggaaaattaaggctttctcatttttgttttttttattcctataaatttatcattttaaatcagtttcaatgattatttttattttctgccaggttagcagcgtcgatgaagtaattgtgcctaaacagacggactctccatcaaaaaacggcccatccaacagaatactctgtagacaattgcgcatttggaacagagagttaggtgggtttgaaaatgaatttaataagaacatattttattgtttcccttttttcaagattttatgagtcaatgcgattttttggccggtctggaagctgcctgctcaattaagtacgaagaatcacaaaaaattcaatattcatttttccgaagacctagagggaatttgattgttgtgccggcggtggtgtcgaatgagcgacacctttggttttatgagcggaatggcgaaatccgaaacaaactcaagctgttctgcccacaatccgtaccttcgtcaaattccgattgcgacggtggcgagttgcacacgcacagtgttgttcgacatttggcgtggaattcgaccggttccattctcatgctctgttacgaggacattttgtcaaagacaacgcaatgtccgtgttattttaaccatctgcatttttttttattattaattttagtgcaattttgggtcgtttcgaattattcgtggacagagaaactgcgcttttctgttggcgaattggccgactttttttgggaccctgaggaccccaacaaattccattatctgacaaagttgggcgtttatcacagattaatattgtgttcggaatacaattgcgaggacatgatcgttgtgtcgatcaacggcggttcgttcaatttctgagcttttgtcccatttccgtttttcagacagagtccgtgtcaccgacttcaaatacgcccccattccgccgccaatgtgccattacgaattgtgtttggaatttgtcggcactccgtctgcctttgctcagtccccagtctttgggttggcttttctcagctccgactttacacggatcagcacttgtgggcccaaatcattttgcactgccagaactggtcattctttgtttagtttctcttcagaatcgacgttttattcgttccaaacgcattgaattcggtcagagtttgggcttgttgctcaatttgatttggcgtgatgcaaatgctcttttggcatttcgaaagagcaaacgaagtgatggcgcctatgaattgaccgaatttcacctggaccctttttcgatgtgctgaatttcggttcattttttcctcccaattcatatgttactatttagttcttctctgagggaatttgactatttgccatttgcactttcgcttattaatgtcccaaatgagcatcagttgcccaattggactcccagcgaagaaaacagtgtgaaagttgaccatgttgaacttgaagacaacaaatatatacttacattgtgcagaacggaagcaccggcagtgtcaaaatggggaggaggagcaccgaaaacaattgaattggacgtcaaagttcgttttaagcccatgccatggcgaacccccgaaagaaaatgagaaaattaaagtttatgcttacaattagttgtgtccgtccgtcttctttcatatcgtttaaacattttcccatgctttaggatgttctcattttctatttgaattccgcacaactttttgtcaatggcaaaaagtttcagtcgaacgtctttaattattgttgtacgaaagaatttcttgttctgatctctggctgttctctgttctgttttcccatcgctttggttcaaaagtttgtcgctagcgatgaaaagactttcgaatgtattggtgcaggtgagtaaaaacagtgggacaataatgtggaaattgtattttaatgctaattattaatccattaagctcgggaggttgaacgactttccgaactaattgcaaacgaaccgaacggaacgcgcgtttggcttcaaatgccaaggggtagcggctgattgcttggcggttattgttatgttcatttatatttaagngcaatttggaggtcatccatccacgcccaattctccttgaacggcttaagctttgtttggatgcccgagaatggtccaaagcgtttgtcgaaatgcggaggcatc

SEQ ID NO: 13015 - DNA, 880 bp, Heterodera glycines
  misc_feature (748)..(748): n is a, c, g, or t
  misc_feature (863)..(863): n is a, c, g, or t
ttttttttttgcaaaattcatccacctcttctcggtgttttcgtttggcatagttgtaattccaacgcatatttgacggtgaaggagcagaagccgccctaacttcaatcggcaaatcggcacgcagtttatctttagtattaatttgcccacgggatgaatttggtccgatctggcgaaaacaatcaccggcgagttcacttactcggcgaaatcaaatacagacgccgagaaaaagagaaatagttcactggcgaaatcactcactggcgaaatcaatcactggcgaaatcccactggcgaaatcactcactggcgaattcactcactggcgaaatcacctgccacccacaatacatattgtatatcctaaaaataagcatcatctttacatcatcatatatcatatcttatcatatcatccatcattgatctgctgattatgggcggcactttctgtcatttgccttcacggaccgacacggcttcttcggctcggcttgaactgttggcgatgaatgaagcggacttctgctgcttggtcttcttgtacgcacggaagatgatgtgttcattttagtctgcaattgtttattgaatttgagtgctttgctcaattaaacaaaataatgtaaatttagaatagcgttcgtggaattattacaattttttaacggacattcctggcgctaaaaattaggcaacaatataattagggtatagaactaggatggcacggaattccgantattttttgggtttcgatttccgaaaatttttgggcctcagaatgccatccctggtataaagattggtaatcagattttttcgggatttacatagttaatttgaattaattccantccatcactaattttcg

SEQ ID NO: 13016 - DNA, 3341 bp, Heterodera glycines
  misc_feature (3197)..(3197): n is a, c, g, or t
aatatataatatcgcagcgttcaggcaattacaaaaaaagatttgattaattaagcgcattgttgattattttggtttgtaactttcttgaaatattagaattctcttgttttttcgtattattacattatttagacttaatgttttcgaatgataccaaaaagataggatttgttcgaacatgaacaaagttattgtataaaaacacgggattgtcaattgattggactcataaaatacatttggactcataaagtgcaagacccaaaaaaaaaaaaaataagtttttagcttagtttctggcatctaggacctattttggactttttgtgcttaatgcttggcacctatttatgcctttttaggtgtctatttcacgattttttatgccgaaaaaaacgaatccttaattatgaattttatacggaccaaaaatttaaacacataatgaatccaatttgtcgtaaaagttttttcctaccatatttactgcaacgaaatcgacagtaagtttatcgctacagtatacgtcagcaaatcaatatatgcaatcaatacacgtaaaaatatacaacagcacagacagacaatgcaataattattccacaatacatattgtatatcctaaaaataagcatcatctttacatcatcatatatcatatcatccatcattgatctgctgattatgggcggcactttctgtcatttgccttcacggaccgacacggcttcttcggctcggcttgaactgttggcgatgaatgaagcggacttctgctgcttggtcttcttgtacgcacggaagatgatgtgttcattttagtctgcaattgtttattgaatttgagtgctttgctcaattaaacaaaataatgtaaatttagaatagcgttcgtggaattattacaattttttaacggacattcctggcgctaaaaattaggcaacaatataattagggtatagaactaggatggcacggaattccgatattttttggtttcgatttccgaaaatttttgggcctcagaatgccatccctggtataaagattggtaaatcagatttttcgggattttacatagttaatttgaattaattccatccaatcactaattttcgacactttctccgcttctgtgtgaatgaggccccgttttccgattttgttgtccgtctgtgtaccgtcagttgtttatttacacattcattatatattcttctgcccatcgtcgtcaccaccagccattatgacccccccccccccctccattgtgtgttagtcattcgagaaaatttatggctcgatggaacttctgccggtcgcgaatgaatgggacgaaaagagggagggaggaaatgaatacatagcggtcggatgagtggggcttatcagcagccactgccacagcgagaaaggcatttggccagattctcacacaatggaaaatttttcgaaaaattcatttggtatgtaacattagaataagaaaggatcattttcggagttttaccacttcctgtgaaccgactgagccgaaatgacattttcaatttattctttctttgccctcctttcgatggctttcggcattttcctccgattaattaaatttccctctctccttatttttgttcgtccattcctcaacaactttacaacaccattgtcttcgtcgttcatcgattaatgtgtgtgtgtgttgtgtaaatggggcattcccaccacattccaaacacaaattcaaacagtccagcaatcaaatcctcccattattataattccttattaataattcggactattgacattctcattgtcggtgacaaaattccccctaaatttatcatttaaattgtgtgttaattaatgagataaaaaacccaattcgttttcgcggattcgttttttgtctttatatttatgtaggaatgccgacagcgaaaagtcaatgtaaaaaacgaatccgcgaaaaacgaattggggttcgttcaattaatgacttagaaaacacaaatcgttcacagcgaagcaaactaaatttaggtaattctattgttaaaattccaattacactaatttctttccgtttcccatccatttttaaagtttccaccggccttttaaccgttgcgaaaatgattaacgagcaaaacaaaaaaaaaattgtcactattttaatcaatttttgtgtgcctgttcattttcgttaattgcctaatttcaaatgcatggctatccttatcagaattattcgcctggtgaattcaatttccattttaaaattaaatttgaattggatctctctttcgcttcagttttttattacccacagtttctatgtttatgtttgggcagaagttttaatttaaaagcgcgtcgatcgatatggcaaaaaaaagaaataaagaaagggagaaaggcttttcccaaaaggcggaagagagagagagagatggtgtagagcaagcaacaattccttccacaaattggcgaatgaatatggtttaaatttaagatgggccccgccggtcggttgttgttgcattttgcattgaatttgttttcctatttttaatcaattccttaattatttaataacccatattaatttaatttattagcggtacttatactgtttaggccacatgaatatttttctagcgaaactcgaaaatttgaactttcgattttttgttcgaattcgggtcaggggttcggaattggtcgaaatgaatgtcatattcgtgatcagcgaccccaaaaaccccatggttacattttttgtgtcattaacaacaaaaaaatccatgtggcctaaactgtataagtaagtaccttattagtagggagtccaattatatacacatgcatatttttttcctggactgtgggaggcctgaaacgcacgaaaaacatgtttttagcgtgttttgaagcttctaggatgactttccatatgcatatttgtgcatatttcgcgatttatgtgcatattttggcatttcgtgcatattttatgtgcatattttggcgtttttccaaaaaacctctaatagatcggcccccaacagacaaattggcctttttgacctcaaaaaccggaaaattttcccaaaaaataattttttagcaaaattttcacgaaaaatattgaataaataaattttctcaaaaaatggttaatttatgtncaaaatacgcaaaaaaagcaaaatttcgctttttgagatggtttttcgcaaaaatgagtaaatttttgctttatcatgtttttttcttctaaaatgatttttaataccacattcagccatttttttgagattttacttaatatt

SEQ ID NO: 13017 - DNA, 3548 bp, Heterodera glycines
catggaagactgtctacagaagtttttgtataatttgcttttggtctatatataggcaatagacaaaaaatattcttgagtatactcgaaaaattctgaatcccgattcttcatattgcattttttccttaatgttagcattagttattttattaggtttctaaattctagatactttaagctttcgtttaataccaagaaaataagatttgaataagttagaaaaaaatttttatagcctaagaaactatggatagtcaatcactgattggacacgtaaactggaatagagccaaactttaagtaaaaagatcaaaatattaatattcaaatgaaaaaataaaataaattttgtcaataccaaatttaatagataatattaaaattgaaatataactattttctttcattttataataaattatatttattgcttaaaagtaaaattttcaatttcaaaaaattatttgttattttattttaacaaaaaaaaaaattcttgaagaaaaaagatattttgaatactatttctggtttccatgtctaatttccgtcactctcatgttctcaatcattgtgtttaatggagtcacggttacactttgagatgatgtttgtgactgggccacaaacctgaaaaaaaaaattaaatattatttttattaaaccaatttgaaaaagatttaaatattatttcatcgtattttaaaagaggaaaaaaaagttaagacaaaaatgttaagcctggtccaattttagccccccaaaaaggctaatgccggacttagactctggcactaatcccgggtctgtccaatccgatttatcttttaaattatcgatacaaaaatgaaaatttgttttcttgactgtcccaaatctccaattttatttcaataaattatatttgtttttaaatttaccaaatatgatggactcatcgtatacgcttgggtgccgtcacaaaagtcctggagacagtaacaaatagccaatcaatatttaggtactgtaaaatcgcttttacccggcatgccccataaatgccaacaacgccatggtcttcgcaacattcggtgttgttatgtccgccggtgtaacacttgataaaatctttaataaaaattaacaaatagtaattaattaaaaatttttaattcaatatttacccgaaatataagtcatcatacacctaagaaaattttaaatttaaaaagtgaaaatccaatttttatttttgttttaccattgttcagaaaatgaaaaagcaggtggtgggtaagtgcaaactaaaatatttaaaattcaattaattaatccaattttttaattaattgtaccctctgagcatgaaatttcattgtccttgcagcatttcataaatttgtctccaatcaaatcgttgttttggaattttggcgtttcgttgggcccattctttgctgttgcctcataatttggcaaaattgcgccataagtgataaatgaaagcagagggaataagaaaagcaaaactttaaaattgaacattctaaaataattttatttaaataatttataaaaaagtccaaattttattttcagattcactttttaattttaaacgttcttattagaaagaaatttaatgaaaaaatataatatttatttaacaacataataattagaactcattttaaaatataattcaataataactgcttaatagccttaattaggtgctaattatgttatttacactaaatactcaaatataaatacgcatttgttggcttaaaatttagaaataataattctgattttaacgagaaaataattaattattaaacgatgaaattgatgcttgctttataaacaaataaattaatacacaaaatctctctgttttcggccgaatatcgcggattaattgtttatcatcacgatgagcagcagcaggcatcggccgattaattttcttcccacattcacaatgcataaaataaacatttgtcagggggacttttatgtattttgcactcccattaaatagaaaagataaaaaagataatgaatggtcaaagatgagtcatttaaaaaataaaagtattagaaaaatatattgcaaataacaaattgacttattattattatcagcaatccaatcgtctgatatggtccgacatgactaatatttgaattaatcatttttttattttgacatcactaataattgattaattttttaattatccaaatttaaactaatttttttttgttaagaaatattaataaagcatttgaattctatacaaaacataatttttaaattgtttaagtgattaaaacaataattatatttttgattatttgccttcattaaaaattggactaatacctaacagacaaaccgtccaagattaggaattaaaatatgaaaacattttaaatccaactaaaaaaaaattttgttaacataaataaaatttaaaaaataaaatgaaaagaaaaagaaaaaaataatagaaatttgcactatctctctgcaaaatgggttctttgtttcgtcatttctctgctcaacactcaattaagcatggaaccggtgcaacaaaagtgcagtccgtggcgggcactggcaataggcaccgtcgtggcccggctgtccgggcaggcctggctgacccggctgtcccggcgtgccggcagtgccgggctgaccaggcgcacccggcacgccgggcagtccctggccaccggggtttcctggctgtccaggcgcgccgggttggcccggaggtccggcattgccaggcagtccgggtggtccaggcacaaaagtgcttaacaaaaggtttttatagtgaaaatttgggattaggcgccggctaacatccctagtcccctcactccctacctttgtgttgccgatgcaccgggttgtcccggctgaccaggcgatcctggtgggcccggcactcccgctgggccaggcgcacccggcggtccggctgctcctggtccagcggattgtcccggttggccaggcgtgccgtcattgcccagtgtgccaggctgtccttgggctcccggctgtcccgtcggtccggcagggcatttcttacaaaatttaatttaattttattgctaaaatattcattttaccatacttgacagccgaccgctgcggcaggtgggcatggcccgctttgctgtcccggttggcccggctctcccgcgtttccagggcttcccggaagcccaggcgtaccggctggcccgggtggtccaggaggccccggtgggcatttgggctgtaccatgttcatacaggaacaatgctcttcaaaaataaaataaattattaaatttttctcccacaattaggccttaatttgagggtacatataatagactttaaagaagggagaggaaattagtcataaattgatttttatgaaattcatgaaaaacttgccgtatttcgcccaaacttctaaattggtttttaggcaacgagttaatatttgttcatcataaatcggatataagcatttttacatcggacg

SEQ ID NO: 13018 - DNA, 3494 bp, Heterodera glycines
gatcagcattccggcgcacagggccaagtaaatcatttaagaattttttttacatttttcatgtcaattttttcatctttttttaatatttttgtgcagaaaaacatgtgcatttgacgcttatttaaattaaaaaagtgcgtgttttcctcgttccatccaatttgaaaaatttttagccatttttggaaagttttttgaaaaacagtaatttatcataaaatttcaacaattttcttttaaattttttacgaatttcttctcccccatttccccatcagaaagaaagcattttttcctgtaaaaaacattttcgtcctcagttggaccaccactcgcaagctgttcggcgaccagttgggctggccccaattcagcgcccttttcttcgccagtgcgctgcgcggcgacggcatcgatccgttgcgccaacatttgcgctcggtggccaaaggcgtggacaaatggcgcatgcgcgcgaaggacattagcacatcggtcggtgtgtgtgccctcgcaaataaatgccgtgccgaaattaataatgctatacatatttaatttaaaaaataattctaaatttttctaaaagaaaatttaatatttttcaattttgtttggatttttcttaaaattacatttaaaactcgcaaataatgccatgccaaaaaaaatgctatattcaattttaaaaaataattttaaatttttctaaaagaaaatgtaatctatttaatttttttttgaatttttctttaaaaataaaataaaatattttcctaataatagaacatgcaaattttcatatattttttcaggcgacattggatatactttagaattgagaattccaatcaatctccagtgaccactaatcattaaaaaaatagtcccgaggtgcgcaaaaaccagaaaccggtttaaatcatgaaaattgcaccaaaaatcagccaaaaacacattttaaataaaaaaaaattttttgaacatatcggttcgacttcatcacctgttttttagacttataattggtctcatcaagagctttcaaatgataccaaatttgctggaaaatttatatttaaaatgggttttcggctgattttggtgccatttttgtgatttaaaccgattcaatatccggttttttggttttccacaccttcaagtgtttttataatgattagaggtcattagagatagattggaacacgttaggtgcggcttgccactatttttcgtatgtttacgccgcatttcactttttttcctctccgcacaccattattccgttccgttttgcacaggacccgcgcatgctgtgcgcggagcacacgcgttccgcgctgctcaaccgctgccccgcgtacattgcgtacgcgctgcgcacgcgcatcaccgagtgggaggagtcggagcgcggcggcgtgctgcgcattgcggtcgacgtgttctgtgagttgattggcaatggatgcactcactcatttggcactcgcgaattctcgactttttttgagggggggggggagtcggtctcgacttccgccctcattttggttacggtcatttatttatacagtagccaatttggactcctttttaagatccaatttgatcgatcgaaaattcatgccttttttgtttgcattcggcgccaagacaaaaattaaattgtgccacataaattattcccatcagtcaaaggaacatcacgaactgtgagtgtccaaatcgctttgaaacttttatcaaattgttgtgaatggaataattaaatttaattaaaaaacaatttctttttgctaattgttattcgctccaaatattgtgcttaaaaataaagggatctttgctgatcattttgaaaaaaagtttatcggttttttggaacattggtcgattttttgcttatcatttttggctccggagcaccaaaaaaagccgaaagactctcatattcgcaatgttcccttgtaagcgccagccgggccttgaggcattcgtgccgcgctttctgttcatttgcttaacgcactcacatttctcattttgcctacaattaggcgacaaggagcgctgggtgaccgtggtgggcagtgttgcggaggaaattgaacgggaactgtgcgaactgatggcccggctgttcggcatgccggtccagttccgtctgttcatctgcggaccggaccggaagcggcgcatcgtcttcaacgatggcactgaacaacaacaacggcatggacaggaaaacgttgacggaacgacgaatggggcgccgagggccaccgcgaaaatgggcgccgccccgaggaggaggcggatggggtgggagatgtcaacatgacatttgaacagcatgtgctgcttgggcatgttggtggaggtggtggaagcggagttggtggtactgaatctgcggcgaagcgacgaccaaattataccaataaaagtcgaaaacgtttttgatttctttgtttgttgttcttacaatttatgcgaaaaattttttatatttaataaataaataatatgtttaattaaattattcgtcctcgcttttttgagttttatactacgaatttaaatttgcagtttaggccacataatttttttttgttttaatgataaaaacgtgtttctgtgggtattaggggccgctgatcacgactttgacatccatttcgaccaatttcaaactccgggcccgaattcgaacaaaagtcaaaaattcatatgcgattcattgccattccatatgcatttgaatcgtttaaacaaacgtaaattcgattgcggaatcaattatttagataaaaataaaagtatgtattaatccgccacatacaggtaaatgtgtgtaaaatggcaaatgttaacaaattggcataaaaactgatcgatcggtccattaaaaatcagtgttacggtgccacggttgacggctatttgttttggcaatagattatgtctccatcctcgatgccgtaggaaaccagagttcgcttgttgtccagttctcccacgcctattcaaaataaaaattcaacatatttaagtacatgtttcggaattttaagttcaattattcaattataagtagggctgggaattttatgcaattctacatcttttgaggtttttgagaatattttttaaaattaaatttgtttgagcttttttccctaaaaattggttttaattcttaaaaaatatgtattaacaaaaataattataagaccgtatcgttttggcgccagaaaaaatacaaaataataggcgagggtagtctgagactttgtctattattttccctatccctgttaaggaataaaattgtgtaaaaaattttgaaatttttctagcttaatgcatgatttttaatcgtgcactctatcactttttgatgctgtttatggtatttggtagagttgagcgggaccgggccgggaattcccggtcctccgaggtcccagtcccggattttgaaa

SEQ ID NO: 13019 - DNA, 2547 bp, Heterodera glycines
  misc_feature (1344)..(1344): n is a, c, g, or t
ttttttttgactagtctctgaatggggttatcccagttttagtatcctttttgaaaaacaacaattttaataactgatacggtagcccaacatccattgccccaatgtactatgccgaggccgagctgtgcgcgaaccggcaattcggaggaatgcgggagcagcgagtgagtgacaggggggagaaatattacattatataatgagcggaagagagggggggggcgagcaatcggaggaatgacagaagggacggggaagcgatcggaggaatgacagaagggagggggaagcgatcggaggaatgacagaagggatggggaagcgatcggaggatcagggcggcgactttaggatcaaaggaggggaggaggactcacaaataatattagggattaattttgtttaattataaaatattttattattgcaatcaattagtaaatgagaaaaataattatggatccaatctgtttttaaataagtcaaaattaacagttatttgtggtgcgactcgcgaacaaatggtggtcacgcggtttgtacgtcaaagataaagcccggggggaattgtgccggcttcgaatggagtgccgaagtgtgctacgggggcagtcaatgtgtcgaagggcggtgcacaaaggcaaaaacgatggacaaagagaatgacgagggaaaagcgaagaaaatggacgacgacggcacggcatttaggaggggcggcgccgaaaggggcgacggatggcattcgacgatcagttttatgaaaaaacgataaacaaattggccgagacaaaagccattctatctgatgctagtgtgtttaattgtgatggagaaattgatgaaatcccaatttttggcactttaatttaaaagtgaaccttttcaaagattcaataaaatatgggctctactgcattttacgcgtccaatcgacttttacgcgtccaatcaaaaatttatgtgtccaatcaattattagaaattatttaattatttaaaatattggcattaaatgcttaaatgtcaaaatgaagactttgattaatacaacgaaaagatgattagacagggtattgaatacgtatttcttcgagaatttgctgaaaaattttttcgttattgttagatctccgaaacatatactgatacaaataagattgtaaaagctcggggttagtgccctggagatgacgaagaccatttttcactgcacgccaagttgcctcaatgccctgtgtgtgaactagtgtgtcttgagatctattattaaattttataacaattgattgaatgcgtatatacctatcgatactttgataataagtagggcagcaactnttagtgaaaaaactttttttttgctcaattgttttgaagaaaggagctcaaaaaacgcatttctgcgttaaaattttttcatttggacgtcacttttcgtcactagaaatcacattttggcgacttcgtcactaaaatagttaaaaatcactattttggcgttttgtcactttttttcactatttcgacattttttggaaaattccttaacaaaaatgcaataaaaccaaaaaatacacccctaagaatcgacctaaaaattttttcaaaaaatacacccctaagaatcgacaaaaaaaatttcaaaaagcactcctaagaaatgaaaaaaattttctcaaaaaggtattttcgtggcaagaattttaattttaaaaattatttttttatgtacctattttgtttttttgcccttaaaaatcccagccctactcatttgcaactgcaatcagtgaataaaaattatttttgctcaatttttggctgaaaattatgtcactattttggacttttttcactattttgtcactattttggcactttttcgtcactattttagttaactattttttatttctcttggtgttacgttttaatatttaaattattatttctttttgcactggttggtaccttatgtcaaaaggatgttcgatttaggaaaattttgattggacgcgtaaaatgtagtagagccaaaatttttattgtatgaaatgaaaaatggttaatatttattcaaatttgtatttttcaccggaatggattttttccaacatttttttgttttcactgatctttttcctaatttgcgacgacttttttctgctttaaagacgctattttttgcggcgcgcttcttcaaaaattttgtgggacaggggggggtgccgacggcgccgataggcgccgccgggaaaaatttgtaatttttattgcgattcatttacagatttttgtccaaaaatgaccaatttgcgattttgggccaattttttaagaaaaatagtgactttatgtcataaaatttcaaaaattctcaaccatgagaaaaaaatttacatttttaatgacataatgccataatttaaccaaaatattgttgaaaattacaaatatttcccaaatttctttgaatttatttaaaacttttccaaatgctcatttccaaggacgtccttggcatccaaggacattttttat

SEQ ID NO: 13020 - DNA, 999 bp, Heterodera glycines
tctcccttattattatattgttatcactcttcacacattttcaatccatcattattcattcacccctctctcgtctcctttccctcctcgccccccctaacccccaaaattttcccaatcaaatttttgtcggcagcggcgctcgtcctcctccgtcactcatctcatcaaaatggtagcaaaatgtgtccatgttcatatttcctcctcctgccgttttctctcaatgtgtcgctctgttctcgtaccactttcttctttctcttcccccctcccatttattctgctgtattatttatgtaccattttcaaaatttgggggtcataaatgagactcttcctctatcattatttccctttaattatttttacaaataaaacaaaaattttagttttttttgaagcatatgactcactcatttgggcaatggctgcgaaattcccgagataacaataagcaaaaaagcgacaaaataatttcaaaaaataaaaaaattgtgcattttgtaaatttttcacattctcgagatacaccgatcgggttcgcaactgaaaatatttctcgattccgagaaaattattccccactcgagacttttggccaagtctcactctagcaccatgtaaatgaattgatgtttaattttgcacaattcgttttctttgtgccacttatctgactcatttcaagatttattttacatatttttaagttccaaaaatttcaaataatatcgtagaaacctggcgtttcgcattccactttttgtcactaaaaagacccctcccttcccccccccctccaatataattgcgctctgacaatgaggcggttcattcattcatttcttcgtcgcccttttcaccaccgatcaatttgttctcctcctcttcctcctcatcatcattcactcttttctcttctcatcacatcggtggcagtacacatagatctcactaatcaccgccacaaccaattcattcatttgttcattcatt

SEQ ID NO: 13021 - DNA, 738 bp, Heterodera glycines
  misc_feature (87)..(87): n is a, c, g, or t
ttgggtgcgggtggaatccgccgggcggatacctccccagctgcggctgctgttgttgcgggtgctgtgccgatcgtgagaagcggngcttcttcggcgtttccatcattgccatggcattcggtccagcggcggtggcgttggccgaagtgccggaaggcggcggatgaaagtcaatgggcgtcgaagtgaacttcggcttgggctcgtcttcaaaattatattttaaaattgcccctttcttggtggccttttcatttctattttctatgtgaatggaaattccatctaggtatttgacatttttttttaattcgcctttctttggatgattggctaaatttattgaaaaaatcggcacacacccagttttttaaagtgtaagtcgtttctttaaaactgccgtgaattaattaaatttgtaaagttgttggttgactttgttttgaattttgggcagaatttttgaaattttgcaggatagtagagaagatttaaagcacatttaatgaaatgatataaagaatttaaattaatttagttttgagtcattaaaaaaatgccggtttttacgaaacatcccagaaccacccatttttacggcaaaaatcttagagcttaattttacgcgatgcccaatttttccaacttataaaatctaacacttaaccagagaaacatttcggcggagggggcggcgggggggggggggggaggaatcataggagatttttgaga

SEQ ID NO: 13022 - DNA, 3429 bp, Heterodera glycines
  misc_feature (3390)..(3390): n is a, c, g, or t
attccagccgtagtcaccaggcacagcgccggcgaagccgtgttaaaaaaatatatacaatgaaacataacaataatcaggggataaaaaatattttaaaattctcttataactgatgcctatatatttgctataaaaaattttaattaaattaataaaatttgaatcctaattaaccgacctttggcgttgtgtagccggacggactgtcgccgccggcgccgccgcctcctccgccaccgccgtgcgctcgaatccactgacttttcttcttttgtagccaaaggcggaacagacccgagcaaaaagctaaaatgaaaatttttttaaaattctgttcgaattttgcagcgctttaaaatgtttccaataattaaatttaagaaaaatccaaaatgtaatattccaaaatttttactgaagattaattgccaaatatttaatgcttttttaccgcttgccacaacgcggtcggtgtgtgcttcgatgtaataaaacagcagcaaattgccggtccgaaactgttccgcaaatttgttcatctgatcctgctcccaaggcgagaagtcgtccttgtcacaaagccatttgcgaagcacctgcgattatttttgaaattaaatttaaattttttaattttcaatttcgaacccatttccgcctctgagttttcagcttcatgcgaaatgcccattccagccaaaacatcaaattgccaaggttgaccacagtgagaaatgcaagcatgaccctgcaaaattaaatacttattacaaattaatcaattttaaaatcggactgcactgtttttaaatgattagaaagtcttttcagaagatgaattgtgacatttaaaattgtattttaagggtctattgaaattttatttatcgttcattacgcacccataaagctagctttaaaaactgttgcttctatagctagaaatggaagaggaattgaatttcacgcttttatggcgcctagaatttcctggcgctgaaatggcagtgtacccaatggttattcccttattatctaaataattttcatgatttagggcgccttgaatttattggcgcccaactggtggcgctcaatattcagtttccgttaattaatcccccgtattttgtccaccatgtgaatagcgcggtccgctcgtgccaattcgcatccaaatagcagcggtaggtcagcgtgtgggtgttgcccagcgacacgtagttgtagtcgcagtaagtgatcctcgggattaacggaatgcgcggcggactgcgctcccagtcgcgcaacggccgctggaacagtcgctgctgctgatgctcgtcgacggcgcccagcacaggcgtaagggtggtgccatgcctgaacaggcgcaatttgaagcaaagtaaaatggacagacagtgcaatgaaatttggaaaactaagaaattgaataattcaaagcaattattatttttaaataaattattcatttaaatttaaaaaaataaaattttaacaaacaaaagtattaaaggtgtaaaattagccatttaattgatttaaaaggcatactaaaataaagtacaactaaaaaaacttaaaataaaataaatataaaatccctttttaatttttaaatattccttttaaataatacttttaaacaattttttcaaatttcaattctttaccattccttgcgttcccaccacgcccgcgcaacgtccaggccccaggtacggtagccggcgccgaccatcaacggtaggacgaacatcagcagcacaatgggagcaaaaacgagtgaaagctcgaagaaaatgaagcctgaaattataaaagatttaaataaattttaaaaagcgaaatttttaaaaattcgcaccggcaaatgcacgtgaataggtggccactttgaaattgtccgcaatggtcggaatgcgctcgtccagcttgtcagtgtccacttccatgatgccgtcgttgtccatcagcacattctgagacgcgttcacgacattgttgaaattgatgcctgaaatttttgggaaaaatttaaattttttgaaattgatacttcaattttttgaaaaatattatttaaattaatttatatttgaaacttatttcccttggttttcgagaaggagtgaccaaagaaaagcgtgtcatcacgtacatgacgaacacaatgggcgcccaaaaccatagaatccactaaaacagtgatttgtttaaataaagaatttttatttaattttacattttttatcgcttttgtcttgtgcacaaagtataaatttgctctcagtttttttaaatgtttttttttttttgcattttgcagaccgataaaacttcagaaggatttcattttaccaaatacggtattgcagtatttgctaatccatcgaaaattaacccgagtaatacaaaattccaattcgagaaaataaacaaaatttcaaatttaatatgatcacccacctccggattcttcacttcccgctcctcgcgccacctgtgctcgtacgagaagggctcttccggtgccacgtaatacctcttcgcggtttgacagtgccgttgcgcgtcatcgtccaacgttgtgccggacagatcgtagatggacccgctctgaaaggagggcacacaatttaatggaaatattttttaattgacaaaaattaatgtattaatggcaaaaaaattttatgtagataatttgcatcgcaatcttttatattatatatgttttttgatcataatatatatttgaattgtattgatatttgtgaattacattaaaacataattttaatatatttttagtttctgtgtatgcataatgaatgataattataaatattaatttattgagtctttaaaaagtgtacgatcgctcactcacccgacaaactgattcttcgagcgcgattttcgatctgaaattagcaaatacgtaaaaaacaaaaataaaacaaatggatgaatttaataattttatgaattaaattcaaataattccaaataggaatattcttgttagattaataaatattttctttataaattatttttgtgctcccccccccccctttcttctttttctgttcacaattttgttgtccaaaggccggcgaacacgagaatggtgaagccgggcacaatccacagattgcccttgtccattttgtcgccaatgccatccttcaccagaccacgtgccaacttcttcattcggccccccaatgtgcgtccatccctttcggaagatttctgtcccaagaatgggtggaaccatcggcaaatttgggcgagaataaagcccaaccactgaaaattgcaaaaaatatatattttttaatgtaaaaaaggatggcatgagagaatggcaanataatatattaattttaaaatatcattagaatgaaaaat

SEQ ID NO: 13023 - DNA, 2741 bp, Heterodera glycines
ttagtctggacacacttatgttaacagggttcatttcctccccgaaggacagataaaggggcaaacaagacaatttaataaacatttttgtccattttcaagtgcgtccttgaaatttaagggggccaaaaaaggctgaaacaatcttaaaacattattttcaaatttttcgatgacagctaaacagataacaaaaatgctcaagattcatctgttttcaaggacgtccgtgccatctgagagcaactgaaaggatcaataattgttttaattttttttttggggtttttctcatatttttataaaaatttgttcattttcaaacacgtcctttccccattcgaggggaccaaaatggacgatgaagagaatattttacaaaaaatttatttagaattttatttcgacaggaaaatgttcggcgacccaaacgcaatcattttgtatgtcaatcaacccgacctgttcccggtgtgccactttgagcagctccaatttgtgatgttccaagtggaaaagctggccaagcaggacggtaaccatgtgctggtccgtcgggcgtcatttattgaactgcgcaaaaggtgaacaaatttggaaatgtctcaaattgacatccaaatgccattcgagacagggccacatgcttagtaaatagtcagaaatttcgaaaaattggggtcaagatacaggaattgaatctggatcagattttttaatttaaccctatttttgcggtctcatgaccggatcagtatcatggaaaaaaaccctatcatcataatctatctaaactgtggccgaaactttattttaaaaaaaaattaattaattgcactatttctggaggcagcaaggatagcctcctcaattgcccttattatctaagccattggttcatgatccacggatcacttaacgtggatcgaaaaatctgtaatcgaaatccgtatgcataaagaccgttttggtgatcccaggctcacgatccattgttctaaggatccgatcctcgtatcaattttaatttttttctgaaaaaaaaaattttattggattctttgaaaacctaaaaattacattaatccgcagccgaatttctatttttgtttagacttagacttgacgaggccggcgactattcactgtattttgacggtaccaagcgtgttgcattagttcacatggcctacggttatttgcctgaacattatcctgagaaggactttgacctgcgcgtgatgatggagcgttcaacagctatcgtaaaaatttaaatattaaattgaaataaaactgtactaccaaattaaataataaacattaattaatgttaatccaaaaagagttttaaaccaagaaaaatttttttgaggcaaacaaaaaaccaacaaaaaaagaattttgtggcgcccaatttttttttataggcctatgcaaaaaattttgatttttgattttcaaggctaaatgatagaaatttaaaaaagtttcgaccttaactcgaaatatttttcaaaagatctatcaccgacttaaataaggaattaacgaatgttcatccctaaaagaatgttgacttaagaaaatttacgaggctaacaaatagagaaataaaaagaggattttcgcatcaaataaattttttaattgatttttaatttccaatgttaaaagaatataaatttaatttattcgaccaaaaaatatttaaaattattaattaattctattaattacttttattcataattatcttctaaatattatttagctgtcgccaaaccttcgtcttcaacttgccggaacgaagaaaatccaacaggtgttcgctggaaaatgatgccataaaattaattttattttttttaagattttgagcaaacccggcacattggaacatttcttccccaacgaccctcaacaggtggccaaaattcgaaacacattcaccgaactgtggggcctagaggagaatgatgaaattaccaaggcggtgattgtggtaaaaaaaaatttgaaaaattaaaaaaaaaattttaaatgtttaaggacgccatgaaaaattgccatgactatgtgatgaaatcgcagatggacggcgggcatggcatttatttcgatgaagaaattccgaaaatgttggccacgttgagcctggaagagcgaggcgcgttcattctgatgaagaagatcaatccggtggtggccaaagtgggaaattcaagtttaaaattaattgtatataaaattaaaaggcgaaaataaaaattatttaaaaatatatttttgaagaaaaaaaaattattaaaaattaaatttataaaccaaaaaaattactaaaagatatatttttaaatattttatctaccagataaaaacagattttcaatttgaccaatttttaataataaaatattttttcctaattataataataattttaatttcaaaaaataaacaattctagaacaaaataaattttcatgtttatatttagttttaattcccgtaagaataaaatatttctttttaattctcgaaaatatattaaatataaaaataataattaaaagtatcatgtgtcttaattataatattttagtgtttttgttcctaatttttgctcattattaagaacttcatggttcgcccgttcgaaaagccccaccaagaggaagtgaacagtgagatggccatatagaggcgcactgatcggtgatcagagtacgggaaaagtg

SEQ ID NO: 13024 - DNA, 1240 bp, Heterodera glycines
aaaaaaagtggataatttttttggtcaatcactaaattaagtttaaaaaaaattgccctaaaagataattggtgaagatttagttagacaagcccatcaaaaagcttaaaaataaccaatttttgttaaaaaaagtccattcgactaaaaattgtaaatggaagttgacacaaattagcaataaatgtttattctgataaaatattttaataattaaaaatgtatggcagacaattcatttgatgcggtcaattcatgtaataatttttgtttaaatggaaaattaaatttaaaaaaatgatttgcggtgaaaaaattggctatattttgacgaattgttaacattttgaagaacatgtgaaaaatgctgccaattgtacacggattcataatttttttatgaaattaaaaatgccattttttaaaaattaatttaagcaattaaatttaattggctcaattagcagctattcttgatcataaatgattgattaattgattgtgtgtgtttttggtgtgatattcaacggaattcgcttgacgggaacagtaacacggagtcgatcacgccactgccactgcacacgccaccgtggttctgcgaagcggcctaaatgtgtgtgaacgtttagaaccatcattaatagaggatcattagttaaatttttaattaaaagttaatcaaatgtcaataaattctcttaattgtagtcccagccgattagatgggctttcgtattcaacgcctaattaacacctaattaaggtcattgtccattagaaaagggaaaagcattaccccaacctccaccagataaagatttcttaaaatccccaaaattttcccggtgccgcaaaaaaaaaggatcatcataggggaaaggacctatggctgagctaataaaaaagatttttgtatttcaattaagtcttattacaatttaaaagaaaataataaataaaaatattattgatacctagtctaattaatggaagaacaatagaattgacacgtatttgctaatatacatttaaaaaaataaattttaatttaaatagtcaaattaaatttatttttttgattaaactctgaccttgcttcgcaccaaatgcccattcaccgagttgaccagcacttttcccgtactctgatcaccgatcagtgagccatagatgcccatctcactgttcacttcctcttggtggggcttttcgaacgggcgaaccatgaagttcttaa

SEQ ID NO: 13025 - DNA, 1782 bp, Heterodera glycines
acgtcctctacagaaagctgtgctcgaagaagtcgcgactcgattggaagaacacaaaggggatgagacgagcgttgaaagtcaggctgaggaagttacgagtacgacgttgcagcgtggtctgcttcagcacgaagtgggaggaatggaggcacagcaaatggttgtgggtgagcaggcgcaatgcccatctgctgagggtaaccgtttgctgtttttaaacatttaaagaaatgagtaaataagcgtttttaggtgttccgcatgccttcctttgcgccgggtgtcagttccgcgcggattgtgccaacttgcttcgtgccatcggtgctcttttgaaagacttcggcagtgctgcatctgttgacggaggacgcaacaacgggactacctaaaagacataacgaatcgtcataaatatcgccaccgtattttaacactgaatttgtgttctagatttccatttaattttcttagaaaatgtttgtgttcttttatcaatttcctgagttttcataagaaatacacagtacgctctctcctaagtattttgcgttgttttgtttacattcaaaagacatatcttcattttttgattcttttttattatggtgttactcggagtcgttatgaatgttctttgttttctcgtttggcttttcctttttttggagttttctttggcgcttgaggcgcctttgtgggttattcaggtcgttgttctcttactttttgcaaaatttccgacaattttagcggaagcgggatttgtatgagcgcaattccgtatgcatggacacacaacgaaaagaaattgaaacatttggaatgcagccatttcatgccattgtaacaccggcgaacacgacgatttggctcaaatgctcccagtggtaagtttcagcgcatttttaattggatttagtctaatgtccatttaatcccaaatgaatttacagcttgcatccggacgatacggaggagttggaggacgtgtggaagcccagtccttcggtcattggaagaaaaatacaacaatttctcaaaaaaattcgtgaagtttgtcactttctgtttcaaatttattttaacaattccagaaaataatacgttctaaatcgccttacgcaaaatctcgccgtgtaaatctggcaacttattgctggcaaaagttgggcaatatcaatgaaaaggacacatcgaagaaaaaatgggtaactataaagagcccaacgtttcagaagacaggcggaagggacaaccaaacggaagtgaccaaattcgtggaagagtaaattggactgaattgagtccacatattcgattttttaactttttaggcttacgaaaaaggacgacgagaacatgagaaatttttatctcggggaccattttgagttggaaatacgcaacattgacgctgcaaaaaaaggatggtatcggtgtcgcaacttaactggaaactatgccgaggacatttcgcaaatttatcatgtggatatattggaacactttcgcactgttatggtagaaacaaaattaattcaaaaaacaaaatgcatgcaaaaaattcagtactcagtagaccaaatgcctgatgaagtgaagaaagccgactttgccgaacgaataataaatgaaaatccgaaaattgaactgttctggcgtgagagtgagtggacgccgtgcaacatgtgcgggcacaaagtgggcgaacaacgccgggtcaaatcatgctatttgaaggtagtcgttaagactgcgtgggggagaggggggggg

SEQ ID NO: 13026 - DNA, 1485 bp, Heterodera glycines
  misc_feature (19)..(19): n is a, c, g, or t
  misc_feature (42)..(42): n is a, c, g, or t
attgtttttactactaatnttgttacataattaatgcgaatntcacgaaacggtttttgtttctcccaatataggaaaaaagaaaatcgtctaaccttgacaaattactatagaaaaattaaatattatgacgagatccagagtacctgatttcggcttactttacccccactcttgcacattttgatttaaaaaacgatgcctgaattcataatttttaaatattaatttttaatacatgtcttaatttagcgaaagtgggctgtaaggaagcaagttaaagtcccttatgaagttttttcgttattcggtgaattgccatgtcacagttcgttagtgcctgaagaactgaagtcaaaattgggaggaaatcttactttctacgaggaattcgccgaatgcaaagtgcgtttataacaaacacattttaaacgtgaaatgtccttcagaagccgtgcaccccatcaaaacaaaatagcgaagaagtgcgtgaagtgacggtaaatgagacaggacatgcggaagtgctggacgtgttgccgccgggagagttcagcaccaacgaacggctgcccccattggcaccaccgatcattcggagaacaatttttgtatgtttttcgattgatgaaaatgcataatctgttatgaacggtgaattttaaggcaactgaaggcgactggctgatgatggactgcaccaaccaagacgcgaccgcactgatttggcgtaaggaattcgtcgagctgaatgcgacgcgtattctttcgctggaggatgggaaggagaggcagaggcgagtgatcacttctcgtgggattttcgtcataagttccgctcgacttgacgatgccggactttactcgtgagtttaccaagtttttatcacgtctaccaagaccgaaaaatctgatgttcaggtgtactgcgtatccaagtgggcatattttgcgtacctttcgacttttcattaatctcggtgatcggtctgccgaagtattggctgctattgcaattgttgtgcgaacattgcttatctttttcctattgctcctcatctttgatttgttaaatgtgaaaattccgaatgtatgattgtgaatcttatttatcatctgaatgtttttcccgaaattgttttttataacatgtaaacccataaagtgctccaagtatttccaaataaaaaagatggtgtaccaacggcagtataaccgaaaattaattttttgaatttcacattcttggtctcaatatggcttaccaaaacggaaatgataagccttatgtaactgtaaaaaatccgtacaggctgccgacatatttgtttcagtacatgttcagaagataccacgaaaacgcagaaatatttcagcatattttggaagaaatgcgattaaattaccccgtatagtttgaactattgagaaatcttgtaaaaatagattagtcaatgacggaaaattgtaaatgcactgaaatta

SEQ ID NO: 13027 - DNA, 1837 bp, Heterodera glycines
ataagtcagttacaaatcaataagataaaaaggggagacaaaaaccagacatgcacacaaaacaaaatgccaataattataataaaaattaaatcatataacacaaaaacacttaaaaataacagtgaattgataatggatctgcgcctatgtatgacattgaatttatgttgttttttctgttcatttttagttttgaattttattttgttgtttaaatgcagggtgcgaccgaaaatttttcaaaagcagaacatcgggctcaaaaaatcagattttcggttaaaatcagaaaattttgcggaattgcttcaaatctattattttttacaaaaatgtattaaatgtttgttttttttcgactccgattatcgaatttaaaattttggggaggaaataagcaaatcgtaagtttcagtgcattcaggatcaaaaaatcagatttttaacaatttttttgcagctcatttttccaaaaaacttttggtgaatgggcgagggtagagggtccggcggtgcctataggcgccgcaggaaaattttttgtaatttcgttctgatttgttaacagattttcaccaaaaaatgccaagtcgccagaagaaagattagttttgcataccgacaaactgatcaacgaactgatcgccaaaatcgacctgaaaacgtaatataaaaaacagctctcactcaagaaaactaactcaattcacaacaacttcacactttaattcaagtaaaacagaacattacagcagacaaacacaccaaaagaaggagaccaaccaacaacaactcaatgaatgaggaaagggcataagtcagttacaaatcaataagataaaagggagacaaaaacagacatgcacacaaacaaaatgccaataattataataaaattaaatcatataacacaaaaacacttaaaaataacagtgaattgataatggatctgcgcctatgtatgacattgaatttatgttgttttttctgttcatttttagttttgaattttattttgttgtttaaatgcagggtgcgaccgaaaatttttcaaaagcagaacatcgggctcaaaaaatcagattttcggttaaaatcagaaaattttgcggaattgcttcaaatctattattttttacaaaaatgtattaaatgtttgttttttttcgactccgattatcgaatttaaaattttggggaggaaataagcaaatcgtaagtttcagtgcattcaggatcaaaaaatcagatttttaacaatttttttgcagctcatttttccaaaaaacttttggtgaatgggcgagggtagagggtccggcggtgcctataggcgccgcaggaaaattttttttttataatttcgttctgatttattaactgattttcaccaaaaaaatgccaatttttgcaattaaaagccaagcgacggtgcttgaatgttagttttgtaatggtttcctttcagccattttgaatctttggcataccgtctctgaaacgaatttgcataagtgttcaaaattataaattatttacagaaatttatccaaagttatgcaataatttggcaaaaatgaccgtccaataaatatgagttcactttttttaagattgataacattttttatagaggaagaaaaaatctgaaaaactttagactgttataaccttttatactgatcaaaaaagtcaattgcaccaccatatgttttctataatcatgtaaaatttcagaaaatttcgttaagtttcaagaaagttgtgaccaaaaatattcaaaaaaaccattggttttttgagtttctcaggtcataacttttttgaaacttaa

SEQ ID NO: 13028 - DNA, 1594 bp, Heterodera glycines
atggacgcagaaatggccaagttcaaaaagttacgagtgatgccagaaagttatgacaaattgaaaaggactcacgaaaatttgtattatggggcggtgaaagcactgatgggacagctggggaagaatatgtacaagagactgtccaaaggcaaagaaaacaatggcatttggcaaaatggtcgaaccattctttaggggagcagcggcgattggccaaatgtctggaccgaattgagaaccgattcgacctaaagtcgccggcaatttgcctggttgaaagcaaacggcgattaatgaagacgcaacggacgaagagcgacgaattgttggcatttgtccaagaagagggtacgatagctgggaggagattgatacggtagggaaatgagcggaaatggccgtttagaaaagcaccaaagcgacagtcatcgtgtagaagtggcattcatgcgagacagtgatgcagttacggtagaaggcactcacaaaacggtacggtatttggacgacaaatggactaattaaacagataatgaaccacagaatgtaggacagaaaaaacaacaaattcaatcagttcagcaacggaatggtcacctgctgggaaaagttgaaaagggacgaaaacggacagagtcggcgcggctgattcggtacggcaaaaagggcagacggagggtgccgagaagggtggaggacggatttgagcagttgctgaaggtgccaattggactcatttaagaaaaggaagcattgagggaatggaaggggagagatcaaaaaatgaaaatggcaatggcaaacaaaaaaacaattggcataaattgaacagacgcgaaaggagcgcgaaaaatggctgaccaatggacgaatggggcgatgggaaagtgcggaagaggcacaaggaaacgcggaagaacggtttaaggtggggttagcaaacgaagaaatgaccgaccactcattccttaattacaatattcgattatttccgatcaaatcgatgaacacttcgcttccgctgagcaccgacgccgacaaatccatcggatcacgcgtaagtgccggaaaagcggaaccaattgaaattcgtcaaacgtactgacaaaagaaatcccaaaaaaaggtgtcaaatttgctgattaaaatgatgggcgaaaggggagaaaaggcggaaaacaaatggacaaaagtgcacggattgttggcacgactttcggaagaaacggaacgacgcaaaaaatttcccggcacaaaagtatttgagaagcgaatgtacggcacggaacatttgaaacttttcattcgtttggcattctttaggtatgacattgttttggaccgggaagagccttctctgagtcccaaggaaaaggttggtctctcatcagtagggatgggatttttaagggcgaacatccaaaataaggatttttaagggcgaacatcaaaaataaggatttctaaggtcgaataagggcgtgaaaacgcaaaattttcagacaaaaaatgtgtttttcgtgtatttctcgttgagttaaagccgcagaaaaaataagtaaaaacttagaaatcccatccctactcatca

SEQ ID NO: 13029 - DNA, 2284 bp, Heterodera glycines
ccagctaaagctaatgcaattggtattgacctcggcacgacgtattcgtgtgttggagtcttccagcacggaaaggtggagatcatcgcgaacgaccaaggtgcagtaaagaccggacgtgctttccctcaaaatattgttaccatcccgaatttcaggcaaccgcaccacgccgtcctatgtcgcgttcaccgacaccgaacgtttgatcggcgatgcggccaagaaccaggcaacttttcacaaaatcaactgtttaagcagtttaaactgatttgtttgacaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggtttgtgctgtttgctaaactgctccatccccccgccccagttgaaaattttgaatggaggcaatttcgtatgcttgattctttttcggaaaatctacaatctgaggaattaaagctttcagaaaaatgaaatttgggagggaagaggactctaaaagcaaccaaaattggcgtttgttgagtgtttgcttgttgtacttaaatgtgtttttttttttgcaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtttgattttcgaatttgccagcaattcaaaatggttcgaactaaggtttaagaaaaatgaaaaagatagtttggtcgaaccaacacttaaaatgaatgaaaagcattttcttttgcttgtttgaatttaaactgcttttccttcaggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccaggtttgtttctttccctttttggcgggtcatttcacaaactcatttgccccatgtaaaactaattccttcaatttcagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgttcaggtgaacgattaagcctacctatcttaaatttcgaattaaattttgtttttcttgtttgttttttttgactgttgtgtattcctttctttttaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtaaagcaacggcatttccccttttgattgtttctgtgtgaaaactgttcaatttgaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattttgaacgtgtcggcccaggacaagtctaccgggaaacagaacaagatcaccatcaccaacgacaaaggccgcctttacaaggaggaaattgagcgcatggtgcaggaggcggagaag

SEQ ID NO: 13030 - DNA, 2298 bp, Heterodera glycines
  misc_feature (2200)..(2200): n is a, c, g, or t
  misc_feature (2258)..(2258): n is a, c, g, or t
  misc_feature (2293)..(2293): n is a, c, g, or t
attgacttttatgaatatatgtttagtagaattgattaaatgtatcggatgtttattgttaaatgccgaagttaaatttaaaaaaattgagcaaatgataaagctgacaagaaaagggaaaaaggagagggggttggagattcagttgatggcattttctgttctcgtcctcctcctgccaccgcttttgctgtgtttgttacaagcgtcgaaaaaaatagcaccaaaaacgaggaaaaggccgcaaaaaccctgcaaattgattggatggacgaagtaaagagaagagagaatgatggagaaaatttggcgaagtgtcataatgacggaaagaacgacggggccgaagttttggatggtcaaataaatgaacacctggcaaaagcaaattcaaagaaaggctaagggaatgtgaataaatgacctggccaagggacgagcccaaagaaaggaacagacaatcgaccaaaacggactcatggacaaacagaaaatggacggaggagggcaaagtccattgttggaggagagggaccagacaaatgagcacactgaacgcattcacacagaacatcatctgaatggaaagaaaatgatgaggggacgaacgaacggacaacaaaacacgaaaggacctgggagcacgaaattcggggcggttgttcgagcaattctgaaaccaattaattcattaggccattctcaaatttaaattaatgggccaagaccgatcaaagaaaaccaaataaaacaaatgaaccctaacaataaaccatccttacttttctgccaattcggagtgaacgcgtcgaacagcaaatagccgagcatcagaagaaaacccgaaacagcgttggaataagcccgtaaagattgtgccaaaacgataaaaaggcctttttcttccttctcagaaggtttttcaaaatgggaagtgccacgagcggaagtgaaatgggaagaatccgaggaagtggcgagaaaaaacaccgaagttccgaggacgagggtcagcgcaaaagcatattggctggtggaatagcgctggccgcgcagcaatattcccatgagcatcgtcggcacaattttcgatgctttgcacacagtctaatgggggggggggaattgctttaaatggcactccaacggtgaaaagaatggcacctgagcgggaaaggaaacgtatttcaatgcctcgtattggcaccacgaagcgatgacattggagaaggaggaaaaagagtgcaggtaaaggggcgcaacgtgcggaggctgcgctttccgagtgacgaaaagataagcgccggaaagtgccaatgccacctcaaaacagcggggtcatttggtgggtcaatgccagtacgtacaattcgattggagaacaccaaaaactgagtgtcccggaaaaagtctgtccttttcggctccgttctgtggggataaccgcgcgtcacaatgcgttcctggaagaagcccatacaaatcaaagtcacctgaaaacggtgggggggggggatcgatgcacaaaggatggacaaaatgacttggattccggcgaaacagacggacacggacagacagtcagccaacaacgacttccgtctccgcaattgtgccgtgccgccgactgaacaaatgcgccctccctcctcgtcctccgccccgtctctcagctgttccttctccgaaagtgtgcccctttccttcgcgctttgggccgtccgaagttcggccgattgtccgacggcgaattggcgaagcaatcgcaaaaggaaatggcggcggaaaatattggcattccctacacatttttacgctaaatgatgcgaagaaaagtgtgctacttttcgcctcttttcgaatgcatcggactataaagtagccgaggagaagcaaagtgccgtaggcagtcaaagtgggcaaaagtcggaacagccaaaagacatcggcggaggggtcatccgaagacgggaataataatgcgaaagtggaaacattaaccatcctgaaacagccaaacttaaatcggaagcaaccaaatgaaacaattactgaatgagagcacactcgcgagagagagatgcaaattttgaggataaattaaacgccggcgcatataaaaagcatccacgcggcggtctttgcgacaatcgtcgagaaaaacgacgacggagagcaaagagaccgagcgaaagctacnaaaaagatagacaaaatgataagaaaaaacattggaaaatcgcaaaatgagcgaagtngtgtcgacagaatgaaaaaaaacaaatttaattanataaa

SEQ ID NO: 13031 - DNA, 2287 bp, Heterodera glycines
agggataatgaagtcgaaatactcctcccaaccggcgtccgtcccatccgtcgcggttatctgtcggcgcttcttcacccgttttggcatcattcgttcgacggcacttcgttccgcttccgtcccgtgctgtgcctcaaagtcgcgccactgctccaacaacaaaagacgttcctccgccggcgctccctcaagtgcttggttcgcgcgtttgtaaagtgcacgggcgcggtcgaattcgccgttgctcgcctcccattcgacccaactgatccaaacctagcaaaaggacatcgaaatgcattggcacagccctcccccccggaaatgcctttaagtgttgggtacgtcgaagcaaactttcgtacaaaatgcgcgctctttcgggttcgccctgctcaatttcgaagtcaatgtacgccttccacagcacttcgggcatgtccaaactgggctgttggacggctatttgaaagacggcacgtgcccgctgctcatcgcccaacagagtttccaactcggcatatttcatccagctgatactgttgtcaggtgagaactcgaggaatttttcgtagagttttcgacatctgtgaaaaaaaacaataaattcgttttgaagtgccaacgcaccggtcgaactccctcagctgcaactccatctccaatgtactcgcggaaaagcttcttctttggacattttccaattgccgtgcccaaaatcttacgagcggagcctaaattgagttgtctgagctcaaattgggcgaacatcagccaagtgaaggcgaaggtgaactgcttgtgggggacgatgtccaaacaggcacgccacacttcacgacactttcccacgtcctcaacatcgagctcttcgtaaatggcgtaatacacccacagccaaatgtaacgacgccaaaaccgtttttcctaaaggttgaaaagaaaatgcattcggatgtaagcccaccattctgttaaatcttatttttgtaaattaaaaaattcgtcagggtcttggtcacagaaaccagttacccgaaatgtctattatttagcccacctaccacataaggcggcacattggaaatggccctctcaaaacattcctccacttcggcccggtcggcctcctccgccatcaacagtcgcacataattgaaccacgcgtcgtaattgaatgggttctccttgacttgctgaaaagggacatttggccaagtgatgggccaccactccgacctcttcgtattggtgacggcgttttgagaaaatgactccctcaattcgcaatcgttcgccaaattttttttcatgcattgtgagacatttgaacagttcagtggtgcgagtagttggcaaatggtctgaaaagggggcaaaaaaggaattcaaaacggtaggaccatttacccccctccccctcccaaattcgtaccgatgccgaattgataaatcacgcgcgccctttcgaattccttttgccgctcttcgaattgcgcaaaggcgatcaaaatgttttctgtcagattctcctccccaaaaaactccaacatttgttcgtaaattgcccttgcatttccagtgaatccgttgcgctcttcgaactttgcgtaccgtacccaatttttgaagtcgtgcccatggacatgcaaataacgctgaattcctcgcgttgttctgtttgttcggtttccgttccctttgctccctcttcacctggtaaaggtccctcgctctgtccacttctttgtagcgcatttcgaagttgatgaatgtcagccacgcctgctcatccggctcccactccatccaccgttcgaacacttgccgtgcgccggggatgttgccgaccaattcctccatgtaggagtacttcagccaaaactgcgtggccctcggcagaatggtcaccgcccggtcccaaatgtttcgggcgtggttcacctgcttgtttctgtacgaaaatggatagattagaagcaaggaaaaatgcagtgaaattgggtggtatccaagtcaaaaggaaagacgaattccaatttagaaaattcgtgcacaatggagttgatgggtcattccgaagtatttaacgaataattttgaaattttatggcttgctaaaaaataaagtgggccctctccccccctcccccccccatttggctctcccgtggtcagaggtgagtcaatccacctcatttccatttcggcatattgcaaccagatggtgatgctgcgatggtccacgtccaacccccgctcgaacaccgaccgcgccccgtgc

SEQ ID NO: 13032 - DNA, 1002 bp, Heterodera glycines
ttgactcatttccatgtcttggattgcctccctttcctccaatttacctccaactcgcgctccttcgcttcacgcaaaagttgctcggcagtgatttgaacgacggccgccgccttaagaggaaaaattggaaatgaatggaagtcgggcactgactgaccttgttcttcactttctccgccttttttggcaatcggatttgcttggctttctcctccatttctatccaaaataataattaaaattaattaattaataataatccgccgcatcgtaaaaatattttccgttttgaaaacaacagataaaataaaaaaataaattgtcgtctcatttttacagattaactgaagcaatcgcagtaaagccttgttaaatgaatgtccaatgtgagaggtatttaaacggaaagcatcgcctcattcgccgttggacgttgaagacgattgctgtacaaaagagggggccattttcgggttcatcggaacatccctcaacataggctccaaaaaagaaaattgcggaacgcgagaaacggccattttgctgaaagttgggatttgaaagaacggaagcaaaagtctaaattccactctaactattgtagcaatttctcattccgcttctccctttaagaatttgcttatttgccgcttcttcctttacatgtgcattggagagagcgttttggttgaactgtgctggacactttcggccgctgcgagcaacaatttctccgcaaaaacttccatggcactgccgatagccaccggcacactggccaccattctgccgatgtcttcgtcactttgcattacttttttcactctcgtctaaaaaaaattagggaattaaaatagattattaaattttattaattggataaattaacactaaatgtaaaattgtatgaatacctaaacagtaaaaaggtgaaaaaatcatcatcgaaaaatgctcatttaaactcgttttaacacaacacattaatgaatttcgaaa

SEQ ID NO: 13033 - DNA, 1612 bp, Heterodera glycines
ctaaaagttataaagaaaaaattcaaaaacttttactttttgtaattttcattttaataatttttgggtcctctaattgagaagcaatatacatgttaagcttgcgaatgataccaagattattggatttgattgacagtgaaaaaattaacagtccaaaaacttgggctggcgccgaaacgacccttattcattttgtaaatattttttgccgaaaaaagaaatgctattcggtaacaactaaaaaatattaggttgtttcataattttgtcgttttttaataaaaatgaaaacatctaaaaaattaggcctaaaaaagctactaatggagaaccaccttcaccaaataaaacaaaaacctatcaccaaaatggaatttgatatcgggaaattgttttggcgaattcggaaagcttcaaaaatcaagggctaatcttaaaatcttttcttaggctttggcttcagatttttatcttgccaagaataaaaaaaggtaaagaattagtcgcttttcgctgcgtttgttccttcgctgaaagagagtgcaccaaagagagaaggcaaagaagacatacaacgggagaaatataacgcagtatttttccttgtccctcctctgttttaactcatcataaataatttttattttccaaatattcatccattttacccgctgttttttatccctggttcctctgtattcggacgatgaaatctttcgccttttactaaaggtttccgtgcagggggacgcttatgggttaaacccaatttttggacagcgctctctccagggagggcgcgaaaatttattagaaaaatcaataattatcttttcctcacccggcataagcagccaacaaatgccaaatggcatgcaaatacggcgtgccaagctgaagccacaggtcgcaaatcattttgtcggccagccaacagctcactgccattatccatgcgaacaaaatgcgtttagtcaattggggaacctcggaaatgccaccttttctgagtagaaatagcaaaactatttcacacaatttcaaaataaacttttgccaaacaaaccgagtgccctcgtggtaaatgaaaatggcacagggcaatgaagaagctatcaaaacgaatgcattcactcgccggttcaataaaaccgagaacggacaccgaaacggacaaaagaatgacggccaaacgaaagtgaggcctaagggggaaaagaatggtcaattagtgggaaaaaatcaataatttaattatttacatttaaaatttaattaaaatacaatatatgttgtaattaaaacaaattttcaaaataaaatttgaaagttgtagctaactcctaagtttctgttaaatgctttcctcaagaattaacatgttttttaagccaaattattatgatagaaatttatttttaaaattaaattaatttttgtaataaaacaaaaataattgcaagaaaatgaaaagatgctttttttaaatttaataaaagttattttttatattctttgttgatcataataaggtacttgtagattttgtcaccctccgcaaatttttttagataattttttctatgctgatttattgtgctaatcacga

SEQ ID NO: 13034 - DNA, 1608 bp, Heterodera glycines
tgcattcactgccgggtcaatgaaaccgagaacggacaccgaaacggacaaaagaatgacggccaaacgaaagtgaggcctaagggggaaaagaatggttaattagtgggaaaaaatcaataatttaattatttacatttaaaatttaattaaaatacaatacatatatgttgtaattaaaacaaattttcaaagtaaaatttgaaagttctagctaactcctaagtttctgttaaatgctttcctcaagaattaacatgttttttaagccgaattattatgatagagatttatttttaaaattaaattaatttttgtaataaaacaaaaataattgcaagaaaatgaaaagatgcttttttttaatttaataaaagttattttttatattctttgttgataataataaggtacttgtagattttgtcaccctccgcaaatttttttagataattttttctatgctgatttattgtgctaatcacgacccatcttggcccatcgcgaaccccggattcgaacaaaaagtctaaaccccaatttttgaaaattcgatttttgttctaaaataaattaaaacaagcaaaaactgatcataaaccattacaacaacaaaaaataatcattacacaaagattcgaacataaaagagaatttctgaaaaattcgaatttcgacttttattttaattcggttccgagattcgaaataggccaaaatatatgccatattcttgatcagtaacccaatccgaattggcatgatgcccttctctttgatcagtaacccaatccgaattggcatgatgctcttctctctctctcacaaatgttccttgagcagtttgcgcggcaccatattgtggttgagcagcaccggcgtgtacgccaccagacacgtggtcatcatgtgcagaaggaacagttcgtccaccaattggccgaacagcgaaagggtggcgtggtaataagccgacgcgagcccattaagtgcgagaaaagcgtggggacaaatggccacggggttcacccggctgagaaagggccacaggcggacgacgttcagcaggggcaacagcagcagcggaaggttggaaatagtgttggcaaatcggaaataaaggcaaagacaatttaaaaagtgccaaatttataaatcaaatttttagttgggcaaatcgcaaccgaaaataatggaaataaaattgaaaaacatttaatgtattaaggaaatggatgtatttgtaattagtttaaaatttgggaatttattaaaaattaaaagataaaatattttaaaataattgaaacaatttatattgtttaaaaaatgttcgaattttcttagccaataattcttaaaaaaggaaggaatattgaaaaaataacaacaactcactcggcaacgaatggcacaattttgtatttgttgtcggacagtgactcgcaccagggcatgcccgactcaaaggcgaaccaatggtccattaaagtcacaaattgtcaattatctgacaaaacattttaaaattagattttaaaatagaataaaatgaaaaaatctaaagagaattattttttgttttttaaacttgtaattaattgagaa

SEQ ID NO: 13035 - DNA, 961 bp, Heterodera glycines
atcagatgctcattctatttgctttaattttgcattttgttttttcaaaaaaatattctccgacgaaaaccatcacatttttgatcacacttttcacacgaggttggttggttggctgaacaaattctgtcattcaatggacaatttgttatgtaatttaaatgttcatcatttgtctctaatcgcagcaaaaaaaaattgggggaaattgtaaaacaattaaatttttaaagaaagggcggaactcattataaaagcgaaaaaaaatacatagggaaaataattggaaaacaacaatttaacaccagacaattaaaattggaataaaaagtacagagagaatagtgcgggaaaattgaaatattaaaataaaaaagcaattaatttgaccatattataaataaaaattttgaaaatgcaaattaaaataaaaaatttcaaatattttacagttatggagatttttgagacgatttctccggccgaattccctcccccccccattttgttaattataaccggggaattggacaactgattgagcggaagcagaaaaaaacacaatgcatttatttgtcaaatactttacactttcggccatagtgtggcagatgttttttgtcattgatcaatcatttgaggggcggggagggatgtgagggacagcacagagagagagagagcgagaaagagggagagaagagagagagagagaagagagagaaggagaaagaagagagagagagggagagaagagaaagagagaagagagagaaggagaaagaagagatagagagggagagaagagaaagagagaagagagagaagagaaagaggcagagaagagagggagaaataagagagagagagggagagaagagaaagagagaagagagagagggaaaaagaagagagagagagaagagagagagggagaaagaagagatagagagggagagaa

SEQ ID NO: 13036 - DNA, 3854 bp, Heterodera glycines
  misc_feature (53)..(53): n is a, c, g, or t
  misc_feature (84)..(84): n is a, c, g, or t
aaagagaaaatgaatcatttttgtggagcatgcggagaaagcaaaccaaaaanttggcatggaatgaggcggaaaaagcgtcgnccgtccccgcgagagcaatttgttggcccccaaatgatgaatgaaagctgtgccatcattaagtgccacaaacatggcccgcaagacgcccacacaaaaattgaaaagccaaccgcctccaactttttaacatagcccacccgccgactctccttggggacacgtgttcccaaaaaggcggcggattcagggtcaatgggtcaatttttagacaattggacaatccagccgaaatagacaatccgtcgacggtggacgtaatgatgctaaatgagttaataaacgaatccaaaaaaaggaaagagcccaaaattgccggggcgccataatttgtaactctaatgattgccacaccatttatctcatcatgataattccatttattgtcatattatattgtccattgtcggatttatcagtgtccaattgtcatttgccgaattgtccggaaacgttcggggtcgagctattaaggtttgaaccaatccattgaaataaatcggtgattcaattccactcaaccagttaatttaaattttttgccggatctatttttttgattattccaaaccgctagcctacccccatcaatggtaagagatttataaaatggtagcctcaagtgattgtcgatcccatgacttcggtgcagcgaccgcctttcacccaaaccagaccagtgctcagcctttctcgggcacttagtatttggtttttggcacctatttatgtgcctaatttgagatattgagcaccgaaaaacaaagccgttacaattataggcttttcctccctttttgccttgcaaatgttccgctgcttacgtctttttccgccaatgcttttcctcccacttcttctggtgcttctcctccctttgtactcctccgtcttcgtccaatctgtttcccaacggcgtccggtccgaattacgcccttcctttactccgacgcgttgaacatcgctgcggctggagggtatgttgtgtattttttgaacaaaatttcagggaattttgtggcatttttcagggttttccgccttctcccctcgccgaagcaataagaatttttcaattttttaacatttttttattctcagaagaacataaaatacaacaaaaatttttttttataaattttggcttttctccagttctgttgctcctctgaagaaggaaaatgccatgtttgatgtgccaacaaagtttggctgggacagccaaacgatgcgccagatcactcccttcctctattcatcagtgaacagcggacagcagcaggagagaaagcgatttgaataacggattataatgtgaatgatggtgataatggagatactatactaccgtataatttctaccgttgatggatgtgctctgatcagttataagcaaattatgggaatttgatcattcaaattaataatatcaaaaagttgcgtctgcgtattttataattgtacaagtgcattacatttgtgagctagctgtttttttaatgtacatgccatagcaaatagtatagcaaaattttgctgccttttcatagtttgaattttacgaaattcggtgcccattttttaaatacgcaaatggcgctagcaatgtttatcccctgctggaatctctatcaattcgggttatatctctcaaatatgaactatcatcatatgcaggtttattttccatttagaattctatataaaccaagaagccgaaaaataaattttaggcttagtttggtgaaactgacccggcgatattattcggacccccccccccccccccctctcggctggttttaatggttaagtgaattttggtgccttgggcatttgcttctccgccaaaattggttgaaaatttaagtttttcatcacaagaataacattttaatcaaaaaaaaacaccttgccttggcacaagcgcaaattaaatcaattgttgggaataaatgataattattttaaaattctctaagaaaaaatgtttaatcactcctatcatctctatctatctatttaatggtgttttatgaatcgaatgaaataatttttcaacaaatataaagaaaatttttaaaattgctattttaaaaataaaatttacgcctccgatccttctccaagacatttttttatattcttactaatgaatggtcactcattttttaattgtttcatttattttccaatatgtcattttttccatctttttctttccccgtttattgctcattccgaattgtttcttcacattttccagcccattatttttttacggctaacttcgattttcttcgaaatttcatctttattttgtccatttcttttgatatttttgcttattttctttacattagctcctttaatccattaataattatttcactatcttgaaatttttttagcctagacttaaaaattcaagtgtaaaatttaatattttaagcttttatggaagtcctttacgccttagtcagacaacggaaatttttggaatttaaaaaattaaataatttttttgtcaaattgcgcgagtttttgggcgcaaatcacacaacacaaataggttaatgttaatgtaatcaactaaccgcgttcattgccacaatttttcgcgcactttggcccaacccctccccccgtcgcccggcccaaaacaaatttaaaaaagaaaacaaaatttcattttcaattcccatcaatcacttttcttccaatcgaacttttaattggtttctcgaaatgcgaaattctctatttgatataggaagaaataaatacgccaatcgcaaaatattttttcatcaatttgctgtcgtgtatttaccctttaaaatattttcgtaaaaaatacccaaaaagtttaaattagctggcgttctctcaggtgtccatgcatttgatcaaatatgaaagcagaagccgaactgatcgattagttggtgaggtagtgatcagttaataaggaggataagacaagatagggacatagaaaaaagagagagagagagacagagagaggggggggggggagggggaaagatagagagagagagagagagtatggagagatagagagtgacaaaaaaattggtctctgcaacaaatttttttcatgctttaaaacaaaaagcttttttccaccccttcttttgcctcaagctaaacaatttggcacacttccgtatgcttctcctctctgctgtcagcttttattgtttctctctctcaccccctttctccgctcatctctaactttgcccactattttaggcatttattctttctttttctgtggcatttttggccattgcatgttttcgtccattgttcatctgtttttctctcattttgcccttttattgatcccccacaatttcgtcggtgtacatcaaagctcaacaaacagcacgggagggggaatgatgatgcaccttctccctcctgtttttgcacatcaaccgcacattttctcctctcattttccaggccaatttcatctccgatgccttaaataattctcaaaaaaacatcagaaaataatttataaaatcattttttatttttactttatttttgagagaaaaaacaaccagagaattaatgagtttaataggagatccacaattttcaagtacccccccccaccctttattgagagaatttctttttcagagtgaaaggggtagaaaaagagagagagagagagaaagagagagagagagagaaagagagagagagagagagagagagaagagagaga

SEQ ID NO: 13037 - DNA, 4021 bp, Heterodera glycines
tggagcgccactgctgcgcctcggtctgctcgcgcgaatttgacggagcaggttggacttgctggacagctcttcctccaacgtgtctctggcattgtaaatatttgttaaattatttacaattaaagctaatttaaatctccaattgatcacctgagctgctccaactcgtgctgcaggttcttcacgtgcgtgctcagtgcctgcttctcgcgctgttcctccgttgcggcacgcttcaactcctccgcttggacaaagaattgcgacttgaggcgtccggtagcggtcgactgcgactccaagtcctccacttggcgcccgaactcgccgcactcggcctgcaggcgctgcttggagaattgcaactcctgcggaggaacattaaaatattcttctttagctaattatttcggtaattcaataatgattcattttaattacttaattaattcgttttaattccccaattaattcgtctcaatttcctaattaatttgtttgattttaaatgtctccattttgctttctccgtttgcttttgccctgcctgaatttgtcgcgactgttcctccgtcttcagccgcaactccaacaattggccctcaaatgccttctcccgtcgttccaaatccatgcgctgcttcgcctcgtcgtctagctgactctgctgcatctccagctgtcgttgcattgcgatgcgctccttctccgctttgttcttcatccgttgcacttggtcaatttgttcgtgcaattccgtgcagcccgaggctcccttttctacaaaaaattgaaaattaacgaatttaagaaatttttagaaggggtcacaaaatcaaaaatgacctcatccatataaatgcggactcaatgaactccattaactccttggtctaattgattaaataaagttggccattttttcattcccattttgaaattcgaaaattgctattggttttgaaattgtccttgaccagaaactgtagcaggacgttgggtttttcaaattttcaaacctcgccgaaaaataaatatttccgatttctttttgtgatgaaaaggaatattatgggagtcctttgatggtaattgccgcaaaggaattttaatattttgtttttttgtaccctaccctctgatgattttacatttttttcgttccctttgatcactgcgattccttcgcttttttcccaatttattacttttcagtgcggtcgcttgtgattcgaatgtcaacttcagctggtcaatttcccgtctcagcttcgccacttcagcgtctttctttttgttcgcttcgatttgcgattgcgtcgcttgcgcctgctgttccaaccgctcctgcagttcgtccgcttcgtattgaatttcgcctcggccgcgctcggagcgcgcccgcgcctgccgttccgcttccaattccgcctccatctctttacaacgtgcgtccatctcctaaaaaaggcacacaaaatataaataataaattaattaaaaatattttaattaattattttgtcccaaatttgtttcgacctgcgcctgtcgctgcaatttcgcgccttgcgactgcgcctcctcaaaacggacggacagtgcgaaaaggtcggcctccttgcgcttcagactcgtctccatgtcctgccgctgcttgcccatctcgtccaaattctcgcgtgcaatgcgcacttcgccctcgaacttgcggcgcgctttctcctgctcggcacgtgcacgacgctcgcggtccatttcattttcaacccgactttaaacaaaagaaaataatatctgtactttttgacaatttgttttattgaaattaaggcacggcgtgccgttgaaagaatttgaaactttggccacctccaaagtttgttgcagtttctgtcggtgcgctttctccgccgcgtttcgctccgcctccatttgcaagtcgttctgcagtttggctgcaagttcctgctgctgtttgcgctccttggccagtttggactcggtcagttcctgcttgtgcagttcatcggccagtgtccgtaacttaaaaaattgtcaattcgtttgctaattttgccaattcattagttaatggtcgattagattgctaattatcgccaattgattaattaattttcaattcgtttgtctaattattgctaattaattaattaattgctcttttccgttacctggttgtccttggcctgcttctccgcctccaatttgcgcatgccaacgtccatgtcggtgatgtttttccgcaacgactcgcactccgcttcggtgcgtttccgctccttttgcaattcaatcgcacgcgactcttcgttggcaaggcgcgaattcacttccaccgactcattctcaagcgcttgctgaaaccgaagagaaattaatttatccaaaattttcaaattttctataaaaatgattttatgaattaattagagggctacagtagccaaagtcaatgttgtgcgtacggtatacaacgttgtcatatgtcgtacggtatgcaatgttttaccattgctttcattcgcgagctaatccatcagttctaagcaagttttgtacctttttgaagcggattatttccaactgtgacttcatctcttcataccaatcaaatgctcttttcaagtgcatcatttgaatgtcggaagccattttttattttagaatgatcggaaacgacataaaatttgaatgatcactaaaattagctgatcagcagaatgagtgatcaatgggcgaatgatttgcggggggggggggggaagcgatgcttttgattgttcgattggccatgtgaatggccacacaaaagcagcaattagtcataggaaggaaggaaaaacacgaaaaggggaaatattggatcgaatttcatttaaatgagtgatcggttgagagggggggggggacttaatgatcaaatgggacggccattcattcgctaccatcactcaaaatcaaccgcaaacaaatcgcaaaaaaaaagtgaatttcaaacaaatttaaaaaatccctgttctatgaatagattttaagagcaaatacaaatgaattgattttttatataatttattgaagtcaaaaagaatgtttttcaaacgttttgctcctggtttggggtttgtatatgatttttataatgcttattttaccaaaagtttttttttaaatttccgattttcaatatattttttagtgtccaggtcaacacgaaggagtgatctgatcaagttgttttataatacttttgaccagcttcaaaattaagtcagcataataattattattacagattttttaagagcattttgaaatggtttttcatgcttgttcaaagatttttttggatcaatgtaaaaatttatttgctttttttgtgcctattcaagcgttttatgcccttttaaatcttattttgctatttctctgccgttttaagtgtttatgatttttgtgcctaatatgctacccaaattattaatttagtcttaagattaataattgtatagtaaatatattttatttatcaaattctgttacttttagccctttcattttatgcttttctattttcgtattatttctccataaattaccatttttataattttaaattcagttttttttaccttttttgagcttagtgtctccatcctgtgctgcacttcagtcccaacttggcctgccttatccatttccttttgcatttcctcccgttctatggccatttgtttggcttcacgttccaacttttcagtcagttcctgttcacgctgcaggctctcctgcaccatctggtatgtctcctgcaccttctccaactcctgctgcgcttttcccttcacgcacaaaggcctggcgcggcttaattaaaaaaacaatttaaatttgcttttgattcttttaaagtactaaattcaatgctaaagtatattgaaagtgttactacagtatggaagaacctgtacaatttaaaccaaggccaagtacgaag

SEQ ID NO: 13038 - DNA, 1373 bp, Heterodera glycines
  misc_feature (23)..(23): n is a, c, g, or t
atgcaatggagcgcattaaattnttgtcgatttttcttcaatacccactttaaacgataagcatttcctcgcacaccgctctatttgctctgttttaaacaacaaaattttcccaagcattcatacctactttcttaattacactgggatcacatctaaacgactatgctaaaaacggggaactaaactgtattaatatttttaacaaattgccgcccttttcgcctaccctgttaagagaaatcttaatttcactaataatttctcaattttcttctataacagattatctcttctatggtgagtttttcaatttctatgtactttattaagtaaacaataataatcaaacatttttctatgattgcaaagcatttaaaaaatcataggcttttttattttcattatgttttggaaaaggtcaattaaataaacaatttttttttgtaattttattaattgtataaatcttatgcaattttctataagcaatcgatagtgtaacaaatagagaagataaagtctgatcaagcacacacctttcattatttccggttaaatatgtgttcatattttaacaaaaagcagtcttgaatgtcgtcgaaatttgtggtaattccatgcttatagcccgaccaattgcgctggaattttgccatgaggcttattttttgtgctggtttcgaatttacaggcgcccatgcaattggagcgcattaaattttttgtcgatttttcttcaatacccactttaaacgataagcatttcctcgcacaccgctctatttgctctgttttaaacaacaaaattttcccaagcattcatacctactttcttaattacactgggatcacatctaaacgactatgctaaaaacggggaactaaactgtattaatatttttaacaaattgccgcccttttcgcctaccctgttaagagaaatcttaatttcactaataatttctcaattttcttctataacagattatctcttctatggtgagtttttcaatttctatgtactttattaagtaaacaataataatcaaacatttttctatgattgcaaagcatttaaaaaatcataggcttttttattttcattatgttttggaaaaggtcaattaaataaacaatttttttttgtaattttattaattgtataaatcttatgcaattttctataagcaatcgatagtgtaacaaatagagaagataaagtctgatcaagcacacacctttcattatttccgggtaaatatgtgttcaaatttaacaaaaaacagtcttgaatgtcgtccaattttgtggaattccatgcttatagcccgaccaattgcgctggaatttgccatgaggcttattttttg

SEQ ID NO: 13039 - DNA, 1493 bp, Heterodera glycines
  misc_feature (76)..(76): n is a, c, g, or t
atgatgcaaaagcatttaaaaaatcataggcttttttattttcattatgttttggaaaaggtcaattaaataaacnaatttttttttgtaattttattaattgtataaatcttatgcaattttctataagcaatcgatagtgtaacaaatagagaagataaagtctgatcaagcacacacctttcattatttccggttaaatatgtgttcatattttaacaaaaagcagtcttgaatgtcgtcgaaatttgtggtaattccatgcttatagcccgaccaattgcgctggaattttgccatgaggcttattttttgtgctggtttcgaatttacaggcgcccatgcaattggagcgcattaaattttttgtcgatttttcttcaatacccactttaaacgataagcatttcctcgcacaccgctctatttgctctgttttaaacaacaaaattttcccaagcattcatacctactttcttaattacactgggatcacatctaaacgactatgctaaaaacggggaactaaactgtattaatatttttaacaaattgccgcccttttcgcctaccctgttaagagaaatcttaatttcactaataatttctcaattttcttctataacagattatctcttctatggtgagtttttcaatttctatgtactttattaagtaaacaataataatcaaacatttttctatgattgcaaagcatttaaaaaatcataggcttttttattttcattatgttttggaaaaggtcaattaaataaacaatttttttttgtaattttattaattgtataaatcttatgcaattttctataagcaatcgatagtgtaacaaatagagaagataaagtctgatcaagcacacacctttcattatttccggttaaatatgtgttcatattttaacaaaaagcagtcttgaatgtcgtcgaaatttgtggtaattccatgcttatagcccgcccgaccaattgcgctggaattttgccatgaggcttattttttgtgctggtttcgaatttacaggcgcccatgcaattggagcgcattaaattttttgtcgatttttcttcaatacccactttaaacgataagcatttcctcgcacaccgctctatttgctctgttttaaacaacaaaattttcccaagcattcatacctactttcttaattacactgggatcacatctaaacgactatgctaaaaacggggaactaaactgtattaatatttttaacaaattgccgcccttttcgcctaccctgttaagagaaatcttaatttcactaataatttctcaattttcttctataacagattatctcttctatggtgagtttttcaatttctatgtactttattaagtaaacaataataatcaaacatttttctatgattgcaaagcattaaaaaaatcataggcttttttattttcattatgttttggaaaagggtcattaaataaacatttttttt

SEQ ID NO: 13040 - DNA, 3045 bp, Heterodera glycines
  misc_feature (921)..(921): n is a, c, g, or t
atttattagtatatacttacctaacagtttaaagtaccatttattttttagccttgcgaaaatggaaaatgctgaaattaaatctcaacgaaaaaataaaaaactcgaacatgaaggctgcctgtatgtcttccatttgttgaacgccgatggtgacgtaaaattttggcgctgtgaacatcagcacggcgaattcaaatgtcgagggcgcattcacacaacgctcaatgacgtcgttctgaagacaattggtatacacacgtgcaaccgcagcgcggcaaatgtcatcgcacaaaaaatcaccaccggcattaaacgacgtgctgctgaaacgatggaaacgccagcagcaatcagggcacacactcttcagcaaattccaacgccagtaatggcgaacattccaacaaagaacgcgacaaaaaaagtgaaaaatctatttatttttttacagttttgagtttaagctggtgaagcgagtccgccatgaaattgaattgccgccgccagtgccggtaacgcttcaagaattggaacttccagagcagtacagaatatacaaacgcaccgaagaaacgcaggagcttttccttcttgccgattctggaacgtataccgatcagaaccgagaaggacaacaacggtgtgtttaatgggaattttcagccatttctttaattttagaattctcatttttggccggctttctttcggaaattgggcttccgaaatgaagtacatttacgctgatggaaccttcgcagtgcaccggcgctcttttcgcaactttacgtcattttggcgcggtacttttttgtcaattttgtttttcaatcattttctccaaatttcagtcgtgataaatgggtgtttccggtccttcactgcctactgacgtgcaagtcgcagtccacgtatganaggatgtttgacatggtccgccaccgctggccgactttttggccgacaaacgcttccatggacttcgaacaggcgatggtcaacgccttccgtgctaaacatccacagtgctcaatcaacttttgcttattccatttggtgcgcaacatgaaagcgcgtcttaccgacgagcaaactcacgtgagaattttttaaaattaatttttaaattctcaaatttagcgtttcaaaacagacgcagcctttgcacgagcagccaaaatggtcacttcgctggcgttcgtgccgctggcggaccttacacccgcgttggcagcactagaagactatctacctaatgagcttgagggcgttctcgattggtcggttgagttaaattttttttcaatttcattagtaaattttaaaggtttgtaatcaactacgttggacgtcttcgaaacaacggcacacgcactcgtccattattccgtcccgaagaatggagtgtgtacgagcgcacaatgaacggcaccaccgcacaaacaacttcgccgaagcgtaccatcgcacgttgcaacatgcgatcggaatcggacaagcacacccgacaatatggaaattcatcaacattttgcgtgagcaccaaaaaataatcgacgtggacttcgaacatttccttgccgggaatgctccgccgatgaaagcaaagcgttaccgtgaagcggacagacgaattttgaggattttggagcgctataatcaggaaaaagcgccgccgcaaatcaacgatgatcaccaatacggccaaaatcaaaataacccgaatttgttcattgaaatgcttgggggaatttcgagcaattatcaaatggattgttaattttttgttaattttatttgttattacattttggataaaacggagatttttaaaaattgagccaaagcgatattttgatgaataattttaaaaatcagaacatgaaaataaataaatagatttgcagatgaatttttgagaaaatttttaatttcttaggggtatattttttgaaaaattcgtcgaaaaaaatttttaaatattttttttttgtctgagacggagttggccccttatgcactaagacggagttggccagacggagttggccccaagacggagttggcgagacggagctggccagacggagttggccccaagacggagttggcgagacggagttggcccgttccgtaatgggtatacctacttaatttaattaagctaatttcgattaaccaattcggtactagttaaaaagagtacctttttggtatcaaaaacaatagggggaccctttgttttgtaaaaaattttttgtgataaaaaaccgttaaaatttgttctccagagtttagtgggccgctgatcacgaatttgacatctattttgaccaatttctaatcccgaacccgaacaaaaaagactatacattaaaacattttgcacaaaacatcaaaaaatcccaaatttcacattttagtgcaccaaactttggcactttttccttttctttatccgacacaaaatggcaagcaaatgttaagagagagatacacaaaatgcaaattattatatgatttaaaatgagcgggatttgattgatccattcattttcaattttcaaagtttaattaactcatgggccgggatgttccttttttgtcggtgtcgtcggcggtggcaccgcttcctcctcaattgtcgatgtcaaacgtcggttctcttcaatgctgctgctgtcagccgcgccgggaactattgttaagctgtttgggctaaattttgcatttttaaatccaaattacatataaactattttaaattaaaatttaaaaaaatattttaacgtattttctctaattatccccaatctccactaatcacccaatcaccaattatcccccagtctacgaggcctttgaaaaataacccctctatcttaatcccttagtttccatttagccgggctcaggtcgaaatatttttaaaaatgaaaaaatagcctcactcaacaacctaacttattctgatgctttaaaaaactaattttaggaatattattataaaatttaaattttccttgcttattttggcatttc

SEQ ID NO: 13041 - DNA, 1305 bp, Heterodera glycines
  misc_feature (1289)..(1289): n is a, c, g, or t
atcgatcagacaaacaccggcggataagagcgggaaaattatcggtcagaaaaagtaggtgcaattttgacggacacagtgatcggacaaattgatcagaataatggctcagcagtcgaaagctgatttatcagcagaaataaagggaaagaagcgaacacattgatgaaagtgtttagagaaatagatataaatttaattagcaaaaaatgatcagacaaaccgagtcagggataaaatggccgacccaaagcagattaagaaggcaaacattgatgaagcgattagacaaactaattagttatcacaaaggagggtagccagcaggtgtcgtgtccctcgagttttggcaccaaattttttcggcaccgagtaaaatgaatttgatcaacaaaattatgggaataccaataaagggaaactgagtgttatcagtgatcacagatcagaattgaattttttttgaaaaccctaaataataaaacaattatttgtttttgactttacttcttccgtcatcagtttgctctccaccaaatgccgctcggtcgggaatcgtttcagcgttcgcaccgaaatgccggtccacgcgatcgctgattggaggctggtccaacgggccaatgttcggcgcgtctccaaattctcacggcccggcaaacaggtggacacacactgtgatcaacagagggggggggggggtgttcacacatattagtactgcgcaggaatggaaatttgtcgatatttctcgagattcaatcccaatcaatttggcgtccctccatgattcgtctcaagggttcagtttcaagatttgagaccgagatttgtctgtgccaggtttacacttgagagagagccggaattggcctagaatcatgtcaatgtgtctctctcgacagtgatttagccgccacaaatctcaagaccgagaattggcccgagatttcgggaattccaaaaaaaaaaaaattaattaatggcccgtccgactgaccatcatgaatttgtcaggccacgagatccagttgaactgctcccaccagcgtgcaacaaccacagccacgaagaaaccgagcagaaatgagagcggaatgtattgggtgccgcttaattagggctgattaattggaaaataattaattgattaattaattatttaattaatttttaattgggtggaactcacatttcacaccatttgatccaacccgtgaagtattccttctgcgaatcgtccatcagaccccactaaagaaaaggcaattagaattttttttttcaanattttatttgtaatat

SEQ ID NO: 13042 - DNA, 2387 bp, Heterodera glycines
ctcattttgttaattaaagtgtcacacttacgcctaataggcaggcaatttcaggcattccatgtgtgccccatatgtcgagaatgttcaagatcactcccgaatagcgtgtccaccaatcctttctgccaggattccaatttccatttggcaaatcaagcttggcaaataattgttgtgttacagcggaaggattctcaaacaatttggcactgcggtacaattcgccaatttttgtcattttgtttgccaaatttggctgaaaataaatattaaataactttttaaattattttttacccataaatccccttgattgattgtcattgaatttgtttcaatgacaaaataattggagaaaataatttcatatatcgtaatcccagccgaccaaatgtccatttttggtgtcacctaaaaatcatttaaatgaaatcgaattttaggatgcattttgtgcgtttatcgacgcgacatgtaaaaacctataattgcataaaaacatatattaattatatataaattaaactaaatttaattttaattatacgaaaattttattacttttgaaatttattaattatatttatatatatatatttttttatgttaaaatcaatgcatacattaattccattgccgcccgttgcactgactcctgctgaaataattctttcaaaaattttgttcaatatgcctgctgatggatcttggaagtttctttgctttaataaaagaaaaatacatataataaattttaaattttgataaataaaatgcaaaaaaatattttttgatgttcgatttaagattatgtaacgagttgaaaagcgccaatttgtctacagtttctcttgctttaaatggaatacggtagtttttttaaaattaaaaatggataaccattaacagttcaggcgcagtataaagaaatgtgacgatcaaagaatttggatcaatttgtccagttcggtgatattcgtcatcataaaagatacaaccttaatttattaattaattactaaaataaaatttatatttgaattccttaaaaagagttcataaatatgaattatttaattcaatgatgttacactattttaatcaaaagctgaattaattaattaatccttaaatttggcaatcaaaggccgccttcccctactatttaaggatatcgtgccaaatttggcaatcaaaggccgccttcccctactatttaaggatatcgtgccaaatttggcaatcaaaggccgccttcccctactatttaaggatatcgtgccaaatttggcaatcaaaggccgccttcccctactatttaaggatatcatgccaaatttggcaatcaaaggccgccttcccctactatttaaggatatcgtgccaaatttggcaatcaaaggccgccttcccctactatttaaggatatcatgccaaatttggcaatcaaaggccgccttcccctactatttaaggatatcgtgccaaatttggcaatcaaaagccccctctccaaccttttaatgatttttttcatttttatggcaaaatttaaattttagcaaaaaaaattccgaaaattaataaattttagtcaaaaaatttaagaaaacatcttttgtatgaaacttccattttaaagggcagtaaatttgcattccataagcttcttaatagggttgtcaggttggtgggaagggtgagggagattaacttaatttcccgaaatgttttttttttttgtaattcctcaaggaaaatttcttactcaaatgatacgcaatttttcaatttgaaaaatattttgttctctgccgttaatctgatcaatagtttctctctctgtctggcgctatctcataattatcatcaattgaggtgtgaaatcgatcagctcattaagcattagcacaaatttacaaagtttaaatttaaaaaaagattggataaaaaaatttttgaattatttttatagtgagtttaatgaaaattagaatttcattgaatattaaaaatatatgcgaaaaacatggaattttttggaaataattttctatttttatattttggccaaataaagcctttaaaaaaatagaaattaaaaactttcaaaaatgtttgataaacttcgagccatgtttcaaagcgttttcgccgaattatgaagggaaatgagtgatgaatgaattgagaatgaaattgatttttaccccttgaaaaaaagagatgagaacgaattttgctggaacttgaaagaaaaaaactgaattaagatttaccgaaatttctcgtaatttctttttttgcccgatcgtttaaatatgtcgaaaatttttatatgtgccctccatcccggctggaccataaatgtgtgacttctaga

SEQ ID NO: 13043 - DNA, 2359 bp, Heterodera glycines
aggttggtttgttaggccggccaaccgccgatttcaaataaataaaataaataaataaaatttgatgggatccaattttttcaaaattaaacataggctttaaaatgggcataaaatgaggatcaaaatcctatttttatcaatttatttatctacaatcattttgatgttttaaaaaaaggattgtataagatggttgccggacgaaacgacgtcggtacttaacgtcgccgcaaaaaaaaataattaaatacttgaagaaaaattttaaaaaatggttttaaaattttttgataacctaaattctacagaaaaaaaaaatttgctgaatatccacaaaaataaacaaaaacttgaaaatttattttatttcctggaatatttctaaaaaaattttagaattaggccaagttactaaaatttttaataatatttttttctaaaataaaaaattttaaaaattgacaaaaaatgaattaagcctgacactgatctgtacgaccgtgtagcctatttggacatggtaaagcaacaccaacaggaacagcgcagaaagctggccatgttgcgcgaagttgagaggtacttttaaggggcgtttttagcgaaatttttagcctgtagtcaatttaatatttattttttgtaataataaaagaatattcaaatataaattataatttattataaaattattaaccaaaaaatcaattattcaaatataaattataatttattatgtaaaaattattgaccaaaaaaagaatcaatttaaaaaattttgtaaaaagctcaatataatattatataaatttaaagttaaaattattaatataaaagttaaaaggcaaataatcaatgaaaaaaaaaaaaatttattttttgggaaaaggagaattttattactttttcaacggggtcgaataaatagaaataaaatctaactctgcctaactaacaatgagtgaaaatctgactcagaaatcccatattaattaaataatccaatcaattttctctagctagcattttttttcaatcaaaagcgaaaaccaagggttacaggatcaaaaatgatcaattttcatcaaatccaaaaatattggccaatatctttgccattgttcttgcattatattgaaaaaaaattatacaaataattttaaatttgtagaaaatttctttttcttctcacctataaaatcataattaaaaaaaaaattattaaaattattctaatttacagttgattaattatgcaaattatacaaatagagaacaactaattattttaataatgttaaattaaatattttgttaaaaaatttctattaataaatacattttccacgctttataattttaatcattaaagccgaaagttcattatggcaaaattcacagttggaggcatttccactatttgttgacttttgaatgtttggcactcaaaaagtggcatttccgccgccttttcccaaacatttttaacgcgtagcggcaaaatgtgtgcttttaataaataaataatatgcccaatcgttctgtgtcattttataatgatgagcaaaaagccagcagcagcaaattaagaaattcacatgcggccaaagtaaagaaatttttaaaatttaaaattaataataattaaaaattcgaaaattcgaaaatttccgttttgagaaaaatttttctaaaattaaaaaggaatatagcaaaaattagaattgttttccaaattagcaaccacgggttttcatttattaattattaaaaaattattttgcatttttttgaaaaatttttcatcaaaaaaccaaaaacgcacgcaaagtatcggattcttcgaaaaattatttgtatttcgtttatttcgaaatttaaatatattcttaaataaaaatcaaccctcgcgtctgcgctaatgtgaaatcccagccgaaccagcaggtggtcccaaaccgatcgcaaccttacaaaaatggtgccaaaaagaagagcacttcttttgaggcaatgtccacgatgccaatcgccaattcggcactttatgccaagatggaccaatgcgattgtgccatgtttgcagactgtccactgggcaaaacgcgtgccaccccggcacagcgatgccggcacagcgcaacgccaaggcacacaaagaagcggcacacagttggcgccgcacaatcgacgccatggacacgaacagaaatgccgcaagccgcttcgtcggaggacattgatgatgccaacgaagatgattatcatgatgaaaaatcagtgccctcactgtcctgccagtgccgaaaacggcagtgcccagaatgtgccaaacatgcgggtggccgaaaactac

SEQ ID NO: 13044 - DNA, 3900 bp, Heterodera glycines
  misc_feature (3888)..(3889): n is a, c, g, or t
gtatgtatataaacatataattaaaattaaattatttttatataaatttaaaagaaatttaaataaaaaaataaattgataaaatttagagctcgacgaaatggttaaaaataaaaattatttaacgcaagcatatgaagggaccaggtcgtttcggcgccgacgtttcggcgccaagccagaaatttaaaaaatatgaaaaaacacacgaaaaggaaatctatttaaaattttagaaatccggtacttgtgcagtttacaggggaaatttcacatagattttcagataccaataaatgtgttttagaaattaatgaaaataagttttaaggggttttcgaggtcgctgatcacgaatccgggctcagaccagcgctaccgttcgctaaatgatttattgtcatctgaaaatgtatgtgaaattgctcctgtaagctgcacaagtaccaaaaatcctataaaagaaaaaagtgtctaacaaaaagtcgaaatttcaaaattttcttttatgttcgtatctgtacagaataaccattttttgaggttacaatgatttttaactaaattaagcttttttggtcaatttaggaacaaaaataagaattgaaaaattttgagttttcggctttttggtagaattcgggtccgggattcgaaactggccaaaatgaatgtcagattgatcagcgaccctgaaaaaccccccaaaacattttccacgacttttcagaactagattttctactcgtgtattttttcgtatttttttatttttggcttggcgccgaaacgaccctggcgcaaaacgtcggcgccgaaacgacggcgccgaaacgatacggacccatgatgagtacggcgaaggacagcagcaaaccctgcttatcctgctggccgttaacgaacgaaggctaagggggggggggggggaacgataaattttacgaagggaaccctgccatgttcgtaaaaatgtgaaatatgcaaaaaggccataaaaatgtcctaagtaggcttagaatcacgttttattttaaaaattatagtgtttaacaaacaaaacagtaactcatccaggaattaatttccctggaattttaatgcaataattaattaatttttaaatttcttatataaaatcatttgcctttggtttttcttagttaactcatcgttttaataaacctcaccccccccccccccaacacacaaagtacaagaaagacggatgcaaaaagcttgaagttgaacaaagaatgcattttttcgaatgcttttgttaatgagaatttgatgctttttgtggggaggaaatcggcagcaattttgagcggaatgaatgaattgatttggtgctccaatttgtgccccttttatatgcttttttggcttttgctctcctcacaccaaatagttacagtcaggtccaaaagtaatgcatcaaaaatgtatgcatgaataactcaattttttattgagataaaattctgaaaaaattcctgctaagctaacttttgatgctgatcaaaaaagttttttacactaacttgatcagatcactcattcatagtgatctgaaaagccacaaatggcttgaaatcgggaaaattttcttaaaaaacacctagggggttaggaaaatgtttcaacgcagaaatgcgttttttgagcttcgattgagcaaaagaaaaaaaaagttaatcactaaaaatcatgaaccctaaatattacaataaaaaaaacaccattctgctgacaatgatttatttatggcacaaagaaaaataatttatttatttattcaaaaataaaaataaccaaaagaaggacatgtgccacttacacttttggcggaaatgaggtgaaatggaaagcagtgataaaagaattgaaattttgaatggagaagcagaaattagaaaagtcagacctccaacaaagggaaaagtggttgttttttttagggttgtaggagaaaaaaaaaattttttttttttttgaggaaaaattttggtgagaaatgtgaagtactggaataaatgtatttttttttgaggaaatgtttggaggtctgacagaactatttattgaaaagacgagggtattgtttttcgagtgattgaatttggtgaacaattttgtcgtttggtggtaatgattttaatgcttcataacatacgaggattgtttggtcaaaaacttccagcggtttggaaatgtcgtcgctggcctccttctggtttggtgcattttctttgacgggagtcggaacatttgtctggcgaggttgcattgctggtgccacgggagcagggttttgttgacgttttcggacgcgcgcttcatattcttccttgagttgttctttggtcagcgctgggcggacgaacagacgggccaaattttgttgcgaacggagtcgagcacgctcgcgcttccatcctccgagtgccatgtgttggtgtgtggttgttggcatgaccaccttgagcgggcgtggtgttgttcgctgcgggtcgtaacgtccgagtcgaaagacggcggttggttgggcctcaacttcaagatggtccaggatttttgtggcggcttccctgtcttcctgaacacgttccgatgggcgaatggcattgctttccgggaggccaatgaagaccagggtgcgttgtcgttcttgctccgcgagtgcgacagcgtttgggtccaggtcctgtgcaggtgccattgaacgttttgcgcgaggcggagtgatgtttgatgcgttggttcgcttcatgtcggataattagcaagaataattgttttttgcgatcaaatcttaaggacttaattggacaactacgtgtctaatcgcgaagcaatagcttagaaaaagcttctagaattgggtaaacgaaaaatttgtaattttaaaaaattttttttaccgtctgttcattttttgctgcaattagcacacttttgccgttttgacaggcgttaaatcttcaattcctatctttcaaaatacataatatttttttttgtttcatttttcaaattttttagtttgggttggtccccgtttttcccacattttccgttcgtcttctgctgctgtttgttttatgcatacaaaatcagcaacaacaataacgaaacaggcagttcggcctcctttttgtgaaagtgcaacagaatttcttcgaaattttcccagcgaaacagaagaaattcaaagcccaaaaatgggggacggtaatcggacacttcgccaccaccactaccatcattttgaatgttcaatgattggcattgtgttgaggatgatggcatttcaaacggccggaaaatggtggaagtgatgcgcgtcgtatgcgtgtcccacggagatgagagattcccattttccgtgagaatctcgacgggggacacagacagaggaggaaaatggaaaaaacaaatttattttctttgaatttgagagggaaaggaagaagatgaggagaagagagaagaagagattctctcgtcatctaatctgaaagtccttcccccagttgtcgactctcaacaagtcaaaatttaaatgttttagttctagtctcttaaatatgtaaaatttaaaattttttttctcgatcaaatttacaaacattaattaccactctcgatcccaaatattctctcaactctcgaacattttttgtgcccttttcacttcctcttgttcttcatgttccctttgtcgtcgtcacatttcggccctctctctgccagcagagagagggccgaaacggaagtgccattcatattaattccgcacaatatatatgggcggggtgccacacccatccataacaataaaaagaatttttgggtgggtgtgtgatgtgccatattggaaanntgtgtggtggt

SEQ ID NO: 13045 - DNA, 1000 bp, Heterodera glycines
aagaaatgcactagtgtcgggcattttgacattaaaaagccattaaggcaccgttgtagcaatgatgcacgtggtccttggaaattcctcaggaattaatccctgaatttcttctattttcttatcactcacaaatcactggggaaaattaagatgattctgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgaatggcattgggaaattcctcaagaattaattttcgttgtctaaagaaatgcactagtgtcgggcattttgacattaaaaagccattaaggcaccgttgtagcaatgatgcacgtggtccttggaaattcctctggaattaatccctgaatttcttctattttcttatcactcacaaatcactgggggaaaattaagatgattctgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaattcctcaagaattaattttcgttgtctaaagaaatgcactagtgtcgggcattttgacattaaaatgccattaaggcaccgttgtagcaatgatgcacgtggtccttggaaattcctcaggaattaatccctgaatttcttctattttcttatcactcacaaatcactggggggaaaaataagatgattctgatgattagcgttcttgttcgatttttgcgctagtgcgatatttattctcatgggtcttggaaa

SEQ ID NO: 13046 - DNA, 1214 bp, Heterodera glycines
  misc_feature (1194)..(1194): n is a, c, g, or t
attttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctcaggaattaatccctgaatttcttctattttcttatcactcacaaatcactgggggaaaattaagatgattctgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctcaggaattaatccctgaatttcttctattttcttatcactcacaaatcactgggggaaaattaagatgattctgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatgngttcttggaaagtactcagg

SEQ ID NO: 13047 - DNA, 881 bp, Heterodera glycines
tcatccatcattcatttattcgttccttatcagcttatcacttatttggccacatattttaaaaatataagaaattatggcatttgacacttaaaaatcaaagtaaaaaatgtcggtcttactgtatcaccactcattcgagtacatacaataccgttttttggtcggacaagttcattacgatactccgttttcgaaaatttgtcaaacaaattaccctaattgatgctacatgatttgtcataattactgtgccttttcagacttggcgagtccattccattttcacggtgtgtgtttttttctcatccgttttgccaatgccaaattatttccaaattaaaatgtgctccccccccccccgctccgcagaatatccgtcgtgacaaaaaggccatccgtgactccaagctgtatctgatcgtagccgcactgctcgccgtcgacggtgccgtgctgctcggctgggctttggtgtcgccgtttcgcatggccatcagcgaacaagggcaatttgtgagtacaaaatgggggggggggaggagcaataggacaatgcgcattcattggccaagctggagaagaaccttctgattgtgcctgagttcgaacggtgccaatccgaccattcattgcccttccaagtggcgttcttcctgttcaaaggcatgctaatggtgaacatttatttggtccagtccattctttccgcatttttacaaccaatctgtctaccgtaccacccaccgtaacctatatcacatatagtgaatgtgtctgctctcgtttacatagtcagctcgctccgcttacattaccgtaggcccacctccttttacagtatgatcattctctcattccgttcattcactttctgctga

SEQ ID NO: 13048 - DNA, 3491 bp, Heterodera glycines
tgaaattaatctcgaaatttgctaatttaaggaacatctgaacgaagcatttgccattgtctcctttttcgtcctttcctccaccactctgacgctttgtcttgtttttgtgccaaaagtgtgtttggcaccccgaaaaatgcataaccaatcaaaagcagcactgatccgaaagggagtcgccagttggccctctaagcaactttagaagctttcttgggaatgttttgatcaatcagggcccaaatccactacgatcagtcctgttgttgtccctaattgagcaattagtgattgattgaccgattgctttccattgttctcctcataccatctttctcttctccccccccccccaaaggttgtcgaactgtggcaaaccccgcgcggcacagaacatcaccgttttcgtaagggaatgatgaaaagtatggtgggcagtggtgccggcggaagtggcagaacggccacctctggcggtggcacatttcggcacgcgcaattgccaatcggcgacgatgccaaacattcgacaagtacggcaccggccgggatgagtgccggtgaggggagggcacagatgatagagtgtcctttatttgattgaggtgtctatacggcgtcgaaagaagcgctgtgccgtcaattgtccctttcgtcggccgaagaattgggccgacgaagtgccgcgttggaagcggacaatttgcgacttcaccaaacgctcgtgtcggtgagttgacacatttgaacaaacagtgatcagttttgatcggaagtgatcactcgcgtttctgatggcattgaataccgagtctcaaaagtgacttaaccaccaaatcaattaaataaaatgccctcgggggctttcccctctccgtcaaaatccgtccccaattttggcctcaatggcaccaaataagctcggctcaccaaattattattcgaattccttgccaatcaaattcagaagtccaccgaactttgggatttgttggagcgcgtccgtcttttgacagtgaaactcagaggcaagtgaagcaaaaaataaataaaaaggcaattgaatcgctaatggacttggccttagccatcattctcattaacaaattgcaaagattttaatgcctaatttagcaaattggcacggctaagggaatcaccgccggtgtttaattggtccaattcggcgttttattttggaattatctccgccgattccttcgcttttcctttaattttaattgcccccccccccgcatttcgatttgatttcattttacagaaatggaagtcgagcgacggaattcgagcaaaaggctgctgctgggcaacaaccaaagcaaaacgcccgaggcattgtgtgttgtgaaagtgagccaaacaaatggccaattttgagctttccacgcgttacaacgcccccttaggcgatattatgccaattaatggatcgtaaatttagcagcgaatacagtaaacatggcatttttggatttattttgtttttttcccaatttcagttggatgccggcgacgacgggggcgaaagtttggccagacgatgttcggcacgcattctgtcgacggtggccaatcagttgagacttcggcggacacggaccagcagcaatggcctttagcagacagaacaccgaatttgccaaatgtacaaacgctttttaaaaatttaattttctctctacgccattcctttctctgttcatttttcgtccattaaaaaagagaccattgaaattcatttgaacttaaaacggaacaataaaatctcaattttaaatagttttatatcatttaaaaatcaaaattcattgtgaaaattttgtataaattacgtcatttgttttttcctttaaaaagcattggtccaatcacaattcaatttctcacaagtcccccccccttcctccgttcgtctctttttctgtccattcaattggccatttcgatcagtgcgttcaccgtcgagtctttggcccctcgattggcctccaaaactgatcggatcacttctcggtcaatggtcggaaacatttcctgcatttcgtccaaatccttctccgagaaagcaacttgagctgaaaacaaacaaataaattaaataatttcacaaacaaaataaatattcagttggatggaaatggggcgatttattgctattaaaacggagcaggtcgtccgtccccccgaattttttttttattcaaacctagaaatttttcataaaaaaaaactcataggaaatttcttagtaagaaatttcaagaaaaaaattttttgagaaaattttcagcgattttttggaaaatttttgaaaaaacttagtagttcatcataaaatttcgaaaaaatcgctgaaaaatttttttcttgaaactttctttacttagaaatttcctaagattttttttatgaaaaatttctaggttttaaaaaaaatttttttaatttttcgggggggggggggacgacgtggggaaaatgaagtgcaccactattaaaaagccaagttttcttactctgcgcggctgtcgccgtttgttgtccgtcgctttgctgcggaggcgcgggcacctgacaatgaatgaacgaatgagacgaacagttaatcagtcggttgttaaatgttaaagtttaatcaaaatcttccaaatcaaaacgggtcaattctatgccgacttttttattcgaaaattggtcaaattaaaatccgaaggaagcaattttctccattccccccccccctccaaaattcatagagactgagacgaatccgggactcccattcccggacttttgagggaaaacaccgggaaagagataaagtggacttttagtccttgaaatcccggcccatcgtcaaatcccgagccaattcaattcagaactcattctctgtttgttatgttagacctgttccgtttgttgttggtgttgctgtgggacaggcgaaaaggaaatgaccaaattgacaacgccttcctttccctccccctgaaaatggaattttagcaaaagggaagaaatgcaaaaactcattcattgtatttagcaattaaaataagaaattgataagggattgttattgtatagaaatttaaaaaatatatttattatttttagaaataaatcaaaaaaaattgtaaaatttttaaacgatttttactaaaattttgtaaaaatttttgggagaaactgcgggagggggaggctgttcccgtattcccccgtctggctggtcatcagggacggtcccaggggggggggggggtacgcggggcaaaatatgtttttgaaaatcaaaacataatttatgcaccttttatttttctctttcaactgtctgtttttgctggggaatagcaaaaaaaaaaaggtcgttcaagcgaaaaattttcaaaaatacacccttaagaattgacttttttgatttggtaccccccaaaccaaaatccggggaccgtccctgc

SEQ ID NO: 13049 - DNA, 1803 bp, Heterodera glycines
  misc_feature (1675)..(1675): n is a, c, g, or t
  misc_feature (1774)..(1774): n is a, c, g, or t
  misc_feature (1778)..(1779): n is a, c, g, or t
  misc_feature (1784)..(1784): n is a, c, g, or t
  misc_feature (1788)..(1788): n is a, c, g, or t
ttttaaggtttgaacgcattccaagggattcctccctttgttgtggacaggcaacaaggtggtgaacgcgagggggaggaggacgagcagttggaatgcgcaatttgcctcgaccccattgattacggcaccgaagttaggccattgccgatctgtaaggtgtgccatcctactgtactacagtaacataatttgcacagaacgcaatttcaatcaattattttagcacaaatttcacaacgagtgcattgaattttggtaaaaacaatactaataaaaaaagttataatttggcccactttttaataatatggcataattaaggatccaaggctgacacaatgcatgcccattttgtcgacaagaaaacgtcaccaacacaatttgcacgtacaaattttgtttttatattggttaattaattaaaaattggattaatgagaaaaaaagaatcagttttttaacttttagaaaaccggcagaccaatgggacggtgtcaaatgaggcgacagtaatagaaatagcaaatggaaggacagaatttgaaggagggcggggggaggacgaacaacagcagagggaggacaaatgacagaaattgacaaagtgtaagagtggaatgttaaataaccgaaaataataaaagcgaataaaaaacggaatgtgccttctttcgacagtgagtgaattcgacttaatttcgacattatccacaaaagtgttaagaaatacacataaatttgatttttttttattgaaatatgtacatcttaaatgtttatcttcttatatgtagagtagtatgcggatctgttctgatttatcaaaaatgttctgattttagccattgttcttgttttaggaacacataaaataattgaaattttatggcataatgtaactaagattttcaaaaatttccacttcgatgtctaacggcaccgtcggaccctaaaaatactttgctttcttaaaatggctcagaataaaatttggagaattttggacaaaatctgttaacaaattatacacaaattttcaaaaattttcctggcggcgcctatcagcaccaccggcggcccaaaaaatcttttcaaaaaatgcgccacaaaattaaaaattaaaaaaaaaatcaaaaatctaatttttttttagcctgattgcatttaaatatacgatttgcttatttcctccccaaaattgttaaaaaggacatgagaggcgaaaaatacggaatttgatactgtattaattgattaaattgttacacaagcaatttaagcgattttgcaaaatgttctggtttttgaccccaaagctgattttttgggctagatgttctgattttcggcccgcaccctgatgtaggtagacagaagtaagtgaggtcaaaagcagggttgaagcgggctggtcattagtgataaggataaggcaattaaattcttttttgaaaacaggatttaagaaccatttttgtttccaccttttaaaaaccgttaatgtatgtaatttcgaattaatattttttatcaaagagccaaaacctacataaatattcacatattctttttatcaggaaattaattaagcaattaattgtgttgtttgttttacttagtctctttggcacaacagtgatttaataattttggaaacatttaaatttgctanaatgttatgcataatttacctaaaagataattaataatctaaatttggcgattcataaaagttgatttttgatttttcacgataaataacgaaaatttnaatnnattantttnatgcgattttgcact

SEQ ID NO: 13050 - DNA, 1875 bp, Heterodera glycines
tacgatttgcttatttcctccccaaaattgttaaaaaggacatgagaggcgaaaaatacggaatttgatactgtattaattgattaaattgttacacaagcaatttaagcgattttgcaaaatgttctggtttttgaccccaaagctgattttttgggctagatgttctgattttcgacccgcaccctgatgtagacagaagtaagtgagggcaaaagcagggttgaagcgggctggtcattagtgataaggataaggcaattaaattcttttttgaaaacaggatttaagaaccatttttgtttccaccttttaaaaaccgttaatgtatgtaatttcgaattaatattttttatcaaagagccaaaacctaaataaatattcacatattctttttctcaggaaattaattaagcaattaattgtgttgtttgttttacttcgtctctttggcacaacagtgatttaataattttggaaacatttaaatttgctaaaatgttatgcataatttacctaaaagataattaataatctaaatttggcgattcataaaacgttgatttttgatttttcacgataaataacgaaaatttaaattatttaattttaatgcgattttgcacttacgatttgcttatttcctcccaaaaattgttaaatcgataagggaaacgaaaaattaatatattgaattcatttttgatcgaatattttaaaaaataactgatttgaagcaattttgcaaaatttcttatttttggccctcatcatattttttggcattgatgttcttattttgaaaattttagatagaaaccctgccttaagggggccggcggtacctataggcgccccagggtaaaataggattttaaatggattttgctaagaaaatttgttaagtttaaaaattttccctcttttatccttcgttctgacccaccccgtctcttttacaccagccctcctagatgcgaaggggtcctctatcttggggccatttgtgggcgaagggggcggggggggggtcgaatcccgccccccactttttcatgtatgatctggacaaaaaaatttaattcttttcctttgaaaattttgaaaaaatttgttattgattttaattattttgtagaagaaagaaaaaacctattttaaagttttccaattttttcccaattttcgttactttttgcccattatttcgttaattattttgcatttttcctcactaaaaatcccagccctaatggttattagtcaatcgagggacaaaaagtgacatatccaataatttttgaatcgaatcttttgctaattcctttcatgtcactttttggccctgggcaatccaaatagtgtaattgttttatgtgatgaatttttgttgcattggtttaaaaatgaatgatttaaatgacttggcgtgtcgtccgaccataatttctttgtcctcctcctcctttttctgttaattgacccattaattaatggtgttgggtcattactcaaaaactatcaacttaaaaatttttggcgaaaaaattttcatatctttgctcaagagtagcccaaatttttaaacattgatatcattcgaaagtcctctgttaactttcaaaatttcaaaaatttggtggactttcaaaaatttttgttgcttataaggaaagttataggcatttttttattttgatggttctttgtagggttcggaccccgcccccgcccccgtccccgggggcgggacatttttggggctcacccccgtccccgcccccgtgactctgacccccgcatcccccgcccccgcgatcttcgcccccgcgggagcacgggggtgaaaatacacccatgaagaatgacatattc

SEQ ID NO: 13051 - DNA, 4325 bp, Heterodera glycines
ctcattcagagagtatgtactaaaagttccgaagttacgtttgtgctgcttagaggaaattaaacccaaagtaccatatcatacactcgtgcccatataaaaattcttgaaattttcatgaccttgaaaaaatatatattatttctcagctcattcagagagtatgtactaaaagttccgaagttaagcttgtgctgcttagaggaaattatacccaaagtaccatatcatactgtcgtgcacatatgaaaattcttgaatttttcatgaccttgaaaaaatatatattatttctcagctcattcagagagtatgcactaaaagttccgaagttaagctagtgctgcttagaggaaattatacccaaagtactatatcatacactcgtgcccatataaaaattcttgaaattttcatgaccttgaaaaaatatatattatttctcagctcattcagagagtatgtactaaaagttccgaagttaagcttgtgctgcttagaggaaattatacccaaagtaccatatcatactgtcgtgcacatatgaaaattcttgaatttttcatgaccttgaaaaaatatatattatttctcagctcattcagagagtatgcactaaaagttccgaagttaagctagtgctgcttagaggaaattatacccaaagtaccatatcatacactcgtgcccatataaaaattattgaaattttcatgaccttgaaaaaatatatattatttctcagctcattcagagagtatgtactaaaagttccgaagttaagcttgtgctgcttagaggaaattatacccaaagtaccatatcatactgtcgtgcacatataaaaattcttgaatttttcatgaccttgaaaaaatatatattatttctcagctcattcagagagtatgtaataaaaggtccgaagtcaagctagtgctgcttagaggaaattatacccaaagtacatatcatactgtccggaacatatacaatttatggcaatatcagctgcccataataaatctacactctgactaaaacgaccctctgactaaaccggacagactaaaccggccagactaaaccggccagactaaaccgacccccaccgcaattcttaggggtgtaataatcggatttcaaggcaaatccgattacgattatccgattccgattatggcccaaaatccgattaattgcgattccgattacgattacgattccgattcggcacatccctggtatataagttgattttcgtacgagttgccattgaccctttttttattatttaattaaatttattggtaattgtttagcggtgggggtgaatcaaaatctcctcccaaaaatgcgagattcgaaaattttaattttgagtttttgctcaaatccgggttcgggattcgacgtggctcaaaattaatatcagattcgggttctccgctctttgatttttattcaaaaatttatttaactaattattcttcgaattcaaattttaggccattgtctccgcccgccgaccaaaacaacgaaaaaggcgccaatttgtgaacctatggccattgagaaaagaagaaaggaccgaccatttgattacctctgctggacttgatttgatgctattttctctttgaatgtgcttactttttcttttgtttaatggattttcattcaaaatcaaaattagattttccgcggctaaatgttgatatttaataaaatcaacaaacattatgccatcaaaacaaataccaacgtaaatttttaaaatttatttaagtggcttataattttatgtagagcgataacgcaaaaatgagttctgctatctctctccccattttatttttgcgccaaaagtcatttgaaaaaaattgctttaaaatttcaaaaattatcgaaattttaaaaatgatgttgagcctttctctaccctcgagcccattggcaacaatttaaggcgaacagatttgaaaattgttttgataaaaaatgcgattctcgtgtttttctcatcaagtattatcgtaaaaaataggaaaatcctaaaaatccaggctttatccaacgcattaattcttctgctatatattgtgtgacatcattcgaatttggccaaattgtgcttatttctgccaaaaaatgaacaggcggtaaggcattttttaaaagccacaaattcctcacttatttagcctaattgtttcccatttcagttggatttgcaacgacgtttggatggacattttccccacttttgaccatgcccaactcggcctcaaattggcacttctttcgccacgtttcaatgcgttggtggacaaacatttcgatggcaaaagcgaattgacaatttggagaacgatcgaaattagcaagtgcattggaacaaaaccgaagctatctgtgcggatggatgacaaatttgtggaatttccgttgccggaccgtccgttgcccagcaaaatccgttttaagcaccttcatattgagtaattgaaaatcagagctatggcaataaaagcatttatttcattttcagttacatcgatcactccgtcatcgcttttcttcgttccaatcaccaaattttcgacaaaagaggcaccaatttagacttgtggattccatcaccacacaccacggatggccagcggatttgggatgtttttgttcgtgaaatttggccaattttttcggaaaatattcgccacttgggctttaccggtgctgatcatttggacaatttgatggttgcactctccgagaaaagatggacaacccaagcgattgcgttgcgatgattacaacgaacaaacggacttagattggattaacaatttcaaggaggtgttgcattgggtgagcaattaaaaaaaagtgtttagataattcaaattgcgcttaattaaggccattgtctccgccaccggaagaagaagcaggacaaagcagcgaaaaagggacgtcttctgctgacaattagtgatggacaaaagaacaaaacaatggtgattagtggaagaaatgtattaattaagaatgaccgaccgatcataattcaaatcagtgatcaaatgaaattttatgaagaaaaacctctcaattttgtaaataaatcggacgtataaaaatggcaaaaaagttgactctattgcggttcacacgaccataagcttttttttgcaactttgatgcaccatagctttttcttattaaaaaattcttacacggaaatgaactaaaagtcatcactgcttcagtaaaatggtaatttgaaccatttttagactaacaagtgattccaaaaaattgaattttcgactttttgttcgaattcgggtccggggttcggaatagggcgaaatggatactggattcctgaacagcgacctcgaaaaccacaggaaacctgttttcatgtcttttgaaaacaaaaaatatttttttcaaaaaaggggggggcaccagctttactattaccgaaaaacattttccttcgctaattttagagacaggcactatacatttttgattgtctttttcgattaactgatcaaaaatagaaaaatttttgtatttcgaatttttaatataaatttcagaaattctttaacaaaagcaacaatttttttattgacgcgtgacatttttgggacaccttcaaaatttcaaagtttcgttaaataaattctgttgaaaaataatttctccgtctccattttttcgagttttgaaccggttcaaaaaccgtttttttggcatttccgcaactcgagacatatttttccacggtagggggggggggtcagttgcgtctggccatttgcgtctcaaacattttttatagagtaaaatggattaattaagttttctgtatgctatattttcattttcacagatacattgacaagaaatattcaaaaatttatagaaaaaataaaaagttttaacaaaattaacaaagtttcatttacccatttggtaattgcttgaaattcccctgagcatttcaataatcaaatttcggttattttggttttggccatattggtgatcatcgtcgatttgcggctgcgttttttcctcattgtagcgctccagaatcctcaaaattcgtctgtccacttcacggtaacgctttgctttcagcggcggagcatttccggcgaggaaatgttcgaagtccacgtcgattattttctgatgctcgcgcaaattgttgatgaatttccagatcggtggggtgtccttgtccgatcgaaagttgcagcgtgcaatggtatgcttcggcgaagttatttgtgcggtcggtg

SEQ ID NO: 13052 - DNA, 2556 bp, Heterodera glycines
attctgtcaattgattgatcactttgggtcaactctcaagtgatctgatcaaattctttcaatggtttatgtgatcccaaattttccatcaatgactaatttggacaatttacatgaactgaaattttggatcaacactgatcaactgcagctgatcaatcaatgcctcctccttccttaccttgtcagtgtgccgagacgcaatgtgccagccggggcggacgcgttggcatgcgaagtgagcaactgttgctgccagctgggcgcattttgctgcatgatgccctcaggcgaatttcggagttgaacagtgctcgcggttacggtaccattgctgaaacagagacacagaaaaaaaggtggaccacaaaatagcacacaagacagacaaacagacagacagagacaaaatcggacagacatacagacagatagacgagactgaaatggccgagaatcaagactaaaaaactttaaaaaaacgagcactttttgcttgttgtccaagaccaaggttctcgaacagaaataaatgtaaaagcggtgggaatacggtagggagtttaaacagggaatacggtagggtaatatgctagaagaataataatggatgaatttcgtgtatatatatattttttaatagagctgctaagatcaaatctaaaagagaaatcggcacgagattctcgaaagggctccattaatttggcatgagaatctcggtcagaattcggtagagatttcttgatttgatcaggcagctctttttttaaatccaatcacattgaatgtgtgtgtatgtgtgaattgatggcactcataggtgagattcatacaaagaaaatgtgtgaaaatttgttggaaaaaaaatcctacggcgccgtcgaattttgtgccatgccaccctctgccgccgaagtgttggccaaatgttgtcgcgcgcgcgggttgaaaatgttcgtgtcataaatgttgtccggcattgcgtcatgaccacgcggcgagaattggtcatcattgtccacctccgaatagtcgttgggcctggccaaatcaggttaattagctagctaattagggacgatccaaattaaataaaatttattacacaaatttttgccgaaaattctccgatttcgactttttgtaaacaatcaatctcgaaaattaaatacaatgatcggaccaagagatcacatgagattaaaaactttatgccatataattgtgaaataaaatgcatttttaaataaatttaattgaaattaatgaaaaatttatttaaccctttttattttttaatgttttaatttcaaattaaatttagcagcagcaaaactcacaagcgtgtgaagatgtaccacgattttgagaccaaaatcagcaaaatgaacagtgaaaggccaagcacaaacaaagtgaatgagatcagaacggagccaaaactgaataaacccgaatttttaatcggtttgaaaattcacaatttttgcgtttaatcgggaaaaattttcgacatttgcgacccgaattcacgcgtttttcttaggccccatcctgctccgtccgacttgatacaaattcccgagtgccggcggtccaaatcacgacccaggaaattccgtttttctttggcacaatctcttacccggtacaaaattcccgagtgccgattcaaattgacactcgactcaggaaatccacagtttttttcggctttaatcttgacccagatattcattatcccaatcccatgtcaagacccaaaagccaaatgttcctacaatccatgccgacagaagccatgctgcatgccaagaacgtcatgatgaagtgccgagcattgaagtgccgagtgcacggcgccctcaaggcgtgccgtggtgataatttgtgccgcaatttgcgcagtgatcgactcaatctgtggggaaacatagactttcatttaaagaataatttgaaatacgcactctcaaaaaatgtagataaattttctaattttttgtaacaattttttttcctcggtggctcgaaattggtcatatatagccagtgggcaccctcaatccctcaaaaacaaattaaattttaaataattaatttaaaatgtttttcgatgttacctccgctgaaccgttgaacagacgtgcaagcagtgcctccaatttgtgttcagcttcattctgttccatgctaagttgacgaatcattgccagcggcagtgccccgggcactaatttatcactgaaaattcattaaatggcaggggaaatatggtattcacgaaaatacccaggatacggtattttaattaattaattccgccatgccttccatgacaagggaaacacagtattcccgacagtaagccgactacagtattttttaataattaattaccccaatgccctttgatgttgccccaggggcttgtgttcggctcctgcattgtgcagtccgagtaaaattggatgacatcaattagctcgtcgttgagatgcgtgcgcagaaaggggcgaccatccgagcagaaatcggcataagcctttgaaa

SEQ ID NO: 13053 - DNA, 2455 bp, Heterodera glycines
gtcaaaaaataacaattttaaaatgatgctatagtcgaaaatcatttattttttggagttttttttttgacaaattttgaaaatccaagtgaaatagttgagagttcattggagaaatttgaaatttgtaactaaaaattcaaaaaaagtttagtaattcccattaaaattttagcaatttttttaaatgaactaaattttacagttttaaatgcataaatccgatagacgattacaaaatacccgctaaaaattatttccaactattttttttaattttaaattaattttttgttggccttaccacagtgagcggaaatgccgcagaaaagagaagccatgtgacgagaaaaatgaccaagccaaggccagagaaaatgatggcacctttacgggactggcgacagaacgcaatgacaccggcgaacagcacggaaagcataatcaaaggcaacaacaggcagagcaaccatctgagagagggtaattaattaattaatattaattaattatctgaggtttattatctgagacgtataactactaattattagcaattaattaataacaaccctagttttaattaaaccgaaaatcactttaaaatagtcattaattatttaattaactatcctaaattcaaaacaatcttagacagttaattaattaattagcaattaattgattaatagtaaatattaattaattactctaagataaattcatctcagatgaataattaaattaattaaaaattaaattattatcattaataaaaaccatcggcaatcagaagaaaaattattaattactaaaatgattaattcttttttctcattattccgccactctgatcacctctccagctccactctttcgcccttccgttttgccgcctccaaaaattgcgtgtccgccaaaatggccaatgtgcgccccaggcgttgtttgagctcgtccactttatccgacagttcagtcagcagcgaatcagcttctcggatcatctgaacataaaataaaatctcaaaattcaaaaatttataaaaaaaatcatttttgttaattttcgattttctttttaccgtagtttgattgatcacatctttgctcttttgttcaatcagcaatgtaagctgatcgatgtgacgcgacaaatgccattgtgactcattcaatttatgtgtctgaaatttttgaaaagaattaagaatgaattgacttaattattaggcattttcaatattgttcggcaacttaaaacaggtaattaatttattgcaaaaaaaaaactcttttttaccgctataattttttttttaccgtttcgagctttaatctcaaatcaaaacaccaccaagtcaagagtctcgagggaatccgaaaactttttttttttgctcttcggactataactttttagtccaattttttttcgaaaatttcagcgccagtgaaaaaaaaagcagaaatttaacagtttttcggtgaaaaatttgacaaattttttgtcatcattttggagtcaaatttccaaaaaaacacacaaaatggagggtaaaagtttcgagatacagaactttctgtcctgggataacctcgtttccccaaaatttaaacaacaccgtttccattgcgacacggaatgcgtttgcgacatgcgcaagtgcgccggtcgattcgcgcacgcttttgttgacgtgttcattaccgtacaggcaggcgcccatcagtgcaaagcacagtacgctgaccaggctaaaatataaacactgtttagctaagggctgttatcaactgtattgtttgataaagatgtactgtgaatatatacggtaaaatttttttgctgttatttaatgagggggggtatcattaagcaattatcattaattaccacgttcctccaaatttatttaatattaaaaaaataacataaagctttcggccaccatttctcgactgaattcaaaaaacagtaactcacaacagtgcacaggagaggcgtccaatgcgagtgcgcgatgtacgatttggcgtgccggaacggtgcgcgaggcagcattgtgctacccactgaaaattagtgtggtctgaaatctcgtgaaaattctcgggtttttggagtcacgattttcgagaaacaagaagctaattggaaggtctcgatgagggtaatttcggtgttgagagtacgaacgatttacttatcttggtgagactcgaatgggactcaaacccacgatacaattaaactgtggaagctcttaatccactaagccacggcatcctctcccccccccaccattaatggcattaatccaacaaaaaatatatccacccaaagaagtgtggcgagcaaaatagcagagcgagcagcagtgaaagtgcgcacagaatgacaaggggactgaaaaaaaattgaaaaatttaaaataaaaattaattaacatca

SEQ ID NO: 13054 - DNA, 1630 bp, Heterodera glycines
cgggaaccactggcgggaggggtcggagatttggccttgggggcactttttgacggcgcatccaggaaaactataggcattttgatccgaggtccagttcagcgccagcggcgctgaaacggctttttcaaaaatttttttgctgttttttggattcaaaaattttttaaaggcctaaatgaaaaatcggcctcgataggattttaagttggaatgtttgccacattttttgcttcttcaccgaacccctagggcctaccagtttttccgaaaaactgactaaaaattgcatacttttttgggccatttcagcgccggtggaataactccccggcttttgatgggaggaggtcggtgtaagcggcttttttgtagagctcgacgagctctatccaaccatgtttttagatttcagaaattttcagaaattttcgagctaggccccctcgaaaattttccgtttttgaattttattattttttacagatttttccggggaaaacggagaccactttcaagcaaccgtttttcatgctctatcgattggtgtcattttcagaaaaaatttttaaaatttttttggaaatagaaaattttggttgctaggcctcaatttcagttctggctcaataactcgtcaggagttgattttatcaaaaaatcgtctaagagcttttttgtagagaattttaagcccaatctaatgtgctttatctcatgttttaaccatgagtttaaaaaaagttatgaaattaattgtgattttgaaattaaaaaccataggggggaccccatggttttgcatttcatgaaaaatttttttgctcctaaattagccaaaatgcatttttatggcctaatttaaggtgctgaactcgaatatatactttatttttggtttcagactttttggaaggtggttataaatttttgaaaaatcgtcaaaatttgagccccggaaaatccagtaaaattttgaaaattcatctctcttcgtttttggtcaaatttagtggaataaagtttgaaaaatagcaaaaaattaggagaattttatgagatttatttggaatttctatcttccaaaataaaaaagttattccagaatttctggaaaaattcaatttttcagaaaaaaattcctaactcccttctaaaaaagtattttataaaaataatatactcaaaaaatccgcaattttttgctctattttataaattttattttagctttttatcacttttttgaaaaaagttatagaaataaaagtgattttggaatttgggaccacaggggtgtgaccatgatttttgagaggaaaaattttttcaccaaaaatcttccaaaaacatgtctttaggggttatttgggccgctgatcacgaatacgtgatcagattttacttttgacatcgttaagacctcagaatccctgtgtgattggggattctgaggggtggggcggcatgttcggacccaggccgtgtttattattttttaatttattaaaaaacgggcgcgaagcgcccgtcctgaggccgcgaagcggccgaatgtccccaaaaaaattaaaaatggcacgaagcgcccgttctgaggccacgaagcggccaaatgttcacaacaaaa

SEQ ID NO: 13055 - DNA, 4557 bp, Heterodera glycines
  misc_feature (4536)..(4536): n is a, c, g, or t
atttggtggtggtgatcatagctctctgttcccgcttgagtgtcttagtgttgttgttgttgttaaagaaccatgatttagtgatgatgatgatgatgatgatgcatgatgaacgtgtgttttttttttaattcaaatattgtcgtttttttttaatgtcagattaaaaaaaataaatgttaactattcaaaattgtacagtgacatttcaactacagcgggcgcccttcacaaacacagagtttttgaaaattgctcaaaacggattcaactcggagtacgatccccaacgattccatgcaatcattatacgactgcgtctgcctcaacaacgcactcttgcgtgtcttctatttcgatcagcccgtgcggtgttaacgggtgtcccttgtccaaacagagcggtacgcgaggcgcaaaaaatcagaagaagggtgcagcatgctttgggctctcagttagaactccatgagatacgtgtgacaaacatagttggttcattcacattaccccatcgtttgcctctgttgaattttataccaacactggacccacacagatttcgtaacatccaatatgatcccacaatttttcccgctatgcgttgtaagattgttgtagacaatcatcacgctttggtcacatgtttagcctatcattctggaaaaatcatttttacaggatccaaaaagcaggaacatctgtctcatgccttgcgattgttcttagatattgtaaattattaatttctttctgtatgacaaacgcttgcaagtttcttcttatatgtgttacatttttttattgattccaatttgagcatccgggaaggttaacaattaataagttgtcatcaaaatcattcagctgtcgttggtgatgttcagcttgttcttgaaccgtttgtgcttcacgaaatccgaatggtacagtttccatgctggggcgaatgcgccccttcacataatgaggttggtagtctttgtgagcgtcgtaggtgtacagatccgaacatggagttcggccaatttgtggaaattcgattcttatcgacgcgttgcttcccgggacaacatgaacaccttccatgtccagcacatcatctctgtggaatagaattttaggattattatgtgagagaaaaatgtgttaacatttgtccatcaatgttgtaatgtgccaaaacaatgcgcttcatggactcgaagttgagcagttgctgcgcagaatatgagagacgaaaacttcggactttcaattcagcacgctcatcctctccatttatgcgatcacaatggcgaaaaccataattctttggaccaccggacacaaattcgtatattcgcctcgagcaatgttccctcttcatctgtcccagcgcttcaccttcaggcacctgctgtctcccgttgtttgtcacgtaataaattgaatcggtatcttgaataataggtcaataaaggtgaaaaaaaaaattttttttttggctcaccgcaataaaggagcttatgaccaagacgcagcacttgttccatatagtcataaaggtgtagacgagcatatgaagtgacaaaaattgcaattggtaagcagttggttgacggtgcttttgcaaattcagcctttttcctcactaccactctgtccatatggtgagagacgtgatgaaagtcaataatgtcgatgttgcgattctcgagcagtgcatgaaactcagctggagttcgggtataacgaacttccgttccaccgactcgttgcgcaagttttccctagagggagtttgcaagaattttctgtgtgttttttttaagtttaaaaaattgtaattctgtattttttttaccgctaccatccgaagtccagggttgtttgaaattttgttgtggtccaactgaatgccttcaacctgcctaaattcatctacataggctctgcgctgttcatcggtatcacaaccggatggccaaccgcttgcttgaactttaagacccacaaaggtgttcatatagtcacgaaacagttggttatcccattcttcataatgccataccttatttttttgaagtttatgtgcaataaacgatacgttatttttacctaaaataaatcaataactttatagccaagctccagtgctttgttcaattcaacatgggtgtatctaaacaccgggacaaaaaaagtaaattgacatggattaatttcacaaaattacgcggaaacccatgcccttgatgcatcaatgtgtttgcatgcccgttgttgtcggttgtcagcacagcgtgcacaaagcggaaaagttaggcgcccgtcggtagttcgatagggaagcaaaggaacttttagcggatgtacagctggatctgggggcagaacacgaacaaacaacagccctttgaatgtgttcgcgtcgacagaacaccagggaagcggtgatgtcggtgcacatagaagtgtctctcgcgtgagaacgcgtgggttaccaaccggaaacgagaatgccttcatcacatatggatataagctcacctttaacaatgaaaaaatattttttgtttctcctaactttttttttttacaatgtcaatgagaattatctcttcgtctggactgcatgtgtaatgaagaataaacggttcagtgtgtccaccccgtagtgcatcctctcttggatcaagcggtcttggaacgaatgagtcattgtacacccggcgaaattctggatcagcacgcagacgctgcttcatttcgcatccccagacaacttccagctcaaagccatgctgattctgcagttcaaatagccgcctcttggttcgttcatacaggtcttcggctgtccttccacctgccaatttttgttgtctgtcgttagcgtaacacttggggcaacctttaagcattttttttttgttcggttgaaaagggcgaccttttttttaccatgataaaagcaacccatgtattcaatggcaaggttgcgttgagggggttcacgtgtgactaatccatcaaggcggtagccagtgtcttcgacgttagcctcaccaattgaccattgggcagaccgaacatgtacccccggatgcgtcatttcataataacgaatgtatcgtgccgattcagcagatgctcgccgcccccttaggtagccaccttctggcgcattaacaagcttgttcattggaagaaagcagcggcggagggtggccaacgcaagaccagctgccgtggatgagattttaaacgggtccagtcctctcgtattttcagcaatgatttggcgaaattgaagcacactttcgcgcagaattgccacatcattcatacagtacaggatgagttgttcacgcaattggaagcgtgcagaacggttctcgacctcccaccaactcataaaggaatctctctttgacgctttcatgtgatcaggctgataaaattctttgcccggtaaaccatgcaatctttggtgtaaattttcacgccgaatgaacagataaggaaagaaaggttttgctgttgcaacttcagcgttcaatccaaatgtgcgtggtagtgcatccaattcacagaaaaagtagttcagcgagtctttaaagatcacgtgtcgttgatggttccctttcaaagtcatcgaaaaaatttttagtcccgttgtgcaaatacgctttggtggcaaattgcgccggtgaagtgcctccagtattaaatgaatgtcgtattttccgccattgtgtgataaacaaattgttttcacaccatgtggaccacttccggtgagaaagttgataaaatcgtccaccgggtcattgttggtagcgtcgtcaaaactatggaaaaacagtcttcgtgggttgtagtggacattggctggtagagcattgtcatcctcaggtgcattcagaaacggaggagaacaccagcgacgcccccttggtcccgcaggaggaccacacacacacccatttgcgtattgtccaacaccagaatgaaccgaaattccttcatttatacacgcttcgcagataatttcggcaataatgagcatcggaacatgtttctgtacaacctttgtacgcagttgaagtggcaaatcttgggacgtttcagcgtcgaaaaagcaaagtctgaccgaccgatttgttccaacttcttcttcttcctcattatcagcatcatgaccgtgatcgtcgtctccctcctcgttaccatcattatcatcatcatcgtcttcgtcatcgttattattattttgttgttgttgctgttgtcctcttcttctccttctcctcctcataggttcatctttgagaggctgaataaaacaagggtctccactttgatggggtccagagcatcgtgcacagcgcacccattccgtttggccaatttgggctggacatttatgtggataattcgcataggttatggctccacattgtcggcatgctcttctccattcacatattggaagaaaagtgcgtcctccctgattatagatgcttgccctggtaaggattgctcagatgnataggcgaagcagtcgtcatt

SEQ ID NO: 13056 - DNA, 3173 bp, Heterodera glycines
cttcaactcaaattgccgccccctccgccgtccgtcgcctctccgtcgcctccgccgccgctttcgctgctacggcatttgcttcaacagcagcaaatgattggtggcacaaccaacagaagtgccaatgggttgccggaggaggccaaactcagcgaagccatcgccgccgcactctccgcgcaccaaacgcatgtgctaatgcagtgaaaggaggagaaaaagcagcgaaattaagccaaccaattaactaattatgttgtatgtttcatcaaaggctccgctgccctttctttgcccccattttgccaaatgtttgtgggtcagaatgccaaaaacgaaaatgcgcgagcgaagagctcgttcactggagtgggagaggctctctgaccttttttgtccttttgaatggaaaagccttctcatacatatatatctatcatatttatttttttattatttaatttattattttaatttatttctgatgcgtaccgtattcattcccacagtgttaccgtaccctttctatcgcgtctttgtcatttccaccgtaattaatttctgcgtgtttcgttgtctgtctagtcagagttcacaaaaaaccaaccacccaattgacaataatgcaaccaaccaattaacttttaattgagcgaatattgttttgttttttcaaaatttgttctccaaacccttgctccctctttctcagcgctctctccgagttccgtgctctctcacgcaccctttttctatttctctgtctttcattttcccactatttcccccctccccatttatcaattgatctgtttttttttcattgttctttcagctttttttgttctcaatgttttttttgtccttttcgtttttcaatgcgcagatgaaaaagagagaatcagagtgatcagtgatcgatgaatgaaatgaccaccaaattgttttttatcgttaatttataaaaaaataagtgcttaattatgcaaataaatgtgaatttggcactgtttcatcacagctctcaaaggcataagaagacagagtttccacccgttctttggcatttcactaattttttgttttgttttggctgatcaattattctgcatctatcatccctctatttctgatcagttcttcttccgtttttgcttgtaatcatcagctgatggtgatcagtcgttctcattcagtggatcttttgctgctcttcatgactctgctctgatctccttcgtttgcttctgatcaattttccttctttttctgatcagttctttttctgcttctgatcacttttttttcttccgttcatcggtttctgatcagatgtttttgatcagcctttcttctaaccggtcatttcctctgatcagttgccttctgtcgtctctgatcagattttctgctgtgtgccgtccccccgtccgtcctcgtccgctggtgccttcggctgaactgtctgaacatcatcgaccctttcatctgatgccctccccctcctccgccgcctcttttccgcgcctcccctttccctttcccccgctgcgttcgtcgcaaatgtcactgagtgacccgtggcggccttctgtactcctccgacttcttgtgcccgtcgaatcgtttcgctgctcctcgccaatccgttggccattcgatgggcggcgcctttcttctgacaaaggcattaattacccgtgagggatttcattataaacaattagttgtaattacttgatgagaggccgaaattcgccgaccgacccaatgggcgagcagaatggcgaccaatgccaacgagagcaaagccaagctgcacagaatggcccacagcggaatctgctcggtcctggggttgaccgagaacgggtcgaactgtggcgggagtcgagccgaagcggcggtcggaaagggcgaaaccgtcgcggacggacggaccggtgaagtctgcccgatcagttgaatagcacgaaccaactgatctgagaaggaattccgacagggttaagcggtgccaaaaccaacccgaaagcacttcaaaggcactcttttcggcactgtccacccgtaccaactgcgaatggtgtgccaaatgggccaaatttcgtctaaaaccaaaaagagaaatgacgatgaatagctggccaagtgcttcccaaatcacctgaacagtcgggcgacaaaaggcattggcacagtgccaccggaccatcccaaaatgaaaaggacaagctaaaaggaaaagcgaggagtgagtgatcagcagaaaaagcccaaatgaccaagtcagggtcgcaccgctcccgcgcatttgcactgttcagcagccgtttcaaagtgccgcgcacgaacagagcagtagcagaggaaaagccatgggaaagagctgaaaggagcaactgatgagagaaaatgacagttttttggactgatcatttagaattaaattggcactgtattttttttttgaattgatcattaacattattttttgactgatcaattcattttttattatgttttttgtctggtttttttaaattaaattggcattttagcattgttttatttgtttttctcggcacttcttgttatccatctctcaagttttttgcattgtttaccttctctgttgcgcctctgttttgccattgtttctccattggcctttcttttttgccgttttttgtcgcccgttaatttggcacatttttttatactttaaaataaagggaatttaaatctaatgcttctccctccgttcgttaattaggtctaatcgccacctgttaatgctggctcggggagtgatcagaacaactattcgaatttggtgcaactttttgtctttccacgccgaatggacaaaacattttcgaagagaaggcgacgaaccatcgcaaaaacaaccagtcaaattaagcggatggactgactgattgggcgaaaaggaagccgaaatgaggcggcgatctgacggaaatatttccaaaaatgtttataattttgccataattagagtaatcaccgatcaattcggcttcagtgcgcgacagaatgccagctgggtcacaaatgtacgggatttggtggtagtgaaattggcagaagggggagagagaggcggaggaagacggactcggcaaatggcacggatccggcaaggg

SEQ ID NO: 13057 - DNA, 1024 bp, Heterodera glycines
  misc_feature (1006)..(1006): n is a, c, g, or t
gtgaaattataaattatgcataatttgggcacttctttgtgttgaggccacgccgaatttaaagaacgaatcgcgaaaagatgaatgaaattggaaggcataagaaatgaaaggcactcatttgcttatgcaatgggaacactcacaatcagaggaaattgaaaataatgagcaaatttaaccgaatgaatacattaattaccattgttaaattcaacataaaatttgatagtaactgaaaaagcatctcggaaattcggattttcttaagagcatcgatcggaattgatttccaaaaaacccatccaaaagggccatgacaattcgacgatttcaaacacaccaatgtaagcagctccatctctgcttgacatcttaaaaataacaaagttcagcagcaaatcggcagatcggacatttcccattcgacgaaattcgatttaaaaaaaacaaacgaacggagaaaaagcaaaagagacagacaaaaagtgatcagcagcagtaaaagggataccaaaaaacggagcatttccaaagccattgtcaattcaatgggccaaattttgtcgccctccgccgatcgctgacaaaaaaaataatttaaattcacaaaaaattcactaatttttcttttttttctgttcatcagactttgttcattttgttttgattttgagcatgtccacccttttccttctgtttatgctccgattgataagaaacaaatcgatgcaatttaagggaattaaaaggcaataaaagtgagtaattgcggggcgaaaacgaaaaatggagcgacgcaaaaaaggggcgaaacattctcaccaaaaatatgacccaaaaaagtggaagggataataaataattcatttagagatttgcacccttttgattaatccgtattattaggaagttatgtacatactagggagagcgaagggaataaattttttcaatattttgctaaatattttggcatgaattatgtgcgtagtgtttgctcaanttatatgtatttgtatat

SEQ ID NO: 13058 - DNA, 3997 bp, Heterodera glycines
ctctgcccatcttttttaattattattttaaaaaatgaatttgaacttttgaagccctcaaaactaataataaaaaggttcccatgcttgtgattatgaatatttgatgtttccaaatttggcattttatgccaattttagcacaatttttgttggcggaaattttcgctctgcaacgataattctttgttattcaattattgcgtgtgaagcatgaagaaaattgggattggacatataattacccactctgttggccatatgactaaaggccctccactaaaaatggacgcaaaaattctcaagattttttttttgctggggtgagcatgactattataaaacacgtaatttttagttcacttttttgtgccgttatcttattaaaagcctaattaaggaaataaaaatttaggggtataaaaactttggcgttacctttcaaagtcgtatattttgaattttcttaaaaaatttggacccttctggttttatcattttttttttttggaaataatatatagtcatgagaacttatttctggctttatttgtttctgatcatgaatgtgacatctattttagcctgtttaaccaatttccgacttcctaatttaatttgaaaaaataaataaatcgaaaattagaatttacaatttttgttcatgttacgctttagtgattagaaacagatcaaaatagatgtcagattcgtgatcagggactcaaaaaatcaatcctctgggaacaagcaattatatggcttttcaagagcgcccgaattattaattttttaaataattgtgtttttataataaaattttttttaattttacattaaaaattggaaatctatgcaaacaattctctttggtaatttaatttggtatttccaatttaattaaatttgtttgttttttagattaaaatgaattattcagattcgccaagcagacgagcaagtgctgttgcaaattgtttaccctctccgtcaataatggagttggcaaaatcggcgggtcttttgtccctaaatccgagcggtaaacaaaaaaaatttttggaggggattaaatttcagaaaaaatgccaacataatttaaaaaatactttattaattgaaattatcaaaataattataaaaattaaaattctttaatttatataacattttttttattaaactcaaatgaaaaattaggaattattttctaaagaaaaaaatatatatttttgttaaaataatttataaaattaattttttacaatatttaaaaaatgcaaattaatttgaaaattttttattaattgaaattatcttaataatttataaaatgaaattctttgatttaaataacaatttaatttcgataaactaaaatgataaaattaagctgatcaaaattcattcttaattttaagcaaaaatattttttaaattgaaataattaaaaaaaaaattataattaaaataataaaaatatcattaacaaatttaaattttttgcagatttggtgtttgagtcgtccgtgctcggcattgcctactacgactttgtgctgtcggttagcgaggttgaatatgcgcctgcaccatctgctggtgctgaacatgaacaacaaaaaaacgaaaaatcgccaaataaaaaagcgttggcgaaacgtcgtgtgcacgagacgggaagtgcgccgttgaacggaacgccaacgatgggcggcgctggcgcaaatgcggcgccaattcaaagaaagcgttgccaaacaatggaaaaggaaaagggcggccgctcattggtggccatgttgcagaagcagcgaacagaaatgcaactggtgaacaacaaaagcaacaacacaagtgggggaaaatgaataaataaataaattgaatatttgaaattaaaaaaaaaatatatatatctttaaaaaattatttaaaattaaaattgattatttatttaaaaaatgaattaaaattatattttcttatttaagctatgagggttttttgaaccctacataaaatctttctaaatttcgaaaatttttagaaaaaaactaatttttgaattatttctttttaattaaaacctaaattaaatttattttactctattttccaaattaatctactaggatttttgtaatccaccatataaaagcaacaatttatattctagccaaatactaatttattatatacataaaacttttttcttttctaaaagttcttgaaaaaatacaaaattatttatttattgtatacaaaataaactatgtttttagtttctcaatttttaataattaaaaaaaaatattttttttatataaaaaaaaaatattttcatatattcctttaaacacaaaatttttaatcctaagctttatattctagcaaaaaatgtatttattatatgcaaaaccttttttatttctaaaattaaaatctttttaattttcttttttaaaattaatttttatacaaaataaattccagaatcttcatcgcttctgccaagctttgagaagggttcgatgggcgaaattcaagaaaaatgtgaaattgaagaagcagaaaaaaatagtagcaacaccacaagaacaccatcaaaatcaccatcaatagaacgcaaaaacaacaaaaataattgtaataatacattgtacagaatatttttggccaaatttgatgcccatacaaatgtgcaatggttcgaaagtgtgttggtgccacgggtaaaattttaaatgttaatttagataattgaagcattaaataatttataataatggggcctaattttttatttatataaattacaaagcattatatttttttttattaaataaaacaatatcaaatttattttataaataaggtaatataaaaaaaataaaaataaatattgtttattaataaaaattaaaaatcaatctaattctgggggtccagatcagggtttttttgatctaatacgtcatccattttaggtgggttttttgggatctggtattttctgggtttttgccagaaaatacaagtccaggggcccagacttttttcaaaaatgtcataatagaagcaaaaatgaaaatttacagttgtgacttcctaaatttgctgaaaagttggttttcaaagcaagaaaaaagaataaacataaaaattgaataaacataaaaaattataaaaatagaattaatctattgcagagatatttttaatacaaaattaataaaaaaatatatttaattgaaaattttaaattattagatttaattattaaaacaaaaataaaagtaattatttaattgtttaaatgtttcttaattgaaataatattatagttatatttgccaatttaaggagttgcttgagcacaatggcatcccagtcagcgagttgtccctgctgaccatgggcattttggtgtggcgctgcacgctgaacaatgcgcgcctgctgtgcctcgtgaacggcatgcaaaaagagcaaatgcacgaagacggcaactcaactgcagcctcgtttgaggcgctgaagcgcgcagcaagcaaatacaagtgcatgcaccacgtgctcacggtaggccaacgacggccgtccgttgcaagcacacacagctcatgctcaagctcaagtcgtaggtgcgtgttgcacatgcatttttattgattagagagattaaaagtttattgattttttggtaaattaattattgatttttaggtcatcttctgcttctgtaacgcgaagccaaacacaacaagagaccgggatgaagctgcgaattttagtatgtgtcttctatagcccggaaccgggcgatttcggtactgagtcggaattttcgctcaaactcaaaaatctcaacgaaaatttcaaaatttctcaaaaatatctcccttatacgaacaaaatccgttaattttaaacaattttttaacaaaaatcccgattctggaaatgccgaaaaactccatttgcgctcagttga

SEQ ID NO: 13059 - DNA, 1638 bp, Heterodera glycines
tttggattttttgaaaaactttttcaaagtgttacataaaggagttttggagttcgttcgaaaatcgcagctcacaaatcaatactgaaatcccagttccgggcctctagtgtcttctctaaaattaattattaattttataataattaattacctaattaattactttttgaagatgtgccaatcgcggtgtgaattgcctgaagtgcccccgcaggcaattagagagaccaaatttctgttgtgccccagttctaacccattactatgcctatgctttccattaacataataattcattttcctctttaaaattggatcataattattaaaaatttaattttctttatctacatatattatatgcttttcatttcataatttatatatttttcatggcattatatcttttgaaatatttttaaaaattctttctctttctatgggtaattcaaatctgatagagagacctgatttacggaagaacggattgacgtatgtttgtttgtttgtttgcttgctcgaaaattgtcattaaatgataaaataatttaaaaaattcactaatttttcaacaaagattttggtcaagtttatggcaaattgagtaccaatattttaaaaatattttcccgagcttaattaattggaaagggtgccggtcaaattgtatggaatttgggaaaatccctataatttcaaatggaacacaaaattaaacaaactcagatttgttagaggacagagaagaaaacaattactttgcctatttaggactttttgccgatttgcctatttcgccatttttggcgcctttttcaggatttttggaaaaattcttaataaaaattcaacaaaaatgaaaaaaataagtttttttaaaattaatttttatgtgttttgctaccaaaaaattttttatttgcctattttagtgcctattcggggatttttgtgcctatttaatgcctatttttgcaatattttttttgcctttttaggtgcctatttcgcgattttttgtgcctaaaaatggaagccctattagaaaatgagaatacaatcaaatataaaatagtaaacagaacgccacaattaacaattatttaatttcacaacaaattcacaataatatcaaacacaacaaaaattcagtgaaataaaaattctaatatcaaataataatttttttgttgtccaattttcccgggaaacgcaagtcagtatagaaaattgtacggattcgtaaattcgggtttttaaggattattgtaaaatttgttcccatatcagtaaattcaggtatatttaaataaaattaaaaaaatatattttttcatattattaaaatctgagtgaacaaattgattttactactcggcattacggacaatttttggtcattggcaaagatttattaaagaaaaaaaattttcattttggattgaatccggcaaaattcgaacaaattttgatgaaatatttggcaaagaatgggaaaaaaatgatcaaggtgaaactataaaacagagaagaaaatgaaattgaatcaattgatcaaatgcaaaatgatcaaaaagttatcaaaagggatcaaaatgtgaaaaaagaaccttcaaaatatgatccaaaaatgat

SEQ ID NO: 13060 - DNA, 3235 bp, Heterodera glycines
cattcatgacagatggcccgaaagccggaattatccaacatactcttaatctgtggaccaattcaggatcctcgatcagttcggccaacctcctctgccatcccgggatcatcagcgaagatccgatcaacatcttccggcgaaagcgttgtcagaactgcgttgtccaagtttggctcaattgttgacacaattgtattggctaccacggcgccagtaatgaccgatccttccggtgatgagatgtcttcatagaccgggtttggtagagcagagatgtccaacaatgctggtggacttgacaatgctgccgacgcagacgaagactttttggagaaacgttttgacttttggtttttgggcattagctaagattgaacccaattaaatcagacggtcatttgcttatactcaattattggataaggaaaaacattggaaggtacaacggggaaataaaaagagaaaaggagaaaaaaactgaaattgaaaagctgtgctaagcataaatgaagtgtgagaaggatttgatcgagaaatgaatgatttgcctagcgaaaaaaaggtttaaatattaaaagagattttccttcgcggatgagaatgaatgtgaagatcgagatcagccttttatggacacattagctcctcccataaggcaaaggagccgatgaagaacacgtgaatggtcactggctaatggaacaacaaaggtaatgcgaaatttcacggtttgggatgaaataggtagagagaaatgaaaaaaaactattacgattaatgaagaaaaactgtaatataaaatcaatgcatactgtagtccattactattactttttttgaatttcaatgcttactgtacataaaggaatatgggaaatagtaattaacatttgatgaaatgttattttatgaaaatgtctttttcttggaaattacgcaaaccaaaagtgtcttatttcaactgtacataaaacgagttggagattaaataaaaaatatttggcaagtagtttgatagctcaggctctgctctttttaatgaatctatatttgtccggattggtttcgaattcagggactagttaggttttttgtgaggtactcattagggtaaaagtgaatgaaatgacaagggatcgttgtaataccaaatacatcattaaaatggattgaataaatagcaaagaagaagggctgttatgtgttggcgatttcaaatgctgtggccatttttgtcatttgcttaaggtaaatgttggactatatgcaaatttgtatttgagtgagaacgacgcaaaatttgaatgaaatgccacagagaatttgatgagaatggtgcttgagagagagagaggaaaaaaatgggaatattaacggtggaataatgttgaaaatggttttaatatttcgaattatttggtcatttaccgtatcctaggtaaaatggtagtacgatagttaaaagatttttgaagtttatttatcgataattgacttaattataagtgcctaatcagacattcgccagcttcttgatatgtcataagaaagtgaatttcgtttttttttgtattcgtcctatcggaacgcgcggaacaaatcgattttcaattcatcgctaattcatcttttagcgcttcttgttttttttttattaaaagaatatttgattttaaccctaaaatgtcacaaaatcgttttttgttttttttttaatcctttttcgtctatcattctctctctatctctttttgtttggttttttgtttttgttttccatccttgacaattcccgcaaacgggcaactcgcgttccttttgttatgttcactttttacggccatttatagcttataatgccccgaaaaaatctgcgttcacggcaaatgagcgctcgccggcgggctcaagaatgctctaaatttgagcagcaaaagaagcagctttttgatcattttcatcggtctggcccaattccggcccatgacaatgatgtcgaattagccatttatgattttattccgctttcattggccgcatttccggtgaccatcagagccaaatttccgccgcaagcacaattcgacgtgttcccctgtaaacttaatgatggggcgtattaccgtccacctcagggtcacagagacccagcccataggtccgcgccataaaatcagcttttatgagtgccttcagctttattttttaagcttttactttaatccctccggcattcgtgcacataccaagccgtgggcaaagcttgttgcgtgtgttgtcacgaggtcattcactgcttatcccggcaattctgtggcgatgagacttctgtgtgcgcatcaatggtcggcaacaagaaatgttcggacagctttttcaagcttaaaaccattttcctcgagacttacccattcatgactgatttgctcgatatttgtgagtaaatgtgtgtttttttttttttgcttactcagattcatttgttggtgataggcctattcagaatgattgtgcaaagatgattttgatttatctaaaatattggctgataggactcattatatacagaaaaatcattcagtgaaccgttttggttttgttatagccaatcgatttcttagagaatatcttttgtcaccactaatatctgcaactgtttggttggtcacattttgtctgtttgtaacggtcgattcactgctttcttggttcgaattatcagcttctgacggttcattgctctgcacttcttcctcatcatcaactgctaatttttccggcactatttgctcgtcattaggagtttttggcgatgtgcatggggggcccattagctcaaagcacttttttatttgattgacgtgtactttttttggtggctggttcggtgaaatgcagcttattatggtagcatggacaccattcagctcaactaccctgaaaattcccttccaaggaaggtgaaattttttggaagtgccaacttttccggcatagtttctaagtaaaaccctatcgccaacgctgattttgggctgtcgcattgttttgtcatattgtgttttcatcttattctgtgcttcttcaattgcctccgccgcacatttccatgcttttcttaaagttgtaactaatttgtgagtaaattcgccatcatctttgaaatcaacttgactgtgaacgcgaacgtccaaaatttgatcaacacagaaaatggggtcccgaccaaaca

SEQ ID NO: 13061 - DNA, 5572 bp, Heterodera glycines
ttgatcgcgatcttttctctgctgatctgtgtcttttgctactgatcgccccccccccaaaaaaattctctgatcacttttattctttgctttacatatgttttgtatgtgttttcaatcattcatgtatttcgggtagaattgtgcttctcgcgtacacaatgtatcccaaaaaagcaaaaacaacaaccgctagtaagtgctcaaaaggcacgcctttgttcttcgccgcctgtaattatttaaaatgatatcatctcataaatcagctctctcatttttgctctgtcatgccatgacatatatttttctggctgtttgccaaagctttcaaaaaaatggattttaaaaaattgaaaattttttttcacttttcaagaaagggatggccggttaactctaaaaatctatattaaattattgaattagtccattttccattccgatttttctgaaatatttaaattaagaaaatattttcccgatttttaaaattttataggacacaaattctcttttaaaacacaaaaatttttaaggctttggcactttttcatcactttttttcgtttctcacacattcagccaataattaaattatctttagcaatttgttgataaatgctttttttccattctcaattccaaaatctctctcattaatttttaaactttatttaaacccgtgtcgtaaattttttttttgtttgtttgtgcccatttccaattcaaaaaaatgccaatggtttatcaccataaattttgatgatttttttttcattattattatttaattaatgagttattattatttatgatcggtgtggtgtcactttttatttacacaaaattgcctccattcttttagcctaggccaccaccgccgttgctccaacaaaatgatctattcttttgctgatttatagtgatctattacactggtctttcatttcaacattttttggtttaaaagcatcgattagatctttttcaactgatcaccctgatagatttatgtaaatttcacaaactcttgatggcttaaatagccgttttgaatttacccctgatcattgatttgctaaaattgtctcccaaattggtttcttccactgattagatttagcttaacattttgagtgatcagcttgcctttatacgtggactttcactcacttttctcattctcatgatcacctagtaaacataaacaaaaagtttcacgccaactcattccgcactgatttgatttaatgtattatttaattgctattaaaccaattaaatgtgatggtgctcaactttaaattttttttttttaaatttagacgataaataggggatacattatcatttaccgtatcaaatgcacttgcgttacgttttaattctaattatctgttttatttatttatttgttatgttcccatttcatatgttgagcacttccaccatttaaatattacaaattatattattcgccccatctcgtcaatttaccgttatgctcattacagtatacatttttgttcattaccgtatcccatttttcgaatctgttgctttttgttaaatttgcctgaaatctatcactggtcttcgcatatttgcgttttatacatataattttttttaaattttggttgatgaaatcccttagcgtacaaatgcatcaatttttgtattactgtagcagcgattttcactgtctacagtatgcctgccttgaccatatgaccatttttacaaaataattcgtggtaaaacatattgccaaactaatactatttctgcgtcatttatcatattcaattattaccatttgctcttttttaaattaagtttttaattgtaaatggaaacagatttttcattgtgacttttatagccgacaaacaatattcaaaattaaatttgcataaatataaactctgtgaaataagaaatttatattggatgtcactttaaaaattttacataaaggcaacttttattaaaaaaaaagaaattgctattagcgaatatttgacatatggtcaggttaattagttatcattttccgcaactcatgcaatattttatttaaattaatttttgtcattttcgagtttttatacaaactcgttgaaaaaagaggctcttttagaagagtttgcacatggaattgtggcaatcaatccatcattatgagagatattcagccaaatacagttgactaaattgctgtcgaaaactacacctttaatttgttaaaaaggcattttattgcttttggtttgtagatgaaatgcgtgagaaaattacaaaaaaacagtttaaatttatttttctctttaaatcttataaaaatttaaacgtttattttcagtttttaaaatatattacatctcatatttaaaaaagtgcaaggttgggcgaagttcgaaaagtgcaagtgatcaaattaaaagcaaaataattattttaaaaattaaaagcaaaataattatattaattcaatttaagaattattcttaaattttggctacaaagcggatctcgtttttgtgtatttttttctctttccttttgagaaatttggttttactctcctcgcaaaaccattttacgaaattatgtttgaaatatttgttttcagtttttgtaactaaaattagcgcaaaatgtaaaattatttgttgtgtttgatttttaaataaatatccattaaataggtaatatagttataatgtagcttcggttcaccacgaatatgattaatataaaaatatattttaattatgttgcgaaatttaaataatatatattataattaaataataattattttgcttttaattttttaagataatcatttgcttttaatttgataacttgcacttttcgtacttcatcatagcagggataggggtgatgagctgctgaaatgattgttaataatgaaggtcgaagaagcgccacggatttgcattggaatggaaatgtgactgattttgacacgtcatatttttgctgtgaatggggcagttttctgacatttaacaaatttattatacatttattttccatattattgaatagggaacgcctcatcaaatccgtgggctgctggcatcttgaaacattcttaaattatataccaatggacaattaagcggccttttccaacaaaatgtttgtaataaaattttacaggaatagtccctaaaaatcctgtcttggaaaagcaaatttagtcattttggggaatggctcttgaatacataatgaattttttattttttgaaagattttttagcttatttgttttgtatcaaactgcttaatcatccgcggtccacctacaaatgaccttttcaattgccaaaacaatttcctttttcataatgctcttaatgtgcaccatttgccaaatattaactgacctaacgtataaatatttttatttttatttgaataattaaatttaaattaagtattcatttgactgatggcggtggtggattcaaagaagcgcaacttcatacattggcacaatgccatgccaacaatggaccaaaacaaactgcaaataagccttacggaattgaatttcgtctgcctcgggaaggcgaaatttgtgatgatgggtgggaaaaaatagaaaaaaataaaataaattattggaataaatttaccgaaaaagctaaccaatagctgaatataacaccaattatatttgaaattaaattctaaattgatggtaacattctcatctgctacccagcaatgcttcaacgaggcgatcatttggacaccaacagaaattcaaaagttacaagaaaattcatcgttggtgctagtacggtaaaatgctctaaccacaatttctggctaattattaattacataattaaccctcagggcaattctattgcagaagaatgtgttcaaaaaatggcaaaaaatggctacaaaaatggcacaatgatttggcgtggcctcaaacttcgcacaatgcaaatgaaaaaggaccaaaacaatggaagaatcattatttttgagtcatcaattgcttcacagaaacagttgaatatttttaattgttttaaccgaattttttaaaattttaattttacacttttataaaattaaatttatattaaaattattttaagatataatttgagtgcaggacaacacaaattttctgtactttttgctttgaatcaaactgctgtgccattcacgcgcttttcatcggtgaaaaatggtgaaaatattattttatatattttaaatgggcattctcggctttcccaaaatgccatttctcagatttcgatggcagtgccatgcaaaatgatttcctccgttcaaatggtccgtcttttttgtcggattatgccgacctttggcttcttggacttgacatgctgccgatggcacaccaaacagaacagcaaagagaacagctgaagatgaagctgttcattagccgcagttccaaatgctccatggaagcatgggtaaaagaaaggcaacccgacaaaaaaggaccaaattttagggatttaaagattttcctattttattttatgggctttatggaaatgatatatttggcaactatttttcaattttagctatttcggtcaaatttaattcctttaaagtttgtccaagcgtcgcattcccttgtgccatccgatccgaaaatgcaattcaacggttcgttgtgcaaaccaaatccgacggaagacgtatatgaacggtaaattaaaagtgaccatatgataaaaccaaatcgaccatacgattaaaaaaaagtgtgaacttggccgtttcgtaaaatccgccaccattggccatccattgtcaatgaaaaaaaattataaattaaatacgccaaaattttgaagatgaatttttgagaaatttatatttcttaggggtgcatttatgaaaattttgttcgattcttaggggtgtattttttgaaaaaatttttttgttcgattcttaggggtgtatttttgaaaaaaattttttgttcgattcttaggggtgtattttttgaaaaattttttttgttcgattcttaggggtgtatttttgaaaaaatttttttgttcgattcttaggggtgcatttttcgtttttattgtatttttgtaaaataaaaaaactagaaagtaggctctaataactagaaaactagacttaacaacaaccaaaaaaatatggttttcatgcgtttcagaccatagggggaacagagaaaaaaagagtaaaataaaactagccggtataacaaaaatttgggttcttttctgttttgtgaccccccctgaaatttacaaataaaaagtcatttctagggttgtttgtggcgctgatcacgaatatgacctttattttacaaaattccgaaccccgtacccgaaatcgaacaaaaattcgaaattcaaaatttcaatgtaaacatatttttaggggttttctaagtcgctgaatacggatatggcatctattttatccaattaaataacgggaactcgataaaatggagttttttttcaacaagccataa

SEQ ID NO: 13062 - DNA, 1706 bp, Heterodera glycines
  misc_feature (582)..(582): n is a, c, g, or t
cggcagcagaactcactcaccctacttaagtggtgcccgtaaaaatcgtttctttttttgccttttggcattgtgtcccgtttgccgcgcccgggcaattatgacacattaattaactccattaaaattgctgcataaaaaagtatgtgttttgtcacgaatttgtcccttttggcaacaccttggaaacaaaaacgcaccccgacaaaacgtgtacgtgcacaaatcggcatttaaaattgtcatttttttttggcgtaatgatttctttcgtgacttttttttgttcctccgccgtccttcccgctctctcctgcaattcattaagccattatctaatatggcatttcaaatctatattgtccatttttcttttcaatttcttgaattgggaagcgggttctccattcattcacctcattcaaaagggcgcgagcgaccaaaacaaaacaacacgtcaaacaaaacgccacagatttttgaatgggcacagcggaaggaattttgggggagagaggggggggggacaaaagggtgaaagaatttggggggtcaaagaatgaatgaatgagtgggaggggnggggggcagacaatgggccccgaaatgatcaatacattgggcggttctgctgatgttttgtgccctttgtgtggcctaaaagttgccaagaaaatggtcaataattgagagttacataaatggcaaaatgtggattttccggaaaatttaaaaaaaaccatttttaatgcattttttggtttgccctgaggggactcaattggtggcattgtttccaaattaaggtgccaattattacgcaaatttattgtgttgaggacaaaaagcgttacatcatttgaaaaatagggctgctgttcctcgtccccgacaattttttcgtttttgttattttcggggaatccctggaattttcaagaaaacaatcctaattagaaagcattacgaccttttgtataccgtattttttatctctttttcttgtcctttctttatcaccgtaatttccaattatactaccgtaaatttggcaaaatgtcatttcaaaatttccaaatttttcagcatttcaatttgatggcaatgatgacactgttggaacaacttcccggcggtggtgtcgtcaccgccaccgaatctccccaccaaattggccatttacatcaccatcatcagcaaccacaacagcaattaaaggcccagtcggcctcctcaaatgggccatcaaataacagtgccgccgggtcgggccatggccaatcgccgggcggcggcattttgctgtcggcaacttcaacacccgacggcacattgatgccagccggcaccactgatcatcagacagccggtggccatcaaaatgtcgcgcatatgggagcaggtaattaattaatgagtgctaattaagggggaatggttgccttttttgaatcaatcaatgctagtgatcgggactgagattaatgcgagtgttgctctggtgacgggaggttgaaattctcgaaaattgggggaattgatgaacaccgaatttggatacagattttcaggaccgtaatcaaggggggggggggggaggcattcataaataattaaagctcaatcaacgggagaaaattgccatttttggaatttcggtacacaaaatttcacgacccaaaatgccgtgggagctctctctctct

SEQ ID NO: 13063 - DNA, 1042 bp, Heterodera glycines
catcatgcgccaaacagtgccgaaatgtgctcgccgggcagctcatccaattcagcaacatcatcatcactgtacaacaacaataaccagcaacatcaacaacaacaggtagcagcttgagccagcctagcctatctattgaaaattgagaaatttctagaaaaaaaatccaccgaatttttgcttttctgtctttgtgtacctgtgggaagaaaccccaaattagttaattaggttcgaatttaccctccctattcatcaaaatacagaaataataaattattctcacgcttttgtgcgtaaaaagagttataattttttctggtgctttatgtctataaaattccaaaaaagggttgcataaaatcgtgagagaggcgaaaaatttaactgaatgtggccctaaactaaaattaatttgtctctaattaatttgcccctaaaaaaactgatttatctctaataaattggacataaactaactaatttgtcactctaatttatttggccttaaactaactaaatttttctctaattagtttggccctaaactaaaactaatttgtctctaattaatttggtcctaaaacaactgatttatctctaataaattggacctaaactaatttaattaaaacaaagcttccagtaattaacaaatgaattcccttccaacatttcagaatttcgctttgtccatcactaacaatcagcagcaccataacaacaatatggagcagcatcagcatcaccagcaacacaaccacggcaacagcaggccatcagcaggaggaggaggaggaggccatcaccacaatcacacgcgggagaaaaagaacaaccaagaggagcgggtcaaacggccgatgaagtaggtggtggtagtactgtactaggggtccggacaatccgtcagtggtcaatccgtcagtggacaatccgtcagtgaaggacaatccgtcagtaatggacaatccgtcagtggataatccgtcagtggacaattcgtcagcaaaattttttgagcaatgattaataatct

SEQ ID NO: 13064 - DNA, 2979 bp, Heterodera glycines
  misc_feature (2956)..(2956): n is a, c, g, or t
tctggatttaaaaataaatttggcttatgggattaattaccggacgtgattgtctacttaccgacggattgtccacttacggatcgaccaccgacggatcgtccaccgacggatcgtccgggagccccgtactcattacagaaaacgtggttcggaattacagtttacttccccaattattttaacacacaaaaatcggataaatttgcgcccatttttaaccaaaatacgtcagcatcaaaaaatcgcgtcagtgaaacagaatttttttgaatttacaagatacggtatcgtatcgtatagtgtgatggtttgaaattaataaacttgaaagcaataataatccaattcgcaaaaaaaaacatttttaattacaaaattgttaattaataattcaaattcattaaagtttttacatcaatggctacagactttattttagaaatacagtatcactcgacccattttacggtagccgcgggggaaaattgggggaaccataaaaaccccaattttttttttttaatttttctatttttttaactttttaccctacaaaattcgttttttcagtgccttcatggtgtgtcgagaggacagcgcaaaaaaatggctgtggaaaatccaaaaatgcacaactccgaaatttcaaaacggcttggcgaggagtggaagaagctggaggagttggagaagcggccgttcatcgacgaagcaaaacgattgcgcaacgagcacatgcaggtggtgattggtgattgaccaaaaatgagggagaaaaaactgatcactcactactgatcagagtgaaattcggacaaatttgacacttcatggatcaacaaacagttgttgttggaacgaaaacatctgctgctcttattatttattccttttaaaaaatatttttgtaaaattttgcaaaaacttggaaaaattaaaaaatttccattttatgtaaggttggaagcatcgatgtgtgctgacatcaaggcaatcggaaatcggaattccgacggcctaaaaattttttcggaacagcccaaaaatttcataaatcggaattccgacagcctaaaaaatttcggaaaccggcaattggaatggtaccatttaaatttattatcacttggcaaatcatttatttgtccatttgtccatttcctcaatttatttccagaatttcaaaacaggcaattttacaggaccatccggactacaaatacaggcccagacggaaggccaagcagcaactgcaccaacagcagcacaacaaccatcaccagcagcacagcaacaacagtcatcatgccaagaaaagtggtgccaacaatcagcaacaccaaaatcatcatcatcataatcagcatgcacaatgttcggccggcactgcgattggccagcagcagcaaaatgccgtcgttggccatggccatggtggccccggggcaatgccaaccgcggcagacgcattggctgcttttgatgcactcaaatgcttgccgcaaccggtgaggcgtgatttgtggggcataattgaaaaaaagttggacaggttctctcgagagccttgcgcttaggaaatttaatttttcccatgtttgggcacgtttttctcgactcagtttatcttgaaaattttaaatttaaattttttcgcaacaccacgattgtttaatcctaaatttttgtttcaacttcgttttatagtctcgaaactaattctcgacatccattctcggtaatgcaaatcataaattgaaaaaataaaactttttcaaaaagcgtcggcccctttgatctgtgccgaccccctaaaactttttcaaaaaacaatctgtccctttgatctatgccgaccctccaaccatttggaaatgttttttttttgcacaataaaataaactaatttaaacacatttttctctcactccctctctctccgccaattctttccgttacggtagtcctactgtagttcagtcgctcttttttttttgaaaatgtcggcgcagatgttcatcaacatcatctcatcaacaaaatcggtgtcgcattagtcgttcgtccgtccgttcgtcggtcaatttgttgtaaaattggggatgaatttgtgtgtccgtccgttccgccgccgatggcggtacaaatttatgcgaacccccgagggcgagggacgggggggggaggcagcaaaaatcggcgcttattttaagagagcagcggagcagtccagtggcagcgcggatgaggagacacttggccaaaaattgagacacaaaaaaacgggggagcagggggcgctacaaatttacatttttttgttttccgagacaaaatgatgttgcaaaaaactgttttttttttgttttttgcaaaataaaatgagtaaatctgtgtttccaatggtgccgattcccgaaacgcgctaattgtcgagagtatctttttcctgtagagttaagccccgatccaatgcggacaattacgaattgcacctgttagatgagagtgtcttaaaatgatgttctaagattttttttaaaagataaatttggtttcttttttttcgactttttataaaaaatttactccacccgacgagtgatttgctccatgacattttttaaatttctccagccatctccgatccaacttatcgggcaattttactccccaatccccgaatttttctcccagacctagttttgtgagtcgagaccagcagacgaactctcgaatgtacctgttaaatagaagtatgaggctctaaaagaggaaatgatgagagagagagagaggtgcgagagggttagaacctaatctgaaattttccgattttatcaacatttttttatgaaaaaatcaatttttatccgctcaaaaaattcgaatgggttcggcacgctgataatttatcatttaaaaaaaaatttggagattttttgagaaacanaaagttgaaaaactattcatgtg

SEQ ID NO: 13065 - DNA, 2852 bp, Heterodera glycines
agaggcgccgtcattggaacattgaagcgcattttgcccgtgtagttgtccagaaacaaaaaaatcataaaactcgtcttcggacttaaccaattgaaaacgccattaagttgtggcggaattgtgctgaaagagcattaaggccattttgaaggtggtgcacagacaggaaggccaatgatgtgatcatcttagacttctcagcgaaggcaggatcagtgttgtaaactttaatgagtttgaatgggaacggagtaataaaaaattctaaaattacacgagtgaggcccagggcccttatttgcttcttcatgttgcggaccaagtgaaaaaaacagtagcgcacattgcacgccggaaagactgactgtgcggaccgcaccgaccatggccaactcgaagtcaagcgaaattgttcggggcgcgaaatttggccatcgttccacaagaagctccaacatacgcgtataaattgcggcacacttcgacgttaaaaggcagtagcaaatgggaaagacccagccatctctcctaaaaaagcttaaacttaatgacaacacacttaaccttactttgccaacaacacataaatttggctgaaaagcggcggtgtcaatgcaaaagtgccgtccgcgtaagtctttcatctggtgggtccaatctgccgtagacgctcttccaaaaatgagaatccttaatagtgtaaatgaccatcatttaatggtttaaacgatatcttaggttggggtccattctgtccgtgaatttgaaaaacgccagtgtccgccaacaggaattgctcctcgtcaatctcagtgcgcttataaacacgataggtattcggaatctccaactgctccaaattgagaggttcgactcgcggtgcattttcatcacggcgcaaacgtttgatgacctgaataaaaagaaaacaaaattatttacaaaattgtttttgatagtaacccaccttttttgtggcatctttgctcggaaaagaggccagcacaggtgtgcatgtgttacaaattatttgaatgcaattttttccatactcactcatacgaaaacggcggtacgaaaatgtctccggtacgaaaacggcggtacgaaaacgtctccggtacgaaaacggcggtacgaaaacggcggtacgaaaacgtcctggcccggaaaaggagagggggggggggcggaccgggtcagtttagtctggccggtttagtctggccgttttagtctggccgttttagtctggccgttttagtctggccggtttagtcagagggtcggtttagtctggccgttttagtctggccgttttagtctggccgttttagtctggccggtttagtcagagggtcggtttagtctggccggtttagtcagagggtcgttttagtctggcaagtcgttttcgcccataattctaacaaatgttttttttctgtcaattatttacaagtaaaaacttaaaatactatgtttagctacaacaacgatgccgtctttgctgaaaaaagcaaaatgatcatttctatggcgtttcttcctgtccaccatctccctgctgctctcaatgctttgcaggcacaacttcctcaacaacttatgggcgtcttcaattggtgaatacgggcatttgattgtacacatccaactgtcttccgctttatcaacacaattcgatgtgagtaaaagtctattgatgcagaaatctcatgatgcatcgctggtctccctcctcaaaaggcgcccaaatatcgtgccgcgatgcgagaattcttcgactcttgcagagctacaatgccatcaacaataaccaggctcagcaaaatgatcacaattaccatgcccttatcaatgttaacccctataacatcatcaattttctccttggtatttctcggaattatgagatgcacccgtaatattttcaatgttttgttatttttttgttgttaacacattgataaatctgttatggtgttaattttaaagaattttcgagaaacaaatcagaattggatcaatgtaggacaaaaacagcttgccagactaaaacgaccctctgactaaaccggccagactaaaacgacccgactaaaacggccagactaaaccgaccctctgactaaaccggccagactaaaccgaccctctgactaaaacggccagactaaaccgaccctctgactaaaccggccagactaaaccgaccctctgactaaaccggccagactaaaccgaccctctgactaaaacggccagactaaaccgacccccaccggcccaactgtgctaataaattgctgcttatggcctgcaatctcatattttccagcctcatttcaaacttttgattgagttttcaaaaaaaaaatcaaaattcaacgctttttttctcttatatagggaaatttggctataaattttgttaaaaaggctttgaaaaaaacaaattgaattttttcttttcaattttcgcatttttgaaacaaaattttcatctcggggacccacgcgtttcggcgctggcgtttcggcgccggtgtttcggcgcttgcgtttcggcgctggcgtttcggcgccagctcgtttttccacttaagcttttttctttggcatccaaatccaacaatcttggtatcattcgaaagctcttatcatgctctattagccttacaataagcggatagattttcaagcctgtaaaaaattttattaagagagaaacttcagagaggggggcgacttttcgaaattttcatgtataacttttttggtaattatctaatcacgaagcaatcgcttagaaaaagcttctaaacatgataagctttccactgata

SEQ ID NO: 13066 - DNA, 1252 bp, Heterodera glycines
ttattcggtgattcgtcattatcataataggtgaccacacttttgcgtcggttttccgtttcttcataactttcgcggtgagcttggtcttcataggagctcctgagtcttctcgaagctgttctctcatgtactccccgcatttccttatcgaaaaattttggtttgattcgttcataacttcttgacaattcgttatcatttctttctggtgataaaagctcgttggcgcattctctatccgaaaagtattgattattctcatagttattaaatgaagtcgatgaatacgaattggagccttggccttcatataattcataattttctaaattaatgctatttaattgttttatgttaataatgtcaagaatgttagcaaaatttttgtgaatataaatttttgccttatttatccatgacttatttcccgacttgagaatcaagaatcacacggaataatttcagaatctcttcccgcccttttatcttaattttttcctaaccaactaaattcataaatttactatttatttaaaatatattttaatttaattataagttttttttgaaaccagtctaaacaggtaggctggtccttttatgctgttgtgtgcccaaataaccttagctcaactattccctttttaaaccttgtcttcgtaatggttcaagtgtacacatcaaaatgccatggctttctgtcaattctttgatgtctctcatggctataattcgtttcatgtccaaatttctgccgtccaacagtggaattccattgtctctcgcacaatgcaacaagtagccgtccaatggctgcgtgggccaatcgcacttcatttttttcaaagcgttcaaatccaattttgccctcgttgagttttccatatggacgagtattgggtaacggacgcccatacaatgcaaaatgctagccaaattgctgacaaaagtgttctgatcacatccgggcgattgaccaaacaaaaatataccactgaatggtgcaaagattgtaataaatataaatgaatttaatggagtcatctaaacaaaagatatttcagcaaataaaattgaaaatttgttttctataagcataaattataagttgtcattatttataggtttaaataccctcttaaaatatatttgttaaggtttcgcgtgcatttctgatggaagtaaaggcgcagaaaaaaaaaatttaaaatttaagaactaacgcttactgataataaaacataattgc

SEQ ID NO: 13067 - DNA, 2555 bp, Heterodera glycines
tgtttaattcacgtcgatggtaaaagtccccagtcgcggaaaaaccctcgcgatatgaagcccgtacattctgccagttagagaacaaatgtgggtatgtagtctgcgcaattaaaaaatttattagtatcttgacactctttatcttttttaggatttatttagaacctttaatagtgttttcgagcattattaaatgtcggacggttcagtcccttttgaattggatgcttcagtacgtactcgacaaaaattaatagataaataaaatttaaaaatattagcatggtaatttaaactttattaatgtgttttttattatagttgccaaataaatgatgatgaaattcatccataatcgatatgaggctttcaatttcccattatgcgtcaacccagcttcattcaaatgattaatttcctgagagaatcgataaaataaaataaatatttataattttttcggtttctgacggtattagccggaaattgtttacatgaatattaaattgagctggattaaaaaaaaatattttaattgtttgttaaaattttaaataattggattaatcgtccgggaatcttcgcttctatctgtccgtaagtcggtcattttcggaaattaatcaaatttttcgaattttcatccggcggcacatgtcagcaccgttggacctaaaacttattaattttctaaattaactgaaatattaagggtttgccgtgacttcaggaatagggaaaagggccggcggtgccgttaggcgccgccgacgaatttttgaaacttttgccccgatttcttagcagattttgattaatgaaacaattatgtaattctgaaattttcaattttatacagtgtaaattattcacggaaaccgtggagagagaggcagagagagagacagcgagagagagaaagagagagcgagagagagagaaatgtaggtaacaaaaagaagagaataaaaaggttcaatttgcaattcaagattggccgacatatgcggcgctgacatttgcggcgctgacatttgcagcgctgacatttgcggcgctgacatttgcggcgctgacatatgcggcgctgacatttgcggcgctgacatttgcagcgctgacatttgcggcgctgacatttgcggcgctgacatatgcggcgctgacatttgcggctttgacatttgcggcgctgacatatgcggcgctgacatttgcggcgctgacacttgcggcgctgacatttgcggcgctgacatttgcggcgctgacatttgcggcgctgacatatgcggcgctgacatttgcggcgctgacatttgcgtcgcagacatttacggcgcccagtcaaagcgacacttgcggcgctgacacttgcggcgcagacatttgtggcgctgacatttgcggcgctgacatttgcggcgctgacatttgcggcgctgacatttgcggcgctgacatatgcggcgctgacatttgcggcgctgacatttgcgtcgcagacatttacggcgcccagtcaaagcgacacttgcggcgctgacacttgcggcgcagacatttgtggcgctgacatttgcggcgctgacatttgcggcgctgacatttgcggcgctgacatttgcggcgctgacatatgcggcgctgacatttgcggcgctgacatttgcggcgctgacatttgcggcgctgacatatgcggcgctgacatttgcggcgctgacatttgcggcgctgacatatgcggcgctgacatttgcggcgctgacacttgcggcgctgacatttgcggcgctgacatttgcggcgcagacatttacggcgcccagtcaaagcgacacttgcggcgcagacacttgcggcgaggacatttgcggcgcccagtcaaaaggacttttgtggcgccgacacttgcggcgctcagttaaagcgacagttgtggcgcagaattaaatgatcccaaaaaatttcaacaatttatttaagttaatagaattgttattttaatagtttatttttttaacaatgactaatttaacaataattcttgcaacctaatcacaaagataaaggtagagttgtttgccgttgtaacagcttcagaaaacgtttcacttagcctcacccagcattttcaaagtataaatggaatactgtaataaaaatatttttataaggttcattatcgccattaaaaaagaggaagagcaccaaaccaacaaaaccgcctgaggccttatggaattgacccaactcgtgggattgccgaaaggcctcgcttaaaaaagattttcgaaatgatgaagcgatccgtcgattagtcctcgcttttgacaataaagaaaatataaactatgatgatataattaatcacattaatacattgcaatacagcctagggatgaaagggtttcaagaatgggactgaaagagtgattaaacaaatgtttttttaatcaaaaaattgttgaaataatttttgggtcatttaattgtgcgtcgcaaatgtcattttgactgggcgccgcaagtgtatcgccgcaagtgtc

SEQ ID NO: 13068 - DNA, 3421 bp, Heterodera glycines
  misc_feature (3350)..(3350): n is a, c, g, or t
cagatcattcgtgaaaaaatcgatgcaaaaaaacattctcggtaaattcaattcaagaacttgctaagcctaggcagatattaactcaaataatctaaaattttgttttaatttaaagttggtgtcggattttccagtctctgatcttccgcttgtgtcggattttccggctcccagtggaagggggggggggagagaaagaaattagagaaaacagtaaggaaaaatataagagagaaatagaacgaaaaaaagaaagaagaaaagatagagatgagagaataaatgttgctttgaaaactatgaccatttttacaaataaaagaatgttggtctggcgtagaatttaaaaataagattcggaaaatataagatttgtctaaaatgggtaaattttttaaatttttagataaaaatattttcaattttttttgcgaaaagataggaaatttttttggaatagcataaataggactgtttttgacgatgcttttaaaattaaaaacattttagaaagtaaaaaaggaaaattaaaaatagaaatgaatcttaggaataagaaaaatataaatttataataaatttaaaaattaaaacagaaagatgatgatttgatgacacatacatccatgtgtatttttgcaaggatagaaataaatcaaaatgtgtgggttgggggaagggaagaggacgattattgatcggaggatggatgggacacaacgaattggccaatgtcattcacattaactgctaatttttgttgttggctgttgctgcggtgtttggatagttattttttaaaaaacaaattaaatggcaaaatatttgaattgataaaatttagaaaatttattaaaagctgtgattggacaatttaaaaaatgcattaaaaaggaattaaatttccttttattttccatgctatgtaaatgtatatatattttctgaattatttacataatttcttcatttaaaacatttttcatcgcaaattttattccttaatttatgaaaaattttcccaacaattccatcgaaagcgccggcccacaacatacaatttggatatatattcataatttttaccttttttgcacgcttttggcaaaagtttaaattgataaattattgttttgaattatttatatttaaagtcaaaatttttcgaagttgcaaaagtcccgcaatccaagcgggtcggtcgcccaaatttactttgggatttaaaacataaaaatcttttaaaaatttgtttaaaaaatattgtttgatgatgaatttaatgataattgttgttttaatgctgaatcaatcatctgcttttaaacttttaaattgacaaaattaatatataaaattgaaaattaaagaaaagttttccacagtatacttaaaagataaatatttcaaaaaaattatttttaatatttatgcacaatttggtaattgtaacagaaatgaaattttgttttcagctcgaataaaaattcgatttggtacgagactaaagcgaattttgaatctgatttttataaaaaattttaatttcaattcttttgatattaaaaataagtcaaataatatgccgcattattagaggaaataaataattttgtgaatgtgatattatatggatttatgaaaatgatactgaaaagctttttttttttataaaagatcaactttcttattatcaaatataaaatgatgaaaaaattaatttattagaacgaaaataatgaaaaattttaaacacaaagatcaaaaaatgggttcccggtgatttcgtcagtgagtgaatcgtcagtaaattatttcgtcagttgaaattaattcataaaaaagcgtacacctagccaaattttacaattcaaaaagtagagtcagaagaacaggcttgtaaatattcctaacgagtcatggtttgcaaaatcttatgcaattattcttaaattgttgccctgccgaacccattttgatttgttcttttcatgtgccccttatcccatcagcagctgggctgcgcgaaaatcagttacttgtttgtacacacctcgaagaacgttacttccatacgtgatcggctgacgtctacgattcgatttgcagacaaaaaactgacgaagaacatcaacatactcaaaattattagtaggaaacaggggtagagagcggacagaaagatcccgcggatcgcggtcgcgctccacccctggtaagaaaattaaaagtgaaattccgagatttatgcagaatgctggctagagaccagggatgacacggaattccgacttccgatttccgacatttttggggtcggaattccgatttctgaaatttttggcaaaaagtcggaaattttcggaaattttttttgatttttttttcaaaaattaacaatatttgtacaatttctgttgataaattggattgaaattttcaaaaatttcccggctgcgcctttcggcaccgccggagcctaaaaatccttaattttgctgcaaaatttgctcaaaatcggcaaatttgatgaaaatttagcctattaaaatattttaaaaaattttattatattttttatttttttcaaaatttccgatttccgacttctgacatttttggggtcggatttccgatttccgaaaatttttggggcctcggaatgccatccctgctgcacaccgttgcaactgctaatttggcatatttcctgttattaatttgtttagtcataattagggcccggatttttatgtttttacatattttttttgcggcttagttatggcgagagaagcccaaaaatagcattatctccgaacaatttttgatttagagcgacttataaaaacataaaaacacatattttggcgttttcgcacataaaaacatatcgcacatatttcggggtttggcacatattttgcacatattttggcatttttgaaaaaaatatctaagaaaaacacaaaaaattcaaaaatgcacccctaaaaatcaactttcttgccatttttataggctctttcaaaattttctttatttatttcgtgtaccgaaaatcgaattctccattaattcgttactggatatcgaagtttcttgctggcacttactcaactgatggaaaaattatctttaaaaacaatttatcaaaaaaggactaattttacccccaaacacctccaaatgttttttatttgcaattgtgcaggcaaaaatgaaaagaatgagttttttggaatttttatgcaaaaataccattgatttttcaaatttttagcacatatttttgcattttttaacacatattttgggcttttttggggtttttagcacatattttngggtttttttagcacatattttattacatatttcaggattgctagcacataaaaatccgagccctagtcat

SEQ ID NO: 13069 - DNA, 2504 bp, Heterodera glycines
  misc_feature (2482)..(2482): n is a, c, g, or t
aaatcattcaaaaagataaatacaaagattaaaataaatgaatttaaaaagttattttcgcaggaataataaaatatttatttaatataaactatgaatgaaaaattttcataaaatattctggtgtaaagaacaaatgcgtttctgattaagtaccattagaaaggtaatataccaaaatgggcgacggcgagaaattagcggtgaattggaccctacaagtgtccctgacccccacaaaagcacaaataaaacatatgaaaagttattttgaaagaaagaacataattaactaattaaatactttaaaaagttctgaaatatcattggaaaataataataattggtgattccaatctccgaccattccatcgccacttgacgattttccacaatttgtaatctgcgacgtgaattagccttggttaattggatccataaagaaataaattaatcagacaataattttaagcaaacaaaatgtaaataaaaatgataatttattttattctaaaattttcaaatctcactcattgcaaaaattgaaatcttttgagaaaaattgtatttaaaaagttgtaattttaataaaaatgtgtgccacatatgttgtctaggggccgaaaatagtatcgaaaaccaaagtgggccttttagtttggaaaaatttatgattttctcaaaataaataaataattacaaacaaaagaacttattttatacaaaaaatataatcaaatcaaagtacgggtcccgctgcgggattgaaactcaaaattttttgcggtacaaaaagacccggcatgattaatcccacaaaattcggcattttggttatgtttcagcattttcaatattaaaaattgctataaaaatgaatgaataaaaaattaaaaaccaaatattgggaatattttcttcaaaattaccaagcgaacatttattttcctgaacaattttttcaataaaatattaggtaaaagacaaatgtgtttctgattaattaccaaagaaaggtaatttaccaaaaatatttgatttatttccaactcgccgcacattattttaacagctttcacgccaccatatttttcgaagcaaaaactagaaaccaactcatatttttgcatgtattaaatataaatatttatttaaaaacattaattagcaaaatcatgggtcaatcaatacattcactttcctattggattttcttaaacccattgacacttggaaactgagtaaacccggtgatgaaaagatagtcaatgctttggcgcggagcttagaaggcagttccgtgcagaaatttacggtatttctctttacacgtgctgtctcttcttcattggcttattcgcttcgtgttatgacgaaaggccacggcaaatgggccaaggcgagaaattcgcggcgagttgggagttgggccacggcgagaaactcgcgccgagttgggccatggcgagaaactcgcggcgaattggccccgccgaagtgccctgacccccaaaacaacccctgcgttcactctatgtgctctctcattccctcccaaagccaatggccaacaaaacaacacagagtcaattgatttctttcattgctttcccaattccgtctttcatctgtgttcttcacttatactaaatttttgcttcttttcacattattttatcttttaaatttatcggttaaagatttttttttgattttgaattttcaatattacacaaaaaattgtttacaactgttgcaggaccaccaacttatttttttggccattggtgaaactgaacggcaatcgtggtttcatttgtgtaagaatttggaaattggcaaagtgttcgtttggaaaagaaaatgtacaatcgaagaatgaggaaaatgtgagctttttatacttctgtgttcaatattttttcttgttcaatgaaaaaaatattttaaaaataaaaattttcatttaaataattttagcccgatttgcacgggacttggaattatatgaaaaaccgggaccggtttttgctttttacccgggacgaaacttttctttttttaacaattcagaaaagctaaagttaaggcaatatttttacatttaagctggatttgcaacgacgtttgggtggacattttccccttttttgatcgtcctcaactcggcctcaaattggcaatgctttctccccgtttcgatgctttagtggacaaatacttcgataacaaaaaggaattgacaatttggaaatcaattacaatttgcaaggacatgaacacggacgaacctgttcttgatataattagcaaagctatgccttggccgttaccactaccggaacgtccgctgccaaaaaacattcgcattaactaccttcagattaagtacttgttgatttaaagcattacgtcatctaaaatatgaaatttcggcaaaataattcattaatatttttaaattatcaacaatttatgacanaaattatatgatttaatgaagt

SEQ ID NO: 13070 - DNA, 2144 bp, Heterodera glycines
ttcttctacattttgggccgtcaaattgtaagagcaagcgaacacttcaagcgcctaaagaaagaaaagtgccaaactatcaaaaagaagggaacaatatgccaaaaaatcggtttaaatttgtatttttattttaaacggttaaaactaccaaattttgcagctccgtcaaaacccaattttaagcaaacatccttctaacgtattctcaagcacacaaattgtctttgtacgttttggtagtgacccaaacgtccataacttcaaccagttcattcattgtgtcagtaataattaccctgtccaagtgctcgttgttgtcctgctgttgatgatcattctgtccctccaccaaattgtcggccgccactgatggagatgaatcaaccgccgcagggaatttttccacctccaccacttttggcatcttctgttgttgctgttgttcattgtcttccccgttcggcatcaaatgttttgacgaccgttcaccacccgtgtccatcagcaaaatttgagttgaaaattaccaaaaacacacacataaacaccacagacataaggaaataaacaccataggtacaatagttttatttaggcaaattccgaacagtgaaaaagtgtccaactttttgggatcaaatttatatgcaaattgaaaaataggaaaaaaatattgcacaaaaacaaaatggataaaagagatttgataatttggacaattttgttggtttttggaaataaaattaaaatggttagtttatttattttgcgtgttcttcctcctcctcctcttcgtccgtttgctcctctcttccctcatcctcctcacttcctcctctcatttctccgttattttcgtacccattcgcttcctcttcttcctcacttccaacttcttcctcatccagaaattcgttgtcactgttggcggacgaggaggaggatgaatgatggttttgctgtcgttgtgcggcggcacgcaatttccgtctcaatcgccggtcacttttgcacagatcggacaacatctgctcaattttttcaaatacattcattacaaaagatttggtaattgtgatctctttgactttgacctcattttatatttttcttggcgattttattttatttgtgcttgtataatccgatacttttggacgattaatgtatgtatatgtccacaaagtaagtggatttatcccttttgtggactttttcttttctttataaataaataaataaataagaagaaaaacgaattttcgtttgcaataattaaatttttggtttttttctttggccattttctgtggggtttttctctcaattgcgatgagctaaactcattttcaccgttcgctcactttcaactcgcgcaatgattgctcaacctttgcactttgcgcttcccttaatgtgccatcctttttcttgcaacgtttcggcatttttcttcttcgttttgagcattggcaatgtttgggtcattaactggaaagataatccatttaattataatgattataatttttatgtattttataattgctctgctaattgaccattcttttccgctgcttttgtgtcgtcatcattaatgtcctttgaatgggccgaaatttgctccaattggctgagaatgtccgccatcgcctgctccgttttgcgcagtctgtgctgcaccgagcggagtttggcaccacgaacacctgcacagaaatacgctaattgtctaatttagagttaattgggcgataattagtggcattaaaagtttagccattgtttctccaattaaaattgcaaaataatcgcaccatattccaagccgtcctccgttccttcatcgtcgtcgtcgtcgccatacaaaaggtcaagcggtcggtcgcgacgtcgtttttgccgtttggtcttcgacttaaacatgatctgaatgtacttaaccatagcacacttatattcgtaaaaactatcattttcttgtctgttagatggttttaaaactaaaaaaccatgcacatggtaatcttggcataaaaagggtcaactttttacgcaaatatgccgaaaatgggttaaaatcccaacaatttgtgttccaacgcaaccaacccccctttccaccttgaacaatgtgtaga

SEQ ID NO: 13071 - DNA, 1994 bp, Heterodera glycines
ccctgttgttgctgctgctgttggttgtgcatgtccggtattcgcatggatgcgcctggatggtgtgggggagggcgatgggcacgttcttaattgtgaggaaagtaccaggcgtggccaagggggatgtataattttcaaaaaaaaaaaattcgtccttaaatttagaatttcagagggttggccaaccggcaaaatgccgctgacaacttatatctttcgtaaaaaagggaaaatttgtacccctctgctgctgctgttggttcgtccccatcatcgacggatgcatcggtcggtccgcggccgccggctgttgccgctgggtaccgccgccgaacaaattggaaagcatcggtgagaagacgctcgggtaaagcaaggcaaaacagagaaaaatggcagcaccgaccaggcacaacttccatttgggcaacaccttaacggaacggaaaattttgagaagaggtgaaattgaggcattgaaaaaattcaggtacctaattaaaaacaaattccgaaacaatatttaaacggtatttgtttcctttaagggacacttttcacatacatttttttctaatgccaatgactaacccgaactagaaaagccgaaaacccaaaaaagtacctcctgtaatttataataaaattccaattatttttcgaggataagacctgaaaaatgccgagaaattcacctcttcgcgtcgtcctgactcgtgccattcctcgtcctcctcctcactgtcctcggaagtgtcccgtcgtttccgtcccttccgttttcgttcctttttccgtctttcctcatcctccgttgtatttggcgtcctcctcttctgattggcaaactttcgattgtgtacgcccggaattgttgttgtttcattcataatttgcgtaacctaaaaatttcaacaaataaaaatttgttaattttcgtgtgctttttgccataaaccattgcttttgttattattattattattatcgggtacaatcctccatttccgtccgcatttcagttggctggtcacaaacaattttcgtcttttttaagtgccatggaattttgcggctatacgactttttttgcaccgaatcggcacattttggaggttctccattcccctcacaattattcagcagagaaagaaagacagtacagacacacagctgacgctgtcaccccaatttaagtggcggcggtgtccgtccgccggtcggtcgttcgccgttggcggaggccacggggccactcattccattgcatttcgtcggtcgaccgtcacacattaaaaatgctatagccatagagattatttggtgaatagagcttttcatttctctaaaatttatttatttgtctcactcggcggaagcgaaaagaaacaaaaattgggaaagaaaaacgcaaaagggagagagagaaaggttgagaaaagagagaaggaaagaaatgtgtttccatgggggaaaagagacggacagacgaagaaaagacggaccgaccagcggagaaagggcgacggacaagggaatggaatgcacacgaaaggaaccaatgttttccgcgtgattcctcctttttcactggcaaccgaccgacccatccgtagatgggacaaagacaaaccatgaaaaatgtaaattcctcttttttgtatgtatgtatatgctcatgaagtggcaccgcacccaaaccaaacaatgcattttattccatcagtgagatttaagcttaataaattttaaaagccaaacttttttgaatttgtttagcttaatgattaaatcagcaaaatttaaaaaccgaggaaattaaatttaatttaggtaattaactttgaaccggcacatttcacttcacttctctgattttgcgaaaaaacacataaatcagtaaatttaccgattcggaaaaactagtgatacttttaggtagggtagtattaattaattacacctaattagcgctttttcatctttcttta

SEQ ID NO: 13072 - DNA, 2157 bp, Heterodera glycines
taataatctgttaaaaggcgagcgaaaatctattaaattttcccggcggccaaaaaagtgggtataaaaagcaaaaaaaaaggcgtcgcccggtcggacttccgcccaagccgaaatcctgggacaatcctgcctaaaagcccgcactttggcaattacaaacagaagtactgggcccaaccgtccctctcgccttttatgtctgcttattggttggtgtttgcacctggtagcgcgtcttctgcgaagtgaatgcgaactcgcccctgttgttcatgtagcgtgggtatcgttccaccagccgttcgcgcactcttcgcggaatccaatcggcctcgtcgacagtgaaacgaatttccgcctttgtggggtctgaatttgcacatttttaaactcccattttacacaatgttcgcaagtattataatttctgataattgcccgtttaaaaaaactgatttttttataaagaaattctttgaaaaaggtacgaactgctcccagcttttcgagtgttggacaatggacaattttttaaattaaatttttgacaattttttaaattaaaattttatcaatattcttaagaaatttcttgtgaaaagatcaaacgatgctttaaaagggaaaagttttaggaattattagtttttattgctttttgacatttttagcgaatgaatgggcaattcgaacgctgttattaataaagcggaggaaatgtttgtttgttttgtccaaaaatgggaaaagcattttcatgggcgatggatttagttttaacacccctcgaccggacggcgaaaaaaaccattgaaatgaatgaatgaatggacttacgactgtttacgttcgaaccgcccggtccgctggacaaagtgtacttctgtttgatccgatctgaagcaggggaaggagggaatgagcaaagaaaagtggagaatttacttaaaaatgcattttgagtttggtggggcgaggggaaagcaaacaaatcgggagaagaggggacagggggaaatttgaatggtcatccgatggacgacaaaacggtggggaaaatgggaaaaggggtgagtgggttggaactggattggattgaaagatggaaaatagaaatgatttaagaaaaaatggtaactgaaaagtaaaccaaaaatatccgggaaaatgggaggtggttctaccgatgattttttctattcgattcaaaaatacaagacgggaaggcaattaaaaattcatatatttttcattcgtttaataaaatggtcaatttgaggaacatgaatgaaaaataagaaattcggacccggtggtttttttggggagggggcctctcctctgcctttaatgaccgaaataaagggaattatagaaaattttgattattaatccaaagattgccgaatactaattgtaagaccagggatttctcctctgctttcagtattttccaaattaacaataaaacaaaacctcgtggtatctctccctcaaaatagaggccttcgaaaaagttgtgatcgcgaccggaattgcgagaatttgaagggtcctttgactgaaatgaaaaagcaattaggtaattcaaatgtataattagtggtccgacagcggttaaaagattatttgaattttggttttaataaataacggcgaaatcactaatcgttaccccattttactagtaaaatgaaacgcatttggactatttagaactctgaaattggctagttttataaattcatattattgtagaaacaactaatacgagaaaaaagcttggcaaaatcaaaaaccaatttttatgagcaaaaacgttaactttgaaacattaaaatgagtttttcaatattcgtgaccaacccagcggtccgttttcaaagttaaactcaccaataaatgtgcggacgaacataagggtcgattaaaaaactgggaaaaaagacgagacaccaattgaatggaaaatgacggcgacggaagcattggcacaaataatgcctaaaagaacagaaaaaaagttaaaatataataaaagaggacgggatcttattttcattaataagagctcaaattaaagaaaggctgcagataattaattaggtaattgcctcgagatcgacgggaaaaaaacagaaaacgggacttgac

SEQ ID NO: 13073 - DNA, 1026 bp, Heterodera glycines
  misc_feature (23)..(23): n is a, c, g, or t
ccctctccccttcgcacattcancaagtttttttgaaatgtgccgcaaaaaatgttaaaaatctgatttagtgatcccgaatgcactgaaatttatgaaaaatataataatagaatgaatatatttttgatcgaataaatgtaaaaatatttgaagcaattttgcaaaatcttcttatttttgaccctaaaatcttattttttggcctttattcttattttgaaaattttgaaatagaaaccctggatttagacaaaaacacccagaaaaattgactattctggcataatttataatccttaaatttggtcatttttagacaatatctgtgcaattataccaaaaaagaattgaatcgaggcgatacatcgaataaaggaatgtggagccaaacccataattcaaaaaaaataagtaaaaaactttttcatgggttgcttaagagctactcccaaaaatatggatataaatttcgcgaagtttcaacatgctgattttcgtattctgttcgtaattgtctttaatgacttgaaattttgctggaaatattttaatttaattttggcagccccaattaactaacaattatgtcaccctatcgtactgcccggccctgctccatttcaagtacagtcatggtcatatctttagcaccacttaaaatttcgtatcaaatttgtttaaaattgtttataaaatctcagtttgattatattatgtatatatgttatacatttcttgtagtattttttgtgggataccaatcattaaccctttcataattgttattattggttacaaaccattttaccaactgcactcccttttttggggtggtcatatctttagcaccactttttgaatctcgaatttgagaggcacagaaaaatctgaataattcatgctaacataacttttgacgctgatcaaaaaagtcttttgcaccaacatgatcagatcactccttcatcgagatctggacaacccaaaatacactgaaaatcgggaaatttttcgaaaaaaatt

SEQ ID NO: 13074 - DNA, 1259 bp, Heterodera glycines
  misc_feature (59)..(59): n is a, c, g, or t
  misc_feature (69)..(69): n is a, c, g, or t
  misc_feature (102)..(102): n is a, c, g, or t
  misc_feature (705)..(705): n is a, c, g, or t
aaaattctgaaaaaattcatgctaacgtaacttttgatgctgatcaaaaaagtctctgntaccaactgnatcagatcactccttcatggtgatctaaaaacncaaaaatggctgaaaatcgggaaaattttcgaaaaaaatccctagggggttgggaaaaattttctggaaatttttagtatgcccattggaaagagcaccaaatttactaccgatttgcgctttgaatggtggatctatgacttttatccgctgagatatgggcactttcatttcgctgtcttcaaaaactactgtatttcttaagaaaatagtgcattttacagaaaaatgatcagcaccgaaattgaacttcccatgcctcagcgggtataagtcgtacaaacttgcggtcttttgcatattgtagagctttttatgctgtttccaatgagcctactcaaaatcttcccaacccccctacgaattttttccgaaaaatttcctgattttcagtgtattttgggttgtccagatcacgatgaaggagtgatctgatcatgttggtgcaaaagacttttttgatcagcgtcaaaagttatattagcatgaattatttcagatcatatatactaatttaatcaacctgagattttataatcaattttaaacaaatttgatacgaaattttaagtggtgctaaagatatgaccatgactgtaattnagtaaaaaaataattggatgaaatacgatcggggttcccgataatttccccgaggggtagggtctttttaatttaatttatttaccgatgatctaagttatctggttcttttcataaatcgtaaacaaaagaaaaatagaaaagttattgtctgttgtcaatcgaataaaagagaataaatcgtatttccttaattaatgggtgggtttgcttgtcataaagcagcagtgtcctttcatacattgatcagccgcccattcctttgatgattgataaaatgcgaacaaaggaagagatgaagccatcaaatggacgagcggcgggcaaaaaaccaaaaacatattgtaggttaaaggcgggcgattaagcgattaaatataagagactataaaattttattgactatattagtagtggggatgatattttaggctctaaaaccgccaaaataggtaggctttaggctctaaaaacccccaaaaataggctctaaaaagtctcaaatttagggtgtaaaatgacaaaatgattcaaaaaagtaaaaaaaaattagg

SEQ ID NO: 13075 - DNA, 3417 bp, Heterodera glycines
gaaaaataaaattattaattacataaaatggtaaaataatagaaaaactgtatttttttttaatttaaagcacaaaatccttaattaacaaattaagcatgaaaaaatgcaataacatagaggaatttatttttgttaatttttaattttattgctttccaatgaaattggatataattgagaatttcttccatttttagttgtgggatgaggccagcaagaaatataaaggtcctgttctgccgtacgacattacagaagccgatttcaaatgtgtcaatgcttttcactcgaaaatttttgtaagaaaattaaaaaaaaattaaaataaaataaatttttcacaaagggtccctcgtgtggcgacccgaaattcgaaatggtcaaacattgcgcaaaggtaatacatgcaatattccttaaataaatattattaagtatgtgcttttatgataaattaaggtgaaattctacggagacacaccgccggagaatgggggaattaatgaggacaataaaggcgagaaaaggggaagggattaaagcagttttgataaatctttctcaaatttcactttcaaaaggaaggaattcggtaaaatttgaaaaaaatcccagcaaaccctctcatttaaatgtgttacgaatttgagccctaattacgcaattatttttgccaaattgtgctgcagatttgcttctgatgttggtcgacgggtgtttggtgtgtcttaagggcgaaagcgacgaatcgctgcgagtcaccgtcaaattgcgactgatttacactttgtccgccggctcattcttcaccgcgtgcgacgtgacgaccatggaaaccgagtaaaacaatggataagagacaaattaatcaaatacagttataggtaaattctcgaccataacccaaacaactccaaatttcctgaatctcaaaaaaataaattaattctgcttacaattaacatgaaaacacaaatcccaacggttagttgcactttttctcagtttatttaaaattcgctttgttggtctttgattaaaattctattaatgagttggaagagaaattgggagaaagtgattacccactaattagccagagaaagaatgaaattagctcatcttgtgcttttgcagagaaatcacagtgactttggacaaaaaagacatcgccaacaaaagggccgtccccccaaaaagtgtcgtctccgcgtcggacgacctcagcaacagcgacaagcgagtgaagaagcccaaagcagccgaacgggtggcgaaggacgattatgacgagaaggacgacttgggggaggaggtgctgtgcccggacaaatgtgtgaggaaggaggacgtggaggagaagattgacgagggccaacgccacttcggcacattcacattgcccggggtgttgctgcagcgcaaatgccgtgcatttttcgcgctggaagagccgaccggcaaattcctgaaagttcagctgaaagtggagcacaagtgggccgacaccagcaggggaaactaaccagggcaggggaagactacggcacatttcacaacatatatcctaatagaccaccattgatggacgtaattggacaattacataaccgtaattaatcacaaaaaattttcaattacaaatccttaacccgtaattactggaatacaaatgctgaatttttcataatcagcaatatttgattttaaagaaataatttttattaatatcatgcctttttccaaaaatttttgaaaaagagaaatgaagaatggtatcaatcaggatacagtgggacacctaaaaaaatttcgggaaccaaaaaaacggtaagcggttttaatagcccataattataaagtgcttaaattttacaaattatatgctgctgtatattattgttcaccaaaatgcaaatcaaaaattcagttgcgagaatgaacgcgccaaaaccgagtcgccaatgatcattcctctggcggacacagtgaaactaaatcgcttcaaggtcctcacctatcgcaaatagtccgctgtaccgggataaagaaagccgagaacgaaatcagagccaaaaagcctgggtggaggaggggggggggggttttggggggttcagtccgttcggatatccctgccaattttgtttgcctttacattgtcgtaagatgcttaccatttcaaatgtgccatttattacaaaatctgatgccaaatgattttatttgaccagcacaatgttgccgaagtgcgtgggctgtacatcaacttgggggccaacagcgtgtcccaatatcagccgttgttggagaagggctggtatagagtgatcaaaaggcacaaagaaaatgcctatcccaacgcggtggtgttcgacagaaagaagtaggagaagccagtgaagaatgccaatgattgtgccaatgaacggaaaaaacgcaaaaccaatcggaatttatttgccaacaaaaagtgatcggtggaaatacgaattgtatttgaatataaattgaacttatatataaaaggagattttaatatagcaaaacaaaaacggaggcgctgtttaatttgagactttatgattattttgttgcatcttctgaacctttgttatccgactattaaaccgaaaaatgtgtcagacgctagtcaaattagttggtaataaatatagcacatctggttaacttaatagctatcaaagaaaattttgagggggggggattaaagtgagcgcttaaagcatgcctcaaaatatgcaattaattcatttattacgtgatcgcttaggtttaagtaatttgatggtctttgttcgcttttttaagaaggaaaaaatttttaatgcttcaaatgatatttttaaatttaatctgtgaactctgatgaaaataaagtgcataaatttctgtcggaaaaaggaccaattaatgttgaaaagtgccaaccaattattgttttatgctatgcattcatattttttggctgataaattggcactgaaattcgcactttcatacaaatcacatgataataatatttaaattaatttcccaagcaatttattactgtggaatttcggctacccgacttggggatttagccaacattcccttgcagttgcattgtctcgaggaggacgcagtaaacaaattttgacgagaaatttgacaaattaatcataataaccaaaggaattgttttagaattccgttgaacgtgccaattccttcctttgccaatttcttccgttaatgggcaccaaaatcactcggcttcatgtgtgttttgcaatttatttagtgaattaaactgatcaatgacaaattacagtatcctgcctgtttttcaggttactgtccaacgccacgtcgactcggcctttttggttcattgatttgatgtgattt

SEQ ID NO: 13076 - DNA, 2868 bp, Heterodera glycines
  misc_feature (2855)..(2855): n is a, c, g, or t
ctcattgattttcgccctgctggcagcccaatggcatcaatttttcccgcaagcgttttcgcggacaaagcactgagagcatttcgccggaagggattgccgtggcgatcaaaggcaaacgccaacaaaagccgaatgtcctgcaaagggaagggcattcaagcggcggcacaaaatgaacaagcctgggcatagctcatgttctcgggttggcccagctcgtgcgcactcgatgccattttgtcgagcagagggccaagcaaagtgcccatcagcaccccttcgatgccgctttgtgcctggttgaagttatttttgtaggagggcatgcgcgaaacggccgccgactcggcggagatacgacgtccgccgccggaggaggacgtccgccggaaggcgccgccgctctccgccgatggtcccgcgccgatgccctcgcggtggaccgacaaacggccttgagaagcgagcgccgaatgttccagcgaaaagttacactgacagaacaccatcagagagtgcagcgcgtccacgagctgtacgcacggcgtttgcgcgactttggtacggagaagcgcacagaaaaagcgcggactgggagaaaatggcattttgaatcaattaattatgccattttgtctccgaaaactgactttgtccggtgcatttgggcaatcaaattgcgcacttttatgcgtagaaactcggcttgtggcgtgtgaacgccttcgttgcatccattggagcagccgagttggagggaaatgcgaaggacaatatgcaacacttttgggaacagttcggccgcgtcggagccgggcatattcagaaaagtgtcacaaccagtgagcacaacctcaagataatgcacaattagatgaacacagcttcaattaaatgaacaattaatttgaattagcccttcttgctgtaatggaaattaatcttttttagttaatttaatatgagttaattagctataacaattaattaatatctgctaattacttaatgaacaacaattagcgtccctaaacggtgcccccattcgccaacctcagaaacgcgcacaacgcaacaacgttccataagcgtgcccaacaccttcagcacaatcggaaacgaaaggtgcccgtttggttcaatgaagctggcggcgccaatagcctctgtaaagaaatgggagttcttccgttttgactctgttttctccggggcgatttgctcgtggcgacgccgttgttgcatcgcgggactgttgcaggtcgaggcaaagccttggagcagttcagtcaggcgagggaatgaggcggggatgctggaggcacgctgcatgcgacgcggtgagctaatgctcggacgcggcatcttaaaatgaaaaatttcatggttattagcaataaattaagtttttacgctgcccgaagtcgtccccggcaacatcgccacaccgtcgcttggcattgcgctgagactgatgcggcgccgtctttccgccgtccgttccgcgcccagcgtttgctgccgctccctctgttgctgtttgccgtcgcttttgctcctctgctgcagttgcatctcatccctctcaaatgccacccctttccccgtccgtcccgccaccgcttcgtctgtccgttcttcccgcgtgtcctttggctgcattttgtccgttcgttttgtgccaccgctgaacgttgctccgttgtgctcttgcagatcggcccaggtgagatagcctttctaaaagataaaagctaatgatcatttagctccttggggggtggggagagaattggcatttcaatgccaaacaaaacaacgaattgccccgcccgaaggcttctctctctgctcacagtgtcaatggtcgcagcttcagttttggacgtttttctggttggaattgttgccgaatcggaattgaagcgcgaacggaaggtgccctcgtgggtgcaccggtgctgtcgcatggcaatcagtcgacccaaaaggtattgcacagcccaaaaagtgcctgaaagtacggaacgccgctcattatgaaaaatgtttaacttttcatcatatttatatttcttatttccattttaccctcttccgcccaatttctgatcagaagacatcgcagcaccgccacatccaaataattggcttcgtgtgggtccaagcaaatgcccagcggagtatctggcgacgactgtcgctcgctttcgcccgagtcggcgcgagtgccgagcgcaattttcggcattttgggagggggaagcgtctgttggcacgcaaaggccgaagcgggcgggggacgggagacgattgtctgttggctgcccaaagaggacggagtgtcgtcgcccgaggcatgaacaatctgttgccaaatggaagattgccaacaacagactttggcactgactaaggtcttagggatggcaccacgcgccccttccgctcgaatggtcgccgttccctccgacattgaccccgccccgctgccgttgtcgcccttccccgccggggggagtgaatccgcgtcggtggaatcgttgcaaatgtcgttcaatcggaccaacggtgccccttcccccgcggctccgccgtttaaacttggctcaaatgcagcagaaaagccgtcgccttcctctgacgcggacgtctcgcgcccgaggaacattgcccaaaattagattaattaagcatttatagagagtaattgaaatttactaattaagaatttatagagagaaatttactggcctaattaggcaattgcctttttggcatggcttttaaaaagttttgacaaacagcaacaattacttcgattgcgcgtatccctgaacatccttcctccnccgtcccagggag

SEQ ID NO: 13077 - DNA, 1503 bp, Heterodera glycines
  misc_feature (43)..(43): n is a, c, g, or t
agggagaaaatcaggtgaaaggggttcctcctcttcctcctcncttgtaccgattccgttgtccttctgctgcttttcgtgctgatccgtccccaaatccttcgcccgtcgtctgcgatttggtcagcaattgctgttgcttttgctgctccgatgctttgtaatcgctcactgaccgaacgattgtcgctgcggcagtgccgtcgtcgccgcattcgcccgtccgatgcttggcctcctctaactctttgagcactttggcatcagttcgaggaggttttggtggcgggatcagatgagtctgatagaccgtaaatgccatcggttgggatgacgaagtcactggtggaagttgcgactgacggcgaccggaaacgccggaaacggaggagagagaggcggacggtttgttgtccccaatgtaaatcccctgttcggcagcagtgctaaaccccaatagtctcaaaatgctattgccacttattcggcacctctgcgccctctttgcccatggcattgtgctgttcatttgtggcatttgacttcgccgctgtttgaccggcgcgcaaaaacaaatcaactcgggcagccgactttgccaaaggcattgccacaggcgaacgccgctttccagccgataatggcctttgatctcatcctcacgcacaatgtcgaaaagcggggccaaaaggtaaacgaacaattggacagaggaaacggaataggtcagttgacgcacatttggcattccgccgccgccactcgcggcactgtcattggtaaaactgatcggtgcaagggaagggggagaaaagggataatagactgatctgagagagaagagacgatgtgagagagagagagagagagagagagagagaaatagagagagagagagagaaggagagagagggaaagaaggggagagagagagagacagagagagagagagagagggagagggagagatagagagggaaaaaaagaaagagagggagacacagagagagagagagaaagagagagagagagactgtggtagagtgaataagaaagagacataggggattggttttgaaagtgaaaagttattagaattttactttgtgttaattttactcacttattttcattgcattccgccgccgcgtcaatgagcaaccagtggaggatgtagagcgatttgaccagcgacccactcattggcacgtcctcttcctccgcacaacgttcggtcaaaagggcggcacaacactgaaaagggggaataattttggcacgtgccaaaagggagcgatggaattagcgaaggacctgcacaatgtgagggaacgcggcacggaccaaactccaacgggagacggacccaatggcatccgaaaggctggggctgatcccgtgcagaatgttttggacaattacacgctcgaaagtctgacggagggaaaaaggatttgcagggatggcaccaatttggtcaccatgcacgaggcatcctgcaat

SEQ ID NO: 13078 - DNA, 3588 bp, Heterodera glycines
aacaaaagctccaaatccactcgatcaattaaaaattaaaaatgaggataaacccgcaaaatgccgttaaatatcattttaccatagaaaaatacaactttttgtttactaccgtatctcattttttcaaaaaaaaaatatatattctgtatcattgtcgtatattctccagcagcaaccctttcaaaattctcattttccacgccgtttttcaatatttttggctcatttgccaatgtcaccaaatgacatgtcccgcactaattatgctgtagtttctcgttgccgcattggcaaaacgtcggccgttcacaatcagatcggtgccttcaattcgggcatcaatattctgtccgtcaatttggtgccgtactccgtcaatgatcacccagctgttttggctttggccagtttgtgcccgattttctggtccatgactcggttgtcgcgcatttgctcgtgcttcttggctcatgcgtctggcggcatgtgtcctttttgtggtaattagatgttagcaaatttgttaaggaaattgagcaaaaaattgaaaaaaaaggaaaaaaataaataaaaataagcattttttggtgacttttttcacactttttgggatttttatgacttttctgcgctttttgtgactttttgaggcaaaatttgaaatgcatcaaagaaaatgccgaaaaatacaaagaaaattccgaaaaattaaatttcgatcggtgaaaaggcaatgaaacctggatgaaatttttcgtaattgttggaagaatcatttttttttgcctattttagttaactatttataaaattaagtgcctaaaaaccgatctctatttataaaattttattctataattgttaaaatgggctttttttaactttcgcctaatttttcaggacttttttacatttttttcgtgctttttggatttttttgtgactttttttccatttttcgtgaattttttgcgtttcttatgacttttttgtgactttttggcgattttttgtgacttttttagtcgactttttgaagattttcagtgacttaaattcccagccctaataattaatatttgcctatttttgtgaaattcgatgcccataaatacacattaatattcctcaccttgggcagatttgattgtaataaactttcttttctgccctatattttagtaaagaattttcgcaaaaaaaaaacagtcaaaacgaactcaaaatttttaaatttttattaaaaaatttcattattaattgaatttttctggctttttttttataaatttgaaaaaaataacttattgaaaccggagtaaatcttttttttcacttttttttcattttaatacattttctttgaattaattcataaataaatccccacatttgtgcctctgcttctgtttgtacacgttgcgcagttgtcaagtgttgttgcacaatattatttgcatttgtcaagtggtgttgcacaatattgtgcacatttggccaagaatgttgcacaatattgtgcacatttggccaagaatgttgcacaatattgtgcacatttggccaagaatgttgcacaacattatttgcatttgtcaagtggtgttgcacaacattgtgcacatttggccaagaatgttgcacaacattatttgcatttgtcaagtggtgttgcacaacattgtgtacatctggccatggctgctacaaaagggttgtacagaatagtgatgctcgagagtcttgatgtcatctggccacgactcgactcgtggaaaaggtctcctgcctggtttttgggatctcgttccgaggctcggggccaattcttgaaccgagaaaagttctcctagcttttttgggtcctgtcctccattgaactctgcgttaagtctcggcctcaactcgcgaaaaaaattcttgttttctgggggtctgggtatacggtgctgggacgttagtcaaaaaccatcaaaatggaaaatttttgacagaaaattattcataatttcgttcaaaatagatcaaattttataatcttgatatttttcgataccactgcaaaatttttaaaaaattcttttagtttaaaaaaaagttatgacctgagaagctcaaaaaactaagttttttttgaacatttttagagtcttgagctcgagcccacatctcgagcattttgggtctcggtctaatatcaagtgtctccaggaagactcggtctcgagtcccgactggagaaaagtcaggggttttttaatgcattgtatcgagtcttaggattgcgggtaatggaaatttcagtctcgagcatcaccagtacatttggccatgggccgctgtaatgaattggagtccgacacactgggcaagagttatagggcaacctttaaaatctttcaaatataaattttttgttttaaaatttaccaaggtgcgaggcattgctggtggaacacatgctaaattcggttatttcatttacaaaatgcaaattttgtaaaaatttattgaatttttcccggttaagtcaaattctaaatttgaaaaattcgatctcgagtctagactcgagaaagacttgggattttgctgtagttttcgaaatagtgaaaatttcagtctcgaacatcacttgttagtagtagagatcggaccggtcggttttttttaggtttttttcggtttcgggtttttcggttttttaaccgaaaccgaccgaccgaccctcttgtccggtctctagttagtagggctataaattatatgctttttgcatattttttctgcgcatatgctatgaagaaaggggctcaaaaatagcatttctacgttaaaattttttgatttggtgaaggtttttagtgcatataaaagcatattttgggagttttcgagaataaatgcatattttgtcatttttgcgtttttagagcatatttcggtcatttttggcaaattttcataaagaaaaatgcaataaaaacgaaacatacaccactaaggatcgacattttgggaattaaaaaatgtacgcttggaaatcgaaaaattttgaactttttgcagaattttgaaaaaaaaattttttgatacaaaagatacaaaaaaaaagtcgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtggcttggacactttgtgggggtgccaaaaaagtaattttgtttgagcataaaataaaaattcaaaattgcatatgtaaattttgaaattcaaaattttttacaattgtctaaaaaagctccttagtcattgttttagggtttttaaagtcaattctgaattgttacacaatttttggcattttttgatcgttaaaagccatgtttggcagtttttaatgcatattttagtgcatatttgggcatttttcgggtttttagggcatatttgaggga

SEQ ID NO: 13079 - DNA, 1177 bp, Heterodera glycines
  misc_feature (76)..(76): n is a, c, g, or t
  misc_feature (78)..(78): n is a, c, g, or t
tttttcagtaccaggtccaggtccccgtacactctaaatttaacactacaaaatcagtgccaaaaaggaaaaagananccgcgaaaagaatgggaggaaggctttaaaggaatacataaatctgtgaatgttttttaaaatttattttgatgataatgagtttttgtattttattataagctatattataatatattttacaaatttaacaaaattatggcccatttttgccacatttaattggttaattgatttttattgtaaataaatttgtacaaaattcattttctctatccaattcttctttgctgaggcttcactcaggctaataaacatccgatttttttgctgtgtattttatcgaatttttaaaatcaatttcataaaaattcgtggatttcatctgctgatttgggcgctggtaaattaattattttttgaaattttttttctaaataatgatttttttatttgccattttctcggaatttcaaaaaaaaagtgttgtgcttgggtcaatctcatccagagaaatcagtagatttttgaagtcgcggtcttgagtcatttctagagactgacttttgaggcatatgcctttttttgagcacgagtttcgatatattgagcataaaaaactcagtttccacttggtttgaggcttctacgttgacttttattatgcctttttttttgcctttttcgggatttcgtgccttaaatgccttttttggcattttgccgctttggtgcctttttggcgtttttttccgaaaaattccataaaaatgcaataaaatcgggaaaatacaccaagactttaaaaaattaagaaaatacacccctaaaattgaaaaattttctcaaaaattgatcgccaaaatttcatttttttcttgataaaaattttaggtttaaaaattttccttattcaaaaaataaaaaatttagtaatcatttaaatgaccaaaattaagtttttcattaagttttacgtgttttgatcctaaaagtgcttaaaaaaaatttaaatgccttttttcatgcctttttcgtgattttcgtgccttttcatgacttttttttcaattttttggtgcctattatagtgcctttttcgcgatttttggtgccgttttagtcggtctctagtcattaaaccattaaatgtatttaa

SEQ ID NO: 13080 - DNA, 2371 bp, Heterodera glycines
attcagcgacctcgaaaacccataaaaatatagttttccttgtaatttatgaatttcaaatttatgttcgaattcggaattttgaaaaataaatgccatattcgtgatcagcgcctcaaattaccctagaaatgactttatttgaaaatttcaggggggggggtcacaaaacagaaaattacccaaaattttttacgggacgggatcccgcgcgggatcccgtcccacgccggtccctactatttattcattgtcgagcaaaaaaacaaaccaaaaaatttactagttaaatcgatgatgctcaacacgaaagcattgttaaaattgatttgagaggatttgctttgtggcttaaatctattaaataatgagtaagaaagaacaaaatacaatagaaaccaaggcgagaatcgacatggtgaaaaagaggggggggggggggggatgacagctcgaagatgaaccccgctccggacgaccacctgctctcgattcggacgacttggagcagcacgttcagcagcatccgtgttctagttcgcgccaacttgcagcagagttcggggtccatcagacaacagtgctcaattacctccatcagctcggcttcatcaacaaaaagggtgccgaagttccccatgcactgacccaacaacaaaagcatcagcgagtggtcacctgcactgaacttctcgcccgtttgagtgctggaatgcagctttcccagctgatcacgtgtgatgagaagtgggtttatctcaacaacaaaacggcacaaaaacaatggctgaagccaaacgaattgggcgagccgacccccaggcgtcttcaacatgcaccgaaggtattgctgtgcgtctggtggtgttcatcagggttggcgcgctatgaacttgttccggctgggcaaaccatcaacgccgacatctaccagcaacaactgcagcgggttcatgaccaaattcgtcgtcctccattttctgcaaaattccgcggcggcgtattccttctccatgacaatgcacgcccacatgttgcgttctcaacgcaacaaaaaattgagcaacttcgatgggcggttcttcctcatccaccatacagcccagacatcagcccgtgtgactactatctgtttcgatctatggagcacttcttgagagggaaagaatttgctgatcaaaacgaggtcgaaaatgcattggatgacttttttggatcgaaaaatgatcagttttataaaaaggggattgaaatttgcccgaacgatgggggaggatcattgatcaaaatgtacatcattgattgaacatttgttttttgtgaaataaaaaattgtttaatgttgaagtgcttaaagggtcagaactttttcatcaacccaatagttaatgcatcactgttttataaatagttgatcatcacaatataaatttctgtaaatgacataatttctcattttattgatcctcgaacgggggctcacacgcagactattgagaggctttggagggctgcaaaaacacggaataaggcccaaagtggaacgcattttaattgaaaataaatttttattttttgctcaatatacactgtgttaatttaaaataaagacaccctgttttttgggagtttgaccacttcccatgaaccgatcgagctgaatttttaactgtacgtagcaattctgaaaatattaagattctaaaaaggagaaggcgaaatgacgaaggaaaaaaattttatgaattttttcccgaaaaggggtgttaatttaaaatagagacacttgataaaaacgagtcaaatctcaacaactaccaaaaagaaactgataaaacaagctaaataagaaagaacaaatcttttttcacatttctgtttattttgcgtacagaaatatgtcttttggggagagttatgttgaattttctaagttttcaggagaaattaagggccaaaatgcttaaatcgcctctaacaaagggaggacataatcaacaaagcagacaacgtagtaggaggaagagagcaaaacagcaatacaccaaaaacatttatttttctttttctgttcattataagtcctccgccgctcacatgccattgccgctggccgttgttttcaacatgcataacaataataaaaaaaactatttcttacgaaataatcatcaattctcccccaaaaaacaacatttttaatggaaaagtcaccatatttttggcgataaaaatatcatcgaaaataaaaaaataatttacatattatatttcattggatagaggagaatttgaagggaccagggtcgttttgggcgcccgacgttttggcgccgacgatttggcgccgacgttttggcgccgacgtttg

SEQ ID NO: 13081 - DNA, 1765 bp, Heterodera glycines
taaaattcttaaattaggccaattacagactaacaaattaaccatttgtaattatccctaattgtgtctgtgaattcgtcctccatcccgccaaatgggtccgcgcccaatttgactgattgcgccaatgccaaagattacgtgaccgattttggctattttttcgtccgctgggcccatctgatcaccgggtcggtgatccttctgttgcttctcaacatttctgtgtttattgccaagaaacctaatttgccattgcatggaaattttaaagtgaaatatattaaaaataataattaatttcccctaaatttccgattgactttatttagttgcttttgctaaatatgctttttctgtatgctatttttgctttgtcctatctgatcacttccgttcgctatttggtaatttctgtttaactcatgccacaattccttcggtgcccttttcagttcattttcgccactttttccgacccgtgccaatgtttgaccccaatttggctcgcctttttgcttcggatgcccgcttacgtttatttggtcgcttttccattttggaattatggtaaaataatattcaaaaggataaatataattaattttaattctttttttaaggtcgaacgcgttcgagcgacgatttttgtggggaaatacgaaagggaaggcataaaatgcggaattgcatcaccatttttatggttagcaccaaaaaaggaaacttgaataaatattaattatattatccaaaattaattaaataaatattttaaaatacgattttcgatttccctcccctttttcagtggctcttagctgtccttttctgcacttatattatcatcacagcatttgcggacaccgtaaccttctccaaacctttggtctatttgaggtgttttttgtccgtttgcctaccgtattcgtccctttttgttacagtatgaccacttcgtccaatgcgcatgtgacaattcgtctgctctttccgctcgacttctcctacacccttttcttcaccattttcatcatttcctccgcttttgtgcgcttttataaggacgaaatgggcttactcgtgtacaacagagcatacgaaggcattcaattggtaattttgcgttgttttttgacgatgttaattttgacattatggatacaaccaaagaaagtgtcacttttttggaacatggccttagggcttcttgcctcgaaaactctgaattttagaagtccaaagattagtttcgtcttggaatccaagaacacttccgacttttacagtgccaatggaaattttgaagaaacacaacaaacaataaatgaagaagcatccttttgcttacaacataaaaaaattgaataagccaagagaaaaaaaaaggagggaatggggggggggggggataaacccaactttttgaccatccctcgtaattaattaaacatccaatcatttaattaacaataacaataaacaattttttgtttcttttatatgcaatttgtttgtccattctttcgcatttcatctgatcatttggattatgtgcttgctgatcgccaccatttgctcgtaattttgttccaccatttccctgttgatcagctttagtgctcttttattgtccattttggcaatgaatggtattgtgcggaaagtgaatcgaagtcggtctgtcgctgtgctgaaatcgtccgactttttgccgcctatggagagattcgccaaacaaagttcaacaaattcggacacctgc

SEQ ID NO: 13082 - DNA, 4713 bp, Heterodera glycines
cacctcacaagtaatgccatggcaaaaagcttattctatcaataatatgcttaaatcataaaatatataaaaaaatacaattgtgaataataaaagtgcaatgcattgaatgggtaaaatatattgatggattttttgcctccaaataatatttaaaaataatatatttaaaataattattaattaattaaaatcatttgttccgtactgaaatgacccgcctcttctgatcacccacatcgatacttttgacacttcatcacagcacctttagctttgttgcatttttttaaacaaaggcaataaaaaaatgcatggtttaaaattaaaattaaactatcgtttttgattttgaaaagctcctgctggttaaaggagataatttagcagaagataggtcaacaatttgccttgtgcggtcggggggggcgaatctgtgcaatttcattttgccggtaaaatatttttgaatttctaaatttgccttgggcaaaaaagagtgaaaacgaacgatggcaaatggaaagaaagaaaatggttaaaacaggggcaaataatggagagagaaagggccgaatactagtgatgaatattctcaaacaaattatttcattcaaataaaataatgttaaaataattcattgaaaaataattaaattactttattatttattcatgtggaatttgaaagggtaaacccctaaaattcaactcaatcattacggtcactgttctctcaattaattaatacgagataaatgaattaaacggaaattttagggttcttttgggtttcgctacccacatctgaaatctttttaaattttattcgttgttgatcatgaatcagaaaccataaataaaaattttattatttgtttcagagtaacaaaaccaaaaagtaccatttttcatagagcttccactgctgcttattcgccttgttcccattgtgaacttgtaaattttctccccaattaagcccactcaaaaagaaataaattgataattttagacaatttctaaaaatgagttgcaactcaaagccatcggccgaatgtttggccgatcggatgaagcgtgtgttgagcaccggcgaagacgcggacgttcagtttttggtcggaaaagacgacaacaaagaggcgagcttattcagctgcaattaattatttgatttaattgggggattaattgttttaaatcaaattttaatgttaattaggtgatttaatgtaagttttgaatttttgtaagcttttgtcagctcataaactgattttgaaaatggcttccgaagtgttcgccgaaatgtttcgctgtgacgacacggaggacgaaagtggtgatgaaaattcaaaataaattttaaatttttactattttaaatttaaatacaacaataattcattttagcggcttgggaagtgattaacagcagcaacccaattgtggtctccgatgttgaggtggtgccattcaaaataatgctcagttacatttacacggaccaatcgcacggaattaacggagacaatgcaattgcggtgcttcacgcgggtcaaactaattaattttttaataatcaattaatttttttttttgaaatttagcaaaaaagtatcgcgtgaatgggttggtcaaactttgcaccaatgttaccatttcggaactgtccgacgtattttttgcgttagctcaagcgaaactcctcgaagatgaggtgctggcctaaaattgagaaaatatttatcttttagtaacattccaatattttagttttgtcaactttccaaatatttcaatattattttagcaatttgccaaaatttaaacattttaatttagcaatttgccactcgctgtttgatttacattgatcacaatgcccacattttattcgaacagtccgaccaatttttgaaaattgaccaaaaattgttgtgcgaaatttttggccgtgatcagctgaaagtcattggagaaatgggcatttggaaaactgtaaaatataataatttattattttttaataataaatagagttgtgcgggaccggaaaattttgccgggaccgggacttgcctggacctgataagccgggaccgggatctcgattttggtcccggaccgggaaccgggaatttttaaaaattcaaaaagaattcaaattctaatttatttcaaataaaaataatacaaaattgatttaataaatcattttttaggctctcctttgggccgatgagaaatgccgtcagaatggcattgactgctcgggagacaatcgtcgtgccgtgcttggccctgctctgttccaaattcgttttccactcatccccaaagaggacttttcggaacaaattggtaagcattttaaatactttcatttaattaattgatttgttttttagtgccttccggcgttttgacaaatgacgaaatgtttgccgttttgctgtaccattcgagtcgcgaaattgcaacagaatgccaagctccgtccgagctcaaatttgccaccattcggcgcaattacatttgcaagcggacttttttggtgaaaattgaacagttttctgcgcttccacgtgcctccgataagaattacgagccaattgacagcgccgtggtggacatcaaagggatccgatggcaattggactattcgttttttttattccaagtgaacaaaaaatccggttactttcgcctttctctcacgtgcaaccaaaatgagaaaggtaatactcagctgagaaatcttaaagtgattaattgcgcaattactaacacaattaagctgccgattggaagtgccattgttggacaatcacacgaacaatggcacaacaaaaaacgggcaaaaaatgcgttgtctgggagagagatgacatttttcgtcgctgcaggccagacttaacatttaccagctttttgatggatcggaaggtagtcatgggatttgcttgttaactttcattaattttcaaatttattttcattacttttgttaaaaataattcaaatatttcataataatatttggcacgaagccaaagcgagaacatttattgggtttaatttttctaaaaaatgtttaaatttgtcttcaaattattctcctgttaataatccagaaaaaggatttttcaaattttctataaaatatttttaaaaattttttttcaaaatcaacaaattttcgtatataattattttaatatttcaaaattgttcattattttgtcttgagatttgaaatttttgccagtattttaattaatttttctttaacaaattttggcaatttgaaatttaatttttaatatgctaaaaagtcactttagattatttctcttgtaaaatgttaatttcaaaaaaaagtaaaaaaaaaacattgatgctaaaactttgttaataatttggcaccataaaatggtaaaaaatgatttagcaattgatggacccggccaacggtttgtacaatgcggaggaggacacggtgaccattgccatagactttatcacttacgaagcagacaaatgagctgaatgaaacagacgcaattcattggtcgtcgcgtggaaatgataaataattatttggctaattaattttggatgcaattttcattaatggtaatatttgagcaaaacaatgaataatctcaataagcaattatcaacggattaaatgaactttttcaaaatttgatagtgcaatattgatgttaagctaataacaattcaatttgctactttgtatcctgttgttttaaggttgagaattaatcttaaaaaatcttggggtcaaaccagggctgggcgtaactggattttcaattacggaaatccgtaattcgtaattacggcgattttttcaattacggccatccgtaatccgtcatgacgggggtcaaaaaacccagtaattttccggaatctgtaacccgtaattttcaaattttattttcaaaagtttaataattttttaagcaatttaaaagcatattaaaaagatttggcgtgaccgaaagtgcggatagacaccgcagaggaaaattttgaagatttaagtgcaatttgtaaaaaaatttgcgttaagataggttaaaacattaattttgtcaaaaaggtaatttaaaaaaaagttattttaacatttttctggaaaatttattagcaaaaatacaataaaaaagaaaaatacgcccctaaaattcaacccaaaaatttcaaaaaacacactcctaataattaaaaattttctcaaaaattcattcatttatttttctttacaaggagtttttaaaaaatatgtgtcccaatactgattccgcttaattttgttgcttttggataaaattttacggcataaatagggtcggtaatgcccggcggggatgggaccgcaaatgtacgacactcaaatgtccggaacacaaatgtacggggcgcaaaagtggggtaaccatctttgctatacatttttgtagggttcgagccccgcccccgtcacccccgcccccgccgggggcgggacaggttttttggcctcacccccgtccccgcccccgcgactctgacccccgccatcccccgcccccgtgaccttcgcccccgcgggggcgcgcgggggtgaaaatgtacccctaaaattgacttttcgagaagagtgatgtatagttaattggcgatgatacaaaaatt

SEQ ID NO: 13083 - DNA, 1826 bp, Heterodera glycines
tcatatcatatcccccccccccctcccctcattcgcttcgcttccattttccgtcccaaaaaaaccattccaaattgcgcacctgtgacaaaatgggagcacaaaagcttcctcctcctccctcttccttttcctatgcttctttctttgctgcctgatcagattttgcaaaaaatgtgcccatttttcataaatttctttcatccccaccatttttcattcgctttttaaaaagccattcaaaaagtttaaagtttggtccgcggatttcaaatttatccacctgctgccgctgctggtcctctcctcttttttgcctgtttatttgttgggcattcattcatttcctctgtacacacatccattttgtaaatataaccatttttggtttccatcgaaatttaaagcgttatccaatcgaaaaaagcggaaatttaacccctaaattttcaaataataagccctccccccctcttatttttaaactctctttctctcccgcctttctcctccagttctccccctatcattattatatccagctttattctcggtgcgtggtctgcctgttccctggggcgccctcataaacccctcccggcccaaactgctgcagttaaaatgtgccttgagggtcaaatttcattcgttttcaactttccaaacaattttacatgtggctacggctttttcaattggccattttgcacacggccaaagcattgcatgaatgaatggattttggattgtccattcaccagcagtacgctttccccccgaacaaaattaaaatttctggtgacaacttgtttcagaaaaaaaagatgtcctttcactagagatttctgttaaatttaaaaaattttaagtagaattttaaagagaatcattcatttcccatttttttcttaattttctgcttattagtaaaaaaaaattgggtcgctttacaaaaaagttatggccaaaaaagctcaaaaaattgacttttacttgggctttttggcgccgtatgtcataactttttttagtcttataagtcatcaaagaaaagaaaaaagttatggtttcctaaaagcggaaaccgaattgccccccaccgataaatccccccggctacttggtagtcggacattgctctcaagtccgtaacaaatgtagcgttcgagtgttgttgagtattggcaatgtctgtttataccgcatccctttttcaaatatgtattattatatgtgattattttattaaaaatacaagttaaacattaaaaaaatactattataaatataatatgtctcggacctgaatgccatcgttaattggtgccgacggagagcaatatctgtagggtatagcgccttcgccaggcaccggcacaagttgtggaggacaatctaagttaattttttcctaatatttactgaaaatgaaataatttcataatgaaaatgaatggtatggcactataaatggttttttttcaatttatgatattaaaaagaacgttataacgatttctttaaaaaaatctctattatctatatataaaaaaacggggggggggggggggggggggtttctcggaaatggggccccgcacttggcaatttcggcacctatcgacccatttctttttgctttcggaaactgatctcccgttacaattttctaaccggggcaaagacaacaaaaaaatttgggaactgagatatgcttacctgtttttgttaacttttcaaaaatcggcgcatagcgcctggcggcgcagctgtaagcgtttcggtgctgcttgcgaaaagttgagccatggaatggggagcatttt

SEQ ID NO: 13084 - DNA, 1913 bp, Heterodera glycines
  misc_feature (1856)..(1856): n is a, c, g, or t
aaatttcagtaagatttgagtctaatttcttttcccaatttcgcattcatattcccccgccccccccccccccctcccgcctgtgtgctgctccctcatcgcacattagccaccccctcgccccctgtcccgtcgtcgctcaccctttcttcatgaaatggcctatgaatgaatgaatagatgaagtgtggtggtctaatgtgtacaattggaccaatccttttttctctctctctctcttttttgaaattattttttaaaaaattattaggatgaattttgcatgttttttctgaaatgtgcgcatttttaatataaaaggtaacggcacccggctgatattcaacccatgcctaaacggctgagctatgggcggaagcggccaaatttggagttttcccatgtgcttcacatttatcccactttctcccatatttttgctaaattctgcttgtaattctactttttctacccccccccccatttgttttgttgctgtctgttgttgttacataatgccaacaacagacattgaaaattttgtgctttctgctttatcttcttcctcatttaaatcatacttcccctgtcccccttccatcgaaataagaagctttgtgctggatgagcgatcagcagcagcagaagcagagcgatggctggcgatttaacatcgaaactgaagcggatggaggggagaggggggggggagggcaaatgcttctttatatgcggagagagggaggggaggggcggtagactgaaaagtacggaaccattggcggtgcaaaaaaatgggggtgcgacaatggggatgttgtgaagtgcgcgagtgtgttgttggttggttggttggtgcggtgcgccatggaattggggctgattttgtttgagattttgaccgaccaagtgaaggaaggcatgcatggatggatggatgatgtgcttttcctccctttgggattcgtttttttaattcaaatttcatttaaattccatccctttgtcggtcattttttgtatgttgccggaatcaatttcctaaatttcttctggattttgattaaaattacgaatcctgtttgagttttgagtgatgattgttgttttaatttaaactaatgtgcttgctttcgatagcctttgataaaaaaaaatttttcaaacgttaaatttcccaaaaaatcccctttgatccggtcccgcttaaccccattttcaataaaccggagtaggcagacatctttaaattcaggttaagaatatcccacaaaggaaagagattctgatcgcttctctctcttcccttctaaaaattatctttcgatactttttcgaatcacttctctctaaaatttccatccgatcacatttcttcctttactttttatgcaaataagcactgatcgctctgatcactcacactctttttctcttccctttcattttgccacaaattttctccatcagctgcacaattttcactctcctttctatctctctatctctcatttcagcaatacaataagcatacataaatctccttgtctatttattgtatgcacaatttttcgtgtcttattattattgttgctccatcccaccgacgctcctcttaaataaatccctttttctcctccttaagtgggcttaaacaacgtgagacgttcaccattttcggatcatctgcagcttttgctgctgctgcgcttgttccagtttcaattatttagaataatgtcatcacacccgtacatccttttatgggaaaaatgaggaaagttgcggaaatttaacaaattttcaattaaaaaaatctaaaaaacgattatttttcatgaatatcttttctttcntttggtcgagttgcttttgtttatccatttaatctcacttttatatgtacaaagctg

SEQ ID NO: 13085 - DNA, 1977 bp, Heterodera glycines
  misc_feature (29)..(29): n is a, c, g, or t
attgttattccgaattttgagacgaaaanatttggggacccttttacacacgatttaaaataacaaaatttaaatccaaattatcaattaccaaccgaacgtgccaataccagtgatttcgtctgcttaatcccttccgctgttacggccttcaaaatcgtaagcagtcgtcgaattgctatatttgtttccgccactttttcatatgcttttgttatgaactcataatcattcgaaactcggaagtacaacaaattataagcctaaggaaaggattaaatttatgaatttaaataatgttttttttcaaactaactatttgcactttttgtccaaattcaaacatttttcgtggaaagggtgacgggaaaagagtgaatggcactatctcagtcacatcgcttctaaaagttttttaatactccctttttaattaattaatagtcattaatttagcagcaaccttcccatgtgttgctttggaagccaaactaatgaaatcttttgggcccagtcaattgcgtcttccaccaatgcttttgtgtccaaatattcattttgtttattttttacgtctgaattattttaaatacgaaaattcgttaatatttaattttcaaaaataaattaatgaccttcattagtctcttttggcgcgttacatttgacaccaataaaaacaaattcgaagagaattaccagcaaaacactgaggcgaatcagttttatggggaacattttattgaaaagcctaaaataaaataaaaaattttaatttcatttaagcatttataattcttttttaattgaaaatcaattatccgataaacaaatgataatatttttgagaaattacgcatataaaaaggatatccgatcggatgcaaaaaagtgaaaacagacggcagaagagcaaagcatgaaaatgtcatgcaaatcataagatttttgtaaattgatcatgaaaatgggacaatctgaaaatcaagaaaaaaaaattgaaaaaattattaaatcaatcagtttaaaaaatagcataattttaaatatataaatttgtacattttaaagtttaaagtagagttgagcgggaccgggaccgggccgggaattcccgttcctctgaggtccggtcccggttcccggtcccggattttgaaaatttatttcccggtttttgtttgtgccaattcgttttatgaaagcatttaatttttccttaagcgacatggtaataaaaaatccaattcaatttttattatgttttcatttctttcatagataaaaaggatattcttatcaattcactttttaaattttaatatgacttccttccaaaatttgatgtccattaacaccagctccgattttccggtaaagaaattcaaattctattttgggttatctcataaatatttgtccctcgttaaaagcatcataaatttattcaaaaaggtttaataaaatttttaaaaattaatgctcgcaaaaataaacacacgttaattgtgttaattgatgccgaaatttgggattttgccgaatggaaactttaatgggaatttattgcttttcaattatcaattagtttatttggtactattagtcaaggttataaaaattaggctaaaaattaaaaatttttgcgttttcccttttcagctttacttggcctaccgtttcgctggtccttcgtccgatttgattgttcccgcactttcggcttttatccccggatattttggggtcattctgaactcattagttgtttttacaacatttagagcaaagtaagaattgatattaaatttacataagctttactaatgttttcataaaaagaaacctgcgcaatggaagtgccaatgttttgatggcattgatttgtctgtccgaagttgggcaccaatgcgggcacattgtattcttagtaatcgtcgcgagtgggataaattttatcggactgtttaaactgag

SEQ ID NO: 13086 - DNA, 1132 bp, Heterodera glycines
gggttgcatttgtgagattttgtcggatgattctgtccgtaatcagtattttttcatcacaactttgctcaattttgcgtgcattgtttgttatgtggccattggagggataataaaatacaaaaaagggggcaagtgccgttaattaattgccaaattttaaatttttgttaaaatttgccaagcttaatttgagtttctcataattcgaaattgatcattcttcgaaaggcaattttccagcaccttctcaaattatgagtaccgagatttctaactcgaaattggttttaatgatcctaatgacccacctgccaactttccagtgaaatttaattacttttaatttgtttttattcgctaattacccatttatccatacttttcagtgaccaaagacacaaacaatcgtctgatgcgttcgctggtgatcattttgttggtcaatgtcggcggctatctgatcaatcggagcgtctatcagttggccttctccttccagcaacagctcggctcttatgtccgcgtttggcaattcactttcatttccggctctctgctgaacatttgctcagccgccaacgcaccgattctttttgtgaacaggtggaaaattagaagaaataatttagcatttttaaaatggcctcaaggttaataaaaatatatatttcgacgatatacagtcatggtcatatgtttaagacaccccaaaaattttttataaatttaaccgtaattttttttactaagatcaaatgtcatatgcgttataccaatcgatagcttattcaatgggttttcgattggtaccaaaaatatgtcaattaatcctctttggccgatatgcgagcagacaaagtgcaacgacccctaattttgggtggtcatatgtttaacacggatcactttatcaatgaatgcgtcaatattttgtgggccaaaaattctgaaaaaattcctgccgttctaacttttgatgctgaccaaaaaagtcttttacagcaacttgatcagatcactccttcatagtgatcgggacacactaaaatacactgaaaatcgggaaaattttagaaaaaaattcctagggggttaggaaattttttttggaaaattttagcaaggccat

SEQ ID NO: 13087 - DNA, 1438 bp, Heterodera glycines
  misc_feature (1374)..(1374): n is a, c, g, or t
cgaaatcatttactatgatcagcagcaaaaaataatgctaatgaatggcattggtctgtgaatgcgcttaaatattcctcgtcccgggggacgcctttaacggcatttgaccctccgacgcattaccatcattatcaataaacaaactttgccgacgatcccatgagcttatcttttgctaaacttattctccttttgcctttcgtattgcctatgaggctataatttgacccttccgatatttaccaattcattagttaattaccccacgcaaaaaaacttaattgcatccctccggcgcttatcaattacaaacttttcgtgctgggaatttggatggcatgacttatgtacacacacttctgctgaggattgactaatttggataattaagtaataaatgcgaaaaggcaattattccatgagcagaaggaagtgataagaaaagatcatcagattgtcagcatataccccaccggtatgtgcctttcttataaacaaattaaattaaaattttactcaattgtcttttgaaactataatcatacctaattaataagcatttaaataaaagaaaatcaaaaatcaactcacaagccgcaaaatcattgtcgaacattcgcccaaggccgcataatatccctcgtccgtctgctggccatttttaatccatttgtccgcttaacgattaatttatgcgttttacgtttaatgaattttattgacaaaaattcaattaaaatattaaaaatatataaatgaatattaaattttctctttacctcttccaactctttcgagggcacgtatttctgcagcaaattgttctaattttcggagtcagcttccgcctcgatttactgcggggattttggggggaaattcgaaataaaacacgacaaaacaaaaacacggcgagacaagcgatcggtgaattcgaagaaatgtcaataaagttaaaacctttacttagccaccgaatcacaatgctcctcgtggccagcaccaacactttgctgctcaatcatcgttcgatttgttttgataaaacagaaagaagaaaatgtatgaaattatggcttatatctaagtctgggaaaatggatataaaatcccgaaaatgtggtaaaattgaaaaagtatgcacatgtttttccaaactgagggaatttttttaaatcactaattttacagtaaaatgtctgaatacggaataaaaagtttcattgaaaaaaatacaaataactaaaatttactaatttttagcgaaaaacaatcaaatttttcatttttttctgtttttaaatctatgaaaaattaattccatcattattttgaataaattttataaaatgagtttttctatctgaaggngtcatacgaataaaagtttttttgaaaatgtataaatgtagcctttaaagtaagtttgctatga

SEQ ID NO: 13088 - DNA, 1510 bp, Heterodera glycines
  misc_feature (47)..(47): n is a, c, g, or t
  misc_feature (56)..(56): n is a, c, g, or t
aaataatttatgtaatattttctcgattttttatgaaaatttacttntctctcccngagggtcggggagaaaccctattgaaaacatttaaatagcaattttaaatcaatttatgaacaaaaataataaaagaaagaaaatgatttaataaatggaatgaaattgtaaatattggactcgggaatgaaaaaagtgaaacttttgcgacagaaaatcaaaatattttttttttgtaaaaatgttactgcgtcgtaattcaccacttgaagaactcacagtaaagacaaaataagaaaattggaaaattgattttgataaaatacagcaacaattaaatttgggtacggatatttcatcattagtgctgctaatttcatttaaattatttttttcctgggttaaataattatgtttgggaacaaaaatttggacttttatttacatatttatttcaaaaattattaatgtactttttttaaatgttgccctaacaataaagctatttgaccacaaatatatttttaacaaagaaagcagagatactaaaatattaagtttaaaaataaataaaaattattttttatgtttacaaaagccgatcatcaggggcttaaaaaaagaatcaagaccgagatcgaataacgtgaggaaatttgcaaaaatggtactgattgggagagatttgagagtcaatatttcgcctgaaggaatacgctgccgcctttcacttatttttcggcattttctttactgaaaattcaaatttgccttagaaggtgcaaaaaagttccaaaataagaaaaactcataaaaagcatgctaaaatgcttttcaagtcattttaatgccattttgaggtagcagaaaaaacgcatttgacttaaattcccagcactagtaaccatcaaaaaactttagtgaaaattaaaattaatctaatcaattttctgttttccaaatgtcagaaaaagaaaggttggccagcagaaactcgtggagtttcggaaccaaattttgttggtggataaattataaaaaggtcatcggcagatcttcaacaaaattaagtagttttaggaaaacaataaattttaagtaacttaaattctcaatattatgggtttctaataaaaaaatgaaaaatgaaaacattgcttttgaatgtttttttaatattgagaaatttattttctaaaattaaaggcttcatttaccacgttttgtatttgctttttatacaaattaaattgttaaaaagaattatgaaataattttatcttctttttttcttgctccattttgatactttacatgatcgataaattattataaaaagtgatttttcaaaaacgacaagaattaaaaaaacaaattttatttagtaaaatttaaaaaataaacaaattaatcataaatattttttactccattgacacctaacaagggtgccatgtcgttatataaaaaaccatcaaattcggctgatcgacaactcagccgtacaataaaa

SEQ ID NO: 13089 - DNA, 1901 bp, Heterodera glycines
taatcaaaattattttaagtctattgaaaaaattttcgttataatgtttagattttttattttctggtatgattcgatagatttaactgctttctattaacctgcaaagttccaaaaaagttatgaccaagatgtctgaaaacctagttccgtaagtacttttgtccataactttgttgaaacttgatgaatttttttgaaatttagattaactaatagagaactgttagggctatcggaaattatcaagatttaaaaatttggttgatttttatgaaaaattatgcgtagttttttgttgaaacttttcatttgatggtttttattcaacggcccttactgatggtttttatataacgactcagcaccctatgaaggattttcgatattttatatattcaccaaatctttttaattattattttatttgcattaaaacgaaaaataaaaaattgttttctgtctctcacttattaaaaatgattttactttggcaaatcaattacatttagtaacattggtctgagcttctagaagatgcacttttataagcatttgctcatttcggcaccccaaagaccgattatttggaaataattctatgaattaaattttaattcatttgaataatttttcagatttaatgaatttgagagaatttttttaattttttcaatattttttttagtttttttttacgaaaaatgcattaaattttagaaaaaatatttaataacaaaatattcggcttttttacttgtacccattttcacaatttatttctaaataaaaaattttctcccctcgcgcaaattttccaacggacaaatcaattaataggcatcttttggcatcccattttctgtcctccatggcaaatttttttttcacgatacatttttctggtggatttgattagcgagcactttcatttgtacgcaaacattcaaaagatccgaatcactcccccccccaccaatggcactttcttttacccattcattcattcgcaaatataagcctatttattggaccttctcaatttattgagcattaaaaaattggcattgactgaaataaaaaatattgcgcttaatatttttaaggatttattttttctcctgggtaatttcgggcactttatccattgacaaattctgtaattgaccttttttaaaacggttaatttagggaatttaaagcagtttggaattccttcatacttttcgtcaattttcttctttatgatgcataattattttctgttacctcttttgcccctttaccaagacaatgggctcagaataatgcacgaaaaactgagaaacccaattttggacactttgacgcaactgcaaaatgccattggaaaagaaaaagaagcgaggtaaaaatggaaaaaataaaatataatttaataataaaaaagcaaaaataaaattaattaaacatatatttaataataaaaaagcaaaacaaataattaagaaggtatcaaaaaatgaatacgatacagtcgaatggcagaatggaaaacgtggaatcaagcaaaaaatgtagtaatttggtcgtgatggccaacaaaacggggagcaaaatccgagaaaacaattggaaagaaaaaaactaaccaaatgaattggaattaaattttctagaagattttggcgttggagcgcaaaaaaatgtaaaaaaatatataaataaataatgaatagcgccggggagccaaaaatatttgaaaaaattaaaataattgattttaaggcgcaaaaaagtgcttacatcagagaatggcacgacaaatatttggcggacatggaaaaggtgttgggacagaagcgaactcagccgcgaaatctattgacagagcaaaagtataaaagtctaatggaaaaagt

SEQ ID NO: 13090 - DNA, 4810 bp, Heterodera glycines
ttcagagtgatggccatttgtcagatgaatgcgaccacttcggagacattgtggctggccaaaaaccggtaaaatggaaaagaattcgggaattttaatatcccatgaatcttacttaaattctgatgttggtttttacaacagctcctttcccataatctttgaaaaagcattgcaaaaaattaaatagcattagcaaaaaaaaaccaaaatgttttaataaattttttatggtgtcgaaacagatttgaattttgtcctaattttcctaactttttcttttttttctccctttcatagctttcgacttaacggagtcgaactttgcgctgagccagcaaaaatattgcgcaaattattcgaacagagtcagctcagtgcggtcacccctttgttggtggacgagtgcacatgtttgttgttcggaaaggaccccgagcggtgcatccaccaaatggcgaacacgagtgacgcatacgcatggatacagcctatcggtaaatccattttcacgacaaatccatttttggtcacataactcacaaataaaatatgttctatataaatattatatatctgagaggaattataaaataaatagaaattccttttttattttgggtctttttttgagtttataattcgggttggaagttaaacttcgtttttctgatttttaatctttttaaatttataaatttgttttttccgtagcttctgcttgtgagatgacttctgattcaatttctgtcctaacttttattttttagcttttgtcgtcgatagtcgcattttacccgtcgattttgtctccgaattgtcccccaaagactctcggattaaaatgcaaggccaaatggcccaaatgttcgatcggtctttgcggcaaatcccttccacgatggatgcgttggttggacaaatcactcggactttggacgcccatctcaaattgtcaaatggacagtgacatttctgttgacttattgttattttgtttttaaattttgatgagataaatgtattttaagtgtcttttccggggattggtacaaaacccggttataatattaatcataggtccaagactcaaacaaaaactatcaaattttgttgctcatttgtccatgtccccgggtccttttgtctgctttttgttggctttgatttgcttccttttcttaatttctgtctttctctctgttttttatgtttgttttggtccatcccttccaaattgtttctctgcacttttctgctcattacccattcattatttctttttcttcccgcggggtgtctttctccggaaaatgaatgaatggaccgattaatgaatgatgagcaacaattggacagtgtaggggggagtggacaatgaacgaatgaatcagtgaatcgtccgatcgggaggagttgcggggactgagggagggggggggtgagaatggccaagcgaggaatgtttgttgatcaaatgcgacggggggggaacgatctgccgccgattgcccatcccttggccactcccatccctttgttctctctcttccggttccctcctcccccctcccttaattatctcctcttttgctcgtctttcgtcacttcattttccaataaattgggcaagttcggccatttcgcctttttgtgctcatttccgtcgctctttcctcccactgtctgtccgtctctcactttgcctttctctctctctccattctttgccatgtgccgtcgtcctttgcttttaattctttcatttgttgtgctttcggagtattgccgtgccaaaaatgccgaagagaacacgcggcacttggacaatgacctaacgaaacggcaagcaggtcagtacgagaacggcacttgttctgtccctatcaatgcccccccctccctcccgcacttaccgtaccccaaacataccgtacctgccaactttgaatccattcttttcatttcttccaattccgtttcccatttttaggattcggtgttccttctgcgtaagctccccccgcccctctccgaattcattttccgttgcttttcagttacggtccgtgtgcccctgcccatggcccagtcggatggtactgaaaatggcaaaaaaaattttggtagtttgtctttaaagtgcgccacccattgctgctttgccgcccccgcctcttgctcccgtgccgcctcctcctccggcgcctgccggacgactgatccctcaggcaatttgtcctctgggcattaaataattcaatgcgtccccatttcattgaaggcattgcctggcgccccttgtgagcccggcgtggaatgcaccggggggagtgtgtgctccatgggcatctgtgagtgcctccatacttttcttcccttatatgccttcccaaggtctgtgtccgcctgaactcgttcaggaaggcaccgtttgcgtgtcgcgcaccatttacggggtcgtcccgccaccgggcggtccgccgccactcccagcggcacccgcctatgctccgccgcctcctgccccggttgtccaattcgcaccagcgccattcccgtcgtccggtgtccccgcctttccaatggcagccgcacctccgccactccccgcatgtccaccgccattccgcgcagcgtgcgtcgccaggcgaagtgcgaaggatgggatgaccggctctaatccatgaggtgggccggcccttccggggaacaaaattggaaataaaatttggggagagtacctccaatctttgatgaaagaccaaaattgacatggatgaggcgaacctaagccctcaatccgttgattgttccccgagaattgggctaattgattccagcggagccacgaagtgaaacaaaggaaacgaaaaagatcaaaatggcaacgaaatcggaaaaacggccctttccttctaaaaaccacacaattccaccactgccagcaccacaacagcaacagcagcaacaacccgaggaggaggacattctgtacgcgctgaccgacgacgacccgaacccaaccaattcaaattccattgaacagtcggtggaatggagcacgaagagacggcggtgaccaaccaccgaaaggaatttgttgttgtattgttgcgctgcttgttccctctcttacccatttcattttgtgatcattttttcaaaattacttatatttcatccaaataaataaaattattaattgttaatttttcataatgcattttgaagttttggggtgtccagatcacaatgaagaagagatcagaaattgatgtaaaagactttttattagagatcggcctgtacctggatccaggcctgtatttttcctggatccaggtacaggtacaggccatttttagaatttagtacaggtacaggtacagctaaacacgaaaaaacctgtattttcctgtacttttctacaggaaatacaggtacagaatacaggtacaggccaatcgggaaatacaggtacaggttcaggtacaggcttttttcaaaattccgatctctaattcgaacacaaaaaaataaattttaacattaattcgaatatatttaagagtcaaaatgccaaacaaaagtgtgacaaacagttcaaaaatcaggtttatcctccaaattttacgatgaagttaaatttttaaatgaaaatagtcatttttcatttgtagattatctagtgaaaatttgaataccatatttgacaaactcattaaaacaaaactaatacgaatcagagtacaaattgggtggtctttcaagtgtacactgccaagatagccatttttaaatatgttttcggtggataatggagaaaataataaagatttactttacaatcacctgctgctgtttaataacatatgcaaatattctcaaataaaaaatttaattaaaaacgcattgacattcaaaacgttaaatgcgtcagtggttttttcagcattttttttacgacgaaaattgggtgacatggcaaataattatgaataaaaaatggttaatgatgtgttattaaaatatatcgaagaatgcatttgtaaacatcacaagccctaattacccgatgaaatatgggataaattgttttcattatttaagaaaaagatttgtgtaatttattttgaaaaataagaaaaatttaaaatcacagtaataaattcgaatttttgtatatttttactgttggatttaaaaaatcttaaaagctgaaaatttacgcttcaaaataggctaattttttaggatattgtatatccaaaagaaaattccgcaaatttatataatttcagagtctcatatgagaattgtataaaatttttataaatatgtaaattccttttattacacattaaacactcatttttgtaaaataaaatataatttttcgtatttaattagtcaaaatccgtaattttttagaaatgtcacgcctttctattttcgttattttcaatttattttttctcatccttgcgacattttgatcataaggggtaccatcggtttggccagcacaaaactctcgcaaagatgaaatcattcattcaaagtttgactaataatcgctagtgaaaccaacaaaaatgctaaaaattcatttttaaaaatttcaaagaaatttgatttatcatataatattcaggaaatttgttggcgttttacatgaaaggttcctggaaatttaagttgtttaggtttcatatatatttactttattgctctaacagcaaaaaaagcatgctaaaacttttttgaattaacaaatataaattaagaaatttatttatttttttac

SEQ ID NO: 13091 - DNA, 942 bp, Heterodera glycines
gaaaattactaccgaacacttacaagtgaaacatttgttcacctcgactgttgtccttacatggatgcggtgggttttgatcaatttacagcaataatactttctcaattttttatcggcataaacgtcattagaatgaatttaaaaagacattttgtagttagccgatttttctttaaggtaattcaaaaaataaacgacgaaagaagcatcgttcagcgcttcttacattacagcactttgcccaagattgaacagctttgttcagaacttttggttaacgaacagctggagaaaatcagtctgatgtccagggaagttgtgcaacgggaaatgatgcacggtgagttggcaataagaggagagaattgacttggccaaacacagtttcaatttccattttcagaccttcagaacatgtacattctgttgaaacctttgagcaacgccttgccagttttgatgcaagaattcgaaatttatattcaaaagtcggggatgaactgcatggagatgacaatcaacgaacctgccgaatttgtgtccaacattcagttgctgcacgaaaagttcacgcagatgatcagcaccattttcaatggggacaatgaatttgttgccggattggaacgtgccatccaatcggtggtaaaccaccgagacgatccaaaacagccaccaaaaatttcggaaaaattaaaccgctacattgactcgttaatgcgtaccaacagcaaaaggggaaagagtgagcaggaacttgacgcacttttgtcaaaggctattctcatctttcgcttcattgacgacaaggacttgttccagaaattctactcaaaaatgctctcaaatcgtttggtattcgaaattaaattgccatgatttgttaaaccaatatattttgttcagatagcgaatttgtccttctccatggacttggaa

SEQ ID NO: 13092 - DNA, 3989 bp, Heterodera glycines
  misc_feature (3939)..(3939): n is a, c, g, or t
  misc_feature (3945)..(3945): n is a, c, g, or t
ggtcacaaaagcaccaccgttcctcatcgatgttcgatcagaaatgttctcttacatcaaatgccaacggattgccaaattctcataagaaaataaagtaagatttatttgcagggatgcaaatttttttttcaaaataaggtcaaactaggttaaacctaagattttgaccccaaaaattaagatttttttaataacggatttttacatagtagaaacaattaaaaagcattattggctgttgtaaaataaactcaatttgcatttaaaatatcagcgaaataatcattaagcacaaaaaatttaaaaagtttaggagaagcctgaaaataagaaaaatcttacaattaggaataaagttaagagatttcaagaatgaaaattttgtagcattttttggaaaacgaaaaaacttactaattcatcataaaattaaatcgctgtaaatttaaaaatgtttcattgaattttcttacaaaaatttttcacaaaaatttttctaacaataagattttttcatgaaagtttaagtttaaaaattaaaaataaaattcggcgaatattaatgtaagcaacaaaatcacttcaatagggaaatggtctgatatcattcggactcccaaattctcttaatttaaaaaattgagtcaaaaacactcaaaactaataaatttttaacaaaaaagtaactaatataaccaaaaaggggacaggacaaaaatttcgccaccgaaatttcgccgcaaaaatattaaaaaatagatttaaaaattttttaagaaaaaaatcttagaaattcctatttagaaaaatttttcagtgattttttttacaaaaaatcgctaaaaaagtttatacaaaaaaaaattctcaaagattttttcttgaaatttgaataaatttaaaaaaagatttctttggtgaaattatgttccggcaaaattttggggtgcacccaccaaaagatgctaggtgaataatacttattgttaggaaaaaaatcaaaataattaaccaccggtcgggcggacccgaacccatgacaaaaggtcaaaaaatgtaagagaaccaaatccataaaaattaacatatttttgctttttctggtcatttttggcgcggagccaaaaaaaccgaaaattggcaatagcaaatcgactattaagcacaaaaaattctctctcctcctgggctatgaccctcccccgcacagtttcactatatcttttaacatgtgaaaattttgaaacaatatacctagtccaatcctacgtcattggagcctggttttgccgctgatcatggtaaaatttaaagcattgaaaatcattcagttgcgatgttcacccgatacagttcatgcgcaaaacgcattggtcgccggccaaacgccgctgcattgacgccaaattttttgagtccgtgaaaatttaagcactcgctgattgattgttttcgtttaggagcaacaatcgcggtgaatggaatttcaatggtaaccatgccaggcggttgttgtgcggacgtggcaatttcaaactggagaacatgttcaagagggtgagatcgttggtttttcaatcgaatcgctcccaaaatttgtttagtttttctccattgccccgcaatttcatcgagcacaatcggactgtgaggctctgttgcaagtttgcctctcctacggcatggattttgtgaaatttgttgaccgaaattgttcatctttccccgactgcttctacacctcctccaaaaagactcacaatcagacttgatttttgattatttaaaatttaaatactgacatttcatctcgttttgtattatggacatgatgctgcttaaccgttcagattgcaccgtttaaatacagacgggtttttgttttgttcttccacgcttatttgctgcttatatatttattattattaaaatagaaatacatatatttttgttttccattagttgatataaaatattcagatatctttcacacttacaaataataaccataagatcgaattaaagcggggggcgtgtggtgtaaggatgtgtcatattgagacctatattttcatggattttgagacaacgggactttttgacgacggccacaacaacccgttgaccaaccccaatcggtccaatgagacggccagagaacgtgcccagaggttggacaacctcatcaagtcaggtgagagaagagattgggctgaaccgcttgaattgacaatgaatcattatgccaacagatggaaatcgctttcctaaaatcacggaaatggcttatatgtcggtgccgcgggtgttgttccttgagggaacggagcaaatgtccgcgcgccatttgtcatcgatgtcgcaagacggcgaagaaagcattgagccggtgcaggtcgttacgaatgtacacgtgcgacagctgaatccgcagcttaatgacaaggagcggttcaagtacgaggaattgcaacggaaagtgccaagtgagtcgtaggttttagcccttccttcagctgtttgttgcccaggcgtgcttctcaaacaatccgatttgacatgcaaatgcactttcgctcaggaatggcccggagtcgtccacctgcttcagactgttccaaaaccagcctgtctggttgcgcacaatggtctcaactttgacttccgaattctgtgccacgagttgcgcaagagcgacctgttccgtacccatccgatcccagaacaggtgacgcttaaaattgattgggttttctggttacaattgttgttcaaccaggtttatttcctcgacacgctttcctgcttttacgaactcgagaaggagtacaaccgcgagatagaattaacgatggaaaatgttgattggactcttggtgggtcactcacacgatggcaccaattttggctttccaattccagttttgtcccaattccaaccgaacagcgaaactgtcgttgcaactgccgagatagaggaaactgtacaacaaaatggcactgcttctgagggaacacaaaattccaatggtcacaaaagcaccactgttcttcatcgattgttcgatcagaaatgttctcttacatcaaatgccaacggattgccaaattctcataagaaaataaagtaagatttatttgcagggatgcaaattttttttttcaaaataaggtcaaactaggttaaacctaagattttgaccccaaaaataagatttttttaataacggatttttacatagtagaaacaattaaaaagcattattggctgttgtaaaataaactcaatttgcatttaaaatatcagcgaaataatcattaagcacaaaaaatttaaaaagtttaggagaagcctgaaaataagaaaaatcttacaattaggaataaagttaagaaatttcaagaatgaaaattttgtagcattttttggaaaacgaaaaaacttactaattcatcataaaattaaatcgctgtaaatttaaaaatgtttcattgaattttcttacaaaaatttttcacaaaaatttttctaacaataagattttttcatgaaagtttaagtttaaaaattaaaaataaaattcggcgaatattaatgtaagcaacgaaatcacttcaatagggaaatggtctgatatcattcggactcccaaattctcttaatttaaaaaatggagtcaaaaacactcaaaactaataaatttttaacaaaaaagtaactaatataaccaaaaaggggacaggacaaaaatttcgccaccgaaatttcgccgcaaaaatattaaaaaatagatttaaaaattttttaagaaaaaaatcttagaaattcctatttagaaaaatttttcagtgattttttttttttttacaaaaaatcgctaaaaaatttttatacaaaaaaaaattctcaaagattttttcttgaaatttgaatanatttanaaaaaaaatttctttggcgaaattatgtccccggcaaattttgg

SEQ ID NO: 13093 - DNA, 1350 bp, Heterodera glycines
gaaccaaaaataatctaaaaaatattataaatttattttatttcattaaaatattgtatattcttttttaatgcaaaagttattcttttaaagaaagaaaaattcattttactatttatttggagagctttaggctggcttttacactgcttttgtcggcactttttacataataccattttaagaatttgagaaatttggaacaaaaatttatagagaattacagagggaatttttacgtgctaaaaaatgctgaaatatgtgcgaaaaattccagaaaatgccaaaatatgtgttaaaaattgaaaaatgaaatgtgtgtattattgcataaaaaattccaaaaattctcattctttttcattttagcccgcataatcgcaaatcaaacaaaaaattattttagaatcatatttaaaaaatgtattttgttggtgccaaaaatggaattaaaaattgttttttttaaaccatttcttcacagcttaacaatcagtggcttcactctctgcattaaaatgtgtgctgcttgttcttcatgcgaaaagctgagcagtttttctgcaatttcttcaccccaaaaattgtgtccaccgccttcttggctcggctttagcacataattagccgggtttttaattgcctcctaaaatatatattgcaccaaaaattattcctaaaaagtaaaattgttttaaataaaatattaggccatttagaaaattgagtgccgtcatttagggaaaacaatcgctctcgggccaagtagccagggggagggggaatttccgccccctgaaatgtaaaactaaatttttttcaataaaatggattttttttggaaatacgaagaaatattcctgacatattggattaatatccaaacaaaaaaaatttcccatcagtgcctatcggcaccggcggaccccattttaccatgttatttgcgaaatttcaccccaaaaaatggcaaaaattgatttcatttcccccattaacggctacaaattcctttttttctccaagtcgacgaaaattttgaattacaatgggaatttttttttggaatttttggcccaaagaaaagtcttcatattcagccctcagaattttttttctggctacaggcctgagtgccattggtggaacttaaatttgtgagcaaaatgaccccccccccctttttttcgcggaaattcagtgccattaatgaaatttgaaaaaaaatcgcttctatttttctaaaaaaaaattttagcaccaaaattgggtgttttttgaaaagccatctccacctttgtaacaatttttgttgcattagcacctgaatgaccgctgttgttttatcgt

SEQ ID NO: 13094 - DNA, 1669 bp, Heterodera glycines
  misc_feature (1503)..(1503): n is a, c, g, or t
  misc_feature (1607)..(1607): n is a, c, g, or t
  misc_feature (1612)..(1612): n is a, c, g, or t
tttatacattttgattagttttaattcatttaaattcacatttaaaaatattctgtttaaaatagtatgatacgagtcaactcgccgcagtccaacgccaagtttggcccgtgccgagttgacccggtccaagtttggcccgtgtctgagtgtggcccgttccgagttgacccatcccgagttttggctagtgccgagttggcctgtgccgagttgacccggtccaagtttggcccgtgccgagtttttctcgtgccgaattgggcccgagtttggcccgtgccatgtttggctcatgccaaattaagcaattcccacctgttgtattttcttggtagatgctaaatcttgtgcaactgttggagtgctctgaaaatttgttgtcaatattaaaataaattttcgttttttaatttttatttaattacgattgctttcgatcgttcaacaatacgtcgcgcggtgatcacttgaggtgacggatttgatggaaacaaatttttgaaatgcacaacgccaacagtgtaaatgtcgtccaaacgcagggtaaaatcgtcgtcaagagataatctattaagcatgttttattgtccaaattacagtatctttctaaggcccagaaataaaattttaaaaaaaatacattttaaaatttctccaatatattgctttaaaaaagttttttttttgatttattaattcaattaatgtttttttcttgtgagtttttttttggtagtgttaaattcaaacgcaaaaaaaaataaaaattaaaaaaaaaacaattttttaaaaacaattttaaaaaatatatttttaggatttttgaaatttttctttaaaatttatgttttttaaattttttttcattcaatttgattttttatgcataaaatccttgaaatatccttgtgtatttaagcttttcacaactttttcgcattttcattcttttgctttttggcaattttaaagtgccaacccaaaaataattaaaacaatttttacttttcagcgcattcaaacagactcaaataaatgattttgattttcttttttgatatttcttctattaataggtcaatttggataaattcgtgccaacgactgaatttgttcgacaccattaggacaattgcatttggatcacgataacttttcctgtaaatcaattgattattttgcctagtatttagcaaccccataataatcaattaaaaacgctacaaatttttgagtgctaattaacttccaaaattattttttttaattaatggatgtgtcttattgattatttcccttttttattatcacatttttcatgattttgtgcgattttttcgtttttgaaaatgaaccaattcggagacccttcaaaatccattttacataaaaaaactctacaacaaattatttctatggaattttttaaacccataaattttaccaagagtaatttaaatttgttttttccgggtacgataaccgtttttaccggatganataaaaacctatataattttgtcaaatctatgattcatggcttcaagtccttgaatcacttattttctagatttaaaaaaaaactaaaattgtaaacatagaanaagtnaatatttttcttaaaaagcactaagaactgaacataattttgagtgaccccaataat

SEQ ID NO: 13095 - DNA, 2113 bp, Heterodera glycines
  misc_feature (73)..(73): n is a, c, g, or t
aaaaaaaaattaaaaattaaaaaaaaacaatttttaaaaacaaatttaaaaaaatatatttttaggattttgnaaatttttctttaaaaatttatgttttttaaattttttttcattcaatttgattttttatgcataaaatccttgaaatatccttgtgtattaagcttttcacaactttttcgcattttcattcttttgctttttggcaattttaaagtgccaacccaaaaataattaaaacaatttttacttttcagcgcattcaaacagactcaaataaatgattttgattttcttttttgatatttcttctattaataggtcaatttggataaattcgtgccaacgactgaatttgttcgacaccattaggacaattgcatttggatcacgataacttttcctgtaaatcaattgattattttgcattaatggatgtgtcttattgattatttcccttttttattatcacatttttcatgattttgtgcgattttttcgtttttgaaaatgaaccaattcggagacccttcaaaatccattttacataaaaaaaactctacaacaaattatttctatggaattttttaaacccataaattttaccaagagtaatttaaatttgttttttccgggtacgataaccgtttttaccggatgaaataaaaacctatataattttgtcaaatctatgattcatggcttcaagtccttgaatcacttattttctagatttaaaaaaaactaaaattgtaaacatagaaaaagtaaatattttttttaaaaaaagcactaagaactgaacataattttgagtgaccccaataattttcttgactatttattaccatgcttcataaatgccaatggccatgtgttgttccgacatattgtttggcaaaaatttattcgacattttacgtcctgaaacctccataatgtagcgatgcaattctgtggcccggacagcaaaagctgggccgccataattgcccgaattaaactcaatctgtcaaaaagaaaaaaacaaaaataattaaaaaataattaatttttgttattaaggacgaagttttcgaaaatcaattatgtaaatataataataaaatattgtatataaaataatcgtaaaacaaaatattatacaataataacgctgttaaaatttaaaaaaaaaattgcttttcattattaaggaatagatgaatttataaaatatattaaataaacagaataaaaatagtataaatcatagaaaaatcctcaaaacattacaaaaatataaaaaaaaaatttttaattaaaatttaatttcaaatacatatatttttggcaattatacaatttaaaaaaaaagaatatattgaatttaaaaatcaattatgataataatttttttaattgaatttttaaatttaattgcttaccaaaacaatatatgtgtttactgtacctgtttaagctcatattccacattgtttgtcaatttgtcatcattttgatggaacatgtaatcctaattaaagtctcatttttttaaatttaaaattaagattttttttttgatttttttttagatttttttatttttctgttgtttttattttttttctatattttttttgggttggcagatttttttaatatttattgacattttgtggatgtagtttggctttttctttttttttatttattgatggggtttttaattttttctttatattttaatttttagaatttttaatttgtatatttttaaaaatgagtctttggatttatggcagaccgatcgggccaaaagcaatgtgatcggctgccgaacaatcgactcagattgaacttcctccaaaatgttaagccaagcgcgaacacggccatttgaatgcgcaagcggtttcagcttttcaatcagaaatttgtggtcttgggaaacgcgaaagtacagctcattgaatgcctaagttttattttttttttaattatttatttttttgaaatttttaattactttttgtaaatgaaccgctttcgtaaaaagtcggcgcgggattggtgacgggaacagtgtaaatgacaaaaatttggcggcatcttttctaaaatattt

SEQ ID NO: 13096 - DNA, 1615 bp, Heterodera glycines
gatttgctggtttcgtagttgttttcaaaatgaatcgatattttgcaggagagcgctgacataagagatacattaaatattaggggtagtgtatactcgaaaagtcttggatttttgtatatctcgttctcgggttttcagtctcgtttttcgagaacgagacttttacatctttaatgattggctctttgttaatagcaaaaatatttccacttaaagcctcggggtcaactcacggtctctagtctcggggtcagtttcggtatcgactctcgggactttgggtcttgaacaatagtagagcaatccaactctatgaacgaagtccaggaggttgagagggacggatcggaggcgaaaatttatagccccctttttgctgacaaaaatattcaaattttctttgactaacttttgtctgcgacaattttgtttttgggttcattggagagttaatagctaatctctttttttgggggctgacaaaggagaggtacccaagtgaccatgggacttccgaatgaaactttcagggtaggtagattacccccccctttgtattataaatttttttttatttttgctaaatgaagcttctggccgagatatgaagcttttcctttttgccttttcaatatcattttcaaagaatgtaaagccaatgtgagcgtcggtggcctggtggttgtgccttccatacttttttcttcttctaaagttcaattccccaaccctgtaaataattattttgtttttttttcatatccaaattagtttttaagctttttaatattaataaatttgaacataatatttttttcatttttattttatatgagagaataatttgtctattgacctattttgcttatcagtaagtgttgaaaaattctgtcgttgctactcttctcggtcctctcatctactctcgtcgcattaataatcattgtaaaaatacttcccaaataaatgccaataaatccaacaaacgttattcttttattgcaagaacattatcatggtaaagctccccctcccacccaattaacaccagaggaaaagctgctggcaaaggattttttgaacacattggaattttgtgcaaaacaagggtcagaaattgagactttggaagaccttattgtggatgaattggccgtttttgatcaaaaagaagatcagcaagattttgacgaggaatttgaccttgaagatgatgaaagtgaagatagtgaagggagtttttcctctccagcaagtacagtatgcctttttttcttggatagtttttgcattagagtcatcttcatcgagttatgcgccctccccaaagaaattgtgttccccgcatgttggatttgccgagaaaatcagtgccctacgacatttccgtggcactgaaaacaacataacagcaattgccggccgttcccacattatgacaaaagaaatggctaaattttttgttgacaattttttactgaaagtgatcggcaacaaaaaagctgtagtgttgcttgactcatggcctcaatggaaaacggccattggtggagcagcaccaacaggtccatcatcatcaactgactttgccagggacaacatatgtctcgag

SEQ ID NO: 13097 - DNA, 923 bp, Heterodera glycines
tttgattatttgtgttaagttttcccatccattttactcttcatcctccccctttccccactaataattggctaattgtttttctgactaattgcccttactaatgcaattgcgtctctgtccgatagaatttcggacagtgttctcatgcccagcatatttctcatcgtcgtttgtgccaaaagtcgcgtcgaatggtgcgcattttcaacgttcgccacacttttggaatttgtttgttcaaattgcctccgtttcgttcatttgtccgctaattgcttcttaccttatcgtcgcgttcaaaattcggtagtaaacgacggcgtccaccgaaacagtgacagaatccctaaaatggcacaacgaaatgccaaacattgttttggtcgatgcctcgtcagaatttcttgtggtgggacactgaatgagacggtccgaaggtcgacacgtacaaacgactcaatgcacggcatcacccagaaaagacctttggggcaatggcagcaatttccgtgcatttaatttggcatccaacgctttgccaattccgatcacttccaattgcttacccggccctttggcgcctccgccgatcagtcgccccaatcgaaagatcacagctcgttcgtactccttgactatctgtcaattaatcgcttatttgcaaatggaaattaaaccgaaaatccccggaattgaaaatgttttaaaaggtgccgaaaaagagcggtggcaaaaaacagaacattagatgtcaacaaaaggccatttattggatttgattttgagttccaactttaatgcaaaagcacacggagacggggaaagtgaacagaaggagaagccaagagagaagccaaaacatccattggcacaccatgctggaagtgtcgtcgaaatcggctgcaaaggggggggggggg

SEQ ID NO: 13098 - DNA, 1962 bp, Heterodera glycines
  misc_feature (27)..(27): n is a, c, g, or t
tcattgagacaatgggaattaaaattntcgagaaaaagaaaaccttacgtccgcccgtgggcattgatcgattctttcgaggggtgtccatgtccttgccacttttgacaacactttgtcaatcatccgccatttcgttttgacaattcccctcataaatgtcattcttccgcccactgcctcactttagcaaatatcaatgggttcagcgtgaaacggcgtcccattcgcggccgaccgccggattggctgggccgcggtgtgttcagtgccgaaccgctgataataatcggaatggcaccgcccccggccaactcggggccgagcattgcgacagccgccgcttccttaaagagaaataactatgacttaccaactcgattgatcagatttaatctcagaaaacttttctccttttcctctctgtcttggattatcttttcaatatcaattaatctttcccctgctcctatttaatcactcttccgatcatgcccactttgtctctctctctctctttctctctttgagctctttgatcactcttttatctctcccactctctccgatcacctcccccctctctctctttctctctttgacctctatgatcacttttctcatctcgctcactctctctgaacagtgatcactctttcccttcctctctcgcgttttctctccctctttgtcaccctctcttttcccctgatcacttcgcccttctcgtgcacttcccacatttacgtgctgttgctgctgctggtaaaacatcagcggtgccgtctcttcgccctcttccgcgtattccttcgtttttgcgcggtactgagacggccttttgctggcaaatggagaggaggagggagcagagagtgattcggaaatggaggtggagggcgaggaacagctggacaatgggccaatcgcagcagagtcggagagggagggacgggcgactgaggactgtactgaaatggacggacggggggaagtgaacggaattggaaaaaaggaactaaaagtgaccggaggaagaaatgatcaggagtgatcggaattggaaaagtaagaaagtaagtgaccagaggaagaaatgatcaggagtgatcggaattggaaaagtaagaaagtaagtgaccagaggaagaaatgatcgaaaaagtgaccgaggaggaaaaaaagtgacagaaatggaaaagggattttatgtgaattgtaagaaaagaaaaagaaaaaatggcgatttgtcgtttgcatcattaactaactcattaaatcctcaaaaagttctgccgctttttctgccgtctcaattagtgcccttcccaaaatttgagagccccttacgctgtgccacccgtcgcccttaccgccctcagggaaatgcccccggtaaaaaagtgcggcggaacggctctgcctgatgagcacgggtccgtggctcgtgccgacgatgcggagtgggcctgctgctccctccgcttcttggccacggagtgggtccattttcgagtggtccttttttgttgccccaagtcggtggtcggttttccgtgctcggcagtgagtttaagtaaaagatgggtgcacgccgggcttttccgggaaggacgggggcattttgataaagtctttcggcaatttcgccgtccattggatgcacttttctctcggccaagtccgtccttctgccgtaggtcccattctcacaaacagagggggtggggaagggggtgccgttccagctgcccccggggggggggggacggacttggcaaggcaaagcgttggaccccgcggaccatcggcggatacagatacagacggagtgtttggtagagacacactagagaaggcatatgttggtaccaagtttgcggtcaaatccccaagagaaaaaagagatatccattttttcggcaagaattattttcgtttgcatttcaaatatcatgtgag

SEQ ID NO: 13099 - DNA, 1660 bp, Heterodera glycines
  misc_feature (1632)..(1633): n is a, c, g, or t
taacgggtaggttaacccttacctcgttcttttggcacgggcccggatggaaataacaaacaaataataaattgggatggatttgtttttgttttcatcgcttttgctttgcctctgttttctgtttgtgtttattggggcggggtggacggaattttccgaaaaccaaaaatctcttcgccacgggcaaataaaaaggccaaaggcgcacaaaaacgacaacaacgcaaagctgcgctttctttttcactttattcattcgttttgattttctttccttttttgcctctcaaatttaaccgattaaaattgcattttttagttttaactaaaattttatcgaaaccgttaattcgcaacgacaaaatgccggcccaatcgccattctttctttggtggctttgtatccgcctgaatttatgaattggcattttaggatgaatgagaacagggagagattctacgagccgggaatgactcaagcggacgtggcgaaggccgcaggtcgccattttaccgttacagaattattatgctgtacagtagcccagaaaaaggaaggcaaaaaccatttattttagtcttaattcttggttccaattcctttataaatcgttttttgggttaacaaatgccatttcgggagggttgcactgggcgtattttcctcaaatagtaaaacattttccaggcgaggaatggcgccgtttgcccgagtcagagaaggccaagtggggacagagatcggcggaggaacgaggacgtcaaggggggcaaggcgagagaagaaaagggcacggatttgggatgattaaaactgtgccattttcagatgtggaggaagaggagcagtaaaacggagaacaaagggagtgaggggggaaaacaaagagaaaacgaaaggaagaaaaccccctttgatccatttaatttgatggcactccaacacattctcatgggcatttcagcctttcttcttaaagaagaccgaaaaataaagcaataaagtcggaaaaaagtttattcggttttttaattcgcaatttttaacaaaaagaaaaaaaattagggattgtaaagcagcacagatattaacgttgtcccaaggctctgtttccgatttacatacaaaagtaaaacaaagaatatttatggaagtaaagaaaatttcctttttaatatttaaaaaatgaattttgaaaatatggaacaaattttccacgtgtatttggctacgcctttttgcagaagcgatgagtgataagggagggggaaatacaaagttgaactccatctcttcatccatccgaaattacaaacaaattatggttagtttgttggatgggcaacaaaattgaaaattcgaaatgtcttacggtgtctattctccccgtttccattatgttttggtcatttggctggtgatgatgtgccgtcttccgtgctttttgtcgccttcgcaatggacgcttcggcgccgaattccttcacgcacagatggcaactccaatccgtctcgggtgcttctttcagcgggggcttcaagcagtacaaatggaagccacggtcgcagtcgtcactttagaaggagaataaaagggaagaaatgcggaattttaccagaataaaagnnttggtcatcattttcggagttccacaa

SEQ ID NO: 13100 - DNA, 2903 bp, Heterodera glycines
  misc_feature (2728)..(2728): n is a, c, g, or t
  misc_feature (2797)..(2797): n is a, c, g, or t
tattaataaaattcattgaaaacgctttaaaaaatttccccggcggtgccgccgcaaaaagcgggtgaaaactaaaaataagcggccgcaaattggctcaaaattgcaaaaatagtcttttttgtaaaattccgttaacaaattgaactttaattgccaaaattttccccggcggcgcctatcggcgtttaaaaaatgatttttttgaaaactaataaaaaatataattataatcgtcgaaaaattctgcaaatatctaaagaagatttttaaaaataataatatttgaaacctttataaaaaacgtactttgatttgacggtcacgtagacaagtgacgcatttagcgcaattccgaaaaagcaaatcagcgtaattatcccactaattgcaacttcgaccgacacaaaaccagcctcatcctttgaataaatgaatagtgaatgaaaagattattaattttggcacagcttttattattattgttacctgttgatcagttacatttgatgacataaataattattaatttaattcctcaaaaaataagtgattcattaaaaataatgttactggttgtataaatgtgagaaaaaaaattcgaaactttcctcataattttttcaatggcatttcattataagaaggatttatttctctgatatatgtgaaaacgggcgcattagcttcattcataaatttttgttgaatttatgcttcattggtttttctagccttttattaattaggcaatcaaaatggttcattaggaaagatctggtgcacattttaatttgttttcaaaaggcattaaaagcgcagtaacgttaaaaaagtaacatacagaataaacaaatattcaaaatttgtgttatagagacaaatgaaacaaataaaaatatttatagatataacgtcataaattttttctgttttattttatttaaatttttttttttttgatattggtaataaattagcgccatgaacagtcggttctgtaactgggttaaagcgcttcgcgcttttggagcttcgctacctagatccattaggtcgaattgtctaaaatttaaaatgtaatacagacccatcacggcatcagacgggcgcttcgcgcccgtttctaaatttttcataaaattttaaaagcctttggcaaaaattttaatttattttttttaattaaaaatcgttaaaaatatatatgaaatatacccaatttaaacacattataatttggtaaggtgtcagttgtagaggctaaccaacagttgccagtggagaacactcactggatgcatggtgccaaattattatatttattttgcaaaaaatctataattttagggaccattttgcataccaaaaaatgtttagtttttttattgtcaaattactgtttttcctctcaacttttccttccttccaattcccaaaaaaataattttttcttggtcctaccccattcttacgagtgcttaaaaatctcgtttctcgtgataagtatttttatttaattttttctattttatcaaaacttagcatatattcattaaattaagttaaaaattcgaatatcattcaagtttcccagctaaatgctttatttaccttaatttccttttttatctttgataaatttgatgaaattacattgatttattgggaagtaattaattgggtgaaagcaaaatattaaaaaatagccaaaaaacttctgcgacttttaactggcctttctagcaccgcgcgccataagtgtttaaatttaattcacattgagaaaaagataaaaccaaaaatgacgaagccgaatgcggatcttcttgggagcaaaaatatttaaaaaacataaaaaacttttacctccacttccatcatttacaaatcgtcttaataagtcttatgtgcaattcaatgaaagttgctctatgaaagggatttgcacttggatactggataccgcatcgataacagaatgaatgcaattgctcccgatcatccctaatgcaattgtttttctttcagttgcattcgaaattgaattttattattacggtaaaaatttaatttaatttaactgctattagttcagcccagcaaaagttgttatttatttaaaagtaaatcaaaccaaaaatcaaatgggtaatttctgaaaaataaattaaattaatcattgattacaccctaaagaacgagttttttaagaaaataaaagaaaatgataaaatttcaatattatatggtcttacaattagctaattgctaactgtggctctcttttcggtttttgatttgttgtgattagagaccggaaatttcaaatttgtggatcccgctgcgggattggaactcaaaattcaattacttttatggctttttggaatatatatatttttacattttattttggtcatttgcatattataccatgatgcaaaaaagaattcattttaaatgacctatttaccaaactcacgcttaattaattagtaaaaggaaaaacatttaccataatggccaaccaaatcaccgtaaatgcccaactattgcatctcacgtaaatgtctacgtaaacagtcgcacatatgccctccacaatcagcacatggccaacaatgttgatgaatgcaggataggaattgtcggaatgagtgtgccaagttccaaaatgccatggcataagcaacgaaaatgaaagtgccgctgatttcggtgccgntttgagatgtttcaaccattttcatgaaaattttgtttaaaggaaaattcaaacactaacaaaagctanatataaaataaaataaaatattgccattcggacggaatatttggtttgcaactgtcatttaagctaattttgttagcttttttcgtcgcaaacgcaaataaaatta

SEQ ID NO: 13101 - DNA, 1734 bp, Heterodera glycines
aattcaaaataaaaatcattatttatttacatgcaaaatttaaaaataatgaattggtgaattcttttttttgtgaaataaataaaaattggcagagaacccatttattcacttttaaagcattgaaaaaagaaaaaatactaaaagtgttagagcagcatgtgcaaatctttttaatctgtgtgaaccacaactcatttttggaattgaataaatagcccttcccccctcctctctttttttaattattttcttattcaaataagaagcagctgaaaaaatggttgcttaattaataataattatattttttctatttttagtaaaatacaacacattttctacgaatatgaaccagttaatgagattatcaatgatcaacaagcactttagttctattttcggtaaatttttagctatttttgtcaaaaagtattatttatgttccacatatataaaaaaacacataaaattggataactattataaaagcccaaaatttagaagtataataaaaacaaatatttttctggtgtttacatttattatttttcattcctttcatcaatttcttacagaaatcaaataatttaataaaattagaaatatttcaaataatacttattaagtttatttgaaatttgccgagaaaatttattatattttatttgctttgtgcagaaaagaccaaacaaacaatcttaatttacacttaggcttaaataattcatataaaatatttattttacttcactgatttaaatttgactttctcaaaggagcataaaaaagcattgttttaattttcaatttcaattttttttaaaaatttcggaaggccaattagtgaacgaattcaacaagaaaatcaggacaaagaagcgtactttaaacaattgacctcagcttggggcgacagagcatgaacatgtaatttgaatttttaaagaaacccaagaagatatcatcaaaattgtacagaatgaaatttgattttcttatcgaaaattaatataatttgacatattttttgttcaaatattaatattgatcataattaaataatgaatgattaatattataatattaacaattaagataatgattataccgttcatacaataagaaaacttgggccagatgtaagttaccgtatcattttttattttctgtaatctcttttgccataagttgtgttattttctatgtataaatgggtgccgtaaagcatgcaaatgtgattgtgcaacagaatggccgaaaagccggcaattgtcacaccgaatgagtcactcgctgccacaattgacagactgaactcgcgcagttctttgggggcctaaaaatattcataaaaaaataattaagaatttacattatacaaattcgcataatgccataaaatataaagtcattcctctaatttaaaatgattttttttttgtatagtttagtaaatatttaattgtctctgtttaaaaataatttttatttttaattaaaattaaaaaaatatattttatttaaatatatttttaccgttttgtgaattctgtcgaatgtgttgacatatgaggcacctccaaaaaggccttcagcaaaaatcacagtgaacataacgccaaatgtgcggaatgtaatggaacagcgattggaaataaaaaaccagaatatttccgcactaaaaatgagcaaataattgaattatccctcattaacctaattattattttt

SEQ ID NO: 13102 - DNA, 2523 bp, Heterodera glycines
ttatccttttttattgcgaaatattgattatgacagcacattttaaataaaaattatttatataattttttgtaaaattgagtgtcagcagaatgaaaaatcacaaatgaaaaagaaaatttggatttagtataatataaataaaaattcggatatgggaaaaaaataaatcattaagcagtttggtcaattaaatgaccaattaaaaataaaattaattacaaaaagacattgatgaaaacgaatgaaaggtcgaaaaaaaacatttggacacaaatatcataaacatttattattggaagaaggaaataaaaaatggaaaatcggtggaaaaatgaaaattgctgatcaaaaaagataaaatgtcaaattattattttttaaaataatttacctttttgtgaatcttgtcgaatgtgttcacatatgaggcacctccgagcagaccttcgacaaaaatcacaatgaacacaatgccaatgtgcggaatgtaattgaacagcgattggaaataaaagatcagaatattcccgcactaaaaatgaacaaataatttaattaccctaattagcttaattattattgattgcctggagtacagcaagcagataaagtacataagtgggcagtgcaagcacagtaaccgatgatcgggagatgaacacgcccagctggtaaagtgtttggtaccaacggaattgactggcctcactgagtccgaacccatgggcacagtcgaaatgcagcaattgatgctttaaataatttaaatcaattaatttattttcaaaattaaacaaataattgcttttttgcttaaaaaatatttttggaaaacacttaaaagaattcaattttattataagctaaaattaatttagtaaatgtgaaatcaaacttacaagcccagagttgatcagatattcagcaaaatacacaattcccaatgggaccatcagatgaagcaaaagctaaatgaatttaataattttttatttttttgttattcaaacggacaataatttgacgcattttggaaccaaagttcagttcacttgtaactttcacacttccatcagagatttcgctattattcatctataaaattttaacattaaaaaaatttaaattaaattctgaatgtttttttttctttttacttgtataatccacgttgatgggtttaataattttgttctgtgaacagttggtgaaggagtcagaagcccccaataactaaattttttaaataaaatgaatttcaaaaaaaaattagagtacttccccgaccaattcgtggtaatgagttttcctaattaaccgaaatatttaatattttcttcaacatttttctttctttatcaccccgcaaagacagccaaataaaattttaagatattaaactaaattaaatttttatttttaaaattcaataactgacgcaattgcaaaaatgattggcacaattagcatggaaagtagggcatttcgtggtgacaatccgaacaattttggctctgtaagtgcagcgtatgccactgagccaacaattccggcaccgcccgtgccggatgaccatgccgaaattgttgatctaataatcattaattaattaaacatcataaattcatgaattttacccatatgaatttttttaccgtttgtaatgagatgagagggccagcaagcaattttcgcccaaaccattgcctaatgatgcaaaaataatgccaattaatgacagtgtgaatgattgggaaaatgccacaatgacaaagctgagtgcctgcattatgcacacaagtaaatgtcgaaaactaataaataaattaattaattagcgttagagttaataaattaatgattgataaaaataaaattataaacccaaatggcactcggtcaataataaagggagaaaacaatttgatgataagtgatggaatgatgtcagccaataaaattgcgccagttgatgtgatatgacaacgtggttttggtaaaactggctaaaactcgcatttttttagaaataaaaatatattgtttattgattaaaataaagtattgtcaaaaaaaacattaaaaatattatttaaaatattattgttgctttttttgaattttacctataaatgcttaagattaatattattaatgaatcattaattaattaaaatccctacctaggcacctttcattagtaaaatttcatcactctgatctcttctaaatgaatcagacctcaaaattttatttattaaaagagcagaatattagctaatcataaaattatgttctcattctctgattctttaattagagtgatgaaaatttttaaaaagcatttagtacaatggtttctatttttgtaaattagttatcataaatcatacttgtttatttaaattatatcattaattaatgaagaaaatttaagctaacttttttttaatgattgattttcttacgtaacaaaaaattgcagaagtcgaattttgcgttagattttgatcccatttg

SEQ ID NO: 13103 - DNA, 3294 bp, Heterodera glycines
  misc_feature (9)..(9): n is a, c, g, or t
  misc_feature (45)..(45): n is a, c, g, or t
  misc_feature (54)..(54): n is a, c, g, or t
  misc_feature (56)..(56): n is a, c, g, or t
  misc_feature (61)..(62): n is a, c, g, or t
  misc_feature (64)..(64): n is a, c, g, or t
  misc_feature (66)..(67): n is a, c, g, or t
  misc_feature (69)..(69): n is a, c, g, or t
  misc_feature (74)..(75): n is a, c, g, or t
tttattttnttgggatttttcttacctttaagtcttactcactanggtttaaanantttgnnantnnanttttnntttatttttatttaggaatcggaagatgctgagcttgaatttttgcgaaaagcaaaattggcagatgcagggactgcaacagcgggaatttaaaccatcggagtttttaccgaataccttttccgatgacatcggatcaaacaacagtggattttacgaattgaaggtactttttaaacatttgtttttataccgttatacccatttataaatatataaaggtaaatgaaattttaaataattttgggcacttaacatctttttgggagagatgatgggaaaacaaaggtggatcttttacttatagtttcaaaattttttaaaaataatgttcagtttggtgtaagtttttattttgattggtcaatacaattgtcagattcaacaaatataacacgttttatatttaagtgtctgataactcatcagggacgttcaagcaattcgggtcattatgtcgcgtgggttagggttggagatgacgaccaaaaaccgaacactaccaaatgggtggtctgcgatgacaataatatttcgccagtgtctgaggaggaaattctgaaattgtctggcggcggagattggcattgtaatgacatggaactgattgctttctcacattcacacactttaaggtgcttatgttcttatctacggacccaaaaagattccgaagctttgagagccgaaagacgagtaaaatttgatgttgattgacactattcaagaatttcgacagtgtttttaccaagataaatttgtttattttgagtacactgttgtttttaatgtatattgttaattcgctagaatacatttgatgaaatgcttttagttttctttttctttagcattatgacaataatccgtgattttttgtgccgttcgtcgtaccaatcgttggctcatttgtgccgtaatcaaattcgcgtttattctgtagaaagggagggggcgggcacggcttcgggcattgaacacgcgctcaaattcaacaaagcgggagcagtgcacaaaaaagagttgaaggattacaaatgcgtcgaatatcttcaccaaaataattattccttttatgacaaggaggtgggaaaattacaaaaaatataacggtcaaaatatactaacttaagccttcattgaaaaaaaatacatattcgggttcgaaataatttaatgccatattcatgatcagcgctctctaaaacccttaaagcatcacaaaactgctcaaaaccccctttttgtctctttttgtgggaagtaaagccgatgattaccaaaatgacataaattcctttttaagtgtgagctgcagcaatttcgcgtggtgcaaccgacgaacaaattgcctgacaccgaaccgaagttcaaatcatcttaaaccgattgatttcatgaaaaattttgttttttaattaggaaaataaaataaaactaaaggcaaaattgagagattgttcaattaaacagttaatttaacaaatattttatttttaatatatttttgttagttaaaattttaattacacttgtataatccaactcaaaagatgacgcagaaggaattgaccgccgaattaattgaacaatgggggagggagccgaacgcccatcagaagttgctttttctgaatgaaatgacacagtcatttccgaatggcactttcccactcattggcattgaccgtaaaaaggtgggtaattcgaccggggggcattcgctggtccgatgtttccgtttataatgcgcttttctttcagttgtttttgtcccatctcttcgacacttgggctttggcctctgagcaaattcgtcttcaacaattacactttcttcggattattttgcgcgacaaaaacactgttgatttggactgttacatttccattttaacacttttaagtcgcctggcaaaactatcggctgattattttgaagaatgcaaaagtgaacctatagaaagtaggctttttatttttgtttcccattcaatttcaattttgagttgtgttggagtctgagaaatgtcttatcaatttgctattcaattctgcaaaggctcgagactttttttgcacacagtgagttttctttcaatttgtaacgaattcgtttattttgtgggtttttgaaaaaattggttccctttttgtggttatttacagaaagaaaccgtttgaccgattgatgtcgcgcattcgttctgtcattgccgttttcgacgggtcgaattcgttgtttgttggtttcgactatttgtccgaatggtcattcgttcaagtggaggaattgctgctttatgatttgaaaatagcgttcataacaacggcattagtccaacaacttcgggtggataattcacattgaatgagcttaattgaggccctttcatttttagaatgaatgcgtaaatgacacagacaaaacggtggtttttctcagtgttatcatttgttcgttggacaaaatgtcaccaccaatggccaccaaatgcgtgaatgaggcactgaatacgttgtttaatgtttaccatgacagcaaagtgttcgaattggtcggttcgtttgttggaaattccggaatgattttttattaaaggaaactgcaaaaaaatgtgccgatgaatgcgcgcgaattgtgaagagtgcacatttggacttgggaacaaagcaaaatgcagtcaatttactctcagttttgacttccgctttgccctcgctgtgtccgaaggtttttattttagtttttttttaatttatttttttaaggtcgacacaaaaggagcgtacgaaggatttgctgcaaaggatggatacgacataagttttttagactcctttttgtccgtttttgagcaacaaattgacaatgtatttgttttaaatggtagccgaattaaaaccaattgttaaagtatgagaagaaacaaatcattgccgagtttttgggcactcatctcaccgttctctgccatctctgctcagagcacaaaacagcgaggcgattttgccgggaaaaggttggaattggccaaggcatagcaagaggtcaattgaaagggtgcacttggaaaccccataatgagttcctattttgaaattaaaaaagttggcatacaacaatttagctgaaacgctgtttttggatattcatcgtgcatttagttgacatttttaaattaaaataaatgtggggcctccaaacggaaaagtacc

SEQ ID NO: 13104 - DNA, 3536 bp, Heterodera glycines
tgttgaaccctttcctcattgaattattgaaattatgttattagtttgcgagttgtccatgaccgattaatcaattgaaacgcattcttccccctcccccaagggcaagtttatttcggatgggctcctccaaagagaacgatggactttccgttgccggccgtgcaaaagcggccaatcgcctcgaagtaactgatgcggccaccagacaaaaactgaaacggcacaatctgaggtgggaaatggggggggggcacccaaggatgagtgccattgatgctttgttctttaaatggtgcttttggcattattttcctctcctctcttcagatacactgatctccgtaagtcccttctcttttccctgccattttctgttgatcgtttgactgtcagagctcacccggtcgcttttggttgtcaccacagtgttcattgtcctcaaccttcctaattatgtctatcgcatttccatccaatttttcgttatcagtgaacaggtaaattagtcaaatggcacccaaatgatggaatgtcaaattaccgaggccagcaaatatttcgggactctcgagttcgttaacacttcgtcctttcagatcaacttgagttttgccgcccacgtgctgttgtacacacaccacgccatccttttttacatttacattttcaacagcccacaagtcgttggaatgctaatggtttttgacaatttgtcccaacttttgctcagatgcgcaaaaggcttattccgacggcacttaaactgttggagtgttactgtttgaagccgcggcacctcaacgatttttcggacaatttgttccaatgaatatttatttatttattttggtccattcatttgttgttgttcttccttccgttcgcttcttcgttttgttgaaagtgtcctttacaaaaaatcattccattggcagaaaaaatgaacggatcgccaacacagaaacttaaatgatttatcattaggcaaaatttgaaccaatgaatgagcccaccggccattgcattcggcgcacgcgaaacattgcaagtggaaaacgcactttttgaaagtgtgaccgcggcaaacactgagcacccactcggacgagccgatttggccagcgcacaaatggcaaacaccgccacggccgaagagacggacatctgacaaatgagcaatcagcagaaagggtgacaaatgagcaaattgagagggcggtacaaatgagcaaacaaattcagcaaaatggggaaaggaaaactgacaatgccaagtgcacagacacagcccatctctgaagaagaaatggtcattctgctgatcaacaagacgacattcgcagcaaacgcacttcaatttttgcaaaaatgacccaatcaattgcttcctttttctgtcggtctttaccctgaggcattcttcgtgccaataacggcttatcgcataaaggcaccaatttccagcaattggattttcacattcagcacaaaaaatcatttttaaaaagggatacctaaaaaatgttatcgccaatattgagtcgaatggtcctttttaatcttgctgtcagagaatgtgcgaatttagaaatctagctcaattctcttggtgccgatgggcttatcaattttttcggtctgggaattaaacaaggacatggtttccgaacactgctgtattaagttcaagcaaaacatgcaataaaaaagtacaaattgactaatcttcagcaaattaaacgaacccaaaatgagttcgaatttaaaccaaaatcagggactgtctcatattgagggagggggggggggggggtgtattcgggcacagtccacctagttctgggaccgtccctcaatgccatttaatctcaaccaactaccaagtccaaagagcgtgacgaatggagtttgacaattgtccgtatgattgtaaatcattaaaaagaaaaagtaaatttttaatttgcattctatggagccagttgaccccaaccggagtccctccccattgtcaatcatcgaatagataacaatctcattaaatgccaaaaaataaaactaacaaagatttcccacgggaatggttcttttccaattaatttcaacaaaaacaacaacatttttcgatcatttaaaggtctttcagccacaaaatcccctcgttcattcggcctttcctttgcgcactgtcgctggtttggccttggttttttgcgagcggaggatttgcgaggcgcgtcgctgcgccagcttcgcgtgcgacggtttgtaggcggtcaccgcatttccgacggcagagatcacccggcgactgtctcttgtcaacgctgtgctggcaactgcctgtttgatgttaaacgcaataagacacgtccaatcaatgactagagccaacaataaaccggaaaagtaaattcagcctcacctgcaatggtttcgccacatttttgtgcttctttacactcataaccactcctttgccgtccttcgcagcagaaatgtccaccgcctttttgttgatcattccgttgtgtcgaatgctgttcagacgcgccatgttgaacggctcggtgctgaagtgtttcgggatgccacgctgacgtttgaggaaggcactgtttttgcggatgacttgccactgaaaaaacaaatgataaagcacaaaacaagctgtgtaccgttccttacctgaatgtagctggaggcgttgttgtagtaaaccatttgaatgtctacaatatttcagcacaaaaataattaattatattttaaaaggaaaatattttaaaaatagtaataagaaaaaactttcttaaaacaaaagtccattttgccgcataatttaaaaggaaacaaaataaaataaagcatttggagacaatacataataattattgagcgtttgcatcacttctgttcgtaaatcctatggttcaaaattgcggcacggagaaggatggcattaatcctgtggtcaaactgcttgcgcaatgccataatccttaaaaaaataaataatttaaaaaatgacaaaaatgcgcaccgatcataagtatcggtgcgattgtcagagaatttggcatgaagcactttgttataggaatcaatctttgccttcagttgaccacgctcgataagagtgaccaattccgactccatctaaaaaataggagaaaattcaaatcaaattataaaaatattgcctgttctgcagtcgtcctaaattcaactgccatttgagcgatatcagccgtgaaatatgagtcaaaatattgaatgatggcactttggcgaatagaaatgtaaaggacgttgatgtgaggtgccaaataaatattgagtagaagctaaagaatgaaaaatgaaactaaaagcgaacaaatatgttaaaactcctttttctgttaacaacctggtcacgcaattcgtggagaatgtccaaacaaacgccgaactgacttttacagaatttttgtaataattcgatcagctttggttccgattcgagagatttcctaaacaagttcgatcca

SEQ ID NO: 13105 - DNA, 2626 bp, Heterodera glycines
ttttttataattagccaaaaaccgaccctaagcccaagttgtaacgaaaaatctgtccaaattttaaataaaatttaaaaaacttccacggcggcgtattgtccatcactagtcgtaaatatatcgttttatttaaaattcaaatatttaaccaaaaaagaaaaaattacctcggcaatttaatcgggtttcctatcgagcgccgattgaggaaatgtgggatcaaataaattaaagctcgcttctttcatattttccggacataaatttatcaaattcaataaaattatcaggccataacttaaaagaacaaaatgttgtaatgaaaaatttggactcaaattttgaaaattatgtgggccactcatatctcaaatatctcagaaatttttgaatttttctcaaattttttgtttctccttagaatttatctccaaattttcaaagttttccccgtacaactcgtcattagccaagtctaatcttttctcggttatttgcattgacatgctgtccctgttgatgaaatgtccgtccctttgcgcaaatttaccgtcttttttggtgcgtttccctcgcacaatgtgttcacaaaattgaaaacaaaatccaagcaatttgctttttgctcatgataattttcgctggaccaaaagcgttcacacatttcgaaaaatattttctccattttttcaggtgtcacaaaaagtcgtccgttgtctttgaacggttgggccttcgtttcgtctgatgcatccaatgttttgtcaatgtcatgacgactttttaattaaattaatttttatttttttaataaaattaatttatttttaatgtattttcttataaatggaatgtgcttcaggttaaaatgggagaagcctaaaaaaatcgaacatcattcggcggctgtggggtaatgacttgtcgagtctctgtctcgacttgataagtctcgggttttttgtttctgatcgacttcgaggtcaagtatcggtcttgagtctagccgaatttttcggtttcgaatatccccattgggtggatgtaacaaaaaggaaataaatctcttggaggtgcctttttaaaaatttgaagcttcttcgggggtatatatattttttgtaatgcctcaaaatccgggccaaacatttttgaaaaattactaaaaattgattggaaccgaggatgagaatttgcatttttatttatcattaataatttcttacaattttctgcgtcgtgtatgtgccacttgcaaatcgaattcttaattattattttttatacaacgtaatcgtttaactgactttagtgtttcataaaccctaaatttactggaaagtgaaattaccgttgtataaaacaaattgtacagattttgacgcataaaatccgtctattaccctacagtatgtttttgttttgttttaccataatctcccgccgcgacatagacatgaattggttcattgcaaaaaatattgacacggattttgacttcaactggcacttttgaaaaggatggtttaatttgttcgggtttcttcactttcttcgacggtgttgctactgtattttcatcatctggtactgtagcattacttttgccagttgcccatggcggcgactttcgaatcattcccagacatgccgacaaacagcagaacacaagcatcaattttaattgccgctttaacatttcgatatttattatattttatgtaataaatgttaaataaaaaactaaaaagtgacgacggcaaattttttaaaaataatttatagctaataattatataatattttcaattgatatgcaaataaatcaatagaattggctggatatgaaagcagagtaaattatttttttgaaaaaaaaagaaattttatttaaatttgatagagaaaattatgaatgaagtaaatttaatattttttaagcaaacgtatgacgaattcaatgcaagcaaatacaatcaaatgctggacgcctacttatttatctcggcacaaagatgttaaatttgtgagaaactaaattgaagaaattcggcccaaattgtgatataattcacgaaaataattttggcactttgcctttgcaaatcgaaaaaataatgaaaatttggtcctaaacggaaaagtaccgaaagtcattcaaaactgcataattgggcggcggagagagtgggggggggggggggaggaaactgtttttgagctctgtgaagtcatcgcggactactgcaagacaggtacaatttttgaaaaaaaaacatgcaaaaataacaaaaaaaattgaagatgtccaaatcctggcccatggtatggtaaagatgcggcagctgttcttgtccgagactcggcatgacatcacggattccgccaccatcccgtccggctgtatgaagtattgggtgcagttggctccccacgacaaagaacgggttgccatcatccccacacttgggatacgagaagcgaggcaaacagagctccatcccccggaaatatttgaaggtgtatccaaattatttttaattttacattttgtcgactctcagtggcgtgcccaaaaaaacttgcgagagaatgccctagtcctgcgccatgtccaaagccc

SEQ ID NO: 13106 - DNA, 1553 bp, Heterodera glycines
cgttcgtttctcccttcccctctttccccactgtccgatcggtctttgatcgcatttgaactgatcccaatcagtgacggatcaccgctcgatcagccgatctctccgctcgttccgtctcgcgctgttcgcccattttagcggcaattcgccgaacaataaaagcatcccggcaaaatgcttcttctccgccgagcgctgcttactaattcattagctgcccccgggcgaatgtgtcgctataaaaggaggccatcaccgaacagtgccagcattcagttcacaaatcattttctaatcgagcttctttctcgaacaatttagcattaaatctccttttaatccgccctttcttttaaatttttgaaaaatatgccttaatgataatttattcattattcagaaattttttttaaaattatctttaatagaatttcttttatctattttttgtgtgctaaaatgaaaggattttcaggtaaaattctaaatttgattttgtgatgtctcgtatcgctctattggtccttttggtcgcgctgttctgcgcttgcgctttggtcgaccacgcatccgcgcagtattggggcggacgcggcggttggggcggaaggggtggcggatggggcggaaaccgctggggcggtggatggggcggaaaccgctggggcggtggatggggcggacgcggtggcggatggggaggccgaggtattttttttttgaaaattacagcaaatttctcacttaatcagaatttcggtggaatattaaaataattattaataaaataaatggttaaacaattcaaaacttcttaggatggggatggggacggcgctgaacggacgaaggacaatgtaaatgaatggactggttggatggcactaatcaaagaacaaatcgcacggatcggcaccgggggatcaatgattagtcctctgacaccaaagatcaatcttcgaatcccccttccacacctcataaattttctgtaatttatacatactgcacagaatttgatgcaaaataacattaaaataaatgataaattaaaaagaatgtgataagactaaaaagcaaagttgtgttaatttaacaggataaaaaatgttgaaaaaacatactgtaaaattgtaagccaccataagaaattaacgtttttgcaaatttgttggttaactcgcattttgaatcattaatggatcattatggtcatttttaacgtgattgtcttcctggtaatacggctctaattaattatttttgtggtgtctttagcagtgataattaaattaggatttgcttttcaaaaaatatttatgtatttttttcgggtcaagggcaaaagcattcggtgagtgcatcggtcagccgaacattccgccgcccattgccccccaagggctgccccctccgccgcccatcattggcgggccggcgccccaaccaccgcccattagcatcggctgtcccccgccgcccatcatgccccacattggacgattccaaccgcctaaaaatgggaaaattcgatttataaattaagggga

SEQ ID NO: 13107 - DNA, 1743 bp, Heterodera glycines
  misc_feature (17)..(17): n is a, c, g, or t
  misc_feature (27)..(27): n is a, c, g, or t
  misc_feature (73)..(73): n is a, c, g, or t
aattattggtttccttnttcagctttntgaaaattttgcaaatttatgcctatcgaatgacaaataaaatgtntaatttgaatgtatgagagaaaaatttttacaaaaaatttcctcgaataaatattatacccaaatcttgcagttttatgaaaaataaaggataaaactaaatatttcatgtacattgagtgagcatttcggtttatcagaataggagaaccccagtcgtaaccgggtgaatattaggactacctccccgaaacttgaaaatgaaaatttttaaaatgaatcgtccaatttgaaaatcgatcattttcgagccaaaattttgataaaaaatgcaaaattcacagttttttttaaagcagttatttgtcgaactgaaccaaagccaaaactcaccgccccaaccgcccattccaatcatcggattggtgcccatcattgaccattgggcaacagagcatttgagcgaaacggacagaagaacaatggccaacaaagtgtgaggaaacataattgaagagaagagattaattaattaagagaatgccaaaataagataaaacaataattggaaaatataaacataattatggaaaaaagaaaaacattggattaaagaatgttttaatgataaataaattacttaaatttaaattaaaaaaatgcaagtacagcctttgtagatatgtgagatatatgtgagataaaagctgatccatttgtgtatttctacagcacaaaagcgcagcggaagataaagcgcaaacatttcaaagcgccgaaatttgaatggctgtaaaaatgggcaaatgcgatgcttcttcagctcaagagagagtgctcttccagttgaaatttcctttttgggaaagcggataagcaacaaaatgaaatttgtgacgacggacgaatgaatgaatgaatgaatatgaatggtctgtgtttgttttgcttatgtgtaaacagcagaacaattaggtagttgcatttgcatattaaatatacttatttattgtaattagcattaagtgtacggctcgtaatgaattcaatcattttaatgggaaatgacctaaatgaaaaaatcttcaaaaatcaaaaatcgctttttatttatgttccaaattgatttttctccaaaaaataccaaatcaaaattcacattttttaaaagcacattttattatttacttctcttttcagcttatctaatcagccaaactttttaataatacaattaaatttttggaaataattctttgatttataaatataataaaatttaatttcatttttacttccggtttcatatttattttctcaacatttattctctcattcatcccataaagaccaccaaaaacgattaatttgcatcatttcccattaaaattgaatcgaactcttttcgttatgggtgttttattaaatgaatgtttaatggattgtagtgcttacaattagtgttttttaaataaatatagttattgcatataaatacgggccgtaaaactacaaaaagaaatttttgaaaataattcttttcgtttaaaagtttgtttatgtgagaagcaaatcttctctgtcttgcaccaaatttaaatttaataaaatttaatttccattcttacttccgcttaaatgttcattttctccacattattctctcattcgttgcatagaagaccataaataaaacgattagcttaaggtttgacaaataattattatacg

SEQ ID NO: 13108 - DNA, 3960 bp, Heterodera glycines
  misc_feature (15)..(16): n is a, c, g, or t
ttccgcgtttgcgtnntgaggtacgtgggtctcggtgagtctatgttgagagagcctcggaattggtctttctgcgacaatggcaaaatgtttgacttgtcgaaacgcatctgtcggcgcattttgcccggggatcggtgtccgttcaatggcgtttgccggtgggttaaataataattgctttcgctaattaaatggtcgttttgccattaattcaaaggggttgggagtggcgaatgagccccgtgggcgaatgtcgccgcgactttttgttttgcaacggcatccgtccgcaactgttccaatgcgagaaggagcaggaagtgttccgggacggcgagtgcaccgccgcgagttccgcttgcgacgtgtgccaaccgggggaaagcaaaaggtcgacagacaaatgcgaagaggtgggagcaaaaggcattgggtgcgaaatgatccgatttctcttactctctatcttttttcttcccccccccctccctcccctcctctctcaaattctctctctctctctctctctctctctctcttggctttgaagctgaatttttgttgtccgcttacctaatcacttggatcagtttttcttctgtgaacgggatgctagcacagggcgattccactggcggcagtacatttgcaccaatggccgagttttcaatccgcaaacgcgcgaatgcgtaccgcacggcacttaccattgcccaacacgaactttggtcctttttgtgttaattatgtaattaccatgctttaatcaccttttgttctttctctcagtgtcgagatggcgattcgtacaggtgatgactgatcagttgatggtcagaacaatttgatcactcactattcatttctcaacagtgtcgaatgtggcgactttttcgtgtgttccaatggtcgatttgtgccgggaaaatgccctgaaatgacccgctgggaaatggcccagcggcgttgtgtgtacgtcgtcattctgcgcttaaaatttcagtccgtccctttgctgctattttagcgcttcgcccgaatgtcgccgtttcaaagatttgccgtcaaaagcatttgtcggaggggccgaatgtctggacggacagacaaagccatcgatcgactgtaaaaagtttgaagagtgcgcggagggcaaatggacgacacggcactgccataactatgccagcagaaaactcaaaagtgtgccaaggatgaggacagaaaagcaaaagagagggaaacggggatatattgaccaattaacgggaaaagtgattaaatgatcagaaatgttggccagtcaaaaaagtgatcaatctcaaaatgatcagtccatccaacgctttcccttttccgttcttcgttaggtccgtgccgtttctgtccccaattgtcgtcctcaattgttggcactgaaattgaagcgaaaaagcaacagcggacggacatttacccgttggaacgccttttgcccgacaatttcaatccgttcgaaggccaaggcgttcgccaccgccgttgtgtggaaggcgaagtgtgcttttgcttcaattttcccggggaattggcattttccagaggattgtgaatcggcacgactgcgcccgcttcatggaatgcgttgacggcgattggttcagcctttcttgcccgcttggccactatttcagtttggaaaacgaaacttcaaaatttaatgaaattgaaaacccaggcccactaatccaaggctgtctgttggccagctcctcaaactcttcctcagcagcgattccaatgtgcaacgagcttctgactgtggcggagaaggccacttcgatcaccaccgaattgaaagacacaaattccaaaagcgattcagtgattatttttgattattttcagcgaatgaaaatgccaacaaaaaacaaacacaatttccctccccccacccgaaaagatgcattttttgccaattctttactcaaatggaggacaatcgccgatcggaccgggcgcggggccattgcctgagttgggggacaaggaaatacggcagaattatgtgggcgattgggaaggggccacggcatcgcaattaatccaagtcaatgacattcactcatcattccattcaggccggcgcattcagcttctgcgacgcgaacgcggccaaaagactgcccaatgcgtacgactgcacgcgtttccgcgagtgcgcgttgacaggggcggatatacgcggaaaagcaatgcgcacccggcacacaattcgacccgacatttgggcggtgcactttcaagtaacgaagtgccaaagcgaatttgaataaaattcgaattggtcagttattcttgcgcaccagcaaagtgcgtggaaggcattcaagaaggagggcaaaagtgtgggaacgcccggcaatgccagggcggggaatggcacgagttcatctgtgagcacggaatggcatttgtgggcggacgatgcagcgaccgcgtgcgttgccaaagcaaaagtgatcaatgggccaaggggaaataggaacaaattctgatcagacccaccgagcaatggccaatgtgccgagggacacacgcgggcacatggcagagactgctcaaagtatctgatgtgccgatttggccaatttgtggaggaaaactgcaacaacggacatcgcttcaacccaacagtcagtggacaaattgccgagataaaacgaaaagtcattggggtgggggagaaaaagccaagcaaagccatgggaaaaatgcgagcggtgaataaatcgcttatccaacggatttggaaagtgttcatctccctttacgttttgaagatcggccgttgcgatccgtccttcgcttgcccggaacatcaaaagccgccgtgttttgagggtcaaatgcgtgtcacggaaacgccgtccgccgcgccaacggccaaatgcacgacggaatatgagctgtgccgtgacggacgatttaagcgcatcagttgcccttacggagaacatttcgctggggggcgttgtgtcgcggggaattgcaacggtgggcaaagcggcagtggccaaggccaaaccgatcgaacggcgatgtgtaaggtgagaaggcatgtgctaattagtggcatttgccttgattatgcccaggaatcgcccggtccgcaaggctttcgatctgacagcaaaaattgtgccaagttttaccaatgtgccaatggaaaatgggtgccaaaggactgtgccaaaggcactgtgttcaatccggcattggccgtctgcgattggcctgccaatgtgccgggatgctaagaaatggcaaacggagaaaggaacagacgattttaaatcatcggcacaaagacaaaacgccaaaatttaaaaaataaataaattttgtctcaaatacaactaaaacaaagtttcaaagaaaaagtcagaacataacgtgggaattgagaaatggcgggagaagttgatgcacactcgggttggccaagttgtaagtgacccctccgccggaagtgccttaaaatgttgaaaatcaatttggatgcattttaaatgcaaatgaatgccgcaccaatggtaaaatgagtaaacttttttcaccatttttgcccattgtcaaaacacaccgcacggcaaacagccatagcacccgcacattggtggcacgccgacgcccatttgcccccctcccatcagcacttggttcatgttctgcgactgaccctgaaatggcaactccaactagtccaattcgttttttttcggcccaccatgttgtatccgactgtgctgcccatcaatgtgccgaccgtgccgagcagtgcgccgccgattgccgcgcccttccaaatgccgtgcccatggcttttcctctccttttgtttcgtcacgcgctgccttcgtcctgttcctcccccatgctcctcctcctcttcgtctgtttggcctttgtctttcg

SEQ ID NO: 13109 - DNA, 4027 bp, Heterodera glycines
aggagcaacaaaaagccttcggaaaaatcaaggaaatgttggcttcaaacgacatcctcgtgcatttcgaccttgaaaagcctctctttttggcaacagacgcgtcggattatggcattggagctgttttatttcataaggatgccaagactggaaaagttggagtcatcgcttatgcgtcaaaaacattaagctcatccgagcggaaatatgcgcaaattgaaaaggagggacgtggagtgattttcggcgtagaaaaattcaaccaatatttatacggccgaaagttcacactacagactgaccatgagccgctgaaacggatttttggacctaagggtcaaatgccagtcgttgctgcaaggcgtttacatcgttggagcttaattttgatgaactacgagttcgacatcgaatattgctcaacaactaactttggacacgccgatggattgtcacgactgccaacaccagaagtcgacaaaatttgcaaggagagcttcgacattggcgaaattcagaaggaatgccaaaatgctctgccaataacagcaaatggcatcgcaaaggagctcagaaaggacccaacgcttaaaatagtaaaaaatttcactgagcatgggtggccaacaaacaagcaaatcgatgccgaaattcgcccattttacgtggtgcacgacgaaattgagatccaaaacggatgtttgatgcttgggactcgaacaatcatcccagcaaaattccgtggagaaattttaaaattgatccatgagacacatccgggaatcgtgcgcatgaagtcgctggcgagacaaaaagtctggtggcccggcatcgacaaggacatcgaagcaattcgtaagaatgcaaaatttgccagaaaaatgctgcagaaatgaggaaagtgccgctgcacccttgggaagtgccagaagtgccttggcaaaggcttcacattgatttttgtggcccatttctcggcaaaatgtggttgatcgttgtggatgcaaagacgaaatggctggaagtcattatgatagcgaaaacatagacagaagcgaccatttcggcaattcgaattagtggggaggagatctcgtgtatgaggacttatttgatgggactcaaatgggcatttcatattttccctcttaatccccaactatcattgctgtctatttaaatgttgtctttccctccttctccccgcagtcttcccagtcattcttcatttattagcccatcctcagcgtccatcccctccttccgctcctggcccttctttggcgtgtagtgcgcgaatttgtcccggatatctcgatagatccgatccagcgatgcgcggctcgcggaatgcgagcgatcacgatcgatgacgcccacaatttggtcgacgatgtcgcgcctggcgctgcgttggagttcatccacccttttcttcggtcttcctctgtttggaggcgcataaattgaatgaaatgggttttttgaaatttaaatgaaaaatgaaggttttttaaaattaaaatgtgagagattttcactcacttttgctggtcgttggtggtgccatcggtggtaccatgtgctcgtccagctgccgacgcagatcactgatcagcgcttctcgattgcgcacctgcttgcgcagaaatttaatgtttttctctggcactctctatttattggtacacatctcgttttttcggacggtgtgttaatgtatcagggtcattaggattgcatgtaaaagtaacaaaaagaccgggttttccagttttattaacaattgccattgcggtccattagattcattaaatgttcatgcatatttcgtggcacatcagtatccaaaatgatatcctttttgaccacatggatacagtaatgatatgtcattggctctacaaatttatctagtgggtataaatctgttaattttttattcggttttcggataaacaataattctcgcagggggaatatcagcagttgaatcgcaaagcataaccgcataaacttcatttgtatgaagaagaatataacaacagtaaatctgtagcgacacttgtatcgataaaacaaggctgttgtgaacacgaaaatttacggcgattggaaatgacaaaaaaaaattatgaatttttccaaaaaaaaatgggtgttccaattactcttttttgataactcacaaatttcctagaaaccacacaaaatctgaaaaaattcatgtaagagtaactttttatgttaaacagaaaagtcagttgcgctgcgataatcagaacactccttcagagcggtctgagaaccagaaaaatggcttaaaaccggggatattttggaacaaattcctaggcggcttgagtgacacccattttttgagaaaatttcatattttttttgacattggcaaactccttaaatttcttgtacatgtttttctacataagcccattaattttccaaattacagctaaagctaatgaatcgatttggtgcccaatttcttcgtccattggcttaagttttgcctagggatttccaattcttcagcaattttcgtctcactcatcattggattactttttcttatttcctcacttcttttcacatattccaatttttcagcatccgagtaacgttttttttctcctaaaaaagcaatttttaaaattttataaattaaaaatttacgaatgctgaaaccgaattttcttttccatctacaaattgtttccaacacaacgcccaattttattgcaattttttctttaattttccaatttggttccaaattgaaattttttgcaaattcttctttcactttttcaaattcttttactttttcaatttgttgttgcgttgaaaatttcttttttataccttaaactgtttttgctgatttgaaaatgaaaatttctctaaaatttcaacataactacttaaattggttgtaataaaatgttactagctatagagtccaattttcttttccaagcagaaattgtgttcattctagcaccaattttttccgctattttttctttaattttccaatttggttccaaattgaaattttttgcaaattcttctttcactttttcaaattcttttactttttcaatttgttgttgcgttgaaactttcttttttataccttaaaatgagacaataaataataaaaaatcgaatatgccattgatctcttaccaatttccaattccttcttccatttgtaaattttctttcttttaattccaatttcaatagcaatttcattttcaattttatttcttttctttttgtcataattaaacccataaattttttcttttctcattttatcaaattttctgatcagttccatttttgtttcttcactttcctccgttttcactcttttttgtcccaattccttcttcaatttataaattttatttcgattaattcccaattcattagctatttctgtttcaattttttgtcttttctttttgtcgtatttaaacccataaattttttcttttctcattttatcaaattttctgatcagttccatttttgtttcttcactttcctccgttttcactcttttttgtcccaattccttcttcaatttataaattttatttcgattaattccaatttcaatagcaatttcattttcaattttatttcttttctttttgtcataattaaacccataaattttttcttttctcattttatcaaaatttctgatcagttccattttgatttctttacttttctccattctctctcttttttctcctaattttttttgcgattccatttcatttgcagaatcgttgtgatcagcagacgaaacattctgatcagcttcctcattaaactcattttcaaatgattcttcgcctaatttgtccatttcaatttttggcatttttatttttatttttaatttattattttgttcctcaaaatgttttttcctttttaatcttttgcattacttttggctttatgtcctccatttctattt

SEQ ID NO: 13110 - DNA, 4024 bp, Heterodera glycines
gtggttccaaagcgcatttttaaaaagtgcaaaaggcaataagtgccgataataggtaaaaagaaaatgccaaagaaaaaacgaaatgcgtcaaaaacaaataaagcttggttttgcggcccatatcgccacttaatcctccgctcatttatttggcattgaaaatgccacacctaatgaaaagaattaattgttgacgaacgatgcaattgtgtgtcacattatatcgatggattagtttttggcgcaaaaccatctctaattttcatgagatctaccatttgaataataaatgactcattagtgtaaatgaaatttttgcgaatctctttaaaaaataaaagttcgttttcagcagttgcgtttgtttatcaattaattatcaatcatcatcatattgtttcagtgccccctctttagcgatgtgtttttgtctttgttatacattttttatattaacatttctttaaaaatgatgttttttcaaatgccaacttggcaattctgtctcctcccaatgctttgtgacgccgtgccatgccaaccctggccatgagtgactatgtagttcatttggcaggccaaaatgccgtgtgaatttgtagagaaagcactcattaatcggtagctaggtaattaatgagtgagcacagcccatcaccaccaccgacttccattggcatttccatcagtcattcattcgtccatcggttgggtgccaaaatgaaatgccaacaaaacattctctgttattaattattattttatttggcgccaaagcgaaacttttgccgaccaaatgttcattctttcggtacagcagctggacgagtgtttgtctcgtttttgaatttttgtctcgtggtttataaccaattaatttattgtaaatacattccgagtcgaataattccctcgaaaatgtaaaataaaagcaaatcttggttggattggccaatttgcactattaaataattaggcattttaaagtgcgattaacaaaaggacgaaattctttgtacaatataaaaggggtggaagaagacgcgaactttaaaatattaaatttcttttgtaaatttcactttcttacaataattcatccgtccgtaatgctttctttcgtaataagccaataaaattactttaaaaatgtttaaattattttattattattattattaattttgcttttacacgcgattcccccacttttgttaattttaattggaaatgctttttctccaaatcgcaccgctggcaaacattgcgtgccaatgagcagcacatctgtcatttttacgcttatctttggtgacagcggaaggacatttctcattttacgttatcggatgtgctttgtgggcgattgaaattcagacgaatggcgaaagggctaaattttagttaaaagttttcctttaacaaatcattaatctgttaaaggaagccataagttcactcacaattaaacaaaaacccattaattccattggcaacaactcatcttttatgagttttcaaaataaatttattaatttaatttatttttggtttttttgttttgtgtccaattgagcagctgtttcccccgtcattttttaatttcggttaatattttttgccaaaaaacagaaactgtcaaaaacatctgtttgagttagtggcaataaattgtgaaaacccttcagttttcaatctctaattgtttgtttgttttgaccattcaatttctgggaaaatgagaagtatttgaacaacaaaaaattagcaacaaatttaaatcgaaacttttttgtgcctttaatcaatttttaattaaattttaagccgaaaaaattatgtaatttgtcatgggaaataaaccaataaaccaactctttcattaattttagaataaaaatcatttctttttgtttgaagtccatgtgaatttccggtaaattcccaacattttacgatgataaaaaggcaaagaaaaaaaagaattttctcactgaattcttttgatttttgaaattgaattttcgatacccaaaaactcgtttatttttaaatttaaaaatttataaagtgagaagatcccgccaattagttcatgtttatgtattacattagaaaatgacagtaatcttaaaagattatcatttaaaatttttagatttagaagtttgagacttatattaaaaaattcagatttatggaaatcatttatttttgatataaaaaatttggtgcactaaatggcaaatattatacacacaactaatttttataactaattaacaatgaacactaaattaggcgaagtcatttttccattttagtttatgttttgagcttttttatgccataaaatccgattcctcctgattattcagtttgataattaaagtgctttttaactatttcaaacttcagctgattagtcccgagagacggaactttttgatttgttagccaaattaatgggcaatttgagcagtaattgggcaaaacagagtaaattccaaattattatttcaccaaaaaacggcgtgcctttatctttcatatttggttcatatcataaaaatgtaaaattaatgttgattcaaaagaatgctttgctgttaattatttgtctcaccgtgccccccctccccgccaataattaatggccaaaacactccgtttcaggggatcatttctcgcttttcgcttttttgtgcctttgaaggtctgcaaatccataaaatgtttgtgctcgaattgaattgatcattttttcattataattatgcaagattttgattaagaatcagaatatatttctcagtttcattctcccccccccccttttggaacgaatcccacgggttttcttacagccaaaaaattggtacatttgtaatacaataacaatttgacttttttgttacgtacgtaaattctgtccataaatgttgcgccccctcaaaattcgccccacctaaaattaccatttcatttccccacttaagcgaatgtatgcgaacaaacaaatggcggcgaaagtcccacggcttgaacaaattagcttcttcttttgcttcttactcttttcgatattcaaaatttcttcggcactttccgtgcgccttttgccctcaccaaaaaatgtttttttttgccgtttttacccaattcctttgttggaaggacacaatctgtgataattattgttaattaagctgctaattttgcttctttttttgttttgttttcctctgatagtttaaaaatattccgtcggtccatcggcgggcgaatgcattctcaggaagaagcacaaaaaattcaaattaattaggtatgcaaatattgactgaataacagcacagcgagtgggaacgaaagcatattaagcaaataaataactgtaaaaagtttgtgggaataagcggcggcggaagtgtttttttcctttccttttttgggttcgtttggtaagaaagtatttaatacgtttcgtgtttgagaatttataaattcaatttcaaaacaaaaaatttttcctaattaattttgcgcgcggttttggcattatgccgaatgccaatgcccattccccaccattttacacttgtcaattgtgttattcatatttcacttggaataagcaaattaccggccccgttggcacccaatttccgcgttggcccattgccgtgggttggcccattcagcacccatttcgtcacgccattcatttctcaattgagattagcatttgcttacagcaggctaagtttttaatcaattttgtttaccagtagcagcccttctttttttaattagcaatttgaaaatgtcatttttggtggccatcacttgtcatacattaattgcaaaaaacatttagcgctcgctcattttggcatagccccgaattaaaattgtctttttttgcactgattttggtggaataatctgtgtggggaccccgccggtgtggtccccttcctctgtctcctccctcttcagccattcttgggccaattat

SEQ ID NO: 13111 - DNA, 2193 bp, Heterodera glycines
ccacacttacaatcacttgtccgggactcatgtagggtagctgtgcatttgttggcacatcaatttttttgacaatgaaagcgatgtctccacggagttccgactcattaaaaatttgtgcaacaatattttttgaggccaaaaaatgttcggccgtcaaaatgccgtcaaaatcaattttcgaagtgatcacgtcatagtcattgttgccattgcaaagttttaaggcagcgatcagacgccacaaaatgttgccaattgttttggccggcacttttccagcaaaatggtccaacatggcatgccaatagagcgggaacggcacataattatcagtctttacaaaaaattcgtgtgtaattagtgctgataaacttataaatttgataaatttcaaaatttttcatttctaattaaattctgtagatagcttagcagcactgctgaagcttttgtcaaaaaaaaatatttgaagacttacaggaatttccgctgtaattaggcaggaaaaactcccaaaatttgatactcaagcaaaatgaaaatttaaaaaatctttctttaaatttgatagccgtttgagttctttcagtttgacgaacttcacctgatccatttgttgtttctctgctccattttgttcattaaaaatattcatttttggcgaaaaaatagtgccagcaacttttggttgggcttcatcagtcaagtttttgattggctttgtcaaaaatgcattcttcctcttgcgttgtagaagctttaagtgattttgaagatgacaattttcgcattggcacaatgcctaaaaggacaatatgccaaattaaacatttaaaacaaggcaaagtttgataccattatttgtcattagcaccgaagaatgcgcccgaccaaatgcagttttatgaacgctggtgatggcacttggcgaactgctgctggcggcattgccaatcagagtttggccagccaaacaacaacattgaagaagagcaagaaatgagacaaaagcgaaaagcaatgagaaaaacattttttttttaattttctaaattaattttggaaattaaaaaattattgaaatccccactaattgttgccgattaaatagccaatttaataggcaattcctaagtttgttgttgatgagcaacactttttttaatagagtatgacgccaaaaagtcggaaattcgtgattaatccagtgttagtaggatcgccgggtttcggcatatcagataacaggcccagaaaattcggcaattctatgaaacaccaaggttcaaatttttcaggaattggagattgactaaaaaagagaggtaggaaaaagttgaaaaactcaagcggctcatcaggggcctcgtgctcgtctccggttttagtaaacccgggttcaagggctaaacactggtttcgttaagaaacgttcatttgatgtttatctcggtgattaatgcttttctttagttaggcgtttttttgaaattttagtcaataaaattgttgaaattaaaatttattaaagcggcgcaaatgtcgattttgctgggcggcgcaagtgtctgcggcgcaaaaatcgcggcgcaaatgtctgcggcgcaaaaaacgcggcgcaagtgtctgcggcgcaagtgtcgatttggctgggcggcgcaaatgtcgcggcgcaaatgtctgcggcgcaaatttcggccaaccgctaaacacgggtttcgttaacccgggttcaagggctaaacacgggtttcgttaacccgggttcaagggctaaacacgggtttcgttaacccgggttagtctatttaaaatcatttatttaatttttctttaatctttaaaaaatatatttattcaataaatatcaataaaattaaagtagcaagtaaaatcttatattttaataaatacgagttagcgagaagccatataaattgtttctgtgaaaatgtaatgttgctattttcttggtgttatattttactttttttatagcttttcgaggtgtatttgtggatgccattccttacatatgtttacatttacatggcatttgcattggcattctccatggaaaagtgccatggcatttcctgtcaaaagcctttcccctttgcccggtgtgttctgatcacttaggaaacagcgcaaattcacgtgaaattttttgtaaatattttcctgcac

SEQ ID NO: 13112 - DNA, 629 bp, Heterodera glycines
gcacttcctctttgatgttgaagtgccatgatgctcgcttctgttgctgcactcgcgcgcgtgttgctgcctcacatgccaacatgcaattgcgatcgtcatggcacggatagtgccgtcgcggcgcaacctccgctgtctttgcgaccgttgtgtcgccgctaataacggcagttgtgccagcattgtcatgctcattacgctgcttgctgaggtcgttggcatagttcgggtcattttccagcaacagctggacaggacggtgctttttttgcttcctgaaaagtgtgcttttaaaaagacttgaaacttaaaatattttcataaattacaaaataaaaatgggaatttttcagcagcttttttgaaaaaaaccattattaattcatcttaattgctgaaaaggttttcaaagtttatgaaaatttaataattttttattttaaaagtttttgaaaaaaattcacggagggaattgatacgggggggggggtaaagaactgctccccgacggaccaaaatttcataaagttttcttaacgtgatcaaattcgtattctggcacaatgccaaacatccaatcaccaatggtgtgccgtaacaaaacacacctcgcgtacagttcgcac

SEQ ID NO: 13113 - DNA, 3796 bp, Heterodera glycines
ttgttgagcaaaagttggctttcctcttcatcttcctcatgtgaaacggcctgtattattgccctgtgtttagcatattcgagtgctttaagccattgtgaacgatcaatctaaaaatatcattctgcatacctaattaggtaaattaaataattttacaatttaaattacctcatttgatgcctttaaatgaaaggtttgggctgatggagtagtgatgatctagcaataggtttgattttcacagtattttaaaatataaattattattacatattaaaacggtggctaatttatgaaattttaaaataaattaaaaaccaaccaagctgtggctcgactcgccctgattgctgtgaatgttcgcttcgctcaaatttatgctgcctctacaagagcgattgacttccgatgggtgccttcaagtatttgatttcctttgatataaaaaacaaccaaaccgataatagctcagaattccttcagcattaaggacaaaccatcgctgccgatagcccttgacataatttgtccatttgtaaagccatccggccttctcaaatttatttgggtcatttgttttggcactgttctctttcactccaacatcagtcgaattgctgccggtgtcttcgacaaaaaagctggccgatgaaatgcttgatcgctttttagtcattttatatcatcaaaattataattcaaccttaaaaagtgagggttggataaaaatgcaaattctcgtgtaaaagcaataggtagatcacggtctgcggatgcgtcgactcgatctcgactgaaggagacattatgacaaatttcgcgaaaacataatttttaaattttttgttggcttggtcctcggttgggttaaaactaggaccgaaatgaagaagatgcaagcttaagcttacagatttacctatatgataaataaaccatttacttattagcaaatgctgagacattagacttcttttaaaatgtttttataatgtttatttcttaatttctagtaaaatttgtctaacaatttatttacgcttacgataacaatttttcgcttccttatccgcatatcataatgacgagtcacacgccggaatggaaaaacttagcagcaggcggtagccatggaattcgttcatccgttctgactagtctaaacggcacaacgccatcgagaaacccaaactatgtgaaaggaaaggtcaacgagggcgatcgctatttatgtctcagaagtgaggagcaattggaactcgccaatcatttgttgtcctcgcgactgctcgtgagattttctttcaacaatctccagttttatttaatcacatgattaaggataatgagaacaccaacaatttgaatacgtccacttcatgtccgacgagtcccgcttccaaattggaacagcagacgaagaaacaaatgatgagggtcaaatcggacaatgcagtgaattcgttggctgattttgaccgagtttgcgcatttcgtaagggactcgctcctctagcaaaattcggtagattaactaataaagccatgaattttacatccaattcattctctgcaaggccacaaacagcaggtgaatgtgcttttttcttgtgttcagccaacttccagttgtgtgaaacggtctcgtcgttacgtcgcaaaggatcccgagagaatgttggatgcgccagatttattggacgatttttgtaaacaaaagttcacatattacatttttccaactattccagattcgaatttgattgattggagcaagactaattgtgtcgccgttggcttaggatcaaaaatttttcaatggaacgcggggaccggtgccgtggatgtcagttcttttacagttttttccaccaaatcttgtgaatttaaggagataaaagatttctctgaaacgcattcgcatccaactctcgtcaaatggtcttgcgaaggacaatatcttgccgttgggttcaatgacggacaattaaaggtgagccgaacggatagcgaagacataatgagacttcatttcgttttcagttgttggacagcgccaccaaaaaagtgctgagaacaattcacacgaccacagacatgcgattggcatgtgccacatggacacacaaagggcgcatttgctgtggctcgaagaacggtcgaatttaccaccacgatgttcgaataaaaaattcgttgatcaggttcaatatttctaaaaaattagcacacaaaccatctcattttaagcactttggatgctcatacgcacgaagtttgtggcctaaagtggagcccagatgagcattacctcaccagtggaggttctgacgcattagtaaatgtttgggagaatgtgcaattatcgtcaaataatccggttaatacaaatatttatcactttctattaccaatgcttttatgaattactcaagacaccgcttttcaaattgaatgaccacgtgtcgactgtgaaggccattgaatacgttcggtttctttgttcttttgatggctcatttgtgttttaggtgccaacgatgggtttaggcccagccaatctcgtggcaactggtggtggcactcgagaccacaccatacgcttttggaacctaacggatggcagtgctcacttcacattggacacgcacagccaagtgaagtagcattttacaaaagttttaattgcgcgaatttaggtttccgccattctcttcagcaaacctcacggcgaaatgatcaccggccatggggccccaaaggcgggcgttcgcgtttggcaccacgagcccaacaaaatcaaaaagtttgagcagacggcggagttgaaccaggcacatggcggacgcgtgttggcactttgtcaaagtccgtgcggagagtacgtaatcgccgcaaaccaagtgatttttgttgttttgtttcaacaaaccattttcttgctgtgaaattgcaggacgaagtgctcaggatttggcacgtttggaagatggacgaatcgatgcgaaaacagacgcaggaaagtgtaacggcaaatgcgaggaaacagcttcagggcgccgctggaaatatcattcgatgaaagcaccaaaattacctatttattttaaccctttcgttctctgcctcactattttttcaatattttagcatttcattaggattgttttttgtttttacgtattcaacttaacttttatactatctttcatttatttgtgtttttcatgcataaaacaaaaagtgcactgaaaattgttacagtaaaaagcattagaataatttgacaattattcgttgtcagcacttatcaaaattagcaaaacattctcttcccttatctccgttaaaaacaaagaaaaggaaaataaaacggtgaaatgttatttttgcgaaaatggacgccacgctgagaaaatgcatcgccaaagtgaggggggagcatgacgacgacgcggtggaccgcgccatctatgccacgacggtgcatttgctcggctttttcgccgtgctcatcatggccaagcagtacatgggcgacccgttacagtgttggttgccagcggagtatacggtaggagggggagacaaacgaatttaaaagaaaagcgaaagagtaaatgtgacagcgaatgtttcagggggcctgggaaaaatacattgaaaattactgtttcgtggagaacacttattacgtggcgcagagcgaaagcggcaaaatgtgagtgccattcctacggtacttctctcactcggtgtcatactgtattctcccatattcattctctctcat

SEQ ID NO: 13114 - DNA, 945 bp, Heterodera glycines
tgaggttcgccgaaaagatttcatcttcctttggctttggttcttcgtctttttaattatcgcttctttgaatttgctgttttggacctatcagattctttcaatgcgcagcaaagaaagaatgataattgatgcacttagggtaatcacttcaaattccaagccaaatagtaggaaattgtgcaaatttaaattattttttaatggagcaataggccaaaaggtaatgtccccaactttcagcttcaaaacatccgcccaagccgacaaattgtaaaagtttttgtttacaaatttctcaaattggacggaattctcgtccttcgactgatcgactcaaacacaggacaaatccatatggctgacattgtccatcagctatggctaagtttcaacgagaaaagctattttaaagaaacaagctgataaatgtaaaagaatttatgggaaaatatctttatttgcatttaaatggtcataaataattaaatattataagtcgacttaaacgtattctcatggtttaccatatctttgagttgagtatcggtcatttctcctccgtttccttctcctcctcctcttgtccatgtccctcggcttcctttgcgtttggaatccaaagtccggaggcagtgcagcgatccaaatggtacttgaacacctcggagtccatgctcttcgccacttcaaatatctttgccatgctctgtgtttcgaacgcttcttgcatttcctaaaattcaagtttcattactaagaaaaaagctcccaactcgccagtaaccagatcaaggatagcacatgcattttctgcttttgaacattttgttttgtatttggaaaatgagcgccatcagacagtaaaattccgatttttgcggccccataatttgtaggtttattgcccttattgttagcacgtaaaattaaaaattcagaata

SEQ ID NO: 13115 - DNA, 3828 bp, Heterodera glycines
  misc_feature (3823)..(3823): n is a, c, g, or t
agaacattctgatttttcgttctccttgtataagatcagaactttctgatttcttgctttgcaattaaaacaaaatcagaatttctgatttaaggaaaaatcagaacatctgattttctatctttgttattaaagtaaaatcagcatattctgattttgtcattgtaattatacaagatgagaacattctgatttcttgctttgtaattaaaacaaaatcagaacattctgatttttcattataattctataagctcagaacattctgatttcttgctttgtaattaaaacaaaatcagaacattctgatttttcattgtaattctataagctcagaacattctgatttcttgctttgtaattaaagtagatcatctgattttgtcattgtaattatattatacaagataagaacattctgattttattaattctataaggccagaaccttctgatttttcattgtaattctataagaccagaacattctgatttttatctttgcaattaaagctaaatcagaaaactccgattttctatcattgtaattaaggcaaaatcagaactattaagatttccattctttttgttctatttttttctgctccgatttcaattttgaaaattaaaaatacaaataaatgcgttaacaatagaatcaaaaagactaaaaatcggttgaaaatgtatgaaacgtgcttttattataaatttatttattggaatataaaggttatggaaattgaaaattagggatatattctttttttgaaaaaatccaagaatcagtgatcatatgtatactttcttcaaaaatgattaaaaattgaaatcgtacgaacatttgaaaatgaaagaaataaattggagaaataattttgatggatttaaattgggaaaatttaaaaaaataaatgaatttgcattaaataaagataattactttccatgctttatccctttctttgcgagttgatcctctaaatattctaatctttcaaacagccgagcttcagagcttatgtattcagctgttagacgagcaaggcttaaataattttaaaaatattcttttttaacttattttcgtttactaaatgagattttgttaaaaaattgttgggaaaatctgccaacgaccaaaaatttctgggcaggcatttagaccataaaagcctgaaattgaaaaaatggcatcaggatagcacataaaaaaacgttttctttcttttcaagtccctaacagttcggtataatacataaaactcaaaaaattccgtccttatttaaaggtacgaacttaataggtgctaggtcgtttcgtcataaatttccttaaaagcaaccaagtttaacattgttgctaacactcgatagctcagctatttctatattagcctgcaatttcaaataaaattatccaaatttttacagtctgatagataaatacctgggctattgaacaatagctaaaatataattgattattatgtcatgttttgttgaaaaaatatttaaaatagcgaattttacgaaacggcccagcacctttgtgtatatatatatatatatagtaccggttttgcaatttttcaacatgcgtccgcaggttgcacaactgtttttcctccgatttgctctcgtcatgcaaattttgggccaaattttcgtccaaaagcccatccttcagcaacagttcacaccccttttgcatcaacaattttttggcctccggatactcgctcagcgcggcccataaatccgcttttttcagcacaaacaaatcggtgtagccaacggaacggatgctggcggaacggcgattgccatgtttgctgccttggcaaaaaagttggggaaaactttttgtaaatttaaatatttaataaaaattatttattattaatcaaaggaattatttaaattatataagtatttactatatgaaagtgtaaatttagagttctataagtatcatttgttttggattaatttaaaaaattaatacaatttatttaatgtgtttttaatttatcttttaattttttaaataaaatattacctggtatattgagaaggctgagttcaccgaaaacagctccttcaactaatgtgtgaaaaattttaactccatcatcagcaaccacttgaagacgaccttttttgacaatatactgaaaaaattaattaaaaaagaaaaaagaataattaaaaaagcaattagatataattttatattaatgtgtttattagtataattatttacttaaatatatgtattaaaattaataaacgcaccatttctcgtccaacgtcgcctttcctgcagacatagtcttttggactaaaaacctaaaaaacaaactttttttaaattaattaattaattaatttgtttttacttgtaactccaattttagcactaattcacccaagagtccagattcacaatccttaaacacatatagtattttaaaattactcttttttatttggacatatatttttatggaaactataaaatttatttaattataaaatttaaatcaacaattaaatttaaataaaattaatattattttttaattttaattttttaggacctgaaaaagtcggactttgcgcagcgtctcaaaatgcacatgcatcgcaatttctgcttgcaattttgtcggcaaaagcttcaacacttcctgatcatcacgaccacccattgcctgtttattctcccacaaataatcaaaccatttgccaattcggtggaccaactcaaaaataggcaaaaaaaaacaaaaaattttaaatatttattaatttaattatttttcaaattgtatttggttacctttttaccgaccgaccgatgcttcataaaagatttcactttgtcaatgtttgtctgaaaatccaatcgcgccgagccagcatttgtgatcagactttgaaaatatggaaaaattttattataaaacacaaaatgccgtaaaaaaagtctcttcaaaactcacgtgccaacattgccgactgttgttgcaaaaaccaaaacgccaaacaacaaatcggcacaaacaatgacaaattcgacactttttattggccatggcacttcgccaattgcggttagcatcagtgttgaccaataaaagctgtacaaataacgacggcccaatgtgtccaaagtgccactgaattttataaaagtaaagattaattttagaaaataaattttattttaaagttttgctaatgagcagttccaaaacattattttcattttatttgctgattaataaatcataattcagcaccgaaatgtgcttatatttttgtatgaccataaaatattccacattaatccttcataactttttttcaggtacaacgaaatttaagtttgttttaataattatatagatcaaaaattctctattcatcactaaaaactgaattaaattttgagctatgttatgatttattattctgcatataaaataaaataatatttgaatctcaattaatttatttttatttaaagcaaaatttatctcaaatgctttattctacctaggatatgaatttttgtgtatgttttcgctggaatatatattttttattcattatatgcatagaaatttattaaaaatttatttctttataatttcaaattgattgtcaatagagcaataaagaaagtccaaatattttgctacaaataaatgaaatttattttgatgaaaacttgatagtttccaaatgaaacttaaattccaaatctacatcacatctccccacaaattgtttcttcccaattaaaaatgctatnttctc

SEQ ID NO: 13116 - DNA, 3480 bp, Heterodera glycines
gggggaggatcacacaatccaaattctttccaaaatcacaggcaaaactcaattcaattatcggggtcaacagaacacggatcaatttggaggccgctttcggcagcaattcggccaaaacaattttcgtggccgcaataattttcgagggtcgaactttattcctttgggcaatcggttcccgagacagaacggtggcgattttcggccaaattttgaccaaaatcggaatgaacaaaattggagaggccgcggaggaggtaattcatacggaggacgcggaggaggcaaccaaggacgcggaaggagcggctggcgtgtgaatgaagtcaacttcccattcatttgctttattgcggttatttcggcaatttttatacccgccactggacaataccaaatttgcccaactcagccaactgagggaattacggtgacaatgagttttccatttccagaggaacagaactgcactctcccggtcgaaacacctccgctaacagtaaaatcgaatttatacatcccaattcgaattccacgagtttttccggcattcaaatgctggaatatcaccacaatcgcatgcacagaatcattccttcgagtcatcacactggaccaccctgataagaaaatcgaaacagaagcatctgtagaggattgtcaggcctcacttcaccatttgccgatgaatcgagtgagcgaaacgagatgggaaagtctgtcaccaattcaaagagaatacggatggtatggcgtaaactgtttcgacaacgtccaaacaatagtcgaagagggaacagcaggaatcttggaaggaaaaaggctgataacatcttggggtgattccttaaaagtcgataagagtcttggtgaagaagggagctggattcggttgccgggcgcaatggaactgcttatgtggcgaataccatctgaagaattttggcattcccacttcgctattggacccgtagtaacggaaatatggccaaataaggcggttgttgtcgatgaacttcagtatacttttccgataagcaaaaatcaggaaaggaaattcccggtgattggagtccccaatgatgctttgaagactgagaacaatgtttatgtacatgttattggtaaagtaaattcgacaaaaataactcgagccagacgggatgccaatccaaagaagtcaaatgtaccaagagccaacccgaccaaaaagccaaacataagaagaaatcaaaacgatggactcccatccaacagttccgtctcgactatggcaattccgaccaccacaattccggtcacaacaaccaaaattccgaccacggcgattccgaccaccacaattccggtcacaacaaccaaaattccgaccacggcgattccgaccaccacaattccggtcacaacaaccaaaattccgaccacggcgattccgaccaccacaattccggccacgacaaccaaaattccgaccacggcgtttccgaccaccacaattccggtcacgacagccaaaattccgaccacggcgattccgaccaccacaattccggccacgacaaccaaaattccgatcacagcgattccgaccaccacaattccggtcacgacaaccaaaattccgaccacggcgattccaaccaccaaaattccgaccaccaaaattccgaccactagaattccggtcaccacaatccgcagtagctcagcattggctacacctcaaagctccactgacaccacaaacaatattccagccactcttaaggaacttaatgagttggcacaacaaattacggatgatgatgtgctcagacacagtgcgcccacgccatttattattcaaaacgagcccagtgaagaaagtccgacaaccgtgatcacaaaaagagaggtgtccgaaagcaacgaagttgggtctgaaaaattctggaaggagaagaatctctaccacgagaattcccgacttagttatttgggatggaagacacaccgagtcaacatacaaaatgcgcgggaaaaatggatttccgattgccatgagcggaataacgctttagcaattgccaaagctcttgctcgccaaatgcctgaagatgcggctcggtcgctgtacaaaagggatgatattaccgccttttggacacagccctcaagggaacagaaatggtcaatcgcactttgcagacagatgaaagcggaagaagttttttgggatcaaaaagttgaaacaaaatgcttccgagaactgcccgtgaaagtcacaagacaaatcctctttgtgaaaccagggacgcgcgatctgacttacatcggtactgaaattagctgcgatgcacaaggaaataatccatgggcagcggagcacagcaacaataactcagaacttaataatgctaatctgggacaccgattcataacggaccaatattcaaacgcacaaaatcctctgattttttttaaccgtggctcaatttttgagtctgagcaggcacgtctggagagaaacttaaaggaattaacggaaagaatcacacgacccgaattggacttcccggaaattgggacaattgatgcaaatcaaacataagttcacggaattccggtcacgggaatattttcgattggagaaattttggttgaaaaaatgagaaacgagggagaaagcctcagaaggaaggcagaagaaacaattgagaaagggaagacatggattgaggatccaattggcataataaaatacgtcaaatggattgggttttctattttaatcgtcttaattgccgtcggctcatgttttatcttcggaaaaattaaaatttacggcactattctgacgattccgctccacatgattggcaccctgacccaaatgttaatggattgtttcacatccggaagaaatgtcgtcgaacgtgttcgacacccggtcgttatggaggtggaactccggtccttctcggaaccttccgcaccgccggaggagcaagcgctcgaacagactgcctacatattgaattatctgccgaaaatttgccaaatccatcattatcaacgccgaaaaaagagatgctacgtgaatgtcctaatcaacgggaaggacataaaagcattgttcgacaccggagcagatgtcacttacattgagctctcaactgccaagaaatacgggctgcgcatacttcgaggagacttcccacaagctcgtgctgctaattcaacgtctataaattttattggatctgctctgacgaacgtcaaattcggagaatttgagggaaaattcccaattcttataagcgaggacggaggctgtccatgcgccgctattattgagactgattttatggattttatcagcgagcaaggagaggaagaggaaattggtcttaatttcaaacagggaattgtccgagtggggcacgtccaattgcccatgattgcagccattaatattgaatgccgaccgatcgaagt

SEQ ID NO: 13117 - DNA, 3853 bp, Heterodera glycines
tttatttatttttgtctatctcttaaccaaaaaaacttctttctgctacatattgtcagaatgagccatgggataaacaataatgtttgcttgtcctggatttttgtccagaaaatgcaggtcaaagtccacattaagcagaattcttgttttttcgaaataagggcatacttaaaacttacttccgtataacgggtggggccgctaatttcaacactttcggcattaggtggatgataacagatcagaaacatactcaaaacaccagcagaaattcggaaaatattcaacagaaataattttttcaaaatttcaattatcctcaaaaaaattttaaatttttcttaaaaaatttaaaaaaatcatataacatttttttaattcttaaaaataatcaattctctcctatcgtcgtatttcatctgcttattcaccagtgccgacgaggcgtactccgtgccaactgagggcagaatctccagcgacaaaaggtgaagtcgcgagtcatgcttttggcgaaatgtgaattctgcaaatttcacacaaattctcgcgggaaatttccccacgacccgggaacattaaaagtgactataatgaggaattgtcaaatcttgcacgacaaatccggcaaattctgtccgtccaaaggtggcatcccctgtccatgaaaagaaaccagaccagaaaatttttgattttgcgcttctctaccctcgatgactgtacaaaaatgttgaaaattgccttcgcaaatcgcaaactccggcgcctcaacgaccaatttgccgcccgacaatccacacacccgccaatccgtaaaaatgtgctcagcgccggttctgcctccggcattcgcagcagtgcccacactttgtccaggcgcagagggcgccgcccccgtggggcagacggatgccgaattgggactgaaagtggctggtgcggaagtggcgtggcagagtctcaaaggggaaaagcatattgaacaatttagtggttattgtagaggatcttgacgtaaataatagcgtaatcttaatttggaaccacgggatcttcagtctcgataaatcttgattcgagtctcaaaaaattcaactgccaaaaaattaggtctacgattcatggcattattcgacgttttgaattgcaaagataggcacttttcccgacaaaaatctcgacttgtcttgacaccgagtcttgaacataaaattggctgattaattcccgattcatacattcttcatgatgatgcgacggcaatggtggtcgaatgccgttcccatgctggattttggcaatttcgctatccgtcgtccattgacagcctcggccaaaagagtccgattttgcggcataaatttggccacattggcactcgcttttttgcttgttgtacccggcacggaaacatggcgcactgaaagtcttttgctgcatattttgacaattaaataacccccaagaattcgattttgtttattctgatcgagccaatcatatcaggtaccagaaaaggtcaaataaatcgggattgggattcagaccagaataatattaccgggactcaaatccttattttacagagaatccttatcctgagaccgggattcaaatcccgtttggggatcagatcctaacattcattttaaaaaatgtcggaattgtgtcaggattcccggtagaattccgatggacgctctcctgttcttgctctaatttatataaattctcgaattttgaaattctggtccgtggtttgacaaccgaccctccgcattccggcgcacagttggcgcatcccttccgcaccgcgaacatttggtcgctgccgtttccgcccgtccgcgccgctcgcctcttttgcgcctccagcagtgcgtccatgtgctgacactggcctttgacaacaatttcttcgacacatcccttgaaaggagattggaggtgggaaaggcgtgagataattagcgtaattagcggcaataattgagaatttacaaataattttagaaaattaaatttggttttgttgcacaattttagcaaatgtttgtacctgaattgaaggtactgtcggcaatttcgttgccgacgagagggccagaggaggacgaagcggaatattggtgttcaacgccgacggaacggcgagggaattgtcggaggaggaggaggacgaatgggcaggggggattttccaccacccccccgcccaaccgcgggacccgaacaaaggagggaagaagcgccgaggaggacggcgctgatcgaaaattccggaggggacattcccgggtaaaggccattgccgtggtgaacgatccctttttttaaatttgtcgacattttcacccctcttatttctctctttatttaaatttttcatttcctttcacttttgctcatttacataatgttttccttcaacttcaccatttgccttttctttccaatgtttttgcccattcacatctgcctccgattttgattcctttgttcacactttctccgatcgccatttccattgggccgtttttgcattcatctcattttttccctttgtttggcattttttctccccgccgatttttgtacccttcggcgtcgctcttttgcatcttaatctttgccccccccccagggggaaattgtttttggtacttaagtattgtttatcgtctatttgggctcattctttttcattcctttccattttttttacacacacattcacctcttgctcttcactcgttttcactcctcaccatctttttctttttgctgaatcattcccaatttttgaccccctcaataatccttatcgcccttcccttcctccaattttcaccatataatccatcaacatctcgcatataatcatccaccaatttttgaccattttatcatcatcatcaccaataaacatttggtcggaaaagtgttgaaagggtcagagggcaaaaaggggggaaaaaatcgctcgggaacgaagtgaccaaaggggagccaaagccccgagaatcgaagcgggggacaatcccccgcagagcagcagcaaaaagggacgggagccagttcctggcggttgacgcagttcgcagccggaagtccaactcttctcccgaacctcaaccgagagcgccgacagctcttcaaaaagtcggtggtgccgttacagcaacaaccgcaaaccccatcttgtttgtcctccccaccccctccccagttcactcccttgggcacggacccaacggcagcagtagcagtttcaggaaattgagtgaattgggcccgagggacgggagagaaactcccgcgcacagaccccctagccgtcagcgccggccgagtttctttgccacaaacaatttggtgccgttagcagggggcaactgcagccatcaacaatcggtctacgagcgaccaacgagcacgaattcgagaagctaacggcaatttggtgccgttagcagggggaccagcaacaacaccccggtcgcaaaggaccagcacaaccaccaacaacagcacttcggtcgccgaggaccaacacaacgcatttgaacaaaaatggagcgacacgacgacgaccaattcaacgaaaacgcgaatcagggggatcctccccctctgatcagcaggacgagaggcgagcgatcggagctcagccagccaagcccaagaaggtcttggaagcgcacggacttgggacaagccaaacgggtgtgacacccgccgtgacgaagaatttgcgcagtggactaatcgcagtgcggtcggcacgggaccaaatcgaaagagcagcgggcactcttgccgcgcgaatcgtcgaagcgcgggagct

SEQ ID NO: 13118 - DNA, 3170 bp, Heterodera glycines
  misc_feature (3165)..(3166): n is a, c, g, or t
aacgccgtgttcccatcagaatcgctgacttcgatgtccgcgttgccctcctcaacgagcaatttgactgaaaaaatagaaatgaattgtcattgattaaggggcgcttttgggtcaaattttgaaaattttagggtaattttgggtcgagcggtgccggtagggacagccgaggtctctaagaagaatttgaataaaaaatacaaaaccaatattcaaaatattaaattgcaaatgtcactctattaattaaaagctgctcgtcccgttacgtataattttcaattaaaatgttttaaaaacccaaattttttataataaatttcttaacgctcttaaatttttttatagtttacaaaaaataaagcccgaacttttcaaaaactgaccaactggcaaattgccatcgccacacgcaatttgcaaaggcacaatgccgcgtttgtccctgctcctctgatccactttggcaccgttcgcgaccaacaatttgcacagcgccaaatcgcctatttgggcagcgaaatgaagcggtgaaatgatggcttaaaggaagttcatgatacgcaacagatgacgaagaaatcaaacacaggaagcaacattttaagcaagctaaacgattttgtgaaattaataaattcgccactctagacaaaacgattaaaaaaaaagaattgttgcttaaagttgcctcagacgccagggatgatcacagggtaaagggacaaaaaaatgtggtaatttgattgacaatgaacaaaggtatgtccaaaaagtcttccggcgacgcttcggccgacgacgttttgggatgcatccataaaaacgaatggttcaaaaaataagtagaaatcaaagaatcctccccttatatacacaccatttcaattttacctttcagttccaataagatttgcatgtgtggctaagtggtttttgtaagatggtaaagagacaaagagttgaggttcgattccgtgtgcaacatgagtatttttatttattttttgtccaaaaaaatttaaaaatgacgctttgtgaaactcgtttttgaaggttttccaatcaaattgggtaattttggtatcattcgaaagctcatggagagctgaagctttttctaagaaatgttaaacagttggacgtgttagaaaaaagataaaggcgttttaaaatttgtcttttgattaacttttgaatttaatcacagataacagatactaactagagattaaggtgtattaaaaaaagaattggagaatattgaactatgagaagcttaaacaatatttcaacttcgacaaaagaccgaaacgccttaagtttttagatattttaaatccttttttctttttatttgattaaaattaatttttgttttgcaattattgtaaaaaattagtccaagattttggtgcctgttggcaaatgaattttaatttgtggacaacatcataaattttcaattgtgctttattatattagttaggtttattttgaatattactggataaatatttcaaaataaaattgttaaaaatgtcgcccatgaatttggtcagtcacatcgcaatttttatagccaaaaaatcattaaaatgtaaaattgtccatctcattttaagccccaatcgtagcttatgctttacctttttctcaacttagataaaaaatcgttcttcactcatttttaagttatcattttgctcaacaaaaaagccaaaaaaggattaatttattcatttgaaagtgaatatttaattgattgataggtcacaaataaatttgcctaattactttttgtctaccaatgccgccttataaaaggcgaacagattcagcgcaaaacagcaaatgttcattcatttatttggcagtgatgaattttattttccaaatttacatttctttttaatatgaatgttaatttataattttctagatagcacaatacactttctttaatttgaaaaaatgtcatcatccatcgcttcgccagatacatttttgcgttcagaaactgatcaaagtaatggaaaaatttttaaaaaattacgaaaaaagaaaataattattaaaaataaaataaattcaaaatctaacttttatcagcaccagcagcatcagcagcagaagaagtgggcaaatacgaagtgttcagttggcacggaaatttgagtgatcaattgtcagctgaactgttcgtcactgatcagcagctgctgaaggtgggccatttttgaatggacaaatgatcaaaccgcggcgggaggggaggggaggccaaaaacagagaaagatttatggaaaatttagttcaaaatttccattcgtttttaaaggttttccaatgatataaaattaaaaggagaaagggccgacctattcctcgaacaatttgatggcattttgccaaaaccattcaattataaaatgaacacaaattacaaattatttattgggctgtaattatttgttttatttaaggaatgccgagaaaaacttgcgaagtccgaattgaaggaaacgaaattgctgtggaataacggtgaactgaatgctgaaaatgtgagcaaaataaaaattaaatttcagaggacgaagtggctaaaacagagaaaatttcacttttttaaatttagagggctctcaaagcagagttggaaaagcagaaactgatgacggaacacattgaattgaaggcaaaagtcttcaatatggagcaggaaaagcagcaatttgagaaaaaatacggtagggaaaattttaaaaataattataaatttccagtaccgtaccccgagccttactgttaaaataagcatttcaaaaagaattccttaaaaattcatattgtagtttctgtggatgtgttcaattcattggcggaacgcatcaaacgattggaaaatcagcagcaggagaagagagaggaggacagaaatggtaaaattgaaaaaacggaccgtaaatttcaaaatttcttctaaattaacattcagctgaccgtttaccaaaatgcaattaaatttcagtttctgttggccaattgttggagaaatttttggcaggagaaaagcagcaaaaacagcagaaaaaggacaacgctcagcagagattggatggaaaatgttctgtggtggacaaaaacaatgtcgcggnngtgg

SEQ ID NO: 13119 - DNA, 2075 bp, Heterodera glycines
actaaggacggaaaggcaatcgcaaaattaaggacaacctttctaaggacggaaaggcaatcgcaaaattaaggacaaacgaattaaggacggaaaggcaatccaaaattaaggacaaacgaattaaggacggaaaggcaatcgcaaaattaaggacaaacgaattaaagacgaaaaggcaatccaaaattaaggacaaacgaattaaagacggaaaggcaatccaaaattaaggacaaacgaattaaggacggagataccatcgcaaaatggaaggacaaatgaccgaaattgaacattttataaacgatgacgaagagacaaataaataaataaaatggcatttgcttaatgaagcttccttcactttactttggcccatcgctttgcctttttctcttgcttttgcaactctctcccccattttccttggccatcgtccgtattctgtccatcaccagcacagatgtgtttgtttgtccgtggccaactgacggggttggatcactttggatcattcccagcagtggcccctcccctctctcccttcgatgatggtcccttcctttcccctccccccgataaatcttttctctctcatcgcctgccgggtcattccttcgtccaattcttcctcaactcccttttccatttctcatgagttttcgcttaaatcgccgccgttcttcgggcaccggaagcaatttgctcttccgccggtgcagcatgtcacagcgcgactttgaacagttggcaaaggtcagcagggcaaaatgcccgggggcgacgaattcgttgtgtttttggaagaggcgacaacgtctgtccgattggcttctgcttccgcttgcgctgttctcccctccgcttgttcttttcctccattcccatttgaccgtgccttttcatcgtcaggtgccctctcctcctccgtttatctctcatttcccctttttttgcccatttagaccctttttgaacattttttggcccaaatttgctcccccgtccccccaattgtcgtcattttaatctcacaactccaattgttctttctttggtttcttccgtcgaaagatgtccaagtgaataccgaagaaggtcatccgatgctcaaacattaagcaaacaattcacaaccgttgcttttgcaggtgaatccttcagcacgcgcttcacctgtttcgagtcttcccttctcatttgtttgttctattttcttggcgttttactcggctttttcccaggcaatttggtctgttttttaaaaatttgaactcggttggcttgtttggggcggctttttgccaatttggacctttcggcagatattcgcccattgggtcggtctgatgttctggctaagtctgctctcactgttcgtcccccttctgctgcttctgctccctccccgcctctcctcgtccgtctccccgccttcccctgccggcgacgacttttccgtctctgccgccctttctgtctcttccgaagcccttccgccgggctctcccgccccatctctcatctcccaacttttctacggagtccatcttcagcccgttctgctgaacgtggacctcaaggcgttcctcaccgtccgcgtgtccctttccctttgggcgctgtttctcatttccgcccaattcgtccaccacaaattcgtcctgactctctccgtgcccactttctctccctcaattcctcttctcaccacctccgcccttcagtttttctatatctttcgtcgccaatgcttcgaacatttgctaatcgatggttcggacaacaaaaacgacagggccggcttttaccgccttttttccgtgttggtttttctgcccaccgtttatttggtcccaattagcatcggaacactttcaacggtaagccaagcgattagaacatttgaatgggttgtgtttcactctttttaaggatgtttcgcaacggccgacaataatttacgtgggactctttctgatcggtcttttcttccaatgtcttaacacggcgattgacttgcaaaggcacaaattccgaagctcaaacggcgatatgaaaatggcgggaaa

SEQ ID NO: 13120 - DNA, 2077 bp, Heterodera glycines
  misc_feature (2022)..(2022): n is a, c, g, or t
gtttatcttccaccttccccccccttttccatgtatgtttatggccaaatcagtttttaaaatattcttaggattcccctccaaaatgtctgaattcagcttatctcttcacccgtctctttgaattggccgaggaagagttcgccgagtgttccatccgatctaagcttctcccctcttccgactcttcatcgtccctcggcacaaccgccctcggccctcttattagcaaaccgatggtccgcaacataaatttcgttgaggagtcaccattaaattccgaagtaaggaaaaaaccaaaaatataggaatcattttcaatttcacaaaatttttgcccttccggtgggaagggtcttttgaatttagcaaggggtcaaacttgtaagccacaattctttgagccctttgtccgcgtaaggatgagaagaaatccttataaaattgtttttagaatgatttgtccgattgtgtcaatttcatcctaaaagaaagtctcaatgacaacgagggaccaaaggccgaggaacaattcactgaagcacagcaacgaatgtttgtgcgtttttcgtcgtttttccgcttgtgccgttcaaaattcatttaattcagcaaaagttttccaatttgaagtcggtcccttccaattccttcgtccgacgactcgccgtttgtttaatcgagaaaatagacggaaattttgtcgatttttgtcgtttatggaccaaatttctacaaattttgcgtcatcattgggagtacaatttgaacttgccaaagtcagtctcgccgattcctcctttatttactttgcttttgagttgtcagttttgacactgatgaaaggccccaattgtcgtgctgtctcctgcaccaaaaactccaaatgattaacttttgcatttcggtgaagaaacgaaagcacaaagaaatggaagcgaacgaaacggagaatttgggcggaagtgccaaagatttgccagcaaatcgaaacactgcgggtaaattcggtgagattagtgggaaaaccgaccgaagacagaccgatttttaattgcatcttgttaaattgggagtgaatttacattatcattttggttcgttgaaattactctcttaagacgacgagtttttcgatgcgattgaatcattcgatcaatttgacgtcgccacttcgtcggagtgccctcgggggagaagccttccactcgattcgaatgaatttttaaagagcaatccaaaccaacgaatttttgttccttttactcaggtggtcattaattgtaagtaaattcgctgaatattaccgcaaaagccctttaggaggagggcccaatgacggaagaccaaattgagcagagagagtcctttctgtgcaatttggaggacgccaatttgaggacgaaggcgcagtccgagctgttgttgtccgacatgcaagcattcaaagtaagccatgtttttgtctaagtttttggttctgtttaaggccgcaaatccgggctgtgaattggtggattttttgagatggcattcgccaagggatctgacggaaggtgagggggaggggaggagaggatatttgacaatgatggatcaaaccgtttaagaaggcgaactctctgatcggatgaaaattgctgggaatttttggcaagagacttgggactcggcccgtgcgattcccgcgacgcagcagcaacgcctcttcaacgagacgcgagaagttgagcaagtacagacaaacatttgaagggtttcgcacccaatcgaattactttttagattcttcaatatttcgcgaacatttgtatcaaagaactcgttgaacttctccttccaattgtctctgtgcatatggccgagattttactcacaaatggtacaattttactcgtaaatatttgatcggattcatacaaaatcttaaaaataacatattttagcagttttcgctgaaaaaaaaccatttatgcatttccccaaatttagccgccgaatgttgggatttggttgaaccgnaaatttgaaaaacttaaagcgaccttaatgtggcaaccaaaactggtgatatgga

SEQ ID NO: 13121 - DNA, 2827 bp, Heterodera glycines
tacgtttgctgtcgcgtgggcaaagtgcgcgttgatattggccaaaagcatggacaacacggcgggcacgccatcgcacatgtatttggtgcacaaacaggcgaaatgggtcatggcctgcacaaaaaaataaataaataaaataaataatggaataccatttattattaagcaatttatttaaaattaaaatatcgaaatattttaataaaaaacaaatcatatttttttttacttattttacgagaataaaaattaatttaataatttgtttttttaaatttaaattcaaaataaataaaccaaaatatcttataaaaaataaattataaaagaaattaaattttttaaatagtgatattttatttatattcaaataaataatgaaaaatatttttaataaataaattaaaatatttttaataaaaacaaatttacaacttttaaaattatcgctttttcccttggcattgtgccaattcccccccccccccctctctctctttcccatccacctgataaatttgctcaattccgtatcgcattgcaaactcatccacaatctgttgaccgttttcgtcaaaatacagtgtccatgccgtgtcgtacgtgttcactaccgtatccgtcgtgccggccatctgctgttgatactgtttgagttggtgctgctgctgcttctgtgggaggcgcacctcgtcatctttgtactggtactgaatttcgtcataaaaaaagcatcataaaaatggttataaattaaaaaaaaattttttattataataattttgaaaatattttaaattaggtttagaaataaaattaaaattttttttatagctttcattggttgcgttgaaccggcaaaaaatgcatcataaaatggattttaattaaaaaaaaaatttttttgaaaatattaaaagtaggagggtattaggtttaaaataaaattaaaaaataaatatatattttaaaaaaatttaattaaataaccttccttgttgaaggctaaaacatgaagaaatttttgaaagttaaatttgttttagaatttcaaatacagtccgatgcaaaataaaatccaaaatttatttattttcaaaaatgtcaacatatttataaaaataaaaaaaaatacagaattattatatcagtttttttcaactcaaattgctactaattaattggaaaataggcccccgggggctctaaaacggtaaatcatttgttgcgtgtgtgtaccgtaccaggaacaaatgctcatgaagacaggtgtactgtagatggaacggtgccagccgctcctcgccattgatgtccactttgatgtgcagccgaatggcaccgctgacaacagctgatgatttgtcggtccttttttcttcaaacgaagaaaataacatatttaaaaagaggtattgaaaatttggacaactatttaaaaacaaaaaattatttaataaattattgctgtatccgcagcattcaaaatttcatattttgtgcataatgtacattgccctactttctcccgaccaatcccgtcgtaaacttatccatctgttcatcccatcccaagccaatcctatccctctcatttccaatgttatcgtgccatttcttcctattcacctctgttgcatatgccatccatttctcttattcccttttgtgtttttccgtcattacccctcatcctatccaaagtccatccccattgtgccagtatataagtccatccaatttccccctcggggactgcgagatgtctgcggtgggtcagtctgtgccgttccttgcctttggcaatcctttcccaaataaccaattgcactgacccacccaaaatgctctgaggttgttgttacccaaacttatttccggtttttaacttataattatttgtcaatgcttttccttataataaattcctctctcttaaaacggtaatttgaaatggcttgaagccttaaacccggggacacaacaattattattttaattaaattatggaaaacaaatttatttctcaataatttttagtttttaactttgaccgattaaataataaaaataaaataaaataaaatttgtttataaatatatatttattcaaatttcccaattaaataataaaaataaaataaaacttgtttatatatatatatatatatatatatatatatatatatatatatatatatatatatatatatatatatatatatatatatatatatatatatatatatatatatatatatatatatatatatatatatatttcaatgggataatagaaagataaaataaaaaattaaatgttcgaaaactggaatatttaaaatgatgataattattttatacaagagataaacaaaaattaaacataaataaaagtaaattaactatagttaaagataaaaaagattacaaatttttagaaaaatttatatttattttttattaaagtggaatttgataattatttacgcaatctaatagaaattgtttttaatgaatattattagcttcctagctattcttctagattattattgaacctgataattatttaaatacacacaaaaagtaatgtttacagaatgttaggtgtagtaactaattattgtataattaatataattttaaaaacgaaattaagcaagaattaataaataaaaaataaaattaaaatataaatggcaaacagaaatttgccggaattattacagtacgaaactaactcatcggcctcttttaccatttttctttccattttccaccatttgaaaactttatttttaataaaatttatttcttg

SEQ ID NO: 13122 - DNA, 1207 bp, Heterodera glycines
  misc_feature (78)..(78): n is a, c, g, or t
  misc_feature (186)..(186): n is a, c, g, or t
tttggcactccattttggactgccctccaaaattgagtttttacgacacgaagagcctgaaaaaatcttcaattaaantaattaattttattaaagagatttttgaggtctttaaaagttaatatagctcataaaattttccctcaaattttggaaatttcgcccaaaacaccgagcacatgaacnaattcaattttccaggcaaacattggcttattctccaggattttccagattccagagttgggttattttcggaatattaatttcaagtacactttccaggactccatcgactctccctcctattggccccacctgctgctgcgttttgtcgtccacgctgaacgcgtccgaaatgcggcggaacacttccggcttgttgcgctcctgggccttcattcgatcgcggatcactgcaaaaaaaaatccaaatttttcaaataaaatttatgtgtgcaaggcttacgtatttttgattttttttttctgaatttaattatttgccaaatacaaataataatatttattcaagaaatatatatgtggaagaatatgatttttacctaacaaaacccgagaaatgagttcgaaacaaaaaattatttaaaaaacaataatgtcagaaaataaaaaaacacaatgccaaagccaaagcaaaaaaaaaaaggaaataaattttaaattaaaaaaaatcagcacggcattcaacccattgttttaaaaattcattttatacaaattttaaaattgtatttcccaccttgtctggccaaaccccacaaaaggccctcacactcatagcaccagatggggggagtctgaaaaattgtgccaacaaataaaaaatttaatgccaaaattaaaagaaaaaaaaatgccaaaaaagttggaccattaagccagtgccagtctcacctgctgaaaatttgttgtgcaaaaattgtgcggtgttgtggtggcactgatcggatagatcagtgcttgaaggcactttctgtagacgagttgtttctgtgttaaaaaatatggagttaaaataaatcattaaaatatatttttatgtgtttttaaaataatgtttaccgtattttctcaaattatatgcccgtctccattaatcccccccccgtctccaattatcaccccctttctgaagagattgaaaaataatatacccgggcaaataattagagaaaatacggta

SEQ ID NO: 13123 - DNA, 3140 bp, Heterodera glycines
  misc_feature (3057)..(3057): n is a, c, g, or t
  misc_feature (3096)..(3097): n is a, c, g, or t
  misc_feature (3118)..(3119): n is a, c, g, or t
  misc_feature (3124)..(3125): n is a, c, g, or t
aggaatcacttatggtgcatatccggatttctgtgacatctaaaagtcccggggaatcattcatacgcaaagacgtgctggaacttcgtcatcggttccatggcattctcgaccgcttctttgtattcctcaattttccattttcgaaagggcggcgtcgaaagcttcccacttttataccaatcgtcaaagactttgtacatattcgcacgttccttgagaagattccatcgtttcggtcatcatcttttattctgttttacctccgaatgtccacaattgtaccatcgcgacatccaaaagccgtacaaagtgatatcattgaaaatcaacgaggaagtgggcactaaacggtgtaaatgtggtaattaatatcggggtaggtggaaatagacccaatttccataccttggaccgggtttttggacattcctccgtaagtgaccatgcacccgccattggccaacgctctggtaaggtaagtcgtgcttttcccaccgacgcaattcaacgccaattttgctccaatttttgacttcactgccttggcgaactaaacgaacaaaaaagcaattggaagaattccctcctctttcggtacctcctcctccgtaaaaacctcagttgcccccaattgtttgagctcatctttcatctcgttaatttggggtcggtcacggacgacgctgatcgatttaaagcccaaatttcgacacatctgttgagggaaaaggagaaaaaggataaaattacaaatggttacgtttcgcattaaattttcatagttttggttttgaaattaattgcaatttgcctgaataacgaagcgtccgacagcagagtttcccccgttttgtaccacaatgtcaccggggaccaatttggcatagtcatgaagcattcgataggcggtggacggattcacctaaaaacaaagatttggaaacaggccgaattaaatcagacaaatattttgcatttgtttacttggagcattgccgttgcgattgagtcgagttgcaaagaactgtcaatagggaacagttgagtcgactgataaatgccgtgggtacaccaagtgccaaggccggcattggtaggaagaacgatgtcgcccactttcaactctcgaacgttggaaccaatctgaaaacggcaagacgaatgaatatttggtgcctgattattatgaaaaaccttctcaactcgggcacagccttcgttgcccgcaacggcaggcaaaggtggcttaatcggatacactaaaaaaggtttaaaacgtaagaaaaacatgacggaacgttacggacccccctgaatttgattgatgtctgacggatttatcggactggccatccatcggacaaaaacttcgtttgctccaatggcattttggtcgattttttcgttgctaagtttgaggacctgagacaaaataaaagatatacggcaaaatgatgcatatataaatgaatatattcacctcagcgggattcccgttttgctcataaataattttggtcgaagagcacaaacggcgagacgtccatgcccaacgatgcacccaccgaatattggtagaacaattaacacccgcaaacaccatttatgattattactaaattaaagcctacgtttttttcgtgccgtagaaaatttcgctaattgtaagttaggtacttcggtaatagtaaaaatccaatttgtactgccccggaatctccttcaataccgtttatagtgctattgaactttcggaaagtcctttcaaaaatttttaggctttataggcgctaaaaataaaagcctagaagataggcactaataactcgaaaagtagcttaacaacagcccaaaaaaacatgtttttcgtgcgtttcaggccacgggcagctcaggaaaaaataggcttttgcctaaaaattggaaccctatacattagtaacactgccaatgcccataacaggtggttgctgcgcatgaaatttgcgcctacgtccaaaaagggatttttcactaaaaaaatgaaaatctattggaaaacagccagaattgcacacacattgtatcatttaaacattattcaaaattttgggggcaaaggtatagattattggtccctaaaatttttttttaataaaatttgagaaaattgtttttagggatagtcttaggcgcaaagcacgaatccggcattattttggctgtttcaaaccccgaaccaggattcgaacatttggtaatactgtcgatggtaccctctttcttgaaaaattttaatttttttctaaaaataaagttgtttcggggtttcagggtcgaagaacccgattctgacatcaatttcgaccaaattcgaaccccgaacccagattcgaacaatagttcgaaaatataaatttctcaaactttacatttttggttaaaaatacttagggtggagcataatttttgatacccaaattttttccaattttaaaaaattcataactccgttatttctgcgcctatttaaatgattgtttttttattttgttcttcatggtgtcctcttttatatcttactatcgtttcactttttatttgattgatagatttttctgccttttttcccgaccatgccaaaattgaaaattggcccactaatttttctcgaattttttatggtcaaaaaccaaagctgatataacaaaatcttagtttttcactacaatttagaccagtagaatccaaatatggccttaaatgggactatcttttcaacctgagcttgtactgctccaactccatgcatgaagttcgagctgtacaggtttgttgcgatcccagagaccaaaactaagaccatattcgaactcaacatacccgatttaccttgtttaattaaattcagaatttccaaaaccacttttaaaacattatgttacttggtggtcttgaaaaatgccgtttttggagaccactttcagtctcagctctccaataattcaatttttgtaattaaattttatatttttgtgttcttatagtcctaactttgctctatttatcactatntctctggctctgtatctcttttattttctttaaatcagnncatcaaaatacgtacctatannatganncattttacttactta

SEQ ID NO: 13124 - DNA, 2241 bp, Heterodera glycines
tgttacccaatgaagttttaccttttcgggtggaaactttgaaaattaaggacaaaatttgcgcacagcttagcgattggttcatccgctcgatggaagagcgcaaatgggccgaactcaccgagggcatagactttcgcgacgaagtcgacccggtgcgtcacctcggcccagcgctgtcgcccggcacattgttcgaaatgcaccgacaaaacgaacacagcggcggcgaagacgacaaaagcgggacaaagtccgcggaggaattccatcggcgagagggaaactccgtgttctatgcaatttgcgatgaaagcactgcacaaatggcatcaacttcgaggtgtaaccgaatggaaaatgggggagacaaagcaattggaaaaggaaatttaaaaccaatcgaactcggtctgttcagaaaaaggaattttatattgttgcaattgttgggcattacccgtaaaatttttatttggttgaattacgaacagttaaaaaatttgggccctgaaatgtttttgcttccacaattttggtctttgacaaaaaaaagtaactgtaccaatgcgaaaaggaaatcagtttggattttacttttcaattgttgacacaaaatgccaaaggtcttgcgatttgtcggcccgttgctgtgacgtttctccgccacctccgccgatggaccgccgacgacggcacagcaacgaattgcggcaatccctggaaaagggagccgaaggacaaggactgcttgcgaagcggacgaacagcattcagcagctgatcagtgcactgtccgagaattcgccaccgtcgccaaaagttagttggccatccatcatttaaatgtgtattttagaatagatttgtgtgatcgatgaatggttgtgccgattgatcacctttttaaatagcaattttattaaattaagcgctgatttgtcttctcatttgactgttttttccgttcagtctttgcgtcgtttcgatgcgttgcgcacttttccctttccatcccttcgcgttccgttccgaaagtggcgaccgcccaaaaaggaattcatttatgagcactcaaaaccgatggagtgagttggggacaatgcgatgggcggggggagagaacgggcggaattgagacggactggaaaagtttttccatcgggcagtgggaacctccccaaaactcctggaccgtcgctgattaccaccccatatttgacaaatagatagagccttcttcaaagcctaatttgtagtatttgatcaactgtaaaatagtcttttggtccgccgatttctcctctcccgcctaaaatgaaaaacattttcagtttcatcacccaattggcccttcagaagcaccgctgcgcgggttgtggcctcaaattggaccacgtttatgtgaagcggacgctctattgccattacttctcgaagttgttctgccagtgctgtcaccaggggacaaaagtgcgaaacatttgacagacaattaaactgtcaaatcaacagtaaattcatttagacgcgaatccctgcgctcattttgcacgagtggaacttcaaggagtacccagtgagcgacattgctctcaaatttctgctggacaacgccgaccagcccgtgttcgatgtccgactggtcaaccccgggctgtaccgtcgtgcaaagaatttgcgcaaatttcggaaattgcgcgtcaaaatctcacatatgtggcccttcgtgcagatgtgcaaattggcagccgaactgatgacggaaaacggaatgtaagtgcactcttctattctggggaagatgaaaagacaaaaaaaaaacggtcccctaattacttctatttttgaaaaatcctcttaattaaacagtcggttcgggcagccgggaggcattatgcgtatccaatttttaaactattttttatttttcgcacttatcatactataactgtttgtgttgcttttccccttttttaaaattttatttttatgccttcaaaaatgataattcgtttagccttaggacaatgttcgcctctgtacccaaacgctttttgtcgttggagtcggtggacgtttactcgctgctcgactttgagcgaattgcgaacaaaaatctgatcgaattggttgaaccgttggctttgaagggcgccgcgcacatcgagaattgtgaagtgagtcgtccccgacggcattttccgagggagtggcacggcattcccccccccccccccc

SEQ ID NO: 13125 - DNA, 1534 bp, Heterodera glycines
ggacagatcggcttgtgggtccgattgaacaaaaataaaatcttatcacccgagtttttcactttttttcatatgcttcgcttgtgtctttccatccctcttatttcctcctcttttttgaacatagtcgcgttaaatgattgaaaataaatgacactgaaaaaccatcaccaagcagtgttttcataaagacatttccctcaaaaaagaaatgaaaataaatgtttgaaaaatgattttatcgaagaggtaaaaaattaaacaaaatgttgagaggaggtcctttggaataaaaggttgaggtaggaagggggaaaggaaatatgaggtaataaagttagtaaattggtggcttaaagttttttgccgatcgattgcgactccgtccgatgcttagattaaacgaaaatttgaaaaatccgaacggactcagcaaaaagttggccaaaatgtgcccgattaagcccaaaaagcatcggactcgccgcaatcggtcggccatcactttctctcctcggcacttcgtccgcccctttttcattgctcttcgccagcgatggcgtcgccctccctttcctcgccgtgcggcgccctttccttggttggtccgccctttttctgttctttgttgggacattcggaggccaaatgggcggtcgattggcacacgtagcatgccttcacattcttttgcggcattcttttgcattgcgacgctttgtgccgtccgtactgaccgcaattgtaacaactgaacggaaaaacaaccgaatgctttcaagaaacaatttgaaaaattctcagggtttgattaaaaaaaagtaaaaaaatgtctattttttgaaaaccacagaaatatgtctagatttctaaaaatccggaaaagtttttgcgccagaatcttgattagcgcctaagactacaatagaaaaatgctttcctttgttcggttcatgaaataacggaaaagtacccagggttttatttattttcgagggagaataccgaccttgaggagtcacataatgcgggggggggggggaggggaggaattatgcccaaatcggatgccataaaagcggaccgaatttccttctccttgcgcttgcccagcgggtgaatgcgatgcccgcgcagaggcgcccctccgatgccgcacacttcggccgcctccatgccgcgcttgccaagctgcacaatgaattccacctgttccccctcgtccaacgaacggaactcgggcattttgagcttcgactggcaaaggggcaaaagccgattgattgatcagtcagtgattgggggaattgagcaaattgccaactgctgctgcacctgatgtacgaacacgtcgtccgcgtgccgcttggcctcctccatgtccggcacgatgaagccgtaccccttgctgacgttgaaccatttgcacaccttcatggcaaattaagcaatgaaaaagcaaaacaagatggccaacaatggcattttctctaatgggttaatctcatggaccaaaactgtactaatccatgaa

SEQ ID NO: 13126 - DNA, 2618 bp, Heterodera glycines
ttttaattaacaattatttgccatttcggcggattgatcgttccctagttggaacaactttgtgtggactaatttttggaactgcgccttctctaggggaggcgcaaaaaatatgaatcgcccatttcggctgcttgtattttctttcaaaggacaaatagcattacaaatttttggactgctccttctatagggaaggagcaaaaaacatcaacattaaaagatttttgattaaaaaaattagaagatttagcaaaatcttatttaaagattgtaaaaatgtacttaatctgctgaaattagcattgtcgaaaaatggggacaaagtgtcaacgaattgtacgctgaaaatgcaaaaaccaataatagtgaaagtgttttaaaactgccaaatgttccttccttttatacctttgtctgtgaacccacaaaaaaaggatgtgcaaatttttgtgccttttcagtgggattcgatggagtataaaagcgttgcatttttcctttcccaaccattcattctccactccgttctccgtcattgtctctccccattttcggcaatggtactgaatttttaaaatttttttttgaatcttatttatttttatttttccaaatttaagggaaacatttttggctctgtcgctgctgatgaagacaattttgagcaacgcactcgccaattcttcgccttcgtcaacgagggaaacatcggacaattgcgtgcgctggtcgactcgctggacgcggatgagttgagcattttgcagcggatgaaccaaccggatgtccaaaatcctcgacccgctctcatcaacgcaatgctacacaagcacacagaaacggcagttttcttggtaaaagaggggtttttgtttgacggtaatcggcagcgattgatttcccccattttaattcagttggagaagggcgcagatccgcagcagactatgcttggccaactgaacggcttggacatgagtgagcagcagcagcaattccgcctcatttgaatgttgtccccaaatttacagatgtgacgccgctttgggccgctgtcgtttttgccgatttggagctatgccgtgcgctgatcgtccatggtgccaacgtcgaatcgggaacggactctggcgaatcggcgctgctgtgcgcatgtttcaatggcaattcggacattggtgaggcaaatccatggatgccgctgtaactgccaatgtttttcccattttcagccactcttctcgtccagcatggcgccgacgtcaatctcgcggacaccgacggaattacgccattaatcgccgcttccttttcgggacaggtggaagagttgaatgatttgtataagtggtgttgtcgcgttttcttaggtcgacattgcgcgcttgctcctttcacgcggtgcaatcgttgaacagactgatttctcgggtgcattttgtctctaattgcccaaaattagtggattaatattccttttttcgacttttaggaacgagatttgcgcttatgggagccgccattgaagcccgtttggaagtgtgtcgtttgctggtggacgaatgggcagcggatgtcaaccaagaagcaatcgatggcaccacagctctgatacgcgcgagcgatgagggacacgtggacgttggtgagaaaaaaatttttgtgcaaaatttcagaatttttcctcattttccagtgaattttctcatcgaacgtggcgccaaccttcaccacaccgacatggacggatacaactcgttgatgtgcgcagtgagaaacggaaagactgaaatggcacggcatttggtggccatcggcgcgagaactgaccaaattggcactgatggtgagcgaaaatgctaaaagttgccccacttttatgtaacaaattttctcccatttaaggcaaaagggcgcgcgatttggcggaagaaggcgaaattgccgaaatgattgacatttttcgtcccgcggctgagcagcgggagaacgtcgatgggtaaaaaatggtgttttttgatttaaaaaaacatcaaaaattcaggcaacagaacgagcaccaacagcagcggatgtgatcggatgagagggaatggcggctcaaaagaattggacggaagtgccgaattattcggaagatattccaatcatttatgtacgctatgtatttgttcatatttgaactcacttgtcatgtttgtctgctctgagtgtacatatcacataatattcttttgtatgataaattgtaaatgaattatgatcgagctgatttttttttgaatattttgtgattttttcggggtcgctgatcagtgatcacgaatccgacatccatttcgaccaattccgaatcccggacccgacctcgaacaaaaagtcgaaaattcaaatttttaatttcacatttttttaacaatttatagaataacattttggtcgtatttttaggcacttaactttataaatagcggtcggggtcgttttcgcgtggccgttttcgcgtggccattttcgcgtggccgttttcgcgtggggtacgttttcgcgtgagtagctgtttaggactgaaattggtcggatttgtgcaaaacatccatgtttcgaatccgaac

SEQ ID NO: 13127 - DNA, 1011 bp, Heterodera glycines
  misc_feature (15)..(16): n is a, c, g, or t
cctgcagggtcacanncgcccatttttactttttgttttattatttatgcatcattttattatttggtatacaaaactttttttgtttttaaaatattacaaaacttaaatctatgtattacttgatttctcataaattttatgattttagctagtaagaggtaaataaatattgtccccgctcagatatatatggcgggcgaatggtttacccgaactgactttttaattgctttcttgaaaatacattttataatgcaccttttagatgctcattgattaatggtttattggtaatcggtatcaattagctattttacaaaaatttattttttttttgcccatttatttaaattatatttttggcacgatgagcaaaaaaaagctacttatttaaaaattatttcttgaccatgatgcatttatatatactagcggggtcagcgccttcggcgcatcccccgctaggtagtacgcttgtattataggattatgaatgataaaatcgactggctcggccgcttcgcggcctcgcatcctattcttggctttttctccaatcgccgggactcaacccaccagcatttcaatcactgggactcaatccaccaacattccaatcaacgggactcaatccaccagcatttcaatcagtaggactcaatccaccagcatttaaatcactgggactcaatccaccagcatttcaatcactgggactcaatccaccaacattccaatcaacaggacttaacccaccaacattccaatcagtgggactcaacccaccaacattccaatcaacaggactcaacccaccaacattccaatcagtgggactcaacccaccagcatttcaatcactgggactcaattcttctgcatttcaatcactgggactcaagccaccaacattccaatcaacgggactcaacccaccagcattcaatcactgggactcaacccaccaacattgcaatcaacgggactcaacccaccagcattcaatca

SEQ ID NO: 13128 - DNA, 2184 bp, Heterodera glycines
  misc_feature (108)..(108): n is a, c, g, or t
  misc_feature (2154)..(2154): n is a, c, g, or t
caatcactgggactcaaccctccagcatttcaatcaatgggactcaatccaccaacattccaatcaacaggactcaaccctccagcattcaatcactgggactcaacncaccaacattccaatcactgggactcaatccaccaacattccaatcaacgggactcaatccaccaacattccaatcactgggactcaatccaccaacattccaatcaacgggactcagccctccagcatttcaatcactgggactcaacccaccaacattccaatcactgggactcaatccaccaacattccaatcaacgggactcaatccaccagcatttcaatcactgggactcaatccaccaacattccattcaacgggactcaaccctccagcatttcaatcactgggactcaatccattctcccgaattcaaatcactggactcaatctcatcaatccttcatcaacacaattaccgggactcagttctccgacatttcaatcaccggaactcaacctcagcaacggaatacagaactatttaaaaggaatccagaaattgaaatataacccataataaatcaaaacactatggtgtataattattgcccccaccccataaattcaaattaaaactgacctgtttaaaactttccacctaaatttgatcccgcaagtggcacgtcaatatcccaattgcatataaatattccactcgagcacaggcaaaacatgagatgtagcatttatattgctttttctatccatcaaaggctttttctttcattgtttattactatcataacatgctttttattcaaaacaaatatcaaaaaccaaatcagattcttttcatattataagcaaggaaaagtacaaaaaacgtttttaagtaacaaacctttttcattcaagcgaattctaatgcatttttttaaccaaacaattctccattatcgtttacataagcaaaacaaaagctttcacatcaaaatcaaatcaattaacaaaaacaaaatttagacaaaaaaataatgataaacaaacaataaattttttcctacacacaaaaacagaaccttcataaaccggaatttccactcaaacaaacacaaaaatgtgctcattattttattaattattttatataataaaagatgggttataaataggaagggatgcgagagaaatttcccattatctctcccttttctttcttttactctcttttcttttccattgcaatttactctctctgttttcccactccttctctctcccacacacacgcacgcatccagcagactgctgctgcacagcagcacgcgtctgtttactgtatggccctcccacccgccgctgcccgcgtagacagacaatcagacagtgcactattttcccacctttccctcgctctacttttttcaaattcatttttaacgcaaaactcaaacaaaacgccacacaaattcaaacactggacacacatatacacacactcaactttattatataagatttaattaaattttttagatgtgcctttttttacattatcaaaatttaatttttaataattatctttagtttagaagaaaaaatttttttcagcataaactcgtattttgaataaatatttttaatttaatattctattaaatttcatttccttccgccattgcgcttttcgttgaaaaccaatttttattatttttaaataatttttaatacagttatctaaaaatcggcttaaattttgttaaaatatgagttatgcacaaatttttcttatatctaataccaaatcctatattttcatgacattattgtaaatttgtttattttatagttttattttgtttaatctgttctctgtcaaatctcaatgtttaggttaaattttaagttaaaccattttcccttgattctttactcgtttttttaattttataatatttttgttttattgtgatcatattgttcagttcaatcaatattattatttaatgtatcaattaataatcaaaaattataaaatcatatgcatttaaaaattatattgctttatatttaaataaaaattaattcttaaaatattgaaatattttatacgtataactcacttttaatttttgttgaaattaattattattactaagctnttacttgtttaatatcacctaaaattgggc

SEQ ID NO: 13129 - DNA, 2012 bp, Heterodera glycines
aattttaaataaattaaaaatttattttctttaaaaaatactttaaataaattaaaaaaattttttttttcgaaacaaaaattcaattttttgttgttaaaatcaatcaataaacaaacgttagagaaccgacgaaagatcgttagcgtcttttcccctgctaattaccaccccccccccctattttttaacatttttaattttgttttaaacccacccatagggcattaattttttagatttgtggataaaagtgttcacatgagcgtaatttcgatcaaagaaaaaaatgtaagattctaataaattttgattatatttaatccggaattttcttttgggttttccggcaaagacttttttacgctcatttatggccaaccaaagaaattagaaattaattttttttaattattaaattgttcagtctaaagtctaaaggcagggacggtcctgggattttggctttgcaggggtaccgtccgtagtgggggacgaccattttttgtggcgcttttttttttaattttttgggtaacaatagaggaccgtcggtacagacaggcgcagtcggaaaaaattcggaaattttcaccatttttaacagatttttgccaaaaactgttctgttgttgatttttgtaaaaatttagcgaaatttttttgaaaatatatgtgagtaagtaacctattaatttaacaaaaattaacaaagcgagcagcagatgagtaatgaaatgaatgaatgaatgtatttgggggggggggggggagaattgaagacggcgtttttacacatagcgcaaatttacgaaggcgaggatcagtcggaatgatcgctgatcagccagccgatcagctaaactgagtattgtgagtgagttaggaccataaaacaattggaaatgaattaatgttggggcgacccataattcaaatattgttgtcattgggttcgttctttgaacggaccaaatattgatttgtcctcctctcccattaattccttccactcatttccccaattcattctttccaatttgccttcgcattgttttccttccaatttttgctccattcctccgaccaaatatttgtattttatttttccattttcttcaataaaaatattttattgtgttgtccacctgcacaaacaaatactctaatctttaatatttacgttcgtttcatgtttatttaagtttttttattttatattttgttatataattcgcttctttcatgctttgtatatttattgtattgctaaattgattgctcggtgctaggtcaagggacaaaaagtgtaaattaggcgatggacaaaaagtgcaaaatttgcaaaatttttgactaaatcaactcataacttttttccgacgcaactaaaattgcataatcttggcttgatatcatgcaattgccattgagttgcgttattagcttgctaatttcaaaaaaaattattattttttcaataattatggattttttcagttttagactagaacttttgaaaaaatttaataattttttttgaaatttagcagcataataatgcaattaaagggctatcgtatgagacgaagattgtgaatttggtttcgtctgagaaaagttatgaatcgatttaatcaaaaatttagcaaatttagcactttttgtccatcggccaaccacggattgctctagattaaaatgttacaatataaaatataaattcttttacccttttcataatttaaaacatatgaatgtgctattttttggttattgttttgtactcacagcacaaaggataagaatttatttagatctttattttaaaatccttccaattaggtggattattattatataataattcgaaaatattttttcaaataaattagagcatgttgatatgttagtttcaaaattttacttccaattttttaaaagcattaaaaatattgattcaattggaggaggaattaaagtggaactaattttttaattaatatcttata

SEQ ID NO: 13130 - DNA, 2122 bp, Heterodera glycines
ttctctctctctttctcctctttctatctctctctcagagatcagattagagagtacatatgcataagagacgggtgagagagtgcagagactgaagagagagtacagatgtgtaagagagagtacagatgtgtaagatacgggtgagagagtgtagagacggaagggagcagtccgtggactggtgagagagtacagatgtggaagagagagtacagatgtctaagatacgggtgagagagtgtagagacggaagagagcagtccgtggactggtgagagagtacagatgtggaagagagcagtcagagagagattagagagtacagatgtgtaagagaaggtcagagatggtcaatggacggaagagaacagttagagataggtgcgagatagtacagatgtgtaagagaaaatgaatgagttagtgctgttcatagcgtgacagctgcctgtatctgtcataactattcagctttttccttatgatgagattaaggtcaaaagattgaataagcacatataatgcctcattcattcatttcaccaaaacaatgcgctgtaaacagtccctgccctcaaaaaattcccaacctccgatgtggtggtatgatccagaaagactggattatataatttttaaaatgattggattatataaattttaaaaagatcgattatataatttttaaaaaaagatcgcatacaaatttttaaaaagatcgattaaaattaaaatttttaaatttcgtccgtccttctcccactcattcctcatcgactgaagacagcacttaaaattattgcataatttcaaaattaaaaatattcaaaaagaatttttaatgtaccatgggctggaatgggcttctttttcttggtcggaagtccatccatttcgtttttgttcggcatttgctgttcggtcgcctttctccccttcgagacttgcttgcgctgtatatttttgatttttaaaataaaattatttaattattttacccgatacgcattggaggatgaagcagcgggcggagacagccaactgtcctcgatgaagccgtcggagttcacttctcgctctgctcaagcgccgaacaaaatctgcatatggcattagtcgctttttctgccgtgtggtcaatcgaaaacgcgagataacaatgtttaaacaaatttccactagcgctaacaactgctccatatttgctttccgaatcagcttccgacattttttacttgatttagtcctcgccaatgaacatagccaatttgaattttgtttaatgagttgactaatttgtacttgttgttccatttttatgcacaaacacaactaagccttggtcctcctcctgctcgtccttaaatatatttgtgcgaaggcgtagtacggggtccgacgaggcgtgcatgtcaattagtaaatacccatatgggcgagcggttgccttacggtaggcgtcaaaaaaaaagtcgagctgccgcgggaaaagctgtactccaatgttacggatggacaacagggagttgggtgcccgcatcagtaccaggtattgagctgaaaggcgggcgactttgatctttcgctcaaacaaattttgtgtgacaaaaacaacagcaaattgttgatggtgggactttttggtgaataaatccgacaaatatcgctcatcaatggggacagccgggttcatttcaccaaagcaatatagagtggaaacaggttttggggcaattaattcatcagattcagcaataaatttcagcaaaaattcacttttacccgatgaagagggacggtaatttaaagcaaatatctttattggagaaagaattaagcattttcgtgttaacgaacaataatgaaatgtgacattgttgaatgggaaaatttagatagaattttacaaattagtcgttgccgcttggacactctcatagaattcctcagcggtcttatcaagagtatttttgtttttgttctttcttttcggtggcgcctgcgctgcgatatccatcattttagtagccgccgaaggactgtcgtagaattcttgcaatttcttttcatccctagtaaggtttaggtggaagcggtggcggaattttgtcggctggtg

SEQ ID NO: 13131 - DNA, 2151 bp, Heterodera glycines
attttgtcggccggtggaaacggtgggggcattttgccggctgacggaagcgagatcgtttccattttctcgattggtggaagcggaagctcttccactttctcgactggtggaagcggaagttcttcggtcttcgtttcggacagcgaatcggccagcaacatatttccaagaatgctaattgcagttttggctttcttccagcgttctccatcatgcaatgcatctgacagcaatccctgttctaccaaatcgagcgccactttcgccttccgcttcagattctcttcctcacgcaatgagtcagccatcagtccctctccatcaagtccagagcagcgttggccttttgtcgcaagtcgttcttttgctgctgctgctgctgctgctgttgttcttggtgttttgggaatgtgatggcaggcagttctccgtaggggatgttgaacacgcgcgccttgttcttcacgcggaaaaagcagtgtccgggtagatcatagatgatgtcgaacggtacaaattgaactttgtcgaaccgtgtacaccaaatggtgatgccttctttggtgatcatcgtgtccacttccacctcggttcccttgcaggaacggcatcggccggcctcatcaaaagggaggaagcgaggggatgagagacgggggccactaattgtgataccgcttgtggtaatagtgatgtcggcttcgccgagaatttggtggagaagccctttcttgtcttgcatgtttatcgccatttgatgattgtgttgggaaagaccaaaactacagcctatttataggggcaacgcagttcgggtgtggagaaatagtgcaggtgtttgatgatagccagagaaaaagagcgaagagatatagtactggtgtagaagagggtgtcaaactaaacatctgtcaccccgcacatctagctccatgccctactcccaattaattaattagtaccaattagtcatcacgaattaccaccccacccccatctgtcggcaagttcaaagggctgcacccctcccataggcttgggtttgaccaattagcacattagcacccctaattacaccacctgtcacttctaattagcgtcaacctccaacggtcccgggggggggggggttactactaatatcaggtaatttctgcaatgaaccaaaatcaccaattttttaaaatttttcatctttttaaaaatatttttatattacttaaagttaaaaatttaggtatcaattttataaaatatttaaatgtaaaaaagtatttttttatgcattgcttttaatttctagaataaactatatttaattttgtagttatttttttaaattttttttatatttatcaatttcagcaaaaaattgtgttcacttactttatacattttttactgacgaattatcaactgcgcaaataataaattattaaatttcttttttatatttatttacaattacatatttatatataatttgtatatgttttttattcctaaatgaaatttgtttcttctctttcagaatttattttcatttattcttatctaagtatgactgttaattttttaaccataatttaatgtcgctgtaatttcttttgaatagttaatagatctccttgtttctcctgttatttttttgttatttaaatcatttttttcaactttgattctagaatttaaaaaatagtttttgacattagagtgttttatattttattggttgattaattgaaaaaattacaaatcgcaaaacttacagagaaatagttccttcggaccatacttgtccttccatttaataattatttttattgttatattttttctatcagaataatatatatttatttttattcttcatatatggatttattaatttaattaataaatttattatagattatcattatgatagttgctgtgaaaattgatgtattattttattttgttatatcttttatatattatctattaagtgttttatatgggttttatagatcaaaatcacgcaaaaaaatgacccaacacctcaaatgcataaagtttgaataataagacaataatagcagtgaattatttttatctttttccataaaataaaaatcattatcttgtaaattttatatatttattaaa

SEQ ID NO: 13132 - DNA, 3484 bp, Heterodera glycines
ttgcttctccatgcgtcctcggcatctccagatttctttttctttgaacagacgaagattttcctttgttttttcctctgttggaaattgttgttgtgtttcccatatcagcaaatgttcggatgcacataactcgggtactgacagtacgcccttgtcttgattccagtgcttttttgggcccattttgctcagaattggcaacaaatttccattgtatttgttttttgccaccgaatgtatccagcgtaagacataggcacccacggttttggcctttttccagctggagtaccggttcatatcaatagttggctggaacggcaccccattcatgactgcggctgtttttatttcttcatcttctgcacttcccctgagcttctcttcatccgggtgataaacttttgctggttttggccacagggccttttcttccgataaccattttgggccatgcttccatagcaaatttctgctcaactctcttggtgttgtgccgcgtgatgccacgtccgcgggattatctgcactgaccaaatgtttgatttcaaactgtccacgtatttttgctaatcgatttgaaacaaatcgatcgcatttcttatgctccttaattcgttcaacggaacacaagctgtcagtccaaattgttgtctgtgacggtttgaatttaagatgttggagcacgtactttaacaacttcactcccagcgttatcgattgtaattccatttttggaattgttgccgcaacatctgatatgttggagggcttcaccaggctcttggcaaacaccaaatttgcgctcattttttctgtcgattcccggatgtaaatggcaacgcctaagccttttccgctcgcatctgcgaagcaatgcatttccttgtccacttcgtcttcgttgtcgactcttcgtgcgaatcgaatttggacctctgtcccctctctcgtttgccaagtctccataatttgattccattcatgaatcaattcttcttccaatccttcatcccagccgtttttggcttcaaaacgtttttgcaaaaaatgctttgctgggagcactgcaggcgccactaaccccaaagggtcataaatttttgcaatgtgtgccaagatgttcctcttcgtgtgctttccggcaaattttttaaatcggaagcaaatttcatcatcctcattcgtccacggaattccgagaacttttatctccctttggtttttggccaataattccacaggaaggcttcgtatggcgatcggcttactgcagaaaaattcctgcagcttcattcccccttgacggaacagctcgatcgattcgtggcaaatttgcgccatgtcttcattcttcttcacattgatcagtatgttgtccacgtacaaattctccattatggtttgcggtagaaccgtgtcgtagaatgaaagatgttcgcggatggttgcatttaaaagaaatggtgaagttgtcaatccaaatgagacccgacagaaccgaaacacaacggttctcacatatgttgggcttgaaatttctgtcttttgtggatcctccagccacagaaatctggtcgcgtctctgtcctcctctcttactgataattggaggaaggctttttcgatgtccgccaggatcagatccttcattcttctccatctcagaaggatcccggtcaattcgtttaacaataacggccctgtgtgcaagcattcgttcaacgatggggctcctttgcggttcgctggcttcgcggatgcatccatcacaattcttatttttgtcgtggccttgtctatttttatcacgggccgatgttggagataatgtaccggtccagttgattgtgttggatccggaactctttcgattatcccgttcctctcccactcattgaaaattttttggtattcttccaccaaattcaattctcgcaatttcttcactgtgccacaaagtcttgccctcgcttgttgaaaatttgtcggcaaatcctttactctttcgttccatggtaggccacattcatatcttccttctttgaatgtcaagctttttctgaacgttctcatcacttcttctttgtcgttttcttctggattgtcactcattccgattatgttcagcccgaaaaatgtctttatctgttcttaaatttcttcgtcagcatctcttctgctattggcacattgtaaggcacttatgagtgctccagtgtacgtcacttgcacactcatgtccgttgggccctggacttggccataaccacttatcatccgcccgactcgagacgttgacaatgtgaatccacttggcaacttttctgtctcgtctcttattttcaggtcatgtctgacatccattcccaacagaatgtctggttgccttggtcgcgatggaagtgaaagctttttcttgcttaattccacttcatccatcgaattcagcgtcacgatgggcatcgctttcacaatgaattccatttcattgagtgcgcatatgtatggatctccgttgacccccagaaatcctacgcggaccacattgctcacgtagcgtttggcttctttctctccgaaaccagtcaaatggcactcttccgtctcaatcactggaaggcctaattgttttgccacgttagcccggatgaatgagcgttcactgccgtcatccacgaaaactgatgcgatcatgcttcttttcggattggacggattgaagatggttacttctgctgttctcagcagcactcgtgaatttccttgcactgaattgcattgcgagggcgtgaatgagacttctttgaattcgtctcttttgtccggtttctcttcttcccggacgttcatgactcggtttgccatgtttttccattctgttaccctttgtgggtttgcctgatggcataatgccgttgggtgtgcttgctggcacttgaaacatttcattgggcatgggcaatttcttccgatatgatttgacttcaggcatttgtagcataagcccttctcctggaggactgcaaatcgttgttgcaccgtccttgccttttcgcaactgtcgtgtctgtgtttccctccacagaaaacacacggaagcagttccccttgagtgttaactgccgttggattccgttgaatttttgggcttcttccttgtcccttacggtctcggaatgcggaatttcgtggcgtctgctgaaaacttcgctggccttgcctcggatttggcattttttgttccggaatttttcttcgctctccgttgggttttccgaaatgtgttgtggctacattgactgagcctccgaatcggttccgccttaattgtcgtttgaatccatgctctggatttgcctctctgctttcgaagccatactctctcatgacttctttgattgctagctctttgctcaatgcacttcctaaggcctttaggagggatgacgtgtcccaaacagtttggattttttgcttt

SEQ ID NO: 13133 - DNA, 3628 bp, Heterodera glycines
  misc_feature (48)..(48): n is a, c, g, or t
  misc_feature (3570)..(3570): n is a, c, g, or t
  misc_feature (3593)..(3593): n is a, c, g, or t
attttttggaaaaattttccaaaaaacttagtaattcatcataatttntggaaaaatttcgagtttttaaaattcttttttgctaacagattttgctgaaaaattgcattaatttagaataaattaaataggtaacttacaaatcggagaagaaagtaagttgagggaaccactaacatattatttaacatagcggccaaaaaacgacggcgaacatttggcagataactgaaaatgagataaatgtccaaaaataaaaataaaactggcaaaactaaagaaccaagggcacccggtgaaggacttgacaaaatactttcatcaaatgttctttagctttgcctaacttaaaaaatactcgcgagaatgttgtcggttatcaaacgcgtaaataaagcccacataactgagtggcatcaaaatggcactgcccacatagatgagacattcttgcatagaaagtacctgtacggcaggaactagctcaagtattaaaatataaatatatgaaaattatttttataaaaatgcgggaaaacagactttttaatttccgatacagagtcaatttatataatacacatactgtatgtacatatgtataggtaaacgaagcaatttttcgccagtattttgccatttgccacaaaaatcctagccctagggattagtaatcccgcggcatctcgtccacaaaaaatttgagttccattccagccagtgatcctcaagtttgaactacctatccgggctccatctaatacttaattacttaacagcagagtcaagcaattatttatatgtattaacacaccgtttcaatttatcttggtatcattcgaaagcccttgatggggagaagctttttctaagcaaatgctaagcaattggattgattaggaaaaaatatgagggttcgaaattttgtttctcgaataactttttagttaaccctttttttgcttttaaaaacccttacattttgttcgtaatttttttctctatcggtgtgcaaaatttgaagaagatttaacatcagagaaaaaagttaaacatcacgaagtgaattcggtttttctctattaacagagataaagaaatagtacgccaaaaagagagatgtttttttctctgcgctctctctttattggttcatctctcgttttttgaaacggtgttaatttgacatttccaatggttgaaccaaaaattccaacaacaagcgattttaacgaagaaaaccctgtaaaatcgacgccagaatcacattcgttaatcaagaatggattttttatgagtgaagaatatgggatgacaacgaaaagtgtctacacttcacaaatttcacaatctgtgataaaagctggactttattctaagaaaaatctgggagtgcatgtttctgcggcgggtaagtaatatttttggttgatggtgtggcacttcacctttcaggtagtctggaaaatgctatttggaatgcaattgaaatgggttgtcgttcatttgcgttgtttgtccggaatcagcgtcgttggaatgcaaagcctatggatgagtcagttgttgagcggtggaattgtgcaattaaagtatggcaaattcgtagacaaagtgaccaattgagagtgggcggttaagcaaatttaagcgcataaattcccaaaaatatattttccattctttttatttatttatattttttaaggtgggatatggaattccccgggtccgttccctgaaatggtacagaaataaaatttattcagaagacaaaattcccgttgcaccaaatcgtcccacatggctcgtatttgctgaatgccgggtcacccgaccaaaaaaaattggagatgacacggaaagcgatgctggacgaatgtcagcggtgtgaaaggctgggaattcaattttacaatttccatcccggtatgattttgaattcccaactttcaaagaattaattaaataagcagtaaattgaaggctccacaactggaaagtgcacgagggagcaaagcatcagcacaattgcggacaccataaattatgtgctggaaaatacgcatcttattacgctcggtaaattgggttttgttagtatttttatttttaaatttaaaagtcgtggagacaatggcgggcagtgggaacacaatcggtgcgacatttgccgaacttcggtcgatcattgacggagtgcagaacaaagaaagagtcggcgtttgcttggacacgtgccatctttttgctgctggtagcgctttgtttttttttggtcgccttccctattttttataaaggctatgacattgccaataattataagggcgtaatggaagagttcgcttcaacggttggcttgccttttttaaaggcgcttcaccttaatgattcgaagggtatttggtaaaataaataatttttgacctttcatttttagagtgttgctcatcaaagctcgaccgtcatgaaaatattgggaaagggaaattgggcacaaaagcatttgagcaaataatgggggacgaacggttagacggcatcccaatgattcttgaaacgcccgaagggaaataccccgaggttttttgtttataattaaggtttgaattattttaatttataaccaggaaatgtcacttctttacgaattggaacgaattaccgaaccaaaggaaaagaaaaggcggaagaacaaatgaatttcatttagactatctaacttaagataagtgaacagaaagtgataacaataaatcaaaaacgatcttcgttattttaaaatggaaaacgatttaaacgccgagtgtttcttttgaggaagcaatttcgacagtttccctcatcttttgcattgtctgacgcgggtcagccgaccgaacgattccagtcccagaaacgatcatattggcccctaaaatcccattatttttcgtgcaaactaatgattccactccgggggacacctgcgttcgcacagtgttcgatgttgtccagtccgaccccgccgtccacttggatgtccaagtttgggtacgcttttcgcagttggcgcaccttttccatttggtcctgcataaacttttgtccgccgaatcccggttcgaccgtcctaaaggcaaatttcatttcgcacggtcattcttcgactccctttacaatacattatgagtgctgtgtcgatcttttcgcaaaacttcatcagtttgtccagctgaactttcgtcccattgattgtcttctatcccatgaattaccggcgtcattggtttgatggacagtccacatcgtattcccttggatttgactcggtcgatgagtgtgtccaccgcttcgtcctctccgagtgcctcccaatggaaagtgaattgatcgatgcctgctttgtgcagagggtcgagccatttggacgggttggacaccatcatgtgcacgtccaacttctttcaagggagtcagaccgaattttatggccctcctcaattgctaagccaacaaatggcaaaacaaaccgcgtcatttcccaatttattcctcagacattcaatgagcggatgtccgaacgtncaattcggcacgaaatgggctanagcaaaacgaaagaatgcgaggggaggggaatgat

SEQ ID NO: 13134 - DNA, 2565 bp, Heterodera glycines
gtagattttttttttgaaaaattcgaattttctttatttgatgttagtaccagtatcctcattcttctaaatatgtttcttaaaaaaaaatgtgtctaaaaataaaatataaatataaaaaaaaattattctaataaattgcaatttttttgtagatatttagtttcaaaatgctttccatcttaaatttgctcaaatatttaaacaatttctaaaattattcatttatttatttaaagaaattcattcaaatcaaattgatttttaaagttttttgattattttacataaaaattgattgattttaaataaaaatatttatataatttcttcaatcatcattttgtaaataatattcacatttgcccacagtttatcaatgtccgtaatcatcatcagctgatcggagattttgaaacgcgcacattttttgtgatttgcgacggtaattcaacggtaaatatttttttttgtcaaattttaaaaaataaaaaaatttcaagattccaacagtatgccaaactgagcgttttcgtgtgccaattttggatggtgttcttccacaaagtgtgtcgttgaacagcaatggacgaccaatctttttgggcattgaatacagtaggacacaaaggtggtgaaaatatttataaaatgtttaatataattataaattatttttttaattaatttaataatttaagcgattctttaaatgccgtttctgctgatgtaaaagtgctttttcgacttcatgcttctgttgaccacaaggctttttatgggctgaacatcaccaacagtgcaattctgaataacacaggaaatggggtgaataaattcagaaaaattaataaataaattttaaaaaaataagccgtaaatcgtttagcaaaatgtattaaacataattttaaattttgtatttgattttttaattaacgattgaaatgcttttcattaattaggttattactttttcaaaataataaacaaattattttctgttggattttcgtttacagtttatttcaaaatttttattcgcacccaatggacaaatataatccctgtccttaaacatatctgatttgttaagatttcaagggcgtccttggcatccaaggcgagccctatccttaaatattttgttaaaatttcaagggcgtccttggcatccaaggacaaatatgtccctctgtccataaatatattagattttccaagagcgtccttaccattcaaggacatgtgagaaccactgtccttaaatatattttattgttcaaaaccaatttgcagattaaagcgtcacaaatccgtgaccgtttcgcgttgcacaatgtcagtgttgagggcaaccagggcttggctggcttactggtccaagacggtgccgccgatgtttggctcaatgacacatcattcagctggaattggggcgacggtgccaatttcatttatttaaattaataaaaaattttttattttttatttaattttctttttccaatttactgacattccttcataatattattatgcatttaattcaaaatttatttatacaataaatttattttttaaataattttttttaaattcatttataatttaataaatgcggaagcattcgaaaaataattttaatttttaaatcgtatttttttatttttaataaatattatttttctattcaatttatcatttttacaaatgcagaagcatttgataaaaattatttttattttttttgttttttattaaatctatttttactcattatttaaaatttacttttctattttaataaattactattttttcaaattaaaatacaaaaaatctaattttgcttacagttaactccgattggccttctgtgtctttgtttgctggcctgtcttcctttgccaaagtgttgatcaattgggtggaattttcggacaatatttatcatcctcatgtggaagttttcgcatgccaaagtgcaaatcagcgacttatgcatgtcgatcttagcggagttagtcccaaaaataataatatattctttacttcggcattttttcactcatcgccaattaaaaatttcgaattcttttgagtttccatacctcagcgcattgtagcgcaccatcaaaaattttcattaaaaatttaaaaaaaatcttttcatggcgccttctggcgcaccgtcataaactctctaagaattacaaaaacatggcgcacaataaatttacaaaaattgaaaaatgccgtgcaatattttaatttaattgcaagggatttaaattaatttttcaatttatattaattaatgtaaatgccaaaaattttaaactaattacagtaatcgttaatcatttctttgacagaatacaatcacgggtggcactggcaagcccgtagccaggaaaaattttcgggggggggggggggaaagggagaggtccggtccgaagaccttttttttttgcaaatttgcaaatttatccataattttttttgctgaataaaattgataaaagttgtttacgatctgcaaataactacaattttcca

SEQ ID NO: 13135 - DNA, 695 bp, Heterodera glycines
ctccaggtccaggcctgggaccaggccatgagaagcctggattttcctggacctgtgttttcctgtgttttgtccaacaaatgaacaagtctatgtcggcttttttaaaatgtcgagccctactattttctactttccctgtaaattcctataatttttttttttacaaatttcaatattttactgacatttaaatttattatgcgtttctaaaatttaaatattttgcttacagttaactccgattggccttctgtgtctttgtttgctggcctgtcttcatttgccaaagtgttggtcaattgggttgaattttcggacaatttttatcatcctcatgtggaggtttttgcatgccaacgtccaaatcagcggcttatgcatgtcgaccttagcggagttagtctcccaaaaaaaaaaaattataacaaaaaataaaaaaattttttcataattcaaaaatacaaaaaaaaaaacaaaaaatttacttcggcttttgacgcaccgccaactaaaaaatttcaattttttttttgaatttccacttttttactcggcgcattttagcgcacttgtcaaaaattttcattaaaaggcaaaaaaatttaacacaccgtcaaaaactccctaagaattacaaaaaaaaatttctccatggcgccctttggcgtaccgaaaatttccaaaattgcaaa

SEQ ID NO: 13136 - DNA, 4055 bp, Heterodera glycines
ttaaattctcttgccctgtaacatcagcgagtgcaggtcgaacttgttctgcatgttggtcaacaggatggcgtagctgatgttgcagcgcagcgcgccacaaaagtcgtcgaccggctcaacgcggagataaacgtccaaaaaagggcgccgatttggcgcatcagcggcggcggcaacggcatttgtctccccaatggcattggcaccggcgatctggcaatatattgaaatggattagcggctgtatggtgttggtgtggtgatcagtaatttaggtgatcgatcggtgggggttcattaatggaaagcccaagttttccaaattgagggaaaatttctcaaaatttcttaaaattctttaatttaagcttaaaatcttgaaaatagctaattatatttgaaaaattatttaataagcacaaaataaacctaaaatttattaattttgtagaaaatgagattttttgaacttcttatttttgttaatatttatgagaaaataccacccaataaagttttttttgagaatttttcggtccatccttaggtcaaagggctgctctatagagggtccgttttaatagaggatttttttttgggaaaaaatgccaaaatatgcatataaatcgcgcaatatgcacaaatatgcatatggaaatacgttgcatataattggatgccattattataccaatccattcacccaatcaatcacaggttttttctaatcattttttatacaataaaatgatgtcatctgcctcaacattttttttttgatcatttcttcttactaggcaaatgttcattctgtgttctccccgtttaatttctcaatttcttctccaatcatttgcgcttctttttctgctgttcgccttgaccaaaaacaatgacgtcatgtcactctgatcagaaaagagaaacagttcagggcaatttggtcaaacactcattttccaatgacatcgtttcaacggcaattataacaaataacatatgtgcacgtgccaccaaaagcctaggaaaatgtgatcagtttcccgttacggtataaataaggcccctaaatttctctgataatccctgctgtttggatttcgttaatcagattagattttgaatttaattgattcgaacacaattgtccggcatttttaataaaaaattttttatcctgattgatttgtacggactacagcgcctaaatttccctgataatccctgattggatttcgataatccgatcagagatggatttaatttattgaaatacaactgttcgagattttaatcaaaattaaaatgtttccttaatgcctgattaatttcggatatctttgatcaattgggctcaatgttgaatgagttccaattgtctgtgatctgatcaattttgggtttgatactttttaggattggatttcggtaatcctaatcatttacattgaatttttgattgaattttaattttgtccaatcgctttttgcatttttctttttttttcttttctttgtcccctctatcatcattatcagtttaccacttttcacattacatatccacccattaatcacaaccattgttagaaagtgtttcatttcatttcggcgctttgataatttggccaaaaagtcatgcggcgggtaattattaacggtaattaaactccccccattagtcgagtacaattaatgaccgaccatgttaaaatttactgataaaattttgatgtgctgtgatggtgtgcattattttgtttgtgatccagctgcggttgtgctaacaaataagtatgtatcaaatttttcctaaattccatcgcacattttcacgcccatcacgtgcctcaattcttttttttttttggcgtttccttggcgttttccccaacaaaaattgtgtacccagaatttcgttgaaatatgcgatttgatcacttgatcagtccccgtcccatcgctcgcccaagcagcgcaaaacgccaagaaatgtcggggcgtggggcaggggacgctgtttttgaacaactaatgatgatgatgaatgatggagtgcacttttaaaagacgaaaaagcggtgccaaatgggtacaaaatgccaaagtatgaaaaataaaattgggaccaaaagtttgatttattatttttactgtttaaattgtgtccagacatttgcgccccagacaattgcccttcagtgaaaatcggacatttcgtccccagtgaaattcggacatttgcgctttaaagattaacttttcgagtgttatttatctaattggtcaaattaatatcaacagatttgaattattttgaatttgataattgacttatggcgttgaccatttgtctaattaataaattttaacgccaattttactatgatcctttttctcgctggccaatttttttttcttttcaagtttgtcaatttttacagtatcccattaaaataaaaaataaaatttaaatttgtacatttgtccgattggcaaaaagtgtccaattgtccggttctgtctgattttctaattacctaatttttgatttttttttaaatgaatttttgcaattgctcttactccaattagttacaacaattaattagtctcatgactttttgccaaatgtttatcaaaaaagtgtcttttgaacactttttgccatcaattgaggacgaaaagcactcaaatttttgcgatttttgcaaattttgacaaaaatcaaatgataaaatgacaaatgataagttgaggagaatgattgtcgtcaaaaatgattgggccctgataagaaaattgggaaaacgaagaacgaaagaaaaaaaagccgaagattgatgtcgaagaaatgaaaacgacgaaacatttttggcgaagtgtaaaaattggagaagaacaatggcgagagagtgtgaaaattgtcaaaaaaacacaaaaaaataaaataaaatatgacgaaaactttgctttaaaattgtaaatgtactgtagggtagaaaaaaaaattcgaaatttacggcatggccccatagttaacgatttaaaaagcttttggcataagcacaaagagaagagtgtgaaaaaaaatactaggacaaaaacttgactttaaaattgtaaatgtactgtagggtaaaaaaaatcgataatttactgtagggcccaagggttatatatttaaaaagcttccggcataagcacactttaaatgatttggcaaaaatacataggcttcccaatttaaattaactatcagtggcttttttgactgattaggaaatttaatcaaattgaatcatttaacctaatcgagcccggctttttgggccaaaaaccgaaaaccgggggcatcggttaataaccggtcaccggtcgtgacctaacataattttgatcgaattggaaatttaatcagcaacatttggctgatcaattagcaaaaaatcggcccacctttacattgagaagcccgctgaaaacaatgcacaacaaaagtgatgagataatttttagctgttgttgatgaacataaagatcccgcattttgttgaacaatggcactgatcagaaggaatcgaggaagaagcgattggcacggcacagctgatcaataaaggagaaataggcgtgatcaatcaataaactgctggcgatcggtgctgatcagctgtggggcaatggatggatggattggattccgccgcgattgaatcaaagccgatcagcagagcgatctgaaagagagtaatttatggaatttatgtgtggatttaatggttaatttaattgatctgattgggtgggaatgacttaatcaggagatctgatcaccagtagcaggatcaataaataattggaagcagggattacttcttggataagagaaagaaaaagaatgggatagagagtgagcagagagagagagagagagagtgagagggaagagagagagggagagagagaaaagagaggaaggaaagcggaaatagaaaaagaaagatggggagagagaaaaataaagagagagatagaggaagagaaatgaa

SEQ ID NO: 13137 - DNA, 3975 bp, Heterodera glycines
ctttgtggagatgacacaatgttcaccatggacgaccttctccaactcgccaatggccgcttattggcggacatcgaagcaattgtcaggattttcactgcccatatcaccgaagagtgcgaaatatgtcggggaaatgctttcttctgcgaactgtgcacagataatcaggttaatggtgttggcttgaggaattagtacaataatttataagttccacagaaattactccgcgccacttttcagcgcatctatccgttcagcgaaaacgtggccatttgcaagagttgctgtgctgtctatcaccgcccgtgctttgaccgtgccagcaaacggtgtccgcgatgtttacgcagaaaggcgagaagaaaagcggtgatggaagagaatgagggggacgaggaggaagaagaggacggacaacaaccgtaggacagcaaacttttttatttttgcataaatcgggtcacaatagtcaaaataaaaagaatttattaaaggaaagtaaataaattttgaaaagatttcgtacacaaatcaacgtgttgtaattgtcgcaacttttgctgaaagatccgagtcaatgtcgcggacaacgggcacaatgtggtcaatgacgtcggcagcgttcatcgatcggccgacagactaaaatattttttggaaattgttttgtaaaaaataaattcgacctgaaaggtccgtagcgatgcgttgcgcaccaaaagcgaagcggcctccgccccgtccagcaaatgctcggaggaataaatgtcggcatctgaggctttccttgcccaaaatgcgaaaagtgccgtcgcgccgctgagaatgtcgccttggccaccgcaacggcgcatcgaagtttccgcttggacaattcgcgtttgggcggcggaaccgttggagattatgtcaatctctcctaaagtgccaatgacaattgttattgaatccaaacctcatatttttcggttgtgtttcgtgccaccgaccctttctcatcacagtcacttccaaatgctttgccaattgttccgccatttcgcattgaattttcaattcgtccgtgtcttctcccttctgctggttagggaacatttgggtataaagccgaacaaattcttaagaaatatgcattttgtttgctttgcttttggggtgcgttttgcctctgtggtttggcgtaatgatcactttgtctgtgcaccctttgaacagttgcgaacattctttgacgaagaacagaccgtccgcgtcaatgaccaaacaaagcttaaaaagcaaagaaaatgatgattgtatctcaataattagatggatttagattggaggggaattacattttgtttgctcctgacgaaatttacgacgtccgccagcaaattttgtgtgtgtttctgtcggccaagccccggcccgaataccagcgcgtccaaccgctcaatgctgtgtctattcgtggcgaaatcggtgctggggtaaacctattaaggaggagggcaattagcaaacccaaccccaattagttaactagtcatcatgaaaacccacgatcagttccggactgtaacttttgatcaccggagcagcgtcggaatgggcgtaaacaaaggccaaatcggcaccgattttcattggggtgatcgaagcgaaataaggcgcacctaacggggaaaagccataaaaatgcattcatttctctgcaatatgccaccggtgtagtcgggcgaaccgccgatcactccgattttgccacagtcgcccttgcgaaggtgtttgccgaggacggggaaaaggcgctttagcaatgccattttgtcagggtcaatcggactcataacaaacgaaaatatcacactgatcagctgacaaataattaggtattaagaaaataacgtaagcataaaacgggaaaaagcgtatggtttgaaaggcaccgacgcataaaaaagaaagaatttatttgagctcgaatgacacattatgcatattttacaggattatgaatgcatatgaaattgaaatcacaaattaaaatgcaagagatttatataaaaagttaaggcaagaaaaaaagaaatgaactcgttatgatgggattggatgggggagatttgtgttaatgatttagagataacgaagcaaaatggacaggaagttctgaactcgtcgatttaaatggcaatctttcaatttcctttccaattttttttggtgtttttctcttttgttccttccgtccgtccgtctcatttcttcttcttcagtttgatgttggagatgcgttcgcccacgtcgttgaagaaattgcccacgtcgtccaccactttgtccaatccgtgcttcttggccagtcggctcaccttctctttgaccatctcccacaagtgtttgacgtactcgcgcaactcgcgactgcgtcggttcgccacgcattcgaagtcgcaatccttcgaaattcgaatggctttttgtggccaaatctgtcctccaaattacctcatttggctgtgtgtccgtcggcagtttggcccggtcggcctccaattgttcgggagtctttccgcaatcgctcatcaccatcaatgtccggtaatggtcgagcgtggaacagtcgaaatgttcattcccttcgacgtcaacggccttaacggaaaaactgccgagttctgatggaatattaccaattaaaattgaaactgtcatcaaatttaataataaaatgaaatttaaaggaaagaccttcaggtcgggcagtttctcgagcagtacttcttcgctgggcagcacatcgatgttattgcgggtgagcgcgagcacagtgaaaccgcggagacgcgacgggggcaattggacaaagtgccgatcgggacgattgtgacaatggatggcctaataagggagagcggaatttggaaagggaaagccaaaacaaggaagtgaacggatggatggtaattaattgacataattaaggtgagagtgtaattgattattaattaattaatagaaaaaaggtaattaagtaattgatttttaatcgattaatattttataaaaaagtaattatttggtgataactgttaattaattgacataaaaaagattgagtttgtatttgataatcaattaagaaaaggggtattacgtaaataattaataactaattataattaattaataattataattaattaattaattaattacctcgtcatcagtgtcacattcgcacccgtccaaacaactgaaagtgtagcctgaaagtatgttaattaattcatcaaaattcttccattttttaccttcgaatccctttgccaaaacgagcaaaagaaaagcaatgagaaaatagcagaacataagtgggaattaatgctgccaaaatatttaatgagattattttaaacccaaaaaagaataatgactaaaataaaattaaaccaaatcaaaggaggggaaatgagaagggaaagagacgaataaatgttgatggatgctgaagaaatggggcggagcaatgggagaggagtggcacagtgtttggaaatgggacaaagtcaaacaaatatttattgatgggattttcgtttggtggaaaagcgactgctaaaccaatgaaaaagggtgaaaataaaaggatggatgagatgagtcatcgcaaattcatttattcatttcattggtggaaaatatgtgaaaaatttgttcgtttttcgtataattatggaaatcgcgagactatgagaaaaaaagagaaaagtaagagaaaattggaaagaaaatataaataaaaattataattttttgatcaaaatctgctgctgacagtgcgtcgcaaatctttgtaattcttcaaatgatttgcgcattggccgcacgtcagcggacatcgctgagccatgaaaactttgtacgacttaaaatgggaagggaattcgttttcacccaatttgttaggtgtttttgcat

SEQ ID NO: 13138 - DNA, 1100 bp, Heterodera glycines
ccaagtggaaaatgcttctttcgtgcttatctgtgagtattaaatgcgcaagattttaggtatttaactaaaaatcgcatccctaattgtcagttttctgtctttaaattgtcaggtttctcttatccattttttctgaaaaataacacattgaaatatgaaatcgtatttaaaatgtcaggtttctgatggtcacagccaccgtcaggaaactgactaaaatgtcagattttttcatccttaatattgccatttgttcggcacaaaagtcgtttgacgcctaacttacacactaaagccacgactttttgtcagtaaacggagacagcaatggaaactcgacttaaattactgacacaattattattacaaaatcaaactaaattttctccatcgaattggcgtcatttatgttttttctccacaaacataccgcaaaaaacgaagattgaccgtgttttggtggcgaatcggggcgaaattgcacttcgaattatgcgcaccagcaagcagatgggaattaaggtcattaactaagtatttttgagatttaagtgtaataataaatagatttttgttaaaaaacccgttaaaattggaatgaatttttaattgagtaaaatttgagtggatttatttttaaaccaccgtttttccctcgttagacaattgcggtttactccgatgcggactccaaatcgctgcacgttcaatttgctgacgaagcgtgccgaattggggaggcgagtgcactgagaagttacctttgcgctgaccgaattgttcaggtgaatttattcgaaatttggatagtcttcgaaaatgacttaaatttgcctttgaaaggcggctctgtctgctggtgccgatgccattcaccctggctacggatttttgagcgaaaatgccaacttcgcggaacaatgcgcagctaacggactcattttcatggggccctcggcggaggcaattcgcgtaatgggaatgaaaaacacggcaaaaaatatcatgacagaggtaaaaacaatgccaattgtatcttatttgaaccataaaattaaacatcaacacggcattttttgccattttagcggaccggg

SEQ ID NO: 13139 - DNA, 2926 bp, Heterodera glycines
  misc_feature (46)..(46): n is a, c, g, or t
  misc_feature (2910)..(2910): n is a, c, g, or t
cctcgggaattggcgcaggactttgctaatttttgtctgattttcncactttctccatcccaaaggtggaacatccgatcactgaggcgatcaccggattagatttggtccaatggcaatttctggtggcccagggcgaccgtcttccgttaacgcagcagcaaatcgcactgaacggacatgccatggaggtaaaagtgcaaaagggtcggcaataattcactagtttctcggcttttgtacgtcaaattcaatttttaggcgcgaatttatgcggaggacagtgaggcgggatttatgccaaccgcgggtcattgaatggccaaaaagaaaattaaatgaattttcatgtgcgccccgtttaggccatctcgagcaccttttcttcccttcatcgatgccgcatttgcgtgtcgattcgggcgtccgcgagggcgacgagatcagtgtccattatgacccgatggtggccaaagtgatcgcgtggggcgcagaccgatcggaagccatccgacgattggacgaaggactcaggtgaaaggtgccagtgtttaggcacaaattaggacgattattggaatagcttagcccatcgtcgcttttttgctgtgccattccctctcattttgccagacaaactcgcatcggcggactgcgcaacaatgtccgcttcgtccgcgcctgtctcgcccacgagcgcttccgtcttggcgatgtgtacacggactttgtcgcagaacacatcgaccagctgttggcccactgcaaatcgccgactgcggtggcgcgtgggcgggaaagtgttggtggattgcttgttgaggccgcactcgctcaattgttgctgtccagggttcgttgtttatttggatgtttttaaaaaaattgtgtgggagcaacgaggctctattgcagtgcacccgacaaaaaaggacacgaccataaaatatgtcggcaatttttaatgcatcattattttttccagaaacatccaatcttggtatcattcgaatagctctacgaattcttcattagactgcaaaacatcgaaaattttactttgtttcaagaaagttatgaccagaaatttcaaaaattatttttctgaacctttgatcataaatctttaatcttggtgattttttttcaaccttttcgtagaattaatcgaggccccagcatggattagtaaaggattatcaaatggcatggtatttgaggggggcgggaagaaatgacaattaattcataagtgaacataataattggttaatgaaccaacccaacaattagcggttttctcatagcgtggtaattttttgagaattctcctggctatgtctgtcaacaccgccggaccccctcccctaacattttaagaattttgcccaaaaagcgagtgccgatttgcttttcaaattttatttcggcattctttcagttccgttctctctgtgccgccgccccttcgtatccgtttgcgcaccaaagtccgttctacgcctcgcccgcctttttccgcatgaatcattttgcgcgtcgtacactccgattggacgctgaacaaagtgccgaggtggaaattcaacgggacggactctaccgtatcaatttgagggtatcgtagtcagttgaaattgggtatatttcacaaatttgaagtttgctgatgataaccaacaaatgcacaatgtccgagtcggcaccgtacaatatgaaaaaacggcgaccacagggaagccaatggtccgattttcattggaaatggacgaaagaaagcgatgggaatgcaccgccgttttgctcgagagagaactggcggtaatgattatgggacgaggatttagtgcttattttttaactcttgacattttttgtaattaatcgaaaaaagtcccaaaaaagtcctttcgactttttcatactcacctgaaatctttttctttttttccccccagattttcggactggacgagcaccagtggccgaacccgttccttcagcaaactgacgatggcatttccggcgccgtgccattgttggacggagttgccgatgggaaggcacggagtccaattcccgggctggtcgagaaagtttttgtgaaggcggacgacccggtggtcaagggccaacccctcgtggcgatgagttccatgaaaatggaattcatcatccggtaatgggatgggaattgagaacttttcattaaacgactgtcaaaatgggatgcctttagggctccgttcgatggcactgccatttccgtcttttgtacgcccgggcaaaatgtggcaaaggatgtcgtgcttttgctgcttaatgtcgccaaaactgacaatgatgagaaccaaactgaaggggaaaaagcgatggataacgaaggaatttaaatccgaaaaagccataaaaaaagcgaatttgattttgtaaatgccatattttcacattttacacttactatccctccacatatcttcttttatgagtttttatacagtgctcacaaattatctcttaataaaaaaaatgccttccattcatttgtgaccgtttaaacattggaaaaattggccgtcaccgaattatttaatattaaagtaacattctttttcaatattcaatttctccccgccgcattctcaaaagtccagtactttttcagagtttaacccaacaagaataattttgtatttgtgttataaaactgtattatgaaataggccaaaatatgccattttctcccggcggctccggcaccatctgaccagagccctaatattaaaccgcgaaatttaattattttagttcccctcaatttacctttccacgtcgatgccatcgcctgcctttaatttgattatttcttaattcattttcttcaaagttgtattggtaattgccgaactngtgttttgttttgact

SEQ ID NO: 13140 - DNA, 3678 bp, Heterodera glycines
  misc_feature (4)..(4): n is a, c, g, or t
cttnaaattttgcatagcgatagagaaaaattttctgcatcgaataatatagattttgcaaaaataaggctcactaaaaagttatccaaaaaaacaattttcgaacgctcttatctttttctaaatcgttaaaccgcttaacattgctttagaaaaagcttctcctcatcaagagctttcgaatgataccaagattgtccaatttggttggcgaaaaccttcaaaaataacaaatcttttttggtacaacagctcagtttccggacggtgtgcttagaaaatattttctcttcacgagtgacgagtctacgaatgacaccaacattgtctaatttagttgccaaaaattcaaaattttttttttattgcaaatcgctattttttgacgaaaaataaataaaaagttactgtcatgtgtcgaattcgaactccaactcccgcccttttccctttattatgtatcttataaaaaccaatgattgcgcgagccactcaatgcaaatccttaatattgatacaggagttcatttttgtcaaactagtaaaatatacctaaatttttcaggtaatgtattaaccaaagcttaaaaatgaaaagcaattctaaaactgctgacattggtgatttttacgagatattgggcgttcctcgtaatgcaagtgagcaggaaatcaaaaacgcttaccgaaaattggcactaacttatcatccaggtcggttctattttaatattttctgtaaaattcagataggtatatttattcagacagaaaccctgggaatgagcaaggtattcaaaccacactaatcattttactgaaaaaatacaattaaagcgcaagaacagttcaaaaaagttagcatagcctattctgttctctccgacccaaataaaaggcggcaatacgatgtgtccggaccatcgatggcaatgaatgattttgaaggactcgacatatccgaacttggcggagttggtgagataagctcaatctcactctgttcttaaaaatttatttaggtcgcttttttggcgcaatggttcgctataagtgctaatatacccttttaattgttttcgccagtttaccaaattgggaataccaattcctacccaaattggaccgaaagtgcttgctcaagctcgtgatctctctcgtggcaatgtcacaaacggtcaacaggctaagtaccaaagagagcatttaaaaaaattctttttatgtgttaaggcctctcgagccaggtctggtgctgtccgaaacagtgaacaatcaggaggcaaatttctacgcgtttcagatgactcccgaattccaacaacacggaggtcctttcattattttacactgtagccaatgttttgttcagtgatcattcgatgcaaatcattggcaatgagcaaattcaaattggtccttttcgatcaggaaggtattccgttattttattattacccccttatgaaattgtttaattttgtttttaaggcgcagtccgtcacattcgcgagagtcagaagaaaaagaaatacacttccgctgaacttttctttgtgccgttccaacgaataaacatttccgaattcattccaattcggtaacttaaattttttaatgtgattgaaattttaaatgactactttagtttttacatggaggacaaagacactccgctgccatttcactttctggacactttagaaacccatggttacacattagcctattaaaacaacataaaatttgtctgtttttaggtgctaatgtgatggagcttcagccaggaaagcacatcctttgtgtatacggcgacaatttcttgagaatggtaaattattgggtgtctttttgtagaaatgccatcaaatcagtcaatttgttcctttcattttgcatttgttaggtcagttacgaagtcactttcctcccgctgaatcattacgccagcgcagcaattaacaaaatcaacgcattggagcccgtgttggcatcgaagaaatcggaaatgcaagaattccagaaagagtatatggacttaaagaggaagtgagccaattcggcaatgttaaagaattgtggtccctaatttcttttttattctgggctcagattcagtttcctggggttttcgagggtgctgattacgaatatgaactcggatttgcccaatttcgaaccccggacccgaattcgaacaaaaaattagaaaaaaattttttccaaaaaaaaaagttaaaaccggtcaaattttggcgcaacttgtgtattttacttaattaaacaatttaagcattattttacatcaaaataaatagtgttaaatgaattagaagcttttatccacgaaaaatgtagaccacaattctttagcattgccgccaattcggacaaagattcgtatttcaattgttcttttcttcaggtgggaagcagcgaaagaaaaactgaaaaaagaggaggaagacatcagcagttgcctgaaggcaagggaaaaggcatatgacgagtgagtcccttaaatcatccaatcagctgtaaccgacaaatcattcctactttaaaggttatatgacgcctgttcgaaaccttatcaaagccaggcattaactgcgaaacctagtggattcttatcttcattatttggctagcacatgtataatagttctcgcgattgtctgttatataaaccaatcctcttaaaaggtataaataaagtttattataagcggatccagaatacatatatcaatcaaggtgaatatttcactttccatcacaatacgatctcatgcgaatgtcaataaacaattattgtgtataataaatgagacaagcacaccgcaatatgttcccatgttcaatcgaaggtgattaacaagtcctcctgtacgccggtcatttgatttttttgctcatcagcagtgatagcgtttggtggcatggaattcggaatttgctgataatgcggttgctgttgatgagggtagggcgacgccaaatgcggcatttggtattgatgcatttgcggttgctgtcccatcatttgttgttgcataatctggtgttcgttgctttgaaaagctcgaattcccacaagatttacattcgtcaacatttcctaaagtgataaggccacaaaaattttgagacgttattgcatttacatttggtggcataggcgtggtgatgttttgtggcaaagatggaatggcattcattgtaacagcagtgtttggtggcatggaattcggaatttgctgataatgctgttgatgagggtagggcgaaaccataggtggcatttggtactgatgaatttgttgcggttgttgtaccagcattcgctgctgcataatttggcgttcattattttggaaacgttgaattgctagctgacgctcattcagcaacatttcctatattaattctttttaacacattttagtttttggattcaaaacccttaatttttatatgatataatcacgtgtttcatttgtcgcatgtgttccattttgtgtctcaattgactctgtcttctgtcgtgctccgctcttagcatttcccgtcgctgacgttcgttctcatcgcgcaatgcgttcaccgcctgtcttgcttccgttatgtgtgacaaattgtcttgcatgcgttcgtagcgttctttggaaggtaaaa

SEQ ID NO: 13141 - DNA, 2072 bp, Heterodera glycines
tcgcccaatccgccgatgtctctttcttttccttctttctttgttaattgattttgccgttctttttcaataataaatttcgtccttttgagattatcacgcgagaaaatcacagagaaatggcagcaaatgttgcggaattgaggccaaatgagtcggtgtttctttttccctttttctgccctttacaaattcaaattgttttcgtccggcattcctttcctttctctcccttttcagtgtcagtgttggcgaacggcgacaacaaacggcggaaatgccacacaaccaaaatcaacagcaatttgttgctgctgcgaatccgagatttggcaacttccgagaccgacttttccaggcgatgttggtgagtgggccgtggcgaaagtgcggaagtgtccgctcccttttcaggtccgtctttccctcccttaccatcaaaatgtgccgcgcactgtccgccgtttcttcgaatttatcactttattcaacgtaactttttcgcattggtctgatcaatctgctgaatttgtcctgttgccaggctttcgctttactcgccgtgctcatttatacgcatttccttctcaactctttccccgcccggtgtttggactccgtttacagcgattggccaaggaaaggcatcattcgcttggaggttccgcacatttgggctcatacaatttaggccaaatttttgttacatccatctaatgaatggatctgaattgtgttggttttgggggataatattaattttgtcgaaatgaatgttcgaaattgtgaggcctaactgtaaaagagtccacatttgttaaataattaaccatttttgtgcaggtgattcaaaatttggaggaataccgcgagagattatcgagaaaagaaagcggtgagtgaattccttggcccaattttcatttgccatcattttgtaatggttcattgtatttgttacatccacagaatcggcccattcgtcgcattgtcttttggacatcgccgacattttgagaaacggcggacttccggcggtcctccgcattcagctcggaagtgtgccctcgtcctcatcgcctccgccttcttccgtttcgccgtctctgaaagtgtccaatgacagcaaagccaacggcaacaacattcagcagagccgtgctaggttcggtcgacccttgccgactttgttcgacctgttcctttggttggtcgaccagttcaaccagcagcaatgggaatttgccaagggaacggacggcggagaaacggcgcaatgggcggacgacaaaggtaaaaaaagggtggacgaacgaatgtaaaagcatttcgcttaaatgacaatttttagcacaaaacgaagcggacgattcttccgacggagaagacactcaccagggacagaaactcaaatgttgtcaatttgcaaacaaatgaatttacaaatgcaattcattctttcagttcattcattgtcaaatgcggcgccgcccgtttattacgtaattttattttcatcaaattttcttacctttttatttagcaattggtcgaattttcgttgcattatgggctgctgaaactgagcatggaaatgcgacaggaattggacgtcgaagtgcaaatagtgcaggcaaaaaaacattcgaatcaaaaaatacttaaaatgtttttagttggacccggaaaaggccgaatgtttcagagattggcgggagagatttctgatgcgatatttaatcgaaatggacgagctgattctgtaaggccattttggacatttcaaattcagagggaatttaaggagttccgtgaagcatctgatggaaaatgagacggaacgaggcaatcggaagtttcacttccgcggccatttcctttttaggctttttgcgcgatttgatcggtggcgaattgtaccatttcgtttacgccggtccgtcctcctccagcacttatctaacggccgccattgtgatgcttatttttgtgggtcattttttaatttattttttgattgttttctaaaaaggatttttatgtttatttttgtgttgtcttcaccagacttt

SEQ ID NO: 13142 - DNA, 1728 bp, Heterodera glycines
aatggtgctcatgtacagataaaaccaatttattcggatgccataagtaacacctgcataggcacaagcaagcccaagtttaggcctatgtacgagttgtcatcgcttccaatacccaagcacataatttatgcattcctcacacccaattttgaacagtttgaagcgccataataggaaaggtcaatagaataaacacaggaaataaaagaaaatacaaagcatttagtggtaatacatggggaagaacacaaaagccacaggcgaaaataaaagaaaatagatataattgttatgtggataacgacagttgtgaatttcggaatatgtaaatttgaattacttataaatgccaagttttcgcaccgatcacaattttccgctacgctgtacgtgccctagtcaatattctacaatgtcttcttgccaccgtcgcccgaccggtgactgttttctgacagtttttcccacgagttgctgtcgtccgtccccgtttgtgtcccttcttcggcgtcgtctccttcacttccgcttgtcccgtcttttttcgatgagcttcgactttcacttctgctgctgcagttgcgttcgccttcattttgtgctttttctgccatttggactgtttcatcagttttattttcttctttgggcaacggagccaaaggaacagtcggaggtggtgaaacgaattctgagtcttaaaagggttttttaaattaatagaatggaaatgaaagaagtgacagaaaaatcggtgcttaagacctgatgaaatggaccggctaaacgcaattttccccatggtatctcatggccagcccttggttcagtttctcaccctcttcgctcttttcctgctctaagaacggtgtcttttcgtcctcgttcttcccttcggtcgttttttcccctcggctttcgttgtccttctgctgttgttgctgtccctcctcgcctttcttttgaccgtctttcttcgcttcgactccttttttctttttatttttcggctcctttttcgcgaaaactccaccggggacgtattccttaaaaacaattgattgtaatcagaaggaaactgtttcattccgctttacataagtgtacgccggttggaaactttcgaaaaagccgcactcctccagcaaatttgggagaagccaaaggcgatgacggcccagagtgaacaaccaaacgaggccaaaaagaattgtacgagctaaaatggaagaatgtaagaaaaaagtcagaatttaaccatcagaatgatggaaatattaccaaatgcgacaccgagcaaaagtccaaagagggcaatcccaatcacagaaaggtaataaatgccaagccgtaaccaatcaggcctaaaaatgcatataaagcgatcaattgaaaagacattcgttagcaatgaccacagcgggaacagacagcctccgatggtgccgaggacgatcagaatgccaacacatttcttccacaacggagtcgggtcgaacacccaaacgtacacatcgctcgtactgacgtcaagcgtttgaatgtcgtggaacagaagtttgaccttctttttcctccgcttttcttcatcctaaacatttttataatacattaaattttcgatttttttcaaggtccaacgggtcaatttcccgggagtggggaaataatctgtgagttgcgaacacccggactgttggacccctcctacccgacttccgcccg

SEQ ID NO: 13143 - DNA, 2140 bp, Heterodera glycines
  misc_feature (2024)..(2024): n is a, c, g, or t
  misc_feature (2053)..(2053): n is a, c, g, or t
  misc_feature (2091)..(2092): n is a, c, g, or t
acatttgccggacaaggaggattactgccctgggtcaatgaagcagacaaatatgagaaattcataaaatggtattcatacgatttggtatttttaatgttatgtttttttaggtatgacgagaacaaaaacacaccggtttatttaccggacgaactaaagacgtattgtcggaacgatacggagattcttcttgctgctgttgtccaatttcgccaaattctgatgtgtgatatcactgaaggttttgatgtgcttccgctgagtgctactattgccaggtcgttatgccaatcggttttctaatttaatttctattcagcgtttgcatgaccatctttaaagggaaattccttaacgaaaaagagcttgccatcgtgcctgaaggcggttacgagcggaacgatagggctagcgtcttcgccatcaaatatttggactggcgctccaagcgagacggtgttcgcatacaacacgctggaaatggtctcgaaaagagatggcggcagttcaaacttgatgggtggattgcggagcagaacaagtgcatagaagttctcggctgctactggcacggatgtgagagctgcttcaaacctgacgacgaactggttgacggaaaaacatgccgagaactcaacgatgctaccaaactgcgtttgctaaaactacaggagcctgttccagctgaggatgcttgcggcgaagcagatgaagagggccttgacgtggaagagatttgggagtgtcagatccgtgaacagctcaaaagagatgatgaaatgcgagattttttcgacgacttggggaccgaccgggggcccatcgacccacgtcaaacattctacggaggcagaactgggccgcttcagctgattgcagagccaaaggaggatgagaagatttctgtcttcgatatcgtcagcctctacccgtgggtcaactatgccaccgactacccgaccggaatacccgctgtcatccaccccaccattgaggagatgatcgtcgactggactcgacctgagcatttacaataccaaggaatttatcgtgtgcgggttattcctccaaaagggctcagaattccggttcttccactaaaaatcgacgaacgcctcctgttctgctgctgccatcgttgtgctgccaaatttcggaagttgaacacacgacgagtgcacaagtgcacacacacggatgagcagcgggcttttacaggaaactttacgcatattgagttggcaagagccttggaaactggctaccgagtggacagattctggagagcttggcactacgatgaatggtatgagtttgttagggaatcttaatatttttgaaatttaggagtgacggaatattcaaggactatgtacgtctattgatcaaattaaaggtctgaatatattttttaaagttaaataaagtccaaattgcaggtggaggccagcggttttcctgatggtgccaacactgtggaacaacagcagcagttcgcggacgagtacagaagaatctacagtgtaaacttggagctggaaaatgtgcggagaaatcctgggttgcgcttcatctctaaactgatgctgaacagtctttggttggtatcaaaaatttttatgaaagaataaatgaaacttttaggggaaaatttggcatgcgaaatgaattaggcgcgaacaaagtgctaacaaggccgcaggaatttttcagcctcatcatggatcataaaattgtaaaccataatgtgtaaatgaattttcaattttgtacattgtttaggaagtgtcggctgtcatccctttgtcagacaccgccgtccgtgtcatgtacaagagcaaaaagaatttcgtcagcgaacacacgtccagcaacattgtgataagtctgtggacgaccagccgtgctcgcctcaagctactcgattttatgacacaaatcgatcgaacagagggagccaaactgctatatacggtaaaaggtgttttaatattgcaaagtacatttgacccaacttttangacaccgacagcgttgctgtgctccatanacgtgacatcgtgcccatccagacaggagaatacttgnnggcaatgagcgaggagtatctcgactatgagatcaaaacttttgtctg

SEQ ID NO: 13144 - DNA, 1992 bp, Heterodera glycines
  misc_feature (95)..(95): n is a, c, g, or t
  misc_feature (114)..(114): n is a, c, g, or t
acgagtacagagaatctacaatgtaaatttgacctgaaaatgtgcggagaaatctgggattacgcttcatctctaagctgatgctcaacagtctntggttggtaccaagaattntagtcaaaataaataacaaatttaggggaaaattcggcatgcgaaatgaattaggcgccaacaaagtgctaacaaggccacaggaatttttcagcctcatcatggatcataaaattgtaagccaaatttgtaaatgaatttcaattttgtacattgtttaggaagtgtcggctgtcatccctttgtctgacaccgccgtccgtgtcatgtacaagagcaaaaagaatttcgtcagcgaacacacgtctagcaacattgtgataagtctgtggacgaccagccgtgctcgcctcaaactactcgattttatgacacaaatcgatcgaacagagggagccaaactgttatatacggtaaaatgctctaatattgtcaagtacattgacccaacctttaggacaccgacagcgttgctgtgctccataaacgtgacatcgtgcccatccagacaggagaatacttggggcagatgagcgaggagtatctcgactacgagatcaaaacctttgtctgcggaggtaaaaaatttttttttttaatttttgttctaaaagttcaggcgcaaaacaatatggctttcgaatgctgaacaaaaggacaggagaagtggaatacgtacaaaagatccgtggcattacattcgacgtcaacaacagtaaggcgctgcagtttgaacacttcctgcaaaaggtaaaaaattacggacggaacactggtgacgacaacgatgatgcacctgccgtgttttcctacgacaaaataatgccaacacgagacagccgagtcatcacacgtgaactacgcaaaaaatacatgccaatatgtcaaaaaggaataatcaacgagcaatacgaagtctacccatttggatatgaataatcaattttaaaatcatattgtattattaatcaaaaacaagtcttattaacacatatttatcgtcatgagaatgtagcaatacaacaattgtttcagtgaaaaatgaaaatgtttccgttttaaagggtttctgttttggagacacgtaacaattcaatgggaaaaatatcgcggtgatgaccaccaccaaactgaacaacacatggaagggttgggtactttaacatgacacgatggcgagtgtaaaggtgttgctgaaccgtgattcctaggaatccacggtatgcaaacacctgatttgcaccgatggggcacaaagcatcgggaataatcttaatattttttctaagatggacagtctcaatgtccaattggctcagataggcaaggttctcagtccgtcgtttctgtagttgcttcgtcagtcggtatgggccacagttgttgaaccggcacagcactctcaccaggttgtagtctcgttttcgcgttcgtcgtcgctccaataattgatcagatccagttcgtccacgatcaggttcatgctgctgctgttcggttgttcgcaatggcgtgacagacacagcggcgagtctcccgggcaaatcttcaagtccttcagttccacatatagaggttcgctccttaaaaaaaacaaatgaaaatattaatatttttttattccgaaaacttaccacactattccctcgtacttcttcttcggataacatgttgagtacagttcaacgtcagcaatcaattcgagcgacccgtcgatatgcacaggttgattcggatggtcagcgtttgaaatgtgtacacagtcgacagcacaaagtgggttgggatagagacaattcccaccttcaggcccgcttttaatttcctctttcaaacaggtgtacagatcgtctacactgctcagcccgtaactgtctatcagataacggattgccctttacaggcaataagcaggtcaatatggggcggcagttttgg

SEQ ID NO: 13145 - DNA, 3059 bp, Heterodera glycines
ctgaaaattgtcacttttctcttccaatgcttttccattcgctttttgtgaatcgagtccatcatcagattcattctcctcctgtttgtttcctgtttgattttggagttcgtcgagaagcattttcccgatctcgagaaattcgtttgccatcaaaaaaagacctaaaaacaaaacaaaataatatttaaattccattgaaaatattgttcaaaccttttttgctttcatcgtttgtgcccaattgaccactcgataaatttattgccgcaaatagcgacagaaaaaggccaaacccatgcattggtgcggaaagcattttgttactatggcaaaaatttgaaaaaactttttttaaattataatctaatgtaaaaatacattgttaaatgcagataataaaaatatttctataaaaagggcacgcccatcaataaatggaaataaaatgggagatggaggcatgaacaaagaaaaaatgtgacataatacatattgcggtgctaggtcgatcctaaaaaagtctcaatggggcgatcctaaaaaagtatcaatgataataattaattaaaataattattattcaatgaaacaaatattttgcaagtaataaaaattgttttctacataaaatattattacgtcggaaacgataatcaatgtatgtcaatattatttgccatataataacaaatttttaatttaaaaatatatttcccttcagtgttaattttattcattagattaacataaaaaataaaaataatttttattagttttatttttcccttaattttacttgattattttgaaggccataaatccggatttgaaggattcgtaaaaaatcctcaagcaatatcacttgtcaaaagctatgaaaaaaggaaataaagacacttgatgaatgtcgcagctcagcgagctgcgactgtccgatggtcggacagtttcaacgaaatgagctaaagatggaagaaggcacaaaaaagggcaacaaacgagcaaagagcaaaaagaaaaggaggtgcagcgaatgagtccgctgattaatgagcacgtgaaggggcaaaatggagcgatcaaaaccggcaacaacaccctttcgcgcaaatgtggaccgatggaacggcaaaaagaggagcccgttcagccgacaacaacacaacgaatgcatgtgaaggaccggccgcaacagcgatgctcgacaaagagaatgaggaaaaaaccccgaatgatcaccccatttcttattaattaattgtagcccaacccaaatgtgatcgtatttaagccccacaaattgttcatttcaagggctccgatcgtacaccgaataaagagagaaaacccagcaatggatattccggaaagcgccctcccccctctccttcctctcccaccccaccccgaaccaatggacgacgaaccgtcccgttgcggcttgtgggccgagccgcaacaagtggcgaccctggcagggattttggtggggttttggggtttgtgagcaggggtagggggagcatgccggccccacaggtttttcgtaacctgtggcgtctggcattagcgctattccattttgcgttccgcgtttctggccccttgggttttttgtaacccaaggcgcctgcattccgcgccatagggcccctcgggtcttttgtgacccgtagcacctcgcctttccgcgccttgcattccgcaccgtttggcctcccgggttttttgtaacccggggcgcctccattccgcaccatagggcccctcgggtcttttgtgacccgtagcgcctcgcctttccgcgccttgcattccgcaccgtttggcctcccgggttttttgtaacccggggcgcctccattccgcaccatatggtcccttgggtcttttgtgacccggggcgccttccattccgtgccatacggcccctcgggtctctttttggcccgtggcgcctcgccttccgcaccacagcccctcaggaaagaatggtcatgcgcttaggcagcgagcctatctcgcactcattggcggcattgtgccgagctcacaaagagggcagtgagcctaatctgcgcaaattgttgaagcgcattggagcagcgcatgttgaagcgcaaattggagaaagcgcattggagaagcgcattgaagcagcgcaaatgaagcgcaaattgaggaagcgcagaccgaggcggaatggaaaattgtcagaggaagcgcaaattgaggaagctcaaaccgaggcgaaagggaagagcaaactgtctgagcaggaacaaaaagacagcgcgcaaattgaggcgaaattgaggaacgcaaatcaattgcaggcgcaaactgagtctgagcgagggcgcagactgagattgaacacaagcgcaaacagaacgatggcgcaaactgagacgaccacaggcgcaatactggagaaccactaagtggcgcccgtagctcagttggacagagcacttcatgctttgaggaggtcgtgggttcgagtcccaccgggtgaaatctgtgttctacactacgagcctggctgaggccatcatgaagtcaatggccatgggcgctggggcccatcatgaagtcaaaggccatgggcgctggggcccatcgtgaagtcaatggccaagggcgctggggcccatcatgaagtcaaaggccatgggcgctggggcccatcgtgaagtcaatggccaagggcgctggggcccatcatgaagtcaaaggccatgggcgctggggcccatcatgaagtcaaaggccaagggcgctggggcccatcgtgaagtcaatggccatgggcgctggggcccatcgtgaagtcaatggccaagggcgctggggcccatcgtgaagtcaatggccaagggcgctggggcccatcatgaagtcaaaggccaagggcgctggggcccatcatgaagtcaaaggccaagggcgctggggcccattgtgaagtcaaaggccatgggcgctggggcccatcatgaagtcaaaggccatggacgctggggcccatcgtgaagtcaatggccaagggcgct

SEQ ID NO: 13146 - DNA, 984 bp, Heterodera glycines
attgcatttatatttttgtcaccgggctttagcactattatattaataattaaatgtatttataagaaatgttaaatattatttaattctttaattctgcaattattttaaacatttattttgcgttttatcgtcagataatttaatttaaaagtggatttattaatttttatttttattattttcttgtataacatacacttaagaaataaactctcataagtgcctttaattttcaaccttaataatgttacttttggtttctttgatataattttttttttactttttttattgaatttttaatttattatcataattatttggaaaaacctttcaatttgtaatctaattattttttgtattatattattggttttatgcaataatgatcatattaaaattaaagtcactatttaaatctgtttaaaaatagtggaaaattccatttttctaaattttcatagaaatttgtctaaatttcaaaaaattaattttcttaatatttaattaataattgaattaaaaaacataatttattcttttatcattttataaatgaagttcagctgttctctcagtttaagtatttatttatttgataatattttaaataaaaaactttttattgaaataattcacttgcgaatttgcttcctatgtttgcagctttttcagcaatccattcaaatacttcaactttgaaaggtttgctacttgaaaagttagattcttaagattaaaaatcattttattttatgttttaattttaaaattattgcataatcaaaaataaacaaatttaattttaagtcaaatttttgtatatttttgatttgatgaattggcttgctatttatttatttaatacatatgtgcatgtaatgattttatatcattagaaattgaaacaatatttttaaaaaagtcatttcatatagattataaaatattaatacatagtagtataggaacccaaaagcg

SEQ ID NO: 13147 - DNA, 2789 bp, Heterodera glycines
  misc_feature (70)..(70): n is a, c, g, or t
  misc_feature (98)..(98): n is a, c, g, or t
  misc_feature (107)..(107): n is a, c, g, or t
  misc_feature (847)..(847): n is a, c, g, or t
  misc_feature (851)..(851): n is a, c, g, or t
aaaaaatttaggagtttaaaaaatatcaaaaatgttttgacatttttgaaagcatagcgagagaaaaaanttgaaaaaattctgctaaagtcaatttntcatgtganccaacaaaatgttcacagcaagtggatcatatcactccttcatgttgatctacactagagatcaacattttgaaaaaaccgtagctgtacctgtttcaaaaaatggcctgtaccagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaaagcgaaatgcgaaaagcgaaattttttctacaactttttaatagttaaaatcataaagcaaaaatcattttttaaaattttattccaaatttaaaaatcaataaaacgcttttttgaggcgcgctttttccaaaaaaactttttgggaagagggagggggcaggcggcgccgggaaaattttagaaaatttgattaaaatttgttgacagattttcactaaaaatgatagtagtatagagcgtcaaaagcgagcgggttccgagcgggtgtttcccgcacgaacccgtgcctatgggaggggtgcagccctttgatgttgccgcccagggacccgtgcctatgggaggggtgctgccctttgatgttgccgcccgtggacccatgcctatgggaggggtgcatccctttgatgttgccgcccagaacccaaacctattggaccactttaaagttcccgcccagaaccaaaatctattggaccactttgaaattaccgcccaaccncatnccaatttcccaaaaccgccacgggtgcttttttttgcccaacccctattcctccccgccgatgcatcgccgcgcaaattaatcgataaaaataatcgataatgacactagcactgtcctccctatcgatgtcgctgccgcgcaaaaaaaaatcaataaatttaatcgataatgagaccgccactctcatccgctccgtcgatgcgccgcgattccgggtcgtgaaaaaaaaatcgataagcaccaaaattgtcaatgaaattcgaatttattaattgaacaatagttgaataaataaaaattcatttaaattaatgaaattgaatttttctgaaataattgatggtcttttattttcttccattatttcgcaatttgcacgtgactttacgatttcgcaatattgaccaaaattaggtcacctgtcaatcaaaatttttttattttgcattttccccatcgatttcgcaatctgcacgtgtttttgttgcatatttcgcaatagacacgtgactttctgccattgcgtcgaaaatataacatttgtcaacgaaatattccacaatgtcaatgaaaaacagtcacgtgccaggtgtcagctgacacgaggcattctgcggccactataaaagccccccaaattcacttctccattcagttcaaccaaaagttggattttgctaaaataaaaattgtgggctcttatttaaaaatattaaatttaattaaaatgacttcaaaacgcaacgggactttgcaaaaaggcggtccgtcgaccaaaaaatgggattttcgagctatagggtaagcaatttttaataatatatttaagagacaagtgtaatcaataatttttcaagaacaattttactgaggaaatggaaaattataaattaattgacgaacggtcgacgatttgcgaaaaatttggattcacgaagaacattacggaatttcggattaattcggatgtgagacgccctgacgaagcgatgagggacgcaatcgacacaatgattaaggcggcttttaagactacggaagaaaggatgaagcggaaagtgcggatgtttggtatggcaataacgggtgccgggcttgcttcccggtttgggtaccgtacagggcgtacccgcagaataatgcggatgttattatgcaggagattaataagttggggcagagcggggacggagatgaaaataagaaaacgcttttgttgtcggagcctattatgatgaaaattacttgtgttacaatgcccagcggggaagggcccagaaatgtccacaaatttgactttggatttaaggaacatcagcggataaggtaagtatttccaatttaaaaaatgcaaaaaaaaatcaataaataaatcattattatgctaatttttactaattaattatttattaaggatttcgaatgcggataaaatttgtttgttttatgcgttggtggcgtcaaagctttatttggaagtgcatcggaatatttttaatcgatttatgaatagcatagtgagacaacgggaggcggctgttgaactattacgtaattgtggaattgatattaacgaatatagctatggagtggaacacttgccgaatgttcagaattattgggtgggtttaaaatttgggaaaacgtaaaattaatggatttttaggataagatttaccccggaaaattccggattgttgcgtttgagaagtctcggatccgcggaaatcgatccgtgttttaaggaagggccctatgggacgcgaaaatgtagtgccgatatttttggagaatggccattgggatggtctgaagaattacgtctgcttttttaatcgtgggagaaaattctgcattgattgtgagtgcttttttgacaaggatgttaaacatactttcgactgccgggcaaggtgttattattgtaacaaagtag

SEQ ID NO: 13148 - DNA, 1029 bp, Heterodera glycines
aaacattccgaaaacaaatcacttcccccggcgtccttttgtcggaacaacaattcttcccttttggccacaaatgagcagcagctgttcttctcccaattccttggcccactcgtcacggcacctcctcccaagtgtttgatgggtgccctcctcctccgttagcttggcttcttcccccccccccccccattctcttcctttttctcttttcccattgttcctcctctgttcttcttctctccgcattgtgttccattgttccgtctttttcctcctttccctttttgtacttctcttctttttcttctcttcctcctttcacctcccttttctctttcttttttccatgtttctctcccctctgttttttttttgtgttcctttttccccttaaaagagcctttcctccctcctctaaagccactcacaaatcagttttattcgcctaaatttgttacccaattttgcactttagaatctgtagctcatccatctcttctcatcttcatcctctacttttgtccttctccccatcgccatgtctgaagaggaatcgcaatagtgagttcgttcattgtccgtcaattggcacactttctctttatctctttttttctctctttccttttctctctttcctttgtttctgtttctgttgttgttcatctccattttattcttatactgcttgttctcgcccctctctacctctcctattttccctctctttctctctctcatttgaatgttccccaacaatcgtcgtcctttcgctccctcctcttcctcttcctcgtcccatttccatcattctcttccccaccatcgttcttcttcctcccgctttccttctccctctaattcgtttcgtccttctgctgtccccctgtcttctgcttctccttcgtcctccgttcgttcttccaatcgtcattttccttcttcgccttccctacgacgatcctcctcaacagttcgtcctcctctccgttctgttccgtcttcgtcctcaactccaatccatgg

SEQ ID NO: 13149 - DNA, 2609 bp, Heterodera glycines
  misc_feature (2576)..(2576): n is a, c, g, or t
atccatggccattcttctcaaccgcagcaatacgtttcgtcctttttgctgaaaatacaaacgcaatatcatcaacagaaaagagacggaggtcatcaacagcaagaggaagccgaaacagtatcaggagaacaaccgcagcagcaaacgctgacggatgagcacgacatggaggaactgttggaaatgtacggagtgcggaagagtggcgaaacggtggcggaagagggagtgccatcggtgaaaaactcatgggcatcgacgtatttgcgggaacggaaggcaaatgcacaacaacagcagcaaaagacagggacaaataatgagaaaggagggaaaagccgaacagcccaaaattgggaggagggcaaagagagggaaaagcaggagacgaacacgggcaacgaggacaagcagttcagagaggtgagagggacatagacaaacccatgggacgagcagagggcatgaagaaaaggcaattgccctttttaggcccccggaattgcttttccgactttttagggctttgacttcttctggtgatgaccccaactaattagaaaaaatcccttcgatttcagcgccttctgaacgcacatcaaacggtggacgaactgctgaagaaacgcggcattggcgacttaaagaaggagagggaaatgctgctgagacagtacgaggcactgctggcagcagcggacgaagaattggagacggaatgggcacggatgagaaagaggggcggaggagcggcggggaacggacggagagactcatccgactcgggactttctgaggattattcagaacgagaaaaggcaccgacggaagggaaaatggaagaggaggaaaagatagatgaggaggaggaggaagagcaagagaaagaagaggaagaggaggaggaggaggatgagaacgagaaggaagaggaagaagtgaaggaagaagagaaagaagaggaggaaagggaagaggaagaggtgagaattgaagaaaaattgcacaaaaaagaagaaacagaaaaagtgaagagacaagtgaagtgccaccagagaataaaagaaaagtgtgagcagaagatcaaagagagtgaagagagaaaggtggaagtaacgctgaaattgagagagaaaaaagaaaaggaagcgaaagcagagaaaatagtaacagagaagagaagaatgaggaaagaacacagcataaagaatgagggaaaagaagaggcaaagataaaagatgaagagaaaaaaagagaggaagagaagaaaagagaggaagaagtgaggaaaaaggaagatgaagagaggaagaggaaggaagaagaaaagaagagaaaagaagaagaggcaaagagaaaggaagagaatagaaaggtagaagagagaaagaggaaggaagagaaagaaaagaaagaaaagaaagaagaagaaaagaagagaaaagaagaagaggcaaagagaaaggaagagaacagaagggtagaagagagaaaaagagatgaagagaagaaaagagaggaagagcacaaaagagaggaagaagtgatgaaaaaggaagatgaagagagaaagaggaaggaagagaaagaagggaaggaagaagaaaagcaaagaggcgatgaagagagaaagaggaaggaagaagaggcaaagacaaaggaagagaaaaagccaaaagaaaaagctcaatcaagcagaaaaatggcaaatgtgtcgcttcagcattgcagtttctcattaggaaaagaaagtggagaaaaagagaaaggacagaaggagggagaaaagagtgtgagagcacattttcgactgacaatgccaacggaagagaaaaaaacaactaaaaagacaatacaagtgaggaagcaaaagagtggggcagagagaacgatgaaagagaggaaaggaagagaaagggaggaaaagaaaatggaagagaataaggaagaaagagagacggacagagaagaaaagggagtcaaagaaagggaggaagagaatgaggaaggcagagagacggacagagaagaaaagcaagtcaaagagaaggtgaaggaacagctgacacggaaaaagccggccaaagaagcacaagaagttcgagagctgcttcaaagtttgcggggaaatctgcgacgaacggaaaagcctaagagacaattcccagtagagaagcagagcaagacgacgagagagaaggggaaaaggacacagagggagagagagacaatggagaagggtgtgcaagcagagaagcagaggacgagagtgagtggcgcacgaggagagcgaaaagaaagagaggagcaaagtgaaaagaaagcgggggaaaagaacaagaaaagggaaaaggaggtcaaatgccgaaaggagagagaagcggcggcgggtgacttttccccttcgcttctcccccggcactccgatcagtccgatcggcccaattcggcttcttcttccccggcacgtcgtccgcatgatgagtttcagccctgctgctcatccgtcgcttctcctcctcatcctcttccaccttcagctgatgcttcatccctcgcctcatccgcctcngccatttgcgtcccatccctccgttagcaatag

SEQ ID NO: 13150 - DNA, 985 bp, Heterodera glycines
cggtttgttatatcaaaattttgtggtaaatatgtatattaaggacccccccggcgtttcaaaccttttcaattgggcccaatgggcacaactatggaagaaaattttgtaaggacaaaaaaccgaacgtttaaacttagaaaaatatcgcaataattttggaatacgggtggaggaaatatgggtcagtacaaattaacgattttttgattaatatttcttaggaatgtgaggtcctacgaaagctcaatccacgtgataatgaaaattatgacatagaaatgaagaaatatttcgattctattcccgataagggtggggtaatcaaaacaaaaagcaatttagcaaatatttaggaccaatcgacccccgggatgcttttgcgggtgggcgaacgcaagcgttttgtttaaaataaagtaaaataattgccttcgaattgtgtgacaacagttgcaaaattcgggagcaaatactcttgaaggaattttaaaaaacgaaataattaaatgatgagaaatgggaccaaaatccatataaataattatgctgatgtactgaaattatagtttttcaataaacaaacatcttcaaaaaacgagataaaaaaatgattttttaaaattccaaaaaaaaaaattattattttttcttgggggaaagggtcataaaaatgagaaatgtccccttccaccaacccaaccaccatttctttgaaatgggtcgtaaacggcttggactggccgaccaaattgcacatgcaatataattactgccgatggtcccccacccttgagaattttttttggtaatactgccgatggccctttacctaacattcattttgcccaatttgaatcctggacccggactcggacaaaaagtcgaaaattcaaattttcaaaaattcacttttttcataaatttattcaggcaagctagattaagtgcacacattggcacatcaaaaaaggtcattctgtac

SEQ ID NO: 13151 - DNA, 2087 bp, Heterodera glycines
ctttccaaaaaacctctaataaaacggcccccatcagctaaatttggattttgacccttaaaaaccggaaaattttccaaaaaatcactttttagcgaaattttgtcgagaatattgattaaatttatttttcaaaaattggtaagtttatgtcaaaaataagcaaaaaagccaaaatttcgctttttgggttgatttttcgctaaaagtgagtaaattttagttgtatcatgtttttttcttctaaaatggttttaataccatatttagccatttttttgtaagttttacaatattttagcgaattagaaggaattttgaaaatttaaatgcaatttcaaccaataaatttgaagaaatgttacactcacttttgaaaatttatatccatattttgagatttttaccatttatgtccatatttcgcgattttagtccatattttatggccatattttgcgattttatatccatatttttaccatccctagtcatgttttcatctaaaattagctaaatatttattttatttttatttccgttgtttgcctctctagtcattccttggccggaaaaaaagttaccaatcttgaccgtgtccagaactagagcccggaaatttcaaatttgcggatcctgttgaaggattggaattcaaaattttttgccggaccggatccggccggattaatcctgcaaatcctgcattttccaaaaaatgcaggattgcgaactgggatcctgcaaaatcctgcgcaggatccggtcctgctccgagctctatccagaaccgcttatgaaaataaataccgaaaagttgatagatttgaataccctttttgaaattcagtgcgatacaaaatgatggttagccgacatttgcggaccgacttttgcggaccgacatttgcggaccactatttttgggttgaattgtcaaaaaaaacaaaaaaaaataataattttttcaaaaattgagtgactaagtagttttatttgtgatttttaccaagttgaacatcgcccttcaagagtaatcgatcaactttttgcaatcaacatcgaaagaacccattttttaaagaagtttagtttccatagataaatatagtatgtagttgctcatttttaattttgggcccatagttttaataacagcaaattacggacaatttttgagaaaaagataaactattttagtttttgtttgttaatttaattggtttgacatgccggaaaaaattaagctctcggttaactaaagcgtggaagtgaaacaagataaaaaattttcttggtataaaattcttgaactgacttttatatttattataagttagaaattctataaaaaagaaagaaaaaagttatgtcaaataagacttctctccaattgagacagatcgctttgcatcagcttaccttcactaatttcaatttgggaatattgaatttattaaaatttcttattatttttttctttatttagacagttctatcgagaaatagtggtccgcaaatgtcggtccgcaaatgtcggctaacccaaaatacatcatgcggggaactttcaaccaaagtttttgaaccagtttttatgagcatttgcttgagcattccctgttgtccgaatttttttctgaggcctcgcatcattatattctcacagacatcacgccaaatagcaatattgaaacaacgaatccggtcgttttttccaaattttttgatttttgcagtgttatttgtcgccatgattgagctaacaattgtgggcgatccaaaaaaaaactcagtgtgggcgatccaatgtcttcttataagtagaagtttttataatgcaaatgtaaaatataagttatttttattagttcagtaaaacaaatttattaattaaatgatttttttaaaaaaagccccaaatatctctgttgataaaaaatgagaccgagccggaccggacccggtaacggttttaccggtacggcaaaccggtctgcgattaaaggagaaatccggtttaaaggacccaccatccaaaggaccaacgccgacaaagagctcacggacagaggacccacgaaaaa

SEQ ID NO: 13152 - DNA, 2438 bp, Heterodera glycines
ctttgggatgacaggggcgttcggattttgtaatttttaatacaattaacagtttttgtccaaaaagaccatcgcctaaaatcttatatttcattttgtggtttttcgataggtcaatgaggctaaatttacaaaatgaggctttgaggttttttgaggcttttgaggaaaatcgtcgtaatctgttaaatttatgattaatcgataaattggcataatgtatgagaatcatttaataatttgcggaaccctcagttcggccccacggttcggcaccacctcgtttttccacgatagcttttttatttggcatccaaatcaaacaatcttggtatcattcgaaagttcgtatcatgctctattagcctaacaaaaaataaaattcaagcctggaaaaaaaattattgagaaaaaacttgaatttttgacttttttgcagtttcatgttataactaatttggtaattgtctaatcgctaagcaatagcttagataaagcctctaaacatattaagctttcgaaagataccaacaacattggatttggttgacaaataaaaaagttatagaaagttatattggaaaaacatgctggggccgaaccgtgggggccgaactgacgtagaccgataatttgggtttttaatagagcatcaaaacgaaaatcacattcaaattttccaaaaaaaattgtttttcataaaaaccagaaaatagtcaatttttcccgaaaattctcaaaattaagaatattttcaatgaaaatatgctaatggtcaaaattcttaattttcgcaccctaaaaatgctcaaaatcgcaaaattttgccatttttttggacaactctgttaacgaatcgtattaaaaattacaaaaaatttttccggtgcgtgcctatcggcaccgccagccccctttccccctaaagttttttggaaaaagcgccgcaatcatgcttagatttcataaaaatcttatttttatataacaaatacattgaaaaagatataacatttgaaaattttaatgtgttttgaaaaatttataaaaattaggctttttgatccaaaatgaggtttgttgcttgccaaataacgtttttcaaattttaatctggctgccctgtttaaaaccctaattataatttagagaaagtttcaattacggctacaacgacttacaatctattttcggcaaaatccaacagaaaatcccaaacataattggccctcaacgctttttcaatgccatgtttatccataatcaaaacttttggaccagcgagtgtacgattcaacttggggttgcctatattccaatcggatcaatgccgccattcaatttcgtggagttttatttttccgacccacaaccctggttttttaatttccgctatcgtctgtatcttattctatgtatgctttgttttgtttaattttgttaaattttttctttagaacttggcgtcaagcaattatgaggaacgaaagtggaaaaagacgaatgctttggtcccgattttttcctatgttaaagaaaaaagatatattttggtccgtccagagtttttaattttcgtatgttaaagaaaacattcactgaataaagtataaaaaataaaatgtatttctgttggaatttacacttaaaaaaggaaatagtcagtcctaaagtacttggtatcatattggcaaactttctacaataccttatgtatgtaaaaattaactcctttagaaaaaaggtacaacaaaattcaaaaaattatttttgcttgtaaaattcaaaatatggcaatatacagaaactttggttttcttttcaaaagtgccttagggtcggggtcagttcagcgcgggtttttcggcgtggggtttttggcgcggccagttcggctccctatataaaatggctttttcgccgccaatatttaaaaacctcaaaaatttttaatttgcttttcattacgcatagaatttatgcaattttctttcaaagtaccgtgctaatgcaatagtgagcaatggtacataattgtggtccctaattaacttttatattttggttcaaaatcgccaatcgctgggttttcgagggtgctgatcacaatctttgaccatagttttgcctaattcagaaccccgtactcaaatttcgaataatttatattggtttgactttgacttaaaagtcacaaactgaccagttattatttgatggtacacaacgctgcataaattcttttttaactctctcaaaattagcctatatgtagttcatagcagaaaatttttgcttttaataggctttgctccagatttagaaaaaaattttgaaaattttttcggcgccgaaaaagtcattttaatagggcgccgaagtggccgtgccgaactggccgcaccgaaaaaacccggcgccgaaaaagccgcgccgaa

SEQ ID NO: 13153 - DNA, 4936 bp, Heterodera glycines
tttgatcgtatgcatatttcggtattgcattgtatatactgtacatatgtacaaatatttgtacctatttgttgttgtattttgctgtcagtgttgtataaaaatgtatacaatttactgggatttggtcaatttacaaaagtaatagtctcctaaatttgcccggtatcagaatgatcatttcgctggagaatttctggcacttttactgttttgggccaacgaaaaaattccaagggggggggcggaggaaagtgccgttaaagtttttcggtcagcgttcccattttacaaggaaaattcgccatatttggggaggtccgtgccacctttttatgcactttttgggaatttctatcattttttgctacaatcctaaacagaagagttacagacagacccgggactgaagtgtctccatttaccaatgggagaaatcccgaaagttgagttggtttttcaagcattttttgctgccaattaccgcaataaacaaaatacacgttttatagtcaaaatgaaaacaaaaaataggtgtgtgatgttgtataaagtcaataatcgttatcataaaaacaattctgtcaaaaaacaaaacaacgcgagaaatacataaaatgaagatcatggagaggaataattccgctgagctgagtgtttacgaacaaaaaacaaaaaataaattaaaatgaattttggatgacaatttcatcagagtaataatgactgagatattcgcctaccgaattcccctccgtaaattattttacaggatggggcggggggaattgaattcgggtcatacataccaaggctcggaaaatttgtgacccaaatgaatggaaaaacaaatttttgaaaatttccgaaaatttgggaggcgaggtcaaagcaaatctcaacattacaacccagaataaatttattggcagtttaatttatacaggttttgccagctcaaaacggaatgaataagcaaggggatatatgtgtgcgtgatcaaaggtgcgacgacgacgaggacgacggctcattggctaatcatggaacagcagcgcgttcagtttggaccaatagggcgtgaaatagcgcgattttgtttctgacgacgaacactcggccaacagcgtggccaggtcgttgcgcagcttggccacggatgcctgtggtggaaaaacaatttgtatttgaaaattataattttaaaaaatacaagaaaaatctagggtttcccgacatgatgggataacaaaatttttggagtacggaataatgaactttcaaaaaaatatatttaaaaatacggggccaaaaaggcccggctttccataaacaatttgttacaccccatgcatgcatggtaggtgtgtaatcaacagtagttattgttcgagagtcccgagcctcaactcgctcaatttttcaaggtctgggtcttggggccaaaagtgtcatggatgttgagcctcgtgcaaaaacagaccctcggcgaaatttgttcctcgttcaaagatcaatggacaaaattaggaaattttttaatttttcactattttccaaaaccaccaatcgcacgcacctcaaaattgacattgctgtcactgatggcgaacaccacactgtggaactgttgttggtccgcgtccgtcgtccggctgttgtttctgttttctgcggcacttcggagcccattggcactgctgttgtcgttgctgtttgtgttgttgtacgtcaccactttctgtgcctgttgttgttgttgttgctgtgctcgctgctgctgtccctcctcctcctccgacggcggtggctgattctcgcgctgttcaatgccatcacaacaatcatcattgttggcgttacagttttgctggtgatgcgggtggccattgctgacaatgaaaaaggcacaattaaaaaaaactattcaaaaatttaaaaaaaaatgccaaacttttgggtttggagaaatttttaaacgatcaaatttttcagggtgatggggcgagagtaaaccatggaaaaagccagccaatgtttctgattaaatacatttttatgaaaaaagtatgagtatgtatccgcctccggaggattttttgaaatttgggtttttcgtgttggtaatctcccaaagacttccctccccaattatttttttagatgaaaacgcctttttcgaataatttctcgaaaaatcgcatcagtgtgtttatatttttccccctctttaggggcctcgaattaatatttacctcaggacatcacggcgatgatcagtgccgtcttcgtcgtcctgctggtgttggttggtgatgtttttgttggtgtcccggtcatcgtttgttgcggtgccgtcgtcgtcgtcggtcgatgccaacaacagcgcatccaacacatccgagtccgagtgttcaatgaacacacaaaatttgctgactgaaatttgtaaggggaaataaaaaaaatgataaaaaaaattaattaaattaaaaaagaaaattcttacttgatcccacaaaatcactcgacatttcgaatacactggctgcacactttcatgaagtttgctgagagcggacggtaagaaaagtgcgagcctggaaatgtttttttaaatttataatattttaccctgcataaatattgcaaaaatgtaaatttttggttttttgagaaagggaaattaaaaaaaaacacaaaaatcaattatttaggttaaattaaagttaatttatcacacatatataaacagtaatgaactcacaacacgccactcagcaacgggtaaaggccggcaagcagtacatgcgggtccttcgtggcacgaactttgtcaaaaatgtaaatgctctccacagcaccctaaaggggggggagggggtttattttttttatttttttttctgtcaccaatttattgtttaattaatttgaatttgtttgtacctcttcaaacacataatgggccaatcggttgagaaacattcggactttctgcaaaatgatgagcatcgagtagaaagatgaacgatattctgtaacaaataaaaaatttagttaaaatatgccagtttgctttataaaaattttattcctgtccttctccactacgcgccggacgacctccccccccccgaagtttttttaaatcaaatttacaattagtacttttcaaataaaaacctagaaaaatttaaattgaaaatttgttagcgattttttcaaaatttcatggtgacaaaactatctatgtttttctacaaaagtttcaaaaaatctcagatttaaaaaaaaaaattttttttttgattcgagggggagggggactgtgcaccaaaacgcaccgctccgtgtggccaaccgctggcgcacaacgcgtaacaaattctgtcccgtgtagtccaactgagcccgctgcaactgcaggttggacacaaagccgaacacgcgcttgtacgcccggagcgcattggtggagaaaaattcagcaaccgcttggaattctgttgaaataaggcaaaaataataattaaagaaaaaaaaccgctcaaccccctaaattcctagtaaaacaaattgttcgttaggtttttaaatttgtcaaaacaaaaaaaaaaaatttttttgaattttatttcatgttaggtatttttaaaacacttttggcttcatagaagcgttttttccagaaaattaacttaaaaggttgtttttcaaaaacttaccgtttcgttggccttcccgaagtcgacttttgagcatgaatttttcggagaaaattttgcacttcatttgctcgcgtttggtcagtttgacgccgcacaacaagtgcatcagattcgccacatttgcgggcggtgagcacattgccaacgcgtcgttcacacatttttccgcaatttttgtcgaatgggacacatttttgcgcgacgaaaatggcgtggcacactttttggttgcggtcgttttggcggttttgatactgcaaaaaaaaaatgaattttaaatcttggattaatgtgttgcccaaatcaacattttaagaattttatcaataatatgatatttgcttttttcgaggaaacaaatttcctttaacagttaaaattaattttaaaaaatttggaaaatttttttcaaacaaaaaaaaattaagccatcggagagtccgtgcttttgacggtgaaaaaattgtttagcacccgtataactcaaagaaaaaggcattgaaaaacagaatttgtttgcttgaaaaagcacattatagctgtgtggggcagtgatgccgcgggttgagaaaaatttcgggtttcgggtcgggcactcaaaaaatttcgggttcgggtttcgggttgagaaaaacctcgggttggcatcactggtgtggggtacataatttttttaatttacaaaaaaaaatttttgtttaatgttttcgaggtgaacctaaaaaaaaaaatttttttttttcaaattaaatttttttttttgatgccttgtcttacaagaggatgtgctcaagtgcggaggcaaaatcgccgcgcaacatgaagaagtagccatggaccaggcacagatggtccatcaaccgttgccgtcccatcaattcccggcccatttcctcgctgaccaccgcgtgcatttggcgcaaaatggtggccatgcgaccgatggcggacggagtgcaccaaacattggtgggcagttgggcacaaagcgattgttgctgctcattgttggcatgggcgggacgcaacattttgagaaagtgcaccttaattggacttaattgtaccgacgggggtggggtaattaagattcgtttccaaataataacaataggttgtttttgaaaaacacaaaaaatttgaattttttcgtcatattttcaaaaaagaaaactctcaacgcgtcatcagtaagaccaaggaat

SEQ ID NO: 13154 - DNA, 546 bp, Heterodera glycines
ctccctgcaaattttcgctttttttaacatttgtttgttattgttttcctaaatccccattgatcatcggtttttatgttcacaatgtttgccttttgtgtattttgtacttttgcccatccgtttccgagcatcacatgaacaaaaaattattataaactaaaattgaaaggacgtgaaaacattctactaagccttgcattgattccgagtccgaatcatttatcttcacatataacgcaaaaatttaagacagttggcgaaatataaatcttttcctcccttctcatggccgtattcactcatccgccgattggtttctccgatgccccccccctccaccctctctctctctcttcccctcctcctctctctctctcttcccctccccctctctctctctctctcttccccccatcaccgctatagagattgaaggaaatgtatgcgcggatgaaaatacaaccatttaacagagagggaaacgatacgggcgggtgacagatagggaagcgcgggggggggggggggggactggtgattagt

SEQ ID NO: 13155 - DNA, 2137 bp, Heterodera glycines
aattcctttcaaaagagagccggagctcttatcgcaccctgtatgtgcactacatagagtgctatgccacattttttaaaaatatttaaatatttttcaatgatgattataactagtaatttgccttcccttccttcgtcttctcttttgacgcttcttttgcctcagtttgctgttcttcctttcaaccttccccatctgtaaaagccttttcatatgattgtctctcgagattgtcacgaggtttaaatggagttttgggtgggaaggaacaaaacgaatcggaggggggggggggggagtgtcctcccctttccgccgaatgtgcataaatgaaagaatgaatcacgtgttcagacattcgcggtccaggtattgtgccccggacatttacagtcaatttcttaagggccattttcggatatttgcgtcccaagataaatcagttttttgcggccaacggaacaccaaattgtcattcttttagaattaatttttaaataattcattagtttaatttcaccttttttttgaataaatgcattcataattaaattttaatatttttcaataaattttcacgaaattgaagtgcccatacctcagcgggtataagtcgtagagacttgtaatcttttgcatattgtagagcattttatttcttccagagaacataattatttttgcagaaaatgactgtatacatattatatattttcacttttggactatttcttaacaaaatgattttttaaaatggggtgcgccttcaaaacgggaaaaacactcttttcgcatgtctttgctttgcttttccatgcttcgtccgccccctcccctccaaataattagcccccctttcgtcttcttatgaccggcttctccaataatggccccttcaccatcactgtccttctcgcccacccacgttaatttatgttttatcgctctctgtgtgtgttttctcaaagcactgatgaggggacttggaccggtgccaacttcctttgagcatcatcagaacagacaacagtttcttctcttcacattctctgcttctcttccaccatttccttctctttctatttcgtcttttcttttctctccattttccttcgctgccgttttctcttccattctctcgctctctgatttctcgcacttttttcgtgttttagtcacaagtcgaaagcgcttgccctacaaaggacattgaaatgttatttgagaattatcatcttttgcatcatttatccaatataccatgtatgtttatcaatcatcatactatgggacatttcgggactgggttgttttggcgccgacgttttggcgccagcctcagtttttttattataactttttttcttgttgaccaaatctaacaatcttgatatcattcaaaagcccttcacactattagccttacaaaaaacaaacaaaaattttagcttctaaaaaagttattaagaaaaaaactcaaaaatttcgacttttttggaatttcatgttataacttttttggtaattgtctaatcgcgaagcaataccttagaaatatcttctaaacatgttaagctttcgattgataccaagattgctggatttggttaacaacaaaaaaagttatagtccgaaaacttgggctggcgccaaaacgtcggcgccaaaacgatacggaccccttttgatagccctaagtgtcctctatttacctgtaaaattcaaaaaattcgattgtgtttcaaaaaggttgtggctagtattttcataaatttatttggtaaacctttttgaccacaacttctttgaaactcaaaggaatttgaattttaaaggcaaatagaggaaactttaggctatcaaatggtaccaagattgtttaatttggatgcttctagagaaagttatggtgcatgaaatttatcaaaatataacattgtcgtgtcttttttcgtggtcgtgtaaactgaaatagagccaaaaatatttattgttattattagcttattattaaattataaatttaaataattaattaatcattagaataactcttccgtactgaaatgacccgccccctctgatcacctctcatttgcctttttgtcacttcgacacagcacctctagttcaa

SEQ ID NO: 13156 - DNA, 2473 bp, Heterodera glycines
gattggtcgcgattaccctcattaaaataataataaaataatgtaaataaaaatactttcacgattgattaaaattccagtcctactgatcacaaaaactgatatttttattaattttacatttttaaactgggcttaatttaccagtgaaattaattaaatttgcgtctgccggcaacgccggtggtcttcagatcccacttacacagggatgggcgcaaggcgcaattacgcattttggaaatgatggcgtttttggacactgagattaaggattacggaaatgagggcgttttaatttcttgaaagcttcttggtaaaccacacaggcttttcaactgaattcagcggccaaaaactagagcacgaaattttgaaaaaaacaggacccggaaacccaagatgaacccgggcaggattccagatcaaaagggcttaacagtttttttaaataaagaaaaacaggagccagactagggtctgggaaaatcctgtacaagatcatgccctgtctgggctctaataatgcatatcctcaataatgatttaatattttatacttgagtttttaaataaatttaaaattataaaaatggtaaaataattttttattttcaaaaagtacaaaaagcaaatcaacaaatatcgtaagaaaaaggcgatcaaagaatatctctttaattttcagttcttcttaattacttctccaaattgtttcttccaaataaaaacggttcgttgattaattttcaatattttgcaattttctcgtcactcatttttgggttttgtcctttcatttgcaaataaattttcactttttccattttttctttctccgtcattccttcacccattccaaattgtttcttccatctcttaattactacttggccaactctaattttcttcacaatttcggcataatttctcttccattcttttctcgaatattttcttcctttttgtttgattttctccttaattttattgaatttttcaataatttctctctttttttgatcattttcattttgatcatttcccttttcttctttttcttcccatttttctccaaatatttcgtcaaatgtgttttgctcaaactttttcttttccgctccaatttcaattagagcaattaaaaatgcaattaaaaagaataatatgcacagtttcattgctgaattttttctaaaatgaatatttatttaaatataatttctcaaatgaatttcttatttttctcttataaattcttaaacattttatgtggaaatattgacattattacaacactcattaaattgtatactgatttttttctctctacttatttctcacatttaataatattataataataaggtaaataattaaaaattcaatcctactgatcacaaaaagtaagatattttaattatttttttattagtgacgagaaaattgcaaaatattgaaaattaatcaacgaaccgtttttatttggaagaaacaatttggagaagtaattaagaagaactgaaaattaaagagatattctttgatcgcctttttcttacgatatttgttgatttgctttttgtactttttgaaaataaaaaattattttaccatttttataattttaaatttatttaaaaactcaagtataaaatattaaatcattattgaggatatgcattattagagcccagacagggcatgatcttgtacaggattttcccagaccctagtctggctcctgtttttctttatttaaaaaaactgttaagcccttttaatctggaatcctgcccgggttcatcttgggtttccgggtcctgtttttttcaaaatttcgtgctctagtttttggccgctgaattcagttgaaaagcctgtgtggtttaccaagaagctttcaagaaattaaaacgccctcatttccgtaatccttaatctcagtgtccaaaaacgccatcatttccaaaatgcgtaattgcgccttgcgcccatccctgtgtaagtgggatctgaagaccggcgttgccggaatttaattaatttcactggtaaattaagcccagtttaaaaatgtaaaattaataaaaatatcagtttttgtgatcagtaggactggaattttaatcaatcgtgaaagtatttttatttacattattttattattattttagcattattaatcgcgaccaatcagtagggagagaagagaaataattcaacatttctctttaaaaaagcaacaattatcataaagaaaaaaactaacaatggaaccaaattttatctccttaatcttttaatcctcatttattcttccccaaagcgtttcttccaattgaaaatggtccgttgattaaatttcaacatttttgaaattttctcgtcacttatttttgggttttgtcctttcatttgcaaataaattttcactttttccattttttctttctccgtcattctttcaccc

SEQ ID NO: 13157 - DNA, 1114 bp, Heterodera glycines
tgcaggtcagaatattgaatatatttaaattttcttaaaaattggcaaatttatgacaaaataagcaaaaaagccaaaatttcgcttttcaggatgatttttcgctaaaaattagtaaattttaattaataatttttggatccaaattttgttagaaaatgaattgaattttgacttatttacttttttaaattttctttttgcattaatcgcccaaatttttctaaaaattatcattactgcagcaaagatacacaaataagaaattggaaattttaccctaaaatttggctatcatttttatgattttttgccagacttatgacgaattaaatttcgcgaaaaaatatcccaaaaaatggcagaatttttgtccctcgcctaaaggcaaacatttttaacggagatagttccttcgagagtaactttaaccaaaatctaattccccaataactctttaaagtgatcagaagcttactaaactctggagggatactaaaatacgaaaaaactagccgaatgtatctataaattttcttatcctataaatcaattttttaaaatttttttgagtttctccattatttatttttttacctcatttttcgctaattttatccctcaaaattttttctaagactgataagaagcattccaaatttttaaatgaatattaaaaagacgagagaatattgcttatataaaaattaattctcatttttatgaaattttttagttaaaatattaatttaaaaaagtaataatctaaatcagataaactgactcatatcgtactccgtgtgccacagtatacaattttaaaaacacgaaatcaatttttgtattggaaattaattctaaattaatagaggcttttggtttttcaaaggcttatcgtagaatagatttttgaaaacttattaattaatttttcgataactaaaggattaaaatgaatgagaattagttcatacagttgggcaccggaaaattagacacaaaattcctcctttaaaaaataaatacaggaatttaaaataaattaaaattttaatcagcaattaaatttaattaaaaaaagatattttttttgttttacttttgctttgatcga

SEQ ID NO: 13158 - DNA, 2326 bp, Heterodera glycines
  misc_feature (2316)..(2316): n is a, c, g, or t
ttcttcgtcccttcgttcttcaccagcagattaatgccataaaatgaacaccactaaacattttaattaaaatgacttttaaaaataatttaaatttattcgcatgcaaaaagtccaaatttaaaaaagtgaatgaaaacactatttaattagtgccttggtaataataatttcaattcctgaaaattctatcctttttttacgaaatgtttcattttttattattgccaaaagcagcaacaattgaatatatatatttaattatttttataattttaatatttagtgtacaattaattccttttttcgcttttttacacctaatttactactttctaaattgaaaacaccttaatttttttattttcgtactttaggtaatttgggtttacgaaatatttcattttttccccattaccaaaaagcagcaacaaattgctgctgatccaagtgaaggcggaagccgggccaagcttctcggctttgctggagctgttactgtgatgactgtgcgacttcaaattgctgttcatctgctcctcagactgatcaaggttgatcaactgatcaaagctgttgcacactttgccgtcgaccaactcgtcacaatggcgacagtccgacgaattcccacccgattcacggcagaatgtgttgaaaaatttcgggcactgcttgtcattttctgtagcgcatccattaatgcgaaaaaggtctttaccatgctctgtaaataagatgaaaaagttaattttatattgtttttcagcaccggcacaatccaagcaattggaaaatatggcattcaaattttttattcggaaaaataaatgaaatttctcaggatattgcccggattttctcaggatcatgcctgagttgggtactggaatgggatgacagggtcataattttttaacggcaaaatcaggatatttaaacccgataatctttttgacccccacccccaccaaattctgatcctcctagctattttttaatttaattgaaaattttatcataaattccaaattttgcattgaattttcaaaaactgtaattttcaattaaaaaaactcaagatttaaacaaaactttaatataggaatagagaagcaaatttgctgaccgtcagtgcaagtgaatgtcaggcaaccataaaagccgccccaaatatggcccaattcgcccccgggcacacaatcagctgtaaaagtgttgcggaaaacgttcgccttttgggctgcttcacgctgatcatagcgcacagcaagatccacgtacgaatcaagctgaattgaaaaatttgccaagtgcttcaaaacaacatgttatggcacaatgtgttggaagacaatttacttttaatttttggcacgaattgttgccaaggtaaaagcatactcaattgtttatacaaaagctattaatgtgtattgtttaggagcaaatactgttttagaaaatttatttttagacgtttggatttcagattaagaaatttttatgagccttcaatcaatctgctatgtgcacaaattgcacttgtcaaaaattttaaacggtttttaagctaataagaaaatttttaaaaagaagtcttgggtctcgagttttttgggtctcgagtctcgggtttttcggtctcgggatcgagtctcgggaaaaaaatttgtttacttttgagccacgtaataaataatttttttttttttttggttgatttatgaggtaacgcccattttgatggctttgagtaacgacaaaacaccaaaaacctagggcatgaaatggcactaaacttaaacagactgactgaccccaggtggaatctgagtacgattacgaatggccacaacacaatcatccgctgaaattttgtgcaaaattaatttgtgaaccgttataaaaatttaatttaaaaaaacgaacaagcgggattaaagaaatagtagttgaagcatggatcgatcagcagcatgatcagaagcacgctgagaaggctaatgggtgatttgcatgaagccattaattagggagagggacgaattagagagcactgggatgaggaaattcaaattttgaattcaaattgaactgaaaaaaaaatattttaatttaggaatgtaaaatccaaatttaaaaatagattaagtgaatttatatctgtgtggtcttttttataagttctgttttgtattgtcatttccggcaaattgtaataactttgctgaaaaattttatgtgatttctttaaagaaaattaatagaaaaatttttcatcgaaaaatcttattatttttttttttttgcaanaatttcaatg

SEQ ID NO: 13159 - DNA, 779 bp, Heterodera glycines
ttgccgttgcggtggtggtcgacggggacggcgtcaatttggaggcgggcactgccacatggcgatgatgttgaagctcaatatcggtggatgttgacttcatttctacaaaaaagtgcgcacttcgatgaaatttcagcaattacaaaataataaaaataattttcgacacaaaatcggagaaaaatgaatatggaaaataaaaaaagtgaaagttttagaacaccaatttttgggcatgtacataaaaattttttaaaaacaaaacaacaaaacgagaagaataccaatatgatgtgtaagtgtgttatatgacattcgatgaaaagaaaattttaaaaaatttacatttcaaaacataatgctgcaggcaaatttttaattcattcatttcttcggaggccgcccatttgggttattggaagaaggaattgcgggcggacaactgtcagctttgggttgcctttgagaagcttaaatttaaaaatgttattattttgaaaattttggtattattctttttttgtatataaatttttaaaaaatgaaaagttaaaaaaattgtttgataataaccaaaatttatccccacaaaatcgaaatcaatttatatttaaaaaatcacaattatcagcagaatgacgctgaacattattgtcattggcaccaacagcaacaaaagcaggcggaagtgacgcattgtctctgccccgtagtgaacggactgctgaagaagaactcgtggcgccaattgacgacgaggaggagacggacgaagt

SEQ ID NO: 13160 - DNA, 1575 bp, Heterodera glycines
cccccccctcgatgtgcccaattttttttaaatgtgccgcagtgtctgaaaagtaaaaaaagacgtccgggtgcggtgcggtacgcaatccaagccaaaatcttaggaccgggcttgttgtatgaaacaaatccgacatattagaacaaccactcttggttacggtccgggggcctaaaacaattacaataatactaacaaacagcagtgtgtcagtggacggcaaatgcgcgtcgacgcgtgcgtaattggactgccaaaggctttgttggcgtttgctttgttgccgaacaatagtttgagtttccatttcaggcactgtgccctcctcctcatcctcccgtatcggcatcattttgcaccgctttcgtgccgtttccgtcaactcctccatgtcatccccttggtctcccgtgttgttatccgtggtgttgatgtactgcttgaattggtccaccgtcatttggcgtggaaaggatgaagccttctccgtcgccgccgtttcttcttcaccattttcctccattttggcaccgtttgaattgcttatttgtgccactgccgcagttgacgtttttcgagacaacaaaagttggtcagcacgtgccaacagatcgcttggcaacggcggcactccgcccgaatgcttcacaccccgtcgcaattgtagttctggaaactggaccaaatgggttgattcttacaaattaaatgtttacgggccaaaattcaaaatccaaaaatataaaagaattatctttaattattcgaaggtttcatacacccggtaatgtaacaaatttccatctctctatttctcaatttttggaatatactttttttcaaattatttaaacaacaaaatatgtaaccaaaaaatgccctccccccaacgtgccaatggaacgtcgtaccgtcaagcattttttggcgcatttgtccgcccattgccagcgcaatttgcaccaaaatcgggtcacagctgcccaacagtttgatgtcggcagtatagttgcgcaacatttggcgatttatcaaaatttgtggcacatcgccggcaatgttgaacggaatcagtgagacgggacgcacctaaagcaattttttgattccgaaaatcgaatcgacgaggagaatatctcttttttgcgtaaattttaaaaaccgtatgaaaaccttaaaattttctttgggatggtaagagcgttaaatttgattagcaaacgcaattcgatttacagaaaatttcggtccaggttcaattccagcaaggtaaaattattttctaaatatttgaaattcatgaaaatattatttgttggtgtcaccgtctccgaatttttttaaagtttaatttaatttcacaagaacatctttccaatttgctttgtttacctgcatggacgagccgatgacgaccaacaagtccaattgagtgtggtcggcgcccatttggtcatgaaacgcgccacccaaatcctcgccgaagaacacaatgtccggcttcagcacacccgtcacacaccgattacagagggcaacttgctgatgaaaataatttttcccaaatgataa

SEQ ID NO: 13161 - DNA, 744 bp, Heterodera glycines
  misc_feature (50)..(50): n is a, c, g, or t
atggcagtttgcggatcagcaattccgttgatttttggtaacggcgaatntcgcgaagcgcaacggtacctgcgaagggaaatgacacaaaattatgtgggaaaagcacatgaattaaaatgaatacaaaatttcaaaggttagcccacccaatcaaaataggatttttaaatcaactttgtctttttttctcaccagggcggtaacgatgcggcttcttgactccaccggtggccggtgccgacttgcgagcggccttggtcgcgagctgcttccgaggcgcctttcctcccgttgacttgcgagcagtttgcttggttcgtgccatttggagagagagcaatgaaagttgtcgtgaacacaaaatggaaagagtgagccaagcgagcaaatgaccggctatttatggggctcggggagggcgggtcaatgcggaagcgacgccaagccacaaaattcaaatgcattttttagcgcgcatcttttcgctgcgattcccaaagggatgccacgcccatcccacttagggctatttaaactttaccaatcccccaccttcctcacactgtgttcacggtgaaactctctgcctctctgctgttctttgtgcttcattcacacaaacattttcgctctcttcaaaatgtctggacgtggaaagggtggcaaagcgaagaccggaggaaaggccaagtcgcgctcttcccgtaaggggctccaattccccgttgggcgtcttcatcg

SEQ ID NO: 13162 - DNA, 1767 bp, Heterodera glycines
attaagaaatagttttaaaaattattattcttaaatagactactacagtttttaaaaagctattcaattttataagcaatacatttagctaattttttgaactttagtgcgctgttataatgtcaaaaactttaatctgagtaaattatgatcaattaattagtaaatacttctaaagatttgaccgaatagcctgaaataagtgttataaaagctaaacaaaaagtataaatattaaacaatcggaataagagctggagtttaagtccattaagaaagccgcacattcacccattctctaatatatttaattaagttatttattattttgtgggtccttagtctgtgggtcgtttgatactgcacccttactgcaaaagtgccaaaaactgtctaataatttgcattaacaaaatgtcagacaaccgaaaagaaggagaagaaaaaatggcaaaagccatgtaaaagctaaaatttcaattttaaattttatttttcctttttcagcttaatctctgccgattgtttgttcaaagtgttcaatttgcttccgcctactcaacttggcctcggaattgcactgattagccaccgatttgactgtggacgaacatttcaaatcgcgcaaatgggcgctaaaatttattcgaattctaagcgaaattggacagaatggcgcaaaaaaagggaatggaaattgtcaatcgctttgacaatttcgcaagcgacgccaagacgctatctgttcgtccaggcgctacgcgcgatttccgaaaagttcgaaaaaaagttagcatatctcagcgcaaaggtgatgcaatttaagatgcaaagacaaaaagttcttaaacgagatcagttgtcgaccaaaaaaaaaaatttcctcgccatcaaacaatatatttcaaatttggtgcagttcattcttttttaaaattgtttctaaattcatttttaatttattatagtctttatagaccatatggttgaagtgtaaataaaaattaattaattaagcaataaagtaaaaaattaattacttaataattagttacatagtagttaataatttgttttttttatctttttcgcatttttaatgtgatcagtaaaattgaaattttaattaataaggaaaaatttattttatcattattttacttaataacaatattttattcatggataagatttattcacaaatgtagaatttctttgttgctataaacaaaacctagaaaataggcactaactaataggtaactcgaaaatagctcaaaaacaaccaaaaaacatgtttttcgtgcgtttcatgtcactgggagagctcggtattttgaaaaaacctggacctggatttcctggacaaaaaccaggaaaatccaagtccagctaaaacccaggtagccaaaaaatgaaatggacctggacccaggaaaaattcaatcataaatccaggtccaggccaagctctagttattaacaacggcgccgaactggacggttccccagaaggtgcccaaagagcttttttttactcaagggtcaaaaaattattttttttctctattaatatttttcaaattgcagagctggggcgaaaaagcaggaatttgtacaggtcttacgcaaaaaaataaccattttatgcataatcccccatgggggataattagagaaaacaccgctaaacacccgatgtaattgggagaaaaatattcgatttcgtcgcgacacttcgcataccaatgcaaatggccaattttg

SEQ ID NO: 13163 - DNA, 2344 bp, Heterodera glycines
ttgaatttgaattcctccgaaccaaaactggccgtaatttcgtccttacggtcaaacaaagcaacgagcggaaaccattggtcaaccgcggaatatgaagcaaaggaaaacttggaagaatctgtgggaaaaaatatatgaaaaagagatggattcttaaaaagcacaaaatttctaaatatattattagaatttctaagcgaatttcaacaaaaagtattaaaattattttcactttcattaaaaaattataaacaaaccaataggacgtccattctttgtgaaaattatctgtcgggtggccaaattaacgccgcatccgacaacatcaccagcaacgaatttatatttaaaaaaagctcttctttcttctccgttaatgtgaaaaaagccattgctcccataagcataaatgccccgggaggaaaaaccattcctttcatcatacaatgagtgccttttataaccaaatccgatcataaaacaactggaaattgtaaatttgataatttattgtaaacactttttatttaaatcattacgcttaccaatagattttttgtactgtaatttcaaagtaaaaaatgccggacgattcatttttgggcgaaattgaatgtttagcgaagactgggcggaaagaaccttttgatgaaatattcaattatttaatagaaaaaattaaataccagattgttttgccgagtgaatgacagtcaaaccatcaatgattcggaggcgtgtatcacaagcggtggcatcccagtgattttccttaaataatttaatttattttaaataatagttttattaggattggccgggtccgggtatcaggccgggtccagaacccggttttttcaagacctggacgggattttttgaaaatccaataaactcgatgaaagaaaaaaattatttaaaaaagtatttgaacaggttcaattcaatctcaggaatgtaatccagcagtagccaaaaaattagtaataataattgtttttatttgttattttttagagtatttgtcagtgtgggtcgtctcaggtttggatcatcataatagcttttttaattactcaaaataggaccgcccaccaataacataccgttttcctaatttcagttttggcctttttgttatgcttttcctcatcaggatttgcttgtttgcgtttcgtggtgttcatgttgctatttgaagaagcctcggccattttcacatcgccaattccactaccatttgagcattcaaaacaaaaccacataatggcagaaaaaaatacaaagattgggaagtgaaagctcattttgttgggtatacagttgatcagtgatcccgttctatgcttatttgttaggtgaacttaatgtttgcctgaaaacgctgtgaaatttaggaaaaataagttaaaaaataagaaaaaaaaatattgtaaagtgataataatttcatattttttttgttttatattgcgaatttctgtttaatagcagaatattaagcgtcgtttatagcaaatacagacaaatatatacacactacagcatcagaaagtattatacaaacattaagcatgtgaatcgtattatttaatatttttacaaattgcagcgtaaaatagaatagagaatggaattttccgtctgtacggaaacgggtacgggttacgggctaaaattcgtatacggttccggcccgtatctgatctctaaatataatattactaaatattatagcatgcaaacacaatgatcaacattttattatataatatttatacaaactctagcatcagcagaggaatattatacaattttaagcatgtgaatataatgatgattttttattaaaatacttatacaaactatagaatctgtagtgaatatgtaataatacgcatataatacaatgatgaatatttttttattaataatatttatatatcaataaaagctataagttgtgtttactctacttatgcagaagagttgtaaatttttaataataataaaaaattgttaatcaatttatgcatgttatattttgtatagttgtatagttgctatatagaatgccgaatttcttaattgcattttacatttttagggatttgagttattcactttctgttatttgcgttatatttcataaggctatgcgattatcgagaacttaaaccgagaaatgcattttttagagcctttccatgccttttttaatttctaaacagggcccggatttttaaatgctaaaaatcccgaaatgggtacctaatagttgctaaaaaactgccaaaatagtttctaaaaactcaaaaatgccaaaatagttgccaaaaag

SEQ ID NO: 13164 - DNA, 3404 bp, Heterodera glycines
  misc_feature (3291)..(3291): n is a, c, g, or t
aagtcattcaggaatacatatggctcatatccacctttgccgtccaaagacgaagactcacccatagcgcaaatgcatcgcgaagtccgcgaactaatgcatatgcaactgcacagatgcagtgatagttggtgtggtccacgtgaccccaactttgggcggtgtaaaaagggcttcccagccccgtactcgaaatgtacgatactacacccggacaggcccgcattgtattaccggcctagcccaaccgacggtggtgcccaaattgaggtgaacggcttaatatacgacaactcgcaagtcgtgccgtacaacccatacattttgctgcgttaccgagtacaccacaacgtgttattcgcatacggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgccatttgcaaaactctcgcatcacgttgttcatttgtccattcatttgccaaaccagcagcccgttgtctacagggcattccaactggtgagcaaagctgaggaaattcagcgaggcgaactcccagagacgccatgctctgcttattggaagcaatggcaaaatgaatggcagcatgttccttcgcttaaggacatgctttttgaaaaagtcccagagcaatttcgctgggcaaaggaccgatgggtcttttataaaaagaagcctatcaaaaggcccccaatcggtcgtgttgtacctgtccctccaacggaccgggaaagatttgcgctctatgcgttaatgcgtcactttcccggtgatccggaccacttaaaactggtcaatgggcagcagtacaacaccttcacagaggccgctttacagcatgggcttcttgaagatgaccaaatttggcacaaaacgctcggcgaggcagccttgcatcgctggccagaccagatgagatggctcttcgtgagcatcctcgtctttgggcagccgagcaatgccctagaactgtggaacaagtacaaagaccaaatgtataatccacagggcatcaccagtgcggctatacgccaagcacgcgagcaggaagcgctagccgacattgattggcgattgcacttctttaactcaagctgcatgcactgtggcctcccagatccaccaaattcaaaagccaaaaatatcaatttggcagttgaagaagctttctttggtgatgatgatcttaatatgccgcctggccagccaaatcctaggcagcagcaaaacgctccacctccactcaacagcgaccagcaaaaggtctttgatgctgttgtgagggctattcaatcggatccgaaggatccgactgtgcctcgccgtttctttattttcggcgatggaggtacaggaaaaacattcctgtttggccaaattatcaagcgcttgcgcaagcccccatacacctacaaagtgcttgccacggcatccactgggtgtgcggctattttgctgccttatgggaaaacagcccattccactttccgtctgggtagagaagtgtcattagacaaactcccaagcattcccttggagagcttctttgctcgacggatacgtgaggcccaactcatcatcattgatgagatcaccatgcttcacaacacggtgattgcggtaatcgaccgagtgtgcaaagaaatggcaattcgccagcacaaggacctcctcttcggaggaaaaacggtcatttttagcggtgacttcaaacagtcactgccggtcgtgcctcacgaaggcctaactgcacaagttgcggcctgcttccaaacctctccactgttttgtcaattcctgactatgaaattgacaataaaccagaggttgggccaagggcagcaagcttacttgcaaatgtgccgccaaatcgggcttggagagaccggagaacacttctggattcctccgcagttcctcgtaaagagcagggatgagttgatagactttgtctatcccgacttccagaaactccttggaaatgacaaggaactgctaaatcgtctgatcctcgcacctcacattgacacatgcgatgagatcaacgaaatcatgatggcgaatgtgcctggtcaagtgcgcgaatatttgtcctcggacaaaccgcttgacgagcggccactggatattgatgaaatcgagtccgaagtggcagcgttgaatcgacgcacagactctgggatgcctccccaccgtctgcgactcaaggtcggaagcgtcgttgttctccttatcaataaaagtgataaggaaggactgatcaacggcacgcgcatcgttcttgaagaacttggcgacgatcgtctggtcggtcgtgtcattaacagcaacgctgttggtggccaggttaagttcttcatcgaaagaacacgaaatgtctacgaggacaaaacgcctggcggcataaaatatgagcgtttgcagtttcccatcaaacctgccttcgccatgaccattctcaaaggtcaaggccaaacaatcagcacggtcggaattgacctcgaaagggatgtattttcccacggtcaattgtacactgcattttcaagagcaacggacgggaacaacgtccgagttacgctcccagaagggagaccgacgacccagacagagtcaaagtgctgaatgttgttgcaacgaaaatgctcaatttgcaataaagcaaacgagttaggtccagcgcgtgcgcactttatgatgtcactccgttctcatctgcacttaaaacggacacatattcaaaaaagtgctgccagctggactgaaggaggcaggtgggccaatgacgtgcgagttagggcacttccggtttccattgcattgaaaaatgcagtgtgtcaaggtgaaaccaagtgcatgtcggctgacgcaaagaccctaacacaaggcctaggtagcgaagctcccaaagcgcgaagcgctttaagcacccaagaaacatgtaagcacacacccgctagtatatacgttatattgacaaggagtttcgttgctaaaaccattttctcccggccgaaggccgggagcgccctgaaagtggtggaagggtcttacaactttttgaggagcatccgggaaaactatagagaaaaattcagcgcggacgactgagtcccggggaccgatttctcactttttcttgcgtttgttagcccataactntttttctaaaaccccgaatcaaaagtgcccgctgtgagggcactccccacaactgtcctctacatgatggtatttttatttttttattagaagccaccccctgggctgcacgc

SEQ ID NO: 13165 - DNA, 2779 bp, Heterodera glycines
gcaaattacaattaaattaaggtgccgattgtcagtgccattgttggacaaccacgcgaaccgtgacagaacaaaaaatgggcaatggttaccttgggttgttcaatacttatgacgtttttcgctatcgaaactcacagcttgcgactcttaacttttttctggacattgaggtggattcccaaatattctgggaaaataataattatgatcatatggttctgataaaataataataataataattggttttatctattttctataaatatctttcctaattaatttaatattattattttaaacggcgtaccaccggggcatttaactgaagggttaaaatattggaaaattgctttagaaactgatggacccggccaacgggtggtacaacgcggaggaggacacggtgacctttgtcacggattttttcacgtaccaatgaaaacagacgcaactcactgatcggcggggaaatgagaaataactttttggcactggtcaattttggattaatttttgatcagttatttatgaataatttcaatgatcgaatggatgaatggtcttttaatgaggttgtaattttcaatttgcttaaatactgttggttaattcgaacattatcaaaaatcattgtgacccgatttgttaggaacagatttatgtcaaaaatagcgataatattttaaaatagtttaataacttaattatgtcaagaaaagtgtgagaaatctaaagttattcaactgtaatcgaagtaggacaatatttatgacacaacataaaaagaggagcattaataaagtaaatattaaaaaggtttttcatttgcatgaaaaaaataaaaatattaattaaacttgaattaattaattatttttatatttgccattaatttgtcgtcgattgtttgtaacttttgtacatttccttctccgatttgtcactttccattgccatttgtctttccgctgcttgcgaatgatttgtgccaattgtgccaccgctaatttttgcgtttcccaacagccaaaaggtttccattacgcctttgccctaaaataatttttaaaatatgcattttaaaagcaaaaaatgaatttgagttagtcaagaaaaagccaatttagaagcaattcgattatttataatgataatcagcagcactaagaaccttgtgctttttttggacaaaattaggcaaatttttgccaagagataaagctttaaaaaataacaaatattcctcttaattctattgattagtgctctctctgattttgaagactttgtctaatttgtgttcaccttaatgatcacttcgcctctgctttccgttaagtaagcgcctccttcagagttttcgtgcaacaaaatgcacgtttctttggagatgtgaattttgttggctgaaatttaaataataaaataaattaaaatgccatttgcttttcgaccgcttgaagaactttccatccgagacgcggtgttcaccgtgtcaccgaagaggcaatagcggggcatggccaacccttggggaattaattgcaatttttaaagggcttgagtcgaggacggtcctaagatttaggcttggacggggtaccgccccggcgatcattccatttttttgcggcgcgcttacaaagggcggtgaccaccagggatgtgcctaggtttcgcatttcacctttcgcattattcgcattttttggtgtttcgcatttcgctttttggcgcgaaacgcgacttttacagccctaagaattggattaaattcccataaaatttttaaaaatttgacctataaattggctaattaatttgatgaaaaactgttctcagcggcgccccaaaactcttattactcattagaaaaatgataaaaatcacaaaatttgatcattttttagtgaaaatctgtcaacaaattttaatcaaattttcaaaaattttcctggcggcacctgccggcgccgcctgccccctcttcccaaaaagtttttttggaaaaagcgcgcctcagaaagagttctattgatttttaaatttggaataaaattttaaaaaatgatttttgctttatgcttttaactattaaaaagttgtagaaaaaatttcgcatttcgcatttcgcctttcgcatattttagcttttcgcatttcgcttttttttcatttcgcatttttcagtttcgcaaatttcgctttttatttttcaatttggcccatccctggtaaagtaatacctatttgacagtatagttaataatgttatacggtaatcattgtccattttacccttttgctgttgatgtgccattcccattttgtcaaccttcgattgaactgtcacaatttgttccatcagctttttctcgagctctgattggaatggcttctgctgaaattaatgaattttattgcaataaatgtgtttactaaaatataaaaatattagggccaaaatatttatttttatttttgtagctttcgattctcagcttcggcattctatgaaataaaaaatcttagcaaaaaaagaagcgatgtcatccaaaaaaatttcggaaattagcacctaaaataggcatgcaaaaaagtgaaaaagcataaaaatacacaaaatgaaaaaaggcaccagacttttggagcaaattttggtacttttccgttttggggccaaagtttgatttttttttttaaatcaacagcaagctaatagaattgcagatccattcgaagaggtataactcaaattgtggcatttatcctc

SEQ ID NO: 13166 - DNA, 4388 bp, Heterodera glycines
  misc_feature (108)..(108): n is a, c, g, or t
  misc_feature (119)..(119): n is a, c, g, or t
  misc_feature (160)..(161): n is a, c, g, or t
  misc_feature (170)..(171): n is a, c, g, or t
cagtcgactgatgattcatccatcgcatttctccggcatcaatgccccgtcccctggatgtttgtgcttgtggagagcattgaaatgtgtcagattagaaaagcgcanaatcggtaatntaagcgtaggcgtcgctttgattcttcgcctgttttctctnntcagtatannccttcccctggacacgcgcttctaccgtatttctgttctgccaatccccggtgattttgctggtgccaccccaataagcgcagcttcgtcagtgtcttcatcaaagcgttagaacgcattgctcaaacgatgacttgttctagtggatttattttatcaccttttcgtcttatgtgttcattctcttttatttgtacattattatacctccattcattttaaatttccgagaacaattgacactttcgtcaattgtacgggtgcgtatctgcttcattctctgcctatgttctttactttgcttgctttagaatttgccataggcattttagtcagacgaaagctgccgttttctttaatttttggctctttatcattttcttcccatgacaatgcgtataaattcatttctacaactatttaaatttagattctgcataactcaataataaaataaaaaaagttgctaatttcgttatttccttttattcatttattattattatttgttaaattatttattttttagttagaaaaaaggcaagcacaatgatcttggcggaaatgccagaggacaaaaaaagtgccgacactgaagtctttgaccgggcttttggtcttcggataaggtgagattcgtcggtcgtgaaggcattgttaatagcatgtgtccataatggaaatccttttaggaacccaaaaattgctctcgaaactttggatgctttttgtcccgggatgaacaaagtgcggctgagcgagttgaatacgcgggtggggcccagcggagaatgggttacgatgggtgttgtggtgggcaaaaacgagccgaagaaaagtgtcaatggcaatgagtacatcatttggaaaatgtccgacctccaatttggtgttccgtccgtaaaagttcttctttttggcgaatgcgtccgccattattggaaggtccaaatgggcgccacacttttgctgaacaacgcccaatggacggaggcgacggatggcaaaaacgaaggtgcaatttggaagcaaatatgggtttagtttttggtttgtgaattcgacgaaacgaaacattccgattttgtgcctccgtttcgatatagcaattttaatatgctcttaaatagaacagagcatttgtatatcgaagcggggcattttcactttatatcaaaagaaaaatgaaaatgcatgccatccccaatgaaattttgtggttcagtgctgctcaagctgttcaagtcggctcaggtcgtcgaattgggtttctgtgccgattttggttattgtcaggtgactcgtttgtctgtctattcggttgtttgaatgtgtttttagggtatgaaaaatggtggcgaaaaatgcacaaatgcagtgaacacctccctctgctcgttttgccctttccacacccaacaacgcgcccgccaactctcaatggcccgcggcgctttgaaccgatcgtacaatttaccgccaaagaaaatgcgctctttggaagagcattcgaattcctttgacacaccaactcaaattggcgtaaaaaccatcgcaaggactcaaatatcagacggaaagatgtacgctttaacaagggaatttgtgggtaaaattactcttaaaaatattcagtttcacaaagccattgtccgtcgttcagcaaaggctcgaaagtaaaacggcggaaatgaaggaaaaacgaatggacgaattgaaaaagctcgtcacggaaaaggtaaatgaaaatgaaggaatattttcattaattattatgggaaaggaaaacattctgttggttttagccgtttggctttggtgcgaagaatttgttgctgaagcagcagagggacaaagagaaccaaagcccgcgggcggaagcgtcggcaccgttgcagtcgcccagtcaaaagtcgcttcagtccatgcgcgaattcatccgctcgcgagtattacaacaattttttttttaaattcaataatttaatagaatttgtgcggctcccggtaaattggacaccagaaaattggacactgttgtaaataaaaatgaaaataaacaaaataaattactaaacaaaaattttggtttggcctaaaagatctttatcttaatctgccatatgttgtttataagcgtaaataatatggaaatgaatttgttattatttttgtaacttcaggagaagaaaaacatcatatcattcataaagaaataagttttattactcatttctggtggattttttggcccattgatcaatcatccctcatttaacccatttattctactcaaatttattttcacctagttcttgattttttttaaaaaggaaatcttagtgtccaattttcctttagtgtccaaaattccggcggtgtccatttttccgcttggtgtccaattttccggtccccatttaggctccctatatttacactgtatataccattattatttttgcctcaaaatgcgtcgtcgcctctcacgcaaatggaatcaatggaaaacacccaagcgcaaaatgttgaccaactcacagcgaaagaacgagcgaaaatcgtaaatgaatttagcaaaacaacaattcaaacaagtacggccattttccttttgcagaaacgcgccgcagaaattttgaaaaatgctcccgccaaacggcacaaacgtaaatttaaatttatatgacctttctggcaatgttccatttttgagccaatgacagtaaagcacaaaaagaaaatggaagtaaaagcgacgacggagaaacaaattttgggggaagttttagcgacgaacaaattcgaacacttttggagaaaacgtctaaccacgacaaagaggcgaaaagggtaagaaaagggcaaaggaatggacagcgaaacaatgcaattttcaggcggaattgaaccaacaaaacgtttatttcgaccggcgccaaatcgaagaacaaattgaaacgaatgcaacttcactaatggaattgaagaactgcaaagtcgttacctgctcaattgtgagtacagaaattgaaataatttctttaaaaaagtttgcttagatcgcaaaagccattgaaaaatagtattttttttgctgaaaatttcggttttctccgtcagacccctcttgttcctaaaattttctttaaattgtctgacgtacgtttgttcacagtgcgcttgcacgagtcgccatcaaagtgtttattgtaagacgtcgggacacgaagtgaagcggcattttgcggacaaacgcttcttcaagtgcaaaaagtgtcagcagcggacattttgctacgaccgaatgcccacgagggcgtgcattgtgagaatgaatgcttttgaccacttttggcattgaatgattttgtttttaagtcgtgcggagcaaaggaattttgccgagtggcgatgaaagacgagagaaaagtgctgacggagagggaaagactgaagctcaaggaggaggagaagaacttttcatcactcaaagcgtagccgagggaagcggcggaacgatttaattcattttttttatgacgcactttatgagtccaatcaattgacaatgcctggtttttatacaataactttgttcatgtttgaacaaaccctatattttttggcatcattcgaaagcacaaagtctaacgaagctaaaacatataaaatctcaacgtttaggcaattatgaaaaagatgtgattaattaagtaattgctgattattttggtttgtaactttcttgaaatgttaaaattatcttgttttctcgtatattgtcaattgattggactcataaagtgcactagagccttttttatcttgtattttcgcaatttttgcttaatttattatgataagaacattaattagtttcatttgaattattcacttatttaatttttgggtcagaaaaaggcaatcaaaaattaattagtgtacagtaaactacctaagttatcgtctaagaaattaaggttgtgcgcctttattagcaaagttttgaaaaagtattactttcaaattattgtcaaaaaaaaaacaattaatacaagtgtctcaatccggagcaggacaaaactccgccaagaaaaaaaaaattaaaaaaagaaaattcaaacttggaaatttttcaagaaaaaagtcttagaaaaattttccagcgattttacgaaaatttcatgatgagttactaagttttttcaataaaa

SEQ ID NO: 13167 - DNA, 1976 bp, Heterodera glycines
catgcaagttttgaaaagtttgaataaacaatattgcctcctatgtatggcagaggattattattataaaaataagtgcttataattaaaaaattgctattttcatcgtttacacaaaaaaaaaggctgctgggcagaaatagaaaagaggagcggctcttaagatgtaaaatgaatgacattgtatcagagatttgtaaaatttattaatattatgagaatattgtctagaccaaaagtgccgattaattcgtatattaatcaaaaaaatttgcttgcagaaaatattttaaaagtttgaaacaaaaatagttaataaaaagaatatatttttaaatgcaaaaagtaataataattaatttttatacacaaatataaagtttttttttaatttcttttcaaaatttgttgccaaataaatttattcaaattcttatatggcagtggaataataaaatgtcagctttcactcacggcaacatttgctattttgctcatcgtatttgctattcaacattgtcgctcgcagtcttccttttggcaaaaatttagaatgtatttgtgatcaaagcatttttttgtaaaataatatgaaattttaattatagattataaaatttaaaatggttttgagtgatttgtcgaatgccgtcaacaatggggcaacactgagtttgcaagaactgcggcggcgccgtaggacggccattgtgtttctggcgcccgacttggcggcccgacagcgacagttatggcgagaacgccaccgcagctcgaatgcagttgaacagcaagatgttattgtattggattagaagatgacggcggaaaaaggccaatttggatgctttttttgttaattttttgttcgaattaatggtaattaattgtgcttgaatctttataataaaaagttgaattttttattttttgtaaaattaaaattcatttaattatttgcaatttttgcatttctttttaattctttggcattttgttttttaagcaagcaattttatccactttttttgccgtccatgacagaatttcacacatttatccgtaaacaattgaatagtttttttatggatcaaaacaggaaatgcattgaaatccgtttgctgacttacagacattttttggtcggagtttgctctttcttggtggagcaaaaagatgggatttgaactgattgacggaggagcagttgaatgaatgaataattgttgtgttttttggttggaccagtccaccactttactttgtgaaatttgtgtttttaatttaaattgattttataggattttaattttaaattgtacagttggtgattttagaccgacttctgttcataaaactatggtctctttggatgattttacgagtacactattcatttttttcaacaattccgttcttggcctcactattttctcattaattttcaaaacattagaaatggcgtttttaattatatacaaaatggtaaattgataaatttgaaaactaagttttatagctgatcagtagggggtcgaaaaaacatggatataaattccttaaatatttcgccaacaaaatctcaaatttatggctaaatttctcgaaatctcttcaaaagttcagaggtgatccgtcaatcaaatttctgtttaggtatctgaaaaaaagcgagaacgcgagagagagtaagagagagagagagggtgaagagagagagagagagagatagttaaagagaaagagaatcaagagagagatagacaaagagagagagagataaagagaagaaaagattgatgttgaaagtgcgagagagagggagagggagagacttcataaaaagacagttagagtaataatgacaaaatattttaactatgaaaaatgcaaatcaaagtcattgctagcgtcagtttcaaatatttattataagtagtgaaatcagtgaatgaagacactttgtattatttttt

SEQ ID NO: 13168 - DNA, 1618 bp, Heterodera glycines
tcaatttaaaattattcaaatttaaaaagaattttaaaaaatattttacttaaacatggaagccacattctgataaatccgcacgatggaccaaaggctgccaaaactgtaaaaaaaataataaattttaaatctgatgaaaaattctggaaatttgtacagtaagcatagtcggctccaggcgcacgaataactgaaaaatcattatttggaaagtcagttttgttgtacagaaaagaatgataagaataaggatatataaaaatgtatgtaatactttttaacagataaaagtgaaaacagaactaatgaaaaaattaataaattaaaagatacattaaccggttatttttttaataggtttaagtaaactaattatttgccaaaaaagtggttcacgagactcgagaatttgtacagaaattgagattaagtatcagtaaccgaggaatttgtaatcatctaaaaaatcgatttaatttgccgaaaatcttcagcaaataaatctttttaaaattacgaattcatctcaatttgcaactcaaattgttgccgtttatcacttcaggcaatttattagttaattgaatcatatgatgcagtaattatttaattatatttaattatttttagttatttcagtgcgattaaattatgtaaattaaaaattatataaaaaatgaatgaccattgctggtgtcgccgttgttgaacactttctgccgtcaaattgtggatggaattcgtccgcaatttgtgtttaatgccgagttggtgcagtcagaaaatttgacaaaagttgtgccaacgtcaaccatcaaaatgttgagcaaaatgtctgtaaaatgaaaaagtagtccaacgggacatgttattaatttaaaaaaatgtgttgtagacaaatttttacaaaaccgtaaacaatacttataggataagtaaagaaataacttaaaggaagtgaaagtcttttaaaatgctcctttttatattttgttttaaattgatgtttggaacaaattctaaaccccttaaatcatcccgtcaaaatggaaaatttaaatcccattgtagggtttaacaaataccaaatatgacaaaatgggaaatagtaaaggaaaaaacaaaataaagacatttgtaattaataaataattttttaattttctttaaattttgatacaaaaagttcagtttaaatgagttcctgttaatagtttgttgttgtagaaaagctataaaagtcacaaattaatgttctcagttttacccaacaatttgggcaatcaattgaattaactttgcagcatttgcagcagttttcaaaatcatagtgaaatgttattgtagccatttttatagagatttatatttaattccgatgcaaaatttctattgcttaataagtagaaaaatttttgagtaaaaactaaaaggagaatttcgattaaacaatgagcactttcccaacttcatttgaagacccacccatggtgggaacagttccaaaatttggtgctatatttatagtgtccaatttataagaaataattatttgtaggtattaaataaactttttattggactctcaaaacacttttttataaagaaacatttc

SEQ ID NO: 13169 - DNA, 1174 bp, Heterodera glycines
  misc_feature (3)..(3): n is a, c, g, or t
ccncggtaccggttcccctggctttaaaaaaccgaaaatccgttaaattttacttaaaaatattaaatataaagaaatttaacatagatgctaaataaatatttttaatataaattatttaaaataaagtgaaaactaaagtaagaattattattatttttcatcatttcaccctataacaaaatgaattaaaaaattaaataatttttaaaagagcaaagcaaataataaggccaacaagttagccagtcatcggattcaatttaatttgttgaatgaaaaattgttattgaaagggagctgagttaataaaaatgaaataaactaaataatgcagtaaaaagttagaagaagagagggaaaattaatgcattctagaaaggctaaataaacaagaccacccaaatggtaaggattggatgcactatataagtaattactcggatagaacaaatatgataatcatttaacgccgaaatgagcgccgtcttcattttactgcttgtgtaaaaatttttattaattgataaataaaataaattaattaagtgcgttgaatttctgtgcaacggctcagcaagatgctgtgcctgctttggtggatgtatgaatgttattttaattaatgtaaaataattactaaatcagatggctgttcgccgaagagtagcacaccacgaagccgggcacattatggcaaatcacctaaataaggatggggctgagtgcttagcagtaaaattttgaattgaaaaattaaaaattcattaattttagtcagatatagtggaagatcagtttatgtgcgaacagttcaaaaaaagagaagtcaaggaagcaataaagcaggtatctcttttagagcaattcaaaaattcaagaattaagcttgccaacgcgttgcttcaacgaaatgtattgcagtgcaacgacataaaacggttagagatattttccaatgacaaataatcatttttatagaattattgggcacattaaacgatcgtaacgttcattctactgacagggatggagctcgtctgaaaaaggaaacataattatattagcaaagcattagtgtgattaatttctttggaaaaaaaaatgcttatttcattattttttataaagaggaattccactccgattttgtattttaaataaaaaataaatg

SEQ ID NO: 13170 - DNA, 2059 bp, Heterodera glycines
atattaattccaaatttgcatttttttcagcgcttcttcttgttccttatgcaaagtttcttcaaaattgccatagtgatcagtaaaaatgccgtcagttagattactagtgccgcaataaacttcaaaacactaaaagaaaaaattatatgcatttttgaattttttaaaataaaatattagtataatttaagctgaatttgaaaccttttatattttgcattattttatttattcaatttgattaccacttcgttctttttggccggccgataactcactaaaccatcactgtcagtttctcggatttgaatgtttcctctgaatatttgctgcaattcttttttcttttttgtcaacgctggtgctgatgatgactcactactgttaccgtaatcgtaattgccacccagtgtactgctactgtaactgttcgtctcaaaaccgtagtttccacttgtagtactaccgtaaccactcgtgtcatcatcaccatcatttacgctataccagttatcagtgtatgcgtttgcgttataccaattattatttccaggaaaattactgtcgttaccataaccataattattgtagtagtaataaggatgatagttgttgttgttatcatcgtcattattcattgagcttatttccgggctttcaccaaaaattaccgggttttcattaaaaatggtattcgtactgtgccattcttcaccaatgccattgccaaaatctaaatctttgccacccattttgccatggctttcctcagcatcatgaccttccgtagaacggtaaaaattgcggaaaaattggggaccaaaaaactgaaaaaatattttgccgcggtgtgccgatgcggcattctttcaaaaagcgcctttttgttggcagtttggggacacacaaaaaaaaagtgtgccggaaatggggcggcacacaaaaagcgggacggatgccattaatggcacaagatgccaaagaataaagaaatgtattatgtgagactatgcgttttgttgagcaaccgctgaatgtgtggtggaatagcacattgttggtttaaataataacatttaaaaattctgttaatttaaaaaattatttttaatataattttaatttttatttgatccaatttcgtgccgctcgagaatcatggttaatttagtgattaattttataaaaagaaaattcaattttaaaaccgcacttaatttggcattattatatgagaaaaccgattaaattcactccttaagattttggcaattcgttaagaaatgaaaactttcccaaaaatttcgactccaaatttatttatttattttcttgacaatttgcaattgtgcgggccaaattgataaaaataaataagtcattttggaatttttatgtataaagttgaaggatttttccaatttttagcacctatttttgcaattattttggtggcgttttgggcatttttggaaacattattgcactttttagcacctattttagtaacctttcggcattttagcaactaaaaatcctgtctctaatcagtacgttttgctctgtcatttcttcagatcacaacttgtcatttgcactttcttctctctcaccctctctctccatctctctcgctccttctgtctcttttctttctcccgttttctctctctctccatctctctcgctccttctgtctcttttctttctcccgttttctctctctctccatctctctcgctccttctgtctcttttctttctcccgttttctctctctctccatctctctcgctccttctgtctcttttctttctcccgttttctctctctctccatctctctcgctccttctgtctcttttctttctcccgttttctctctctctccatctctctcgctccttctgtctcttttctttctcccgttttctctctctctccatctctctcgctccttctgtctcttttctttctcccgttttctctctctctccatctctctcgctccttctgtctcttttctttctcccgttttctctctctgtccatctctct

SEQ ID NO: 13171 - DNA, 3458 bp, Heterodera glycines
atacctgggtgagaaccgttttgatgttagtcgaagcacttacttataaatatttttgtccgctaacttcgccggggtgaccttgcaatgatttcgagcggacagtgagcaaaatgtgccatttcaattcggaaaagagaaagggcacagcgaatgggggaacagtccctataaaagcacaaaattggcatgtaatccaacttctgtggcagaactttgtgcctcttctgccttaagaagcaccaaaacggcggcttctcttcgtggttcgcttactgtaccaaattcatacggtgccgcgccaaatgccattgcctcgggcaataaaaaacaatcaaaagccctcaggcaaaattgggacaaattcatcaaaaatgaaaaacaaatgcttaagaaactaaaaagaagaaaataatcgggaaaataaatttataaattctttctgagaattaaatgagactcgaaaaaatgaaaattacaaaagccaacatattttacaatagcactgtgaaatgataagacaaattaacaaaacatgctcaaaaggagaggagagatggcacaattaggggagaaaggcaaatgaattaattaggagggaaaggcatttcacacaatcgaaaacaattaattaattaggcatttttaatttcctaaacttatctgccattagtagcagttttaccacaaaactcttcttcgagtctccgtttttttcacattttttggcacttccttcttcctttcctcctcctcccctcctccattaccgtgcctaatctgtgccgttttccaccgtttcaatgctcccctgggccacagtaacggcacattcagatgacttacagtacgaagtccagtggaaaagatggccaaatctgtggccataacccaatgatttgggggcggggagtgcaaatttacgttcgcgtggccagacaaaggccggggtgagcgatgttttggcaatacgaattggacacaatgcgacccaaacagtcgcagaaagtgttgtcacacagcgactgactgatgttccgctggtcgtagcacacgtcatgatgttcgcaacagaggtggactaaaaacggaagaatttccaagggatggccgagtgagtcccagccaatctaagcccttgagagattgattttactcttctcatgcttaataataataaaaaaagacaattaaaactgtgaaattggaaaatgcaattgaaagttgattttcaattgcaacgccaaaagacttttcattttaaaaaactcgcaaacatcaatgatttaacgccttccctccccccgttttgcattgatcagaccaattctgctgatcagataatctccccgtgtgccatgaaaggtggcagaattttttggtttggggaggagcttctgaggtgtcaaacataaaatgggaaaatatttcggtcagtcactttggtcccgatggcaactgatgctgatcagactggcagccatgaagctgaagggatccccgccgcagctgaactcctcctccgccggtattatttgtgaagaaacccacgcgtaagtcgaacttcgctgttccgccgcttcttttctttggctattccctccgtcagaaaaatgatcactttgaccgatgtaagtgactgctgttgatggcggattgtcgattagaaactcatcaggcattaaaaggaagagaatggtcgaaagtgccgtaagagtgacaaatggggagcagggagggggccaaagggaggagaagcggacggagggcggggagaagcccgagaggggggatggcatccgaccgaagcggaaatccctaaaatggaaagtgcggcaattaaataaaatattgatgaaaatggggacgcgtaaagagagggtgccggaaaaacgggaaagcagagacggcaaacaaaaaggaaagtggcaaatgcaaaatggggccggctcagccataaaatttgaagggccgaaggtcggatccttaagtgccgagactgatcagtcaattgaatcagttttcttttattgtaatggtgagaaatgaaaaaggaaccgaaaggaatgaccaaaaaagaacattcttacaattagtgattgtcagttcattttaaatttgcaggcgctgtcactctccccccatttgtgtgttgctcccattcaatcaaattaacttatcaccttcggtcccaacggggaaagaaagagccaattttgaatggctaccatcaaattaaaattacaaatgatttagggggggggaatgggaagataattaatgattttaatgatgaggaatggaatgaatgaaagaaagttggaagaatggggggactgaaaaatcagaagagagagagagaggaaggggggagagagagagagagagaaaggggaaagaagagggcagagagacaggagggagaaaaaggagagagggaagagagagagagagagaaaggggaaagagagagggcaaagagacaggagagagagagagagcggggagagagagagagagaaaaagcgacagccaaataatgaatgaatgaaagtgaatgaacggctctttcattttccttatgaaatttaaaaaaggccaaaaagcactccctccgtctgactttgaaagtattggcgattacaatggcgccgcttggaatgccaagacaatcatcggaggattaacacaatcatttgtttgttgggttgggggattattagcagccattcttcgaaagggaacaaagtccaaaagaacgaacgaatgaatggaacaagaaaaacgcagagtattgagctatgaactgattggagaattacgaatccttctcacataacagtcaaaccagagaaatgtttactttgttttttccgtcttgaccatttcttcagtttcttgggccatcttttttctcatttacaagggaatattccgaactctgtaactgctcagatcactttaaaaccatttttatcagatagagcagcaaagtcgatttgctattgcaaatttttggcttttttgtccttacccccagtgtcagaaaaaatcggtaaaatgaaaatactaccaaaaatatgtactacctatatttaatgttattttcttatggctatagtatgatttggaatttttgaatgtttttaaaaatttaaccatttatatcgatttttcgaaactctgatcgatttttccgatcagtttagggggccaggcaaaaaagtgtacaatttacaatactaaatcgactatgctctatagtgtctgagtagttacaattagaaatggtcccctatttgtcaatttgacgcgtaaaccgcagtagagtcactaggaccatcgcccttcgagtcacacccaactcatccatgtccaacgcatccaaacccaactcatctaacaagggaacattccgagctgtgactaggaaattgcatataaacgatataccacca

SEQ ID NO: 13172 - DNA, 4130 bp, Heterodera glycines
aaaacaaagccaacgactttttctcgggaaaaaactttgctgagattttcgttttgatgctctttaaaaacccaaattattaaatgattgtcaaatattatgccaatttatcaaaattaatcataaaatttaacaaattctgacgattttccccaaaagcatcaaaaatcatcaaaatttctcaaaaagccacaaaaagcctcaaagtatcttttgaaaatttagactcattgacctattaaaaaaaccacaaaatgaggctaaaccctcagacctggtggctaccctgattatatcatgttaagcttatattaaaaagaaaaatattcatttcttactattgaaaacatcaaatcaaaaactattttaaaaaagtcaatcaattttggattaataatcgaatactattcaatgttgcattttccggctccaaataaaaatatatgtaaaaatggagaaaaaaacaaatcaaaaaccgggatgtcggagattcctcggcttgatcggtctcaatactgatctttccagctctaatctattttcttgaaaatttctgactccattcctttatagtacttataatagggaattttttgaaaatcttcttattctaaaacaggaaaagagccaaattataatatgcggacatggaaatgagctcagacaaaccgaaccaaaaagtaagaaaaaatagaaattataaatttaatattgtatcttatacatattaaatagaataggaaaatttaaaaatggcagagaataaatccagttagtttttattcgtttttttgtcaacgccaataaattaacggcaaaattatgacgccataaaagaggtgaaaaacggcaaaattataaacggaataatatttgattaataaactgaataaatttgaatttaaaaaacggcaaaattatgacctaaaaaagaacaaatggaataaaatttataatttgaaaaacggcaaaattatgaccccagaaaggagatgaacaaatggcatcaaatttgaatttaaaatataaccagaacaaatcttttttataaataattctttttatccatgtattttgtttaatgtaaaaacttctaaaaacatttaattctcccattttgataattcatctaatctattcggattttttagggtagtgcggcctatctgaagcagaaattcattaatttgataattaaattggtggacaatggccgatcacaacaaccaaaaaaaaaattttaacccaattgagctttgccaagaagcagtaaaaatgagcgatcataaaggccctaccgcatttgtaaaaattgccaaaataaatttccaattttggaaactcgtcgacgaccatttgcggaataaaaaatggcttcttgattatttggagattgatgaagaagaacaaatggatggaacgacagaaatggttatttatgacggaaccggaaaaatattgccaattccgcaaaatccattgcccaccaaaattagcggcttccaaacgatttggatcacgtaaattaaccgattatagtaaatattatattttttgttaactttctagttacctggatgcaaatgtgatcgcttttctccacctttttcaacatcttttcacttcgtgtgaaattactttgaccattgaaatgaccaatggtcaatttttgttcagtttggcccaaaatatttggccactgatcaaaaacaacgttaaacgcttttcaatgccgaccaactttgaacattttcggcatcacttcccttcaattctcagcagcgaccaatggccatctcttcaattcttttattgtgaaaatgttttgccagatttcccagccgatgattgtgccaacgcgtcggatggacaagtgctgtccaagtggctgttttcggcacattttggtgatttgccaccgaaagtggctcaatgtgaatgttcaacggacctgcaagggatcacgtcaaaaatggcattggtcaaatcggtagtccaattttaacttatttaattgcagaaattaataaataaatttaattattaaaggaaaaagaatatttttgtatattaatattttatcttatatataaagaaaagatataaatattttaattcttatgtacgtttttatttatttttttacatttaggcatttgtcaatgcgtcttctcgtgccaattttatcgtgtacatttggtttaatgcctcttcttcggatcatgtgacagacattccgacttttaaattgtccaacaattcaactggcgagcacatgacattgaaacggattcgtgataagtatgctaatattacagttgggttggtgggactgcggcaggtcaaagaaatttaaatttgaactgttataattctctaaaactaatttgttttgtttttctatcaaaattgattttggattatcatttagcaatattgcttggttttaaaaataaattttccctatattttggaaaaatacatacattatttggggatttaagcttttttttggtatttttattttaccaatttttttgttgagtttatcggtcagagcagccaaaaaagccaaattaaattggctataataaatcgtttgtctttttgatttctaatttgctccctagtgataagcgtcgccttttgctgattcgttgtccaatttcgcgagatgagcacaaatgggccaagtgggaaaaggaagcgattgaatggacattcgatgatcaatggaacaaattaactttttacgaaaaagacgaaatcgatttttgaacccaatcaaatgaatttttattttgtcaactttttgattatttctgtgatgtatttgattctcttctgtgtctttttaaagatttttcggttgataaacttttattaaatgctcgaaaaattcattccagcggaaagaataaaacatttaataaatgcaattaatttacattgcacatgttaaaaattttaaattctaaattcgtcaaatttgactagtatttcacggactaaaaatcttcgaatttattggacttttcaggaatttcgtattaaacaattcaattggttgtttcgattgaaaatgatgaacaaaaattagtggcacaaaagcggcaaaaggctattgggccggatgttagcattgactgttttgaattactcttctcattggccatttgtttgtgcttgtaaattgtccaaaaggaagtggcgcaaaatatttgccaacatttgcattcacatggaattttatcgacaaaagggcgacgaaattttatgtttttttaaaattttttgcataatttttcatttgaacttttcgccctcataatagggcaaaagataaaatttatcttcttttataattaaaattgctgctgaataatacgctatttacagcaatttttatttattttcattgaaatttgcccatattttaccattttcgcgcctaaataattcgctccctatctataagtggtcttcggtctcagttgctaaagcttattcataaaaattaaacaattcctttttctaaatttagctatacaaaccccaatttctttgaatacaaaatcaatgctgcaaatgaaatggttcaaataaatttgccaaattagaatttgccttattttgtgtatttggacatgaaaaagaattttttatctttaaatatatttttattaaaggattcgctagattattgtattatttaaatgaaaatttttcaagaattgcaatttttgcgcctttttattcgctgttagctgctaatgataaattatttaacgaattttgcttttttgcttgatttgcataacaattcaccgtcaacctatgaaatttatttgatttttaatgtcatttgttaacagatttgtcaacaagaatggccaattttgtaattttgagcaaattaaaaaaaaaatttaggttccggcggtgccgatagccgccgccggcggggaaaaattgagaattttgaccatatttttagcaaactttcatttaaaaaaaattcataattttgtggattttcgaaaaaaattgtaattttcttgctaaatttgggtgagattttagtttgatactctattaaaaacgaattcaaattaaataattgtaaaaca

SEQ ID NO: 13173 - DNA, 3358 bp, Heterodera glycines
attactttatacgagttcaaccttagaaagtcttgttttatatttttcgtatgtttttaagtttgatcatcctcggtctagttagatttaaaaaattaaaaggttttaacaaaccataagaaaaacaactataattttaaattttagtaaaataaaaattgtgccaattttaatcaaaggattcagaaaattgtgaactttgtcaacttttataaatttcaatgtttgtacggataaacaacaacaaaagccattagcctcagtttattatgttttagggttccgatgccttgccaatgccaatcacaaaatgcgccattcattcgggtggaaacataatggcctatgcgatcggttatgattggagcaaggtaataattgaaggggcgcagagagcggacaaattgaaagagaattgccaagccaaaaagacaccataaaatgagaaatttggtttttagggcttcgaatacagcacggcgaataatgtgacgaaaatctttctgcacgggtgtgacgaggagatgaaaccaaagccgaagaagtgatctccgtgagtgaccgttttttaatgttctctcaattgtttttttataaattttttacacttcgttttgcattgctttaaaacggcctctcctccccttctcccctccgttattcactctcaaattcatttttacaaaattccctggccaacttaacaaaaaaagaaccctttgccgttcccaggctctttatttttattacatttctcactataattctcttcaatagcccggaaattggcttcggcggatggcagacaaaaattgagaaaggaaaagccgtgcccattggacagaggcaaagaaaagggggagggaatgttccgggaagggaagggaagccaattcaatgtttattcacttctccttttatgtccttagaaaatttggatgctttgacaaaaaaaggaaaagccttcgcacaaattctatttgccggaaattttacacgggaaggaaaaagtagaaaatgctttaattttaatattgatcaaaaatggagaataatcaaaaggaacataaaacaaaatacaaatcaataaacatagaaatcaatgagaaagggggacgaattgaacaaaaatggataaaatgtttttttgttgtgcggtgaacgaaaggacgggggaattgggagagatgcgatgcgtacaaaaaatgggggggggcaaagcgaattgcataaaaatctcgaactaatcatcacattatctaattgctataattgtcttaatgatggtctaaggagggggggggggagaatttatttagagacaaaaattaaaacataataagtgaagacggagggagcggagagtggcgaaagtgcccttaggggagagcacgaaaaatgtgatgcaaatggaaaaaagcaataataataatgcaaagttcagctcggaatgtgagaagagcggcgggggggggcaacggcacgggcggcgccggcactattatttcttcacttcgttggtcagaatctgaaaaaacgaggaaaggaaaaaagtgaggattttccggcaaaagtttgaattttttattttttatttctgagacaaaatttgcctggaaaagctccttgtccgcaaggcacccgtcaacaaattccttcagtgtcagctctttgtcattatttacgtccattttctcgaaaatcattttcgcccgttttcttggcgaatcgtccgccgatttggtcacttcggggcccaacatttcgtaaattgcctaaaaacggcaaaatgttggaaatgtcaagcccccatttgtgtgtacttcgatgattttgatcatctccttctcgtctatcgtcccattcccgtcgatgtcgtacatctgaacgggacaaaggcaatggcatcgttttgaattcgaaattcaaaaacccggaatgcccattcgagtttctgctcgggtgtgccggaggaagtgacgttgatggccagcaagaactccttgaagtcgatgaacccgctgttgtccgtgtcgaaggtccggaacacgtgttcgcagaagccttccgcggagccggaggggaaaaagtcctgaaaagaagcggggcatgagtagggctaaagtcagtccccgaccgattaaatcggcatggcactgaccttgtacactttgatgaactgctctttggtcagatggcccttgggacagtcttgctaaacggggacaaaaagcggtgaacggacggaggcctcgcaaagtgtacggactgaccacgaagcctttgtaccactctttgatctgttcctccgtgaagttggtgttcttcttcaggaactccaggtcctccttggacagtttcggcttggagcctttcaagcccatttcagtgttttatcggtgcttttcctcccagggaaaatttgttgggacgacagcgccgagagagaaaaatgatggccaaacgaagagaaggaattcaaagcgacggacggagaaataaacggagggaacgactgatcagaaatgacgttggctgaagagaatggagaccctttacaaaatcaggggtgattagaagaaaccgttaaggatgtcaaaggaatgatcgaaccgatgaacggaccaatgatcactctcaagtgtaaatggttaaaggatggatgatagtaatcaggcggaatgatcagtgctcatttaaatggctaatggatggtattttaaaaataatcggactgactgatcactgaaatgactaatggactagtcgtcacattacaactatttcgaagtcggcttaagattctttttcttttattaagcgtcgtaaacattgggaaaaagcgaatgaaaacgaaccttttaaaatttgtaaatgatcaaaaaatgggattattgctgagcgaacagagaataaacagaagaattagccaaattctgtttaggacaattctttgctaaaaaagcgaagaatttcgaaacgacactttcaaacacaaatttcgggcatgggatggcccgaaaatgggcaaatgaatggtaattgtattttggccattaaattgaatttgttccgaaaagggacgaattttattgaaaatttagaggatcgaatcggacggacaattttcaccgacacaatttactttttttctgattttttttgttctctgaaatgtttatgtgcccgagggatgaaaatacgaaattgtaaaacagctgtcgccgcaaatgcaaaaaggtgacaagcgaaaaatacgccacataaatcccttcggcggcgggggacggagggatcaaatgtcgccgcggggggcggggaataaatgttcttattaaagggggaggggggggggggg

SEQ ID NO: 13174 - DNA, 1358 bp, Heterodera glycines
ccccccccccctttttgttgtgtgtgcgttgttgggactgttaaaccaaattttgaatcggtggcgaaaggcgcggacgcccgaggcgctgtcgcttcccccgtcccaaccgccggtgggagcttcaaagcggcggacttcccttcgggcgcatgcggcgctcacgcctttgttgagggaaaggggggggggggggagagagggcttatttgatgagaaaacgagagagagagaaagagaagggggaaaagagagagagggggggggggaggggacgaagaaggaagttggtcctcatccgttagtgatgagtgagtggggcgggaagttcattcgagagcagttaataaacagagagggaaaatggggagagctgagaaaagggaaaaagggggaggagaaagaaaaagggagtgggtgagaaagagagagagagaatggggaatagagagagaccaatccaatggtaaaagaatgaaagagaggaaaaaagagatggggaaggaggaaggaaaaagaaagggagtagaagggaataaagagaaactggaagagagagagagagagaagagagagagaaagaagagttaaagaaaaagtgaaaatccgtgggagatactgaaaaatttgacgaggacggaatattgtgtgaagcggatgttaagtgtttgcgggagggggcggggcacagtgaatgaatgctctgtccgtcttccccctctactctttcccttctgtttttctctctggctctctccagtttagaccctattttcccagtgtgtagcctaaggcgatgacttcatcatcaactgcggagaaaagctacttgaggcgatggtcggaaaaggaagagaatgaggggaggggaaaaagagagaaaagaggaaaagtagggaaagggaaaaagagagaaaaaaagagaaaaaagagaaaatggaaaatggggcaaaataagggaggggaggaggaaaatggaaaaagaatgaaaggaaaaaagagaaataaagagggaaagaggaaaaatggtgaaaaatttggacgatgaaaagaattacaatagaaaacgaaaggaaagaaattatgaaggatttaaatgcttttgtcggttcatcaaaatgttttcgtttcgttcataattttatgggttccgagaaagggtcccttttggttgggcccgtgagttgtgctcgtccgtccgtcccattgaaatttcgttgtgctttcgcccgtgggacatatccaatttcggaagatgactttgccaatgggggcgggggatttcaacggcaattcggactggcggtgggaaaaagtgggccgaaaagaatgcggaaaagggcggggggggggggggg

SEQ ID NO: 13175 - DNA, 4918 bp, Heterodera glycines
  misc_feature (8)..(8): n is a, c, g, or t
  misc_feature (10)..(10): n is a, c, g, or t
  misc_feature (4915)..(4915): n is a, c, g, or t
gatcgttncnaaatttaggtaatttccaaaatataattcgtaaaattctcgcgagattcatgaaagaaagaaatagagaaatgagagggcgaattaattggtaaataaaatgtaagaaaacgaaaaatgaaatcaggtgcgacatcgttttgaaaagtgtccgatttttccgcatctatagcacttcacatcgattcttcggttgctgttcgagtttgacggggcttgttgggcggcttcggcgtatgacggcaaatattgtggcggatacggcgccattcgcgtacttggaccagggcaatttgaaggcattggcattgtgtgaccggcgatcatgttaattggaggagggcgcacagaggtgtcaatgatcatcattccgtgtgagaaagccggcggttgagcatgacccgaactgatcggtggaaacacatttgcctgagctgtgaatggcctgaaaccacctgtgaaaaatggggaaggggaaaaattatttacgaaattatttattggtggctgatacgccaaactatcgtgtcttaaagtactgtccctttcggcataaaattcaaatgccatcggaattgtgccatccctttttgcaataaattttcccacccgggacggaaacggattggaaataaggtttaaatactccggggttaccgcaaccgtcatttttaatgtttcgtcaatgaaacgtctccacacagtccctttgtgccaaatcaacgacaaatctccgatgatgaccaatccaaatttgggacgggagagagccacggttgttctcgcgcaatccgcccagaattccttgccagtgtcagcttccaatgatcgtccagccgcggagcgagtcgtgatgacaaggacaagctcggcttcctgactttgaatcgaatcgactgtactcaccttgacatttggccaccttctccgttcgatttcacttaccatgtgtttcctctctgcttggtaaaaacacacaacttgaattaagcctggaaaggttccctggattattcccaaaaatccaagagctgtttcccgttgctcgggattgtgagaggaaaatgagatactttccatttgagccgatgatttttgatggattaaaatgatcggacaattttcggctacaatgcgtgggcccatacaatgctctttttcttttggtctgacgaccattctttacaataaaataggctaagttttgttctgttaatttcagagtactattacagctacgcactgtcgatttccctggtgcgtcagttaaagctaattgagtttcgtctgctagccaagtattgttaagaacacgcccattgaatgacccataaaaacgatattcacaattttttcccgattcaggttcccaaattaattgagttttatcactcattaagcaattgcctctttcgtaaggacagttaaaaagttcaccaataggagaatgaatggatttgtcgccaaagcgagaagttactagcgttttgaaaagataacaattatcgctaaagattcgttcccatgagaatgaaccgaaaagccaagagcgaggggtaaggtcaatctgattattggtatgataaagtccatcgaggtgaatgagtgaacccaaatagcatttcttatggttaatcatgagtttgcattcatctaatccaaccgtaagaagttcagattcgtgaaatttttcgattgggattcccgttagtgaggtaaattttgacacagattttcttactatcctacatgcccatgcctcagtactgaattcaaaaaaattaggggtatagattcgccttcgttgtgatttaggagtgtgagatagattaactgcaatagaggagcatccattgaatttgggaagaccccattctgatttgcccttcaagagaaaatttgagtcggcctaatttttctttttctgaccatgttgtgccagcataatccaaaaggtctctaaatttttgggcccagttatcgaaagaggtaagattttcatccttgcatgccggaagttgactagcaaatgggtccacagttgtcaaaacgtttaaaaattcgtcttcatcgtcctcttcctcaagtaaacccactcggctccttagtactacagtggcatccccgttttgtgataagttatcagtgttaggattatcccaattctccacttggctttccaaagtttcaactttatctaccacttggtcaagtcttgtggagagagtgtccatgttagcattaacagtaacagatacttggttaatggcgtctgtattttgtacagctctgcgattaatcactcttagactccgattagcggcatcctcaagacgtacagtgccttggtatactttttctaccaatgaaaagggagcaccggaattaggagggtgactgagattttgaaataatgtcctgtctacactcgttattgtaacttgttggtcttccattgtttcgtttctttctatccaaaggatagttcaattgaaaattggggtggacaatttgaaaagagaaaaaaaaaaaaaaaaaaatttggtctgctcttagtcttacgactattctattgattgaaatgagagcgcgagttaaaacaattcaaatatgagcgcaaataataagcaaaatgaaacggggaaacaaaattagaataattagatgtaacaattaaatttggaaacaaatgagggaataggcggtagggttcgcgcggttgcttgcttaagcttaaggctgtgaattgcagagtgtttgtcgattgagatgagagcactatgtgctttggatgaagaatgaattgatgaatgagtgggaaatgctttttagtgaaaagtggagattgttaatagcgacgcttttcccattagctgttgtaacatttaagagcccatccctatcgtggaaatcgaaaaatggaattgtccaggctcatcggcgattacagtaaaagataagtatgatattagcgttcaaagtgcaatgttctccgcatcgcgcattgttgtactgtattagtttcaatagggaattgaacttttggcggcaatgtttttttttgacgaaaaaaaatagagaagagaaaaaaaattgaccattattttgttgtttggtagcaaattgaattagttagtggaaaatcagcccaaaaacattgattaaattgataacagggaaaaaaaataaaaaaataaaaatttgaccgttttgtggttttgatagtaaattaaacaaattaggcggtaatgacagactgaatcaaagaaatgtttgaacgaaattgaatgcagaacagaaaaattcgcttactgcacacattgcaatgccacgagcagtttgggcagtgcccaatgtccattccgtcgccaagcgcgtcatttgcgccatttccagtgtccacagcatgagcaattttcgggtcgctgctgatgttcgcgccattgtttgcaccactatcattgtccacatttcgcctcatttcctctgtttttgttggtcaacggcactgagatgggaatgggaatcaattagaaatgaatcgattttgacccttcgtttttttttgtcgaatgccaaacttacgaaaaacttgcatccatataattactgccgatagtgaagagagaaaaaaaaaccaaatacgaaaacaaacacaaaaacgaaaacaaaaaaatttccgacgccctatttctcactctcgaaaacgaccaaaaaaaatctgtgtttttcttcatttttataattattttattcgttgtctgtctaattgcttttatttctttttttgatttatttttgccatttaacctattttacttatatgtaattcatttctaatggtggcatgtccacagtaacgaccactgaaccctgtctcggccgccccttggctgtttgttggggggttcacatatttgttagtgttaggtggcaggtggccttggtttagcaccgcaaagttcacagttgccgaaaatgcttctacgccaccagcaaagcgcttataaatttgttaaatctcataggaaaatggcaaaataaacttttatataaaaatagcgcacaacgaacaaaaacaattaaaaaaatagagaaaagagacaaatttaatggtcgatttcggcgatttttgaggagaaaaaatagctatataaattttaacttaacgtcaaacataaacttatttaaatcattaattaagtattaataccttttcgaactcggagaagtgattcgaaactcaaaaataaatttgtaaataaatttgtccttcgctaaattgttcttagagatgaaaacaaaatgaaaaaaaaatattaatgtcaacaaatgaaaagatttgtttctttgcactctgacgagtgttcaatggccaacgaataacgcccatcatccaattgcaaattctgcataaacagagggagggcagtatcaacacaattcaaaggagaaaatggggaaaaatgggaaaggggggggggcaaaatgtcgcgtctgttggagctgtggagattaaatcgttattatgagcaaaaatgctaattctccgctgagggcgcccaaattcaaatttttctgctctgtttagttaattcagtccccataaaattactgtatttctttcttactgtaagtaagttctggcggtttccttttggcactaatattcgccacatacatctgtattttagcccgtttcgcccttacattcaatttctgatcagtttgtctcattaatttgtgatctgtagggctcataatttctgatcacttgtgcttttcattttctgatcacttgtgcttttcattttctgatcacttgggcttttcatctctgatcactagcgcttctaatttgtttatagacgtgtcttctcttttttagaggtattccttctcaaanttt

SEQ ID NO: 13176 - DNA, 1209 bp, Heterodera glycines
  misc_feature (1070)..(1070): n is a, c, g, or t
  misc_feature (1157)..(1157): n is a, c, g, or t
  misc_feature (1162)..(1162): n is a, c, g, or t
atgccttttttggcgtttttttccgaaaaattccattaaaaaggcaataaattcgggaaaatgcacctctaagaaatgacccgaaattttttttagaaaccctaagaattgaaacattttctcaaaaattgatcgtcaaaatgaatttatttttttttcttgataaaaaattttaggtttaaaaattttccttattcgaaaaaaatttataaaatatttattaatcatttaaataaccaaaagtaagttttttaattaagttttatggttttggctccatgaaaatcataaataaaaaattttaattgccttttttcatgcctttttgggacttttgtacctttttcatgcctttttctttgcaatattttggtgcctattatatgcctttttcgcgatttttggtgcctttttttatcgttctctataaataaaatacaaatgattattcagatgaatcccttttaacacaatatcaaaatgacaattctttgcttcaatttgttgaggaagaaattcgaaaagaattttttggagcagaaattgagggatttgcagaagatttgcaagaaataaaattcataggaaatgaaatgaaagaaaaaataatggtaaaatttatttattttattaatttaatttaatttttaaatttagttgtcatatttgaaaaagaataaatttacagaaaacaatgacaattttaataaagcactgaacgaattgcaacaaataattgaagaatgggtaaggcacaagaaaaaatgttttcaaaaaaagttaatttatttattattctaaattaaaaataaaaaaatattaataataattaactaaaaaataaaatgccgtaaaatatttgcagtcagatgaagctcgacttcaagtaacgggcgcgctcatgataaaatatgaaaatgaaagcttcagcccaatttgccttttgcctggcgaatttaatcgggcaaaaatttttggcaatttaatttgtgactttaaaaagagaacattgtgccaagatgaatcactttattgcattttttgtaaggtcagagattttgttgtattanatatgtacaaaaaaatgcccgaaatatgtaagaaaatatataaaaaaaattttaaatgtgttattttttaaaataaattctccgtanagggntgataggcacaaaatgctatagaaaattacctaaacaggcttaaaat

SEQ ID NO: 13177 - DNA, 3084 bp, Heterodera glycines
ttgccgaaattttgaatttttttgaggatttccaaaatttctgtaaaaaatccacaaaaaatataaaaaaaatgaaaatatataagaaaaaagttcaaaaatacaccaaatatgtaaaaaaatcccgaaatatgtaaatatgtataaaacaccgaaaagtgtaaaaatatataaataaaagttccgatttttaattggcagccatattaatcattgaaaaataaaacatttaatcatttcagaatttaaatgtttcattggtgcaaaagtttgagagagatccgcttttatctgtgccaacactgaaaataaatttaatgagtgtgcaaattaacatacaatttgttgccgtgccaaatttaaaacatttgccaattggaaatttcaatggcacacaatttagaagaatttcaaaaatatttgttgaaaatataaaaaatttattgaaaaatgataattttgatgagtgtcaacataattttgagctaaaaaagctaaacgaagaaaagtataaactgacgaaacaattgtcgaaagcatgtaatattttaaattttaaatcatttcaaacaaaaaaataataataatttatattttaagcggaagaaaaagcggacgaaattagggaaaaaattaaaaacacaaaaaaattagaagatttgttgacaaaattctgccaaaatgctttaaaggaccgagaaaaagtgaacgaaatgaaaacaatgcttgcaattttaatgggtaattaatagggctgacaattttatgtaaatacatattttttcctggcttctccatgctctaaatagtaggaaaaacactttttttgtttgtgttttcgaataaaagttgggacttttatttacatatttttacataatttagaggtttttatatatttttttttgttattttggactttttagcattttttctaatttttttttgagaatttttgaaatttataaaatttcttgatttaaatttttttgaaagtgtacccctaaaaaaccgggttttttcttaaaaggagataccaaaaattaattttaaatatacaaaaatgtgcttctaagactatataagttatttttatggtattttgtagagcccggaattttgaaagtaccgggaccgggcccgggaccgggcttagccatttgaccgggaccgggccgcccgttcaaaaaaagcccgttttaccgggcgtcccgggcccggtccaaaattttgaccgggcgcccgtacgggaccgggcttttttcaaaatttttggaattttgaattaaagacatttcgccaaaaataattattaaattttcaaattttgagcagtttcgctggtgaaatttaagcccgttttagcccggtcaaattgaccgggtccgggaacgggaccgggcttagccatttgaccgggaccgggccgcccggtaaaagcccgccgggcccccgggcccgtccgggctctagtattttgtgcctttcaccatttacgaagaattttttccaaaattagaatttggaaatgacattaaagtgttggaaaacatttggccatcaaatgaagaaatttataaagaaaaagttgtcgaaattaaaaaaagaagcgatttgaaagtgtttgtccaatcattggcttatttggaaaagtgggcaatcggtagggatttattatattttatgttttaaaataaatatttaaatttgcttttatttagacaactatattttcaattccgaattgggctatttggactcgaacattctgaaaataatgctatcaaaaataattgcaatttatccgaactcatcggcaccttttataatccacaaattctttttgactttctcactttggtatgtgaataggtgcagattgtgagccgttataaaagccatcaaatgaaaattatcaaaaaaaaaaactttaactataaaaacctggtccctggagtacttttggccataactttgttcaaacttgacgaaattcctttgaattttccaggttaatagagaattgttagggttatcggatgatattaagaattaaaaatttccgttgggcttgagcaaagttatagtcagttttttgttgagaattttcatttgatggttttttatagaacgatatagcaccagcgaaaacggaataaatttaaaactaaaattaatttatgcagcaacaataaaatattctttataaatattttatatattataaataatttttaaatttaattatgtttttttccaaattttaggcattggcctttgcccgtacagctcgaacagctcacttatgagcaaagtggcgaactgctgctgatgtggtcaccggggagagaatgggtgctcaaaaagcaaaatgtgaagtcgaaaagtctgagaaaacggcaccagcgaattctgacaatgccaatcattgggccaatgtttccgcaacaaaatttgggccacaaaatcaattcattgactgcaaaagtcattcagcgcaaaatgcaggaaggttaaatttgcattgtctgaaaaatttgtaaataatcattagaaggattacaataattacagtaaatttgattaataaaattataataataatagtaaatttgattaattaaatatcttgggataattataataattacagtaaaacttgaataattaataatcattaggaggattacaataattacagtaaatttgattaattatataatcttgggataattataataattacagtaaatttgaaaaattaaataatcattgggtaattacaacaataaaagtaaatttgaataattaaataatcattgggttaattacaataattacagtaactttgaataattaaataatcattgggttaattgcaatattacagtaactttgattttaattaaagaatcaattcgattaattacaataataactaaatttggataattaaataatcattgggataattacactaattacagcactggaacaaacgctgggcgaagaaaattcgggaacaataaccgaaccgttggggcccatcaaatttcgcgcaatggtaaaaaataattattaaat

SEQ ID NO: 13178 - DNA, 706 bp, Heterodera glycines
tcattcatgacggcaaggaaagggcagagaatactttggcattttgaactaattaaaattcaaaaattcaattttggcatttccttttggaacgagtcaatcaattaattgactttttattacttatccaacataaacaatgtcattcttggtagcattcagtgtgattctaagtgtacattataattataattcataaaaaataaattaatcaaatttcaaaaaaaaagttaaatgaaaaactaagccattaaaagattctctgttttgtttattgcctttttaattgattaaaattcaacaaataattttttggtagttaatttgaccaatgacaaaataaacaaatgggaaacagcagcagaaattggtgaggaggcattgttttcatcgggcattttgggaaagaaagcggcaaaaaacggcggaggaaaagcgaaaggccaaaagtggagcaaaaggggggggggaatttataatttgtcggaatgcgaaataaatgaaataattacccgcgggggaaaaggggaaaattcgatgacacaaaagcccacggcaaccaaattgaaattcttatcatatcaatcaaaaccaaagcggaggaaaaggaaaaagggaggcaatttaataaatgatgggaaaatgggggggtaattacggacagagagacaggaaaagagagaaacacaacggagaaaaggagagc

SEQ ID NO: 13179 - DNA, 927 bp, Heterodera glycines
ctatgttgggtgcgataatggtgagaagcttggatccgggacatggaccggtcagccctctttagggcctacaggtgaattgccatttagcgctcaacccaataacgtgccaactcctggactaagggagggaggagggccatgacgtgcaacgttagggcacttccggtttccattgcattatgcgatgtgtcaactccaattattggaggaaaccaagtgcatgtcggctgacacaaagaccctaacagcctaaaacgcgcctaggtagcgaagctcaagaagcgcgcagcgctttcccaagcgccaccctcgcatgcacacacccgctagttatatatatgttatattgacaaggagtttcgtctgcaaaaacaaaatctcccggccgaaggccgggagcgccctgaaagtagtgtacgtaccccccccaagacccccccgggtccaaaaatttttaaggaaaaataatattttggctgaaaattttaggttttccttgctgggctggtacccccccccccctttccaagaaatgtcgctaaatttttcaaaaaatccacaaatttttaatgaaaatctgctaaaaatggctcaaaatcacaaaatttggtcattttttggacaaaatctgttaacaaaccgcatttaaaaccgcaaaaattttcccggcggcgcctatcggcaccgccggaccccctgtcccccaaaaattttttttggaaaaaccgcgccacataaaaaacgggtgtgaaaagcaaaaaaaaaaaaaaaaggtcgtcgcccggggggaggtgccccccccaagccaaaatcctgggaccgtccctgggtgagtgaatgattaagggaatttgccatgcaaatttgggatggaatgaaaagtgttaatgggagggaaaagagtcgggggaagggaaaaaggaa

SEQ ID NO: 13180 - DNA, 468 bp, Heterodera glycines
ccccccccccctcctcttcctcggttcagtgttgtgtgatatttcccttcgctccccacatgacaatcactggcatattttgcttcatcatcattttgttgcagaaaaatgctgaagcactcgctgctggagtttctggccgcactgcagctgaacatgcagcaacagcaccgcggcgctgctgctgcaatggccggtggcagcacgcagcagcaacggatggaactgttgcaggcccaactggagcgaatgggatgaacggaagggaagggaaaggactgcttgacgaggacggacacggacggaccgacacacacaccaacaaacagacgatgaatgaatgaatggacgatgatgaaaacgaaacattttgaaaatattaatgttatatgatggtgggggcggaataatgatggtgaatacagtatatgaacaatgatattatatgatgatagtacagtatgacaa

SEQ ID NO: 13181 - DNA, 2500 bp, Heterodera glycines
tttctaatgcaaacgcatttcctgacgatctgacaaacaaaaaatttaaacattcggcttccataggttgacgttgaggctatcatcaatagggctgggatttttatgttttaacatattttttttgccgcttagttatggcgagagaagcccaaaaatagcattttctccgaacaatttttgatttagagcgacttataaaaacataaaaacacatattttggcgttttcgcacataaaaacatatcgcacatatttcggggtttggcacatattttggcatttttgaaaaaaaatatctaagaaaaacacaaaaaattcaaaaatgcacccctaaaaatccgcctcccctcgattcgtctactcaacgattcgtctattcaacgattcgtttactcgacgattcgtctactcagccaaaaagtgacgattcgtctactcagacaaaaagccatgattcgtctattcaacgattcgtctactcgacaattcgtctactcagccaaaaagtgacgattcgtctactcagcaaaaaagcaacgattcgtctacattattcgtctactccgccaaaaaaattctaaaacccgggttcgaactcgaaaaacttttaaagtcatttttatggagttttcacaaattgcctagtacaatacaacgtaaatgaatgtctgaaatcgaaaatttattataataaacatcaaaaataatagttcaaatcaaatgaaaatgttgaaaatcacggaaattgaggtttaaaaatccaatcacttgtgcggaataagacaagggtttttgccaatggtataaagcgatcaatcattcacggtcctcatgttcgtgttgagcccctcgtgcacgcaggccacccacatatccttgcatctgcagactcagcagtgaaaggatgttcatgacgtcttcgtcggtgttgtactccgcctcgtccaatgcatctccgatcaattgctccttcaaaatgtatttgatgcggcgtttgtgcgggaacactcgggcagatcttgcgatgtccacctgcttgtcaacatcatccagaatagctgctagaaagtctgacaaagatgggtgatggactagaccacgcttaagttttaaaaaccaaattaaactcgcactaaaaatcgcacaaccgaaaattggaggtgtgatgcctccatagcattgttcgttttctccactgctgacttcgcacggtcgtggacattccagaagtgcacagggtacagtggtggacgcacaattggcagctcccagcgcggcacgacggaaacaattgttgacgattgggttgttggcgttgatggaacaggtgaagggatgccaaattggatgaaattgttaccataaacatggtccaaattcactaaaataaagaaaataagaacgaattcaaaaaacaaaaatactcaccactaccaaatgaattccggcgactgtattcggcatcctcagtggcattggtgctgattgaactgcgtcggctttgatcagtgcccggaacaaacgccacggcgccggcttcttgttcgtgtgcggtcagtccaacatataccctcgcgaagtaaccgaaaaatgcagccaaaccttcgggtgcatggtttactatgacggcaaaaccacgacgaacatgttgtccggggatcaatgctagagcaagcagcttcctaggagtgaacttttttttgcctttttcactcactccaacactcacctgaaactgttccgcgcgacttctccttgttcttcgtcgttggcatacaattccgccaagcccatttcacgccattttctgaaaactgcctggctcatgtggaatagacatcccgtcaattgggccgccggaaacgtttctcgcatggcccgaatcgttgctgtttcaaagtcactgatgacttaaattttgggatgaaataaagttagaagaaatgatcacttactatgtgctggggtgttgggtgcaatcaccgctttgaccgcattgagtgcctcttcgtagtattttcgttgctttccaggcaacaaagcatgcacacataatgcgagccgccggttgacaaaagcgccgatcacgaaacactgcgtccatgcggctggtgccactttgaatgttccatcaaccgaaattttcctcgcccgcttcaaaacgtccaacagctgaaaataaaagcgaaaaattgaacatagaaattaatgaacttaactgtgggtgtgcaaagaccaagaccacatccgattctccttggcgacgcactcggctgtcatacaacaatgtgttttcgccatccttcataagcagggcatcgggtaggacaacattcagagggttgacacggtccatgttgccgtaaatctttcttttctgcctaaaaaactggaaataagagtgaaagaggaattcaagtatcaaaagagaatgaccttctcattactgccgccagtgcgaggtcagtgcccatggacacaaatgtttcatccttgg

SEQ ID NO: 13182 - DNA, 1682 bp, Heterodera glycines
  misc_feature (1606)..(1606): n is a, c, g, or t
atgaatattttaaaattattcaatttattgttttaaatcctgtttattattttatttataattttgctttttaattgcttaaaagaattacataggtaattgctgtttgtttcaaatcatacagttttttagaaaaatcaataattgtttttatttttttatttaattttctcgaactaatttgccttttataccagattaattagatattcaatttcgaatacttttatccatttttcgattaatttttcttttatacataaattattataataaaaaatgattaattttgttttattatattttgttgaaataaaaataaattaattaatacagataagaatttttttgaaagttctttttggtctcaattaacgtatttaaatataaacattaaatactttttaaattttaaccgtcaacttaaataaatttcataatcctaaagaaatgactgctaaaattagtattattattattatatttttttgctatttcactgctttaatttaaatttttttagcctcggtgcatggtttatttaattaaattagaaatttatattatgctatgattttaatgtattagtcaagttgaaataatttaaaatgtttttataaattcttttttccttaattttggttaatatattttttatttcatacttattttagtatgtttttctcatttactgttgcttataatgctatattcataaaaatatttatttatttatatgataatcaccgtttcataattgattctaatgtataatatgacgcggagcaaatattgatattgttgcttatattgtaaaagatattgcaagtgatatttctttgtttgaaatttgtaattttttatttaaataaaactgttcaatgaaattttattttattatttaataggaaaataatatctttttaacatacattaaaatttgaaagtttctggaaattagcaagctcaacccaaattctttatttttatcagttgtcatggctgatcgactgcgctgatggctgtaacctaacgactgaagagcatatcgtcgccttctctggccttccgaaacaaatttttaagattcaattttagcaaatatatatttgtagttggcaaatttttatttaattcgctgagtttgatacattataaattctgcattttcgtagttcgatattataaatattaaaatcatatatagtattacaatctttaaattttatgatatttctagttttgttttacacttttatttattttctaaaaaagaaagatttaattaatataaatattattaaacttgggtttattttcttttttttattcagcaaaaatttattacaaaaataatttacaaagaaataatgatacttttaatttattttgtttaacgtaaatttatttaatatatttatttttatttttatgtcttaaatcactgtatttttattagttttgttgaatcttaatatttataatataaagttaataaattattttaaaaaatataatatttatttttttactttaaattatttgattttaatataataattaaaaaattaaataattaagaaaatttttgtgttttggactcgtntaatccccatcctgccaacataaaaattttttttattaatttttataaaaatttaaaaattttacgtcgacgtgcg

SEQ ID NO: 13183 - DNA, 3353 bp, Heterodera glycines
cgtcgacgtgcgacaacggaaaagctgtcgagtgcaaaaaaggcgcgggttcacgggccagaggagccaatggacgaggaatagtgggtggcgaggtggggagggagtgaaatttgaatgatgatggtaatgcatatgtaatagttatgccattttattttgggtctcttcaattttaaaaacgaaaagtaaattttagatgatttaaaaccacattttagcaaagaaataattggattttgcctgaaattgttaatacaaattggcaccttgacttacttttttgacccaacatttatgattacttttattttgagttttttgtcttaaatcaatttttttaagtattttaattcataaaatggcatccctagtattaaagtagtgatgaaattctttgtgataatataaactatcgcattagcgggaatgtatcaatatctcgccaatttgcaaaattttcagcatgtcccgcttttgtaatagttttttatacaatttttttgtgatattttactttaccattgtgatatttattttttttatttttctttaattttcgatttttttgtgatatttatcttttaatttgctttaattttcgattttgtgatatttgtcttttaatttgttttatttattttaaggtatactgtagcaattttttaaataaattacttcaattaaaatctcttttgaattttctttattttgcgtggcctttccgttttccactttctctttttttcatttctatttgagtgcaaatcaatttccctccacgcccgttcatccaaaatcaaaatttccagaattaagcaccaaagctccccttaacgtcataattatccccgccctatcccttcccggccgtcaataaaagtgagagtaattaccagtcctccatcacttcaaacaaattcatttttaaaaaagggtctcgttaatcctcctaaaaccaaaaacgtatttaataagttttttctttaaattattatttgaaattttacgttttccgttttcttttgttttccattctttcccattcaccctatgggtgtaacatttattcccttcattccgacactcattttcccccccccccgtctgattttaatattataactcttttttaattcctttttactataaacatttaattagttttgatggaattttgttattttaatgttaaaatattttatttttataattccttatttctcatccatctctctttttcaactgtaattagcctcacttcaaataacaactcgcccggggaagagggggaatccttggatcaatcatcgcggcggagaatcaattctgacgaacgataattcaccggggcaagggtctttggtttttgcttagttaatgtaaaaaaaaatgttttttaggccacgggggcaggggtccagggccaaatatttatctggaaatcttataatgagttacattattaacttcttagtctaataatcgaactcgtcatattaaggtcatcgttttttctatggaatttcattgacattgacatttaatcattattttatttttacatattttcatattgttatatttattttgacattatttattcgtaatttttttttgagccacataaaagcactaaggtagttaaatattaatttttattttctgtataaaatggtataaaatccatgaaacaaatattttaatcaataatatccggtgctttctaaattatcctaaacaaaatattacaaaatgaatttaaaataatttgaattttagacaggtaaattatgttttgttattttatctgatcaaattggtccaaaagacttttttgatcattatcaaaagtaagcttagcaggaattttttcagaattttatctcaacataaaattgaattttggtcgattaaacattttgaggcattacttttgcaccgtcagagggggggggggggggcgtgaccaatttctcgtcgacaaagagagttatatttttgagaaaaccagttttaaaaaaaaattttttttgaggcaatacttttgcacctgactgtagttgctattattttgattttctttttaataaaaaaccgaaaaccaaactcaccggaaataattggtggaagccgaatctctagctttgatgcttttataaatgatgaaaaagtaaaaaaattactgagtgcatataaaattcttattttccgtgtattaatttctttaaaagggtggttgaatttatttaaccaaataatttttaattaagagatggtttaaaggtggtgctgcaacatttacgcctctacattcttctttttttaatttggttagatttagagttattatcgcaatatagtgtaagtatagctaatctatttgatagaaaaaatgccgtgaaatttattatttatttaatgatttaaagaatttatttcaaaaaaatagtatcgtgcatgtcgctagttcattaattgctttgttagaaaccaatattttttaaattatttatcagcgttatttttcaccgaaaaaattgatgtggatattttatttaattatggaattttttaatgaattatgtttattaaaaaatcattaattcatttgtataattaatattataaacataaaaattgagtttaatgtacttatttagtctcttctcatatgaggtttgttaatttttgtaatttattccaatttaaatttttaaatatttttttactttttttaaaaaacaaagagttcttttttgttttttttaaattaaatgattttaatacaaagatttacgatatatttatacaacagattcatttagaaatttaatttttaaaatttacgtttgttcttgctttttaagactggtagtgcaaatatttttctcatgacgttagctgatctttcttgttacgttagaaacatcgtgttttggtaattatttgtatatttttaagtaagggtttggtatttgcctttttgatcgaataattaatttatattttttatggcaatgattttgatatttgtttcatgcaataatgtgtgatattttaggtgtttattttttatatttttaattaatttttagaaaaaaatttgttttatggaatttattattatataggtaaatttgttcttttttaaataaaatcattaatttatgaactgaaacgaatatagattttgagattttaaatttttgtcgtgcttgtaatttttcaattctttttttaaatattactttataaatgaatttaatcattattatttttaatgtatgccttattttatttcatgagcaaatgatagttcttttatcaatatttacattataaatttatag

SEQ ID NO: 13184 - DNA, 2355 bp, Heterodera glycines
ttctccgactggcaaaatccaaccgcaaatatttttctaggccataaaattccgagcaaataataataatacaatgggaacaaatatttttggccaaattcgtaactttatgttcctctcatggccattttttgtgaatcattcgcccatttttaaattattacaatttcaaatggtcattcatttgctgattaattaattaattaattaattatgtaatggttcattttcccattcaattacatagctgaaatgcttaaattccaagtgacttcctccgcttcttcttgctccaaccgtttttctccctcgccccaaagactcagtcaaatctcttcttcctcctcctcttcctcttcttcttcctctttctcctcttcacatccctcggcaattggggaacacaacgtggaccgatccatcgacgaattggaggaatttatcgtacaacaaatggccaccccagcaccgtacccaactgatggcaaatccttttacgatacggtaacactcctccggcggggaggctaaaccaaaaacaagcgccatttacagaacgaatgcgccgctgctgcaagtgccgtccctttgccccgtcgcttcgcttctctgtccgatttgtccccctctttttcctcctcctcctccccgtcgtcctcttctagcagttcgtcctcctctctcaactgcggcactttgggccggagaaagtcgcccgccccgcagccgccaaagccaaaaagaatggcccccggcgaatgggtgagaattagccgggggcatttttgaagtgctgttctgtaatttacttttaaggactatttgcgcgtgtacacggcacaaatcaaaacggacacggactacaaaacgttgcaagtgcccgcgggggtcagcacagaatgcgtcattcgccagttggtgttggacaaactgcgtctgtcgttgcgcgacctgaacctattccatttgttcatggaggttcgcttttcgaatttttgttttttggccctttgaaatgccaaattttccgttaggtgcgaactcggcgcatggacggaacggaggcacgcagcattttggagttggaccgaatggcacgaccgctggatctccaaaagtgccacccggtcggaatgtcgcgcttcatcctcggcatggactcaaacgcaattttggcccgaatttacgacggcgaagtgaatccggaggtgaattaatgcaaaaaagagaaaacaaaatgaacacagcttcaatcacttaaattcaaaaagaataatagtcatagttttaagccgtcagtcaaaatgatcggctgtggtcagtgagtggctctgttcagagtgatgagcagcgagtatttgatcagattgactagcaagaatattaattagagtgaccaacattgattatttgatcagagtgatcaacaataaatattgatcatgattagcagtaagctttatgatcccaatgatcagtacttagtattttgatcagagtaattggcagtgactgatcaatgtaaccaaaagcgagtgttttgacccgagtaatcagcagagtgattaatatcagtgtggtcagcagtgagtgactctgatcagagtaatgagctgagtcaatgtgatcagcagtgagttgataaatgatcagcaattttattagtaattagtgccggatgatcgttcataattgtctttctctttagagcaactacaaatcggtgctgatttctcggcgaacgtgctgtgccgaagtgctccaaatgctgtgccaaatgagtcgtccgtcgtttgtctccgccgactgccgccttcggcccgcgcgtgacgccccctcaaaagcgcagtactgccagcagcttggcctggatgccatctccgaactgcgactgttcgtggacagtcctcgcggcgccgagtcggcactgatccccgcgaaatgcccattggccggggtatacacggcactgatgccggggcaacgaattgcactccgccgagtgattgcgccgagggcggacagcttttcgtaagaggcgaaatgcggaaaagtggacaaaaaacatcggatgacctcactcttctgttgataataaatggcctagcatttaaattattcacttttcaattgctaattcatgaaatctgtggcatttgtttataaatcatttttcactttgacccgctgactgtaatattaaatagtttttcatttattttaaagtgatggaacattggcttatttgtttttcgaaattttttaactcatttctttaatggactttcaaatgaatgcaaatgtttttacaattttatgcaccttattccaatggaaaaaataggctcaaaaagt

SEQ ID NO: 13185 - DNA, 1799 bp, Heterodera glycines
tgctttgccaatccagatttgtctcgggaaaagaccatttttttgtgtaaacaattataaatatttgctatgctaaaaaatttttccttatgcaacgattttcttgaaattttgcataggcccatattttgaccccctctatcgaatccctgtttattttttggaagttgtgtttttaactcgagatcggctcttccatttttacaagggaaaatctcggcaaaatttttaaattagtggggttttttggcgttttgtccttaggcaatttttgtcaaaatgatgatatatgcccgctgactgtaatattaaatagtttttcatttattttaaagtgatggaacattggcttatttgtttttcgaaattttttaactcatttctttaatggactttcaaatgaatgcaaatgttttcacaattttatgcacatttattcaaatagaaaaaataggctcaaaaagtcgcaattttatacagcaaatggaatgaaaaaagaaatgtgagtttttagtcaaacaatattattgccaaaagtgtgaaggatccagcgaataaggacaaaatcggacggcataatagtgactcgatttgcgtgtacggcacatctgttagcggcttcaaaaaaggttgtgagaaaagtttcagcggcctgtaaattcaagaaacttcggtaatagtttcatttaagctatttttagacgaaaaaatgcgaaaatttttgttaaattcatgttcgggttctaaagaccaaaaaggatgtcttgtaaattgaccaataaataacccacctcctgaagagcagtggccgcttgggtctccaaccggtgagagttccatgttatttcgcttatcacttcccggatcaagcgacggaacggctgccggggcatcaaattgtctgtggatttttggtacctccgaatctctttaagtgccctaaaagattaagtttgattgatgtcgtgtttgtcctctcattttttttaaagatttaaatttaaaaaataagccaagtcattttgattgttatttcttttttattttttaaaaatgtctaaagggccgatgattttggctatttgtgatttttgtcaatccaaatgaaaagagctctccatttgtggtttaggaaaaaaaaagttaaggtacatgaaacccaaacattatttaatttaccataaataaaaaagaaaaacaaattacttctcccctggtcggtaccgctttcgccgttcttcttcctttttgttgattttttttttcatgatatgaatagccggccgagaaaaactaaaaaaaaatctatttttaatcatacgcaacgaattatttacaggcaaaaaaaaagtaaacataaatttgtattttattttgcataaaaaatatgttgatcattttggtgttcctttttatggatgttattttcatgatatggcgaggatttttagaagcgaaatcccccagaagagatgctttaactaagaatgaaaaaattcgacaaacccatgttgtttttccaaagataaaaaaactgagaaaatttaggactttcaaaaacaaaaatagggaaaaaatacaaaacgccaaacaaaggaacagttcgaaaaaaatttcttttcttctcaagatagacagaaaaaaaaatgaaaaaaagcatcctagaagcttcaaaataacctagactagaaaatgcaaaaaaggaagaaaatactgtaaaatatttttttatgtttttcatgaatccacaatatttttttggtgaaaatattaactcaagtatttttagagaattacat

SEQ ID NO: 13186 - DNA, 1893 bp, Heterodera glycines
  misc_feature (1753)..(1753): n is a, c, g, or t
ccgtggggtgggccggagctattttcttctatagtcgacccccccccataggggagaatcccaccccgtgggtcctataggcgacccaccccgaaaagggagaatcccaccccgtgggtcgtttggcgacccaccccgaaaagggagaatcccacccggtggtcggcctttgtcatatggtttgcttgcgtgaaatacgttccatttgcgaatggtcaaaatgtaaggcaaaagtattgacaacgacccacggagtgggtcgcctggcgacccaccccccgttgaagcaacaaactaaaaaaatgctgaagaatgtacgctgaggcaaaattggcttgggaaaatatgatggggtgtaaattgaggtagagaagtcagagaaaagtgttatatttcttctttacttggcgacccaccccgtggggtgggccggagctagttcctcctataggcgacccacccccaaaagggagaatcccaccccgtgggtcgcctggcgacccaccccccgttgaagcaacaaactgaaaaatgctgaagaatgtacgctgaggcaaaattggcttgggaaaatatgatggggtgtaaattgaggtagagaagtcagagaaaagtgttatatttcttctttacttggcgacccaccccgtggggtgggccggagctagttcctcctataggcgacccacccccaaaagggagaatcccaccccgtgggtcgcctggcgacccaccccgaaaagggagaatcccacccggtggtcggcctttgtcatatggtttgcttgcgtgaaatacgttccatttgcgaattaacaaaaaatatttcattgtaaatatacataaaagtaaaaatagttaaataaaattctaatgcgcaagaaatttattcaaatgataaaacgaagcatgatcagatgattgaaataacaaaaatattcataagtaaggagtaatacaaaataccaatgattaacataaaacaatgctaactaaaattcatattaaaaacgtatttcccacactcaacgatgtctttcttcctaccccgcatttcattcatattgttgtttttaacatctttgagcattccttttttgttcgtcattgcctttgtttccgcacgcttttgtgggttggccttaagagatttgagttatattttattgacttcaacaatactgactcgagtgcgtttcttagccactttgcttttcttcttttgcttatccacccaaggcttcacagaaataacgtttccatcaattttatgaggatcaaatgacaaaacagcagatgactaaaagagatttattgctccaataatttagaaaataaatacctgattttgtgtctcgaactcgacaaaaccaaaaccacgagagctttttgtttttgcatcataaacgacaccacagttggtcactttaccaaatttggaaaagtatttgtttaaagaatcatcggttgtttgaccagataaactaaacacggtacaagtgatacaatgttacaactaatatatgaacgacaaacccaacaataaagattttgtggttggtattgttgttcccagacaactggccatcggatggagtcgaggttgcggagggatgactgctttgttcctcactcatcttgagatagaaaatgaccgtcggatggaatttagaatttaaattatttcaataaatatgaggctaaaattaaggaaatgaattggtaaattgaaattcaatacgcgcgaagttgngtcagatggaacagcaaactgaaaaatgctgaagaatggacgctgagccaaaattggcttggaaaaaatatgatggggtgtaaattaaggtagagaagtcagagaaaagtgtaatatttcttctttacttggcgacccac

SEQ ID NO: 13187 - DNA, 3052 bp, Heterodera glycines
gcttgccactataaaaaacattttggaagttggccactaaaatagttttttttgccactaatttagcattttgccacctatttttcactattccgacatttttttgaaaaatttctcaacaaaatgcaagaaaaaaatacacccctaagaatgggtccacctcgtttcggcgccagcccagtttttggactataactttttctttatcaaccaaatctaacttttggtatcattcgaaagccctaagtgttctctattagcatgcaaaattgccaaaaatttcattaggtttaaaaaaaagttatggtcagaagaattcaaaaaaccagatttccaacttttttggctataacttttttcaatcttaactaattttttcaaaaatttttgcaagctattcatccctcatttttttcttgtcaagaattttggatgtaaaaaatgtcaatattttctaaaatattagaaggaaatgtaacctcatttgcaacagcacccagtgaataaaaaaaattttgctcaatttttggctgaaaattatgtcattatggatttttcgccactatctttgccactattttggcatttgtagtacttttactgtcgattttgtttgttttttgaaaaaaattgacggcatataattttctgaaaattctatttatccccctgggggataaatggagactgggggattatttttcaaacccctcctagactgggggataattggagattgggggattaatggagattgggggataattagagcaaatacggtaaatgcctgtgccggacagcagcaggcgaaaagtgccgaaaatcacaatggaaacggggcaatggcaattaagcaggaacattttgacgaatgatttgtgtctttaaatattatatgttatttcttgcctttttaaaatttttaatttgacttttgtgatggccgagttgagacggataatttatcaaaaatcccatgtttttatttcaatagttttctttgttcttttctttttattgtcccatttattcttaaagcaaaatttaaactttacttaactccgattttttcagagagccttttaaaaatgccaaatgttttgattttggccccaattatgacgatattcacttttaaattttgtttcaaaaagttgagaccgattcattctcacgtttaataaacgctgttttatttacacaatgaaaatgatatgttcgatattgcagatcattatttttaatgggtgagaatttgctgggaaaacaaaaagcattttgagaggaaaagtaattgtcaaaaaatagtgaaacgaaatgaaaaattaaccggaaggctaattgctgagatcatttctggcaccattctagcctaatggccatgccattcctcgttcatcgctttcagggccaaggccaatacggcttggtcagcattaatcgactgccaccgccgctgcggcggtgctttcggccgcttgtgccgccgctggtcaatttgcggacggcgccggtgggcacgcgtttttcatgcgcggtcgctccgtcgatgacaccgtcggcgtttttcaaactgcgccggtgatgccgacgtcgttgggccgaatgtccgagcacaaaatggtcgtagtgagaacgatgacgacggtggtggtgccggtggtggtggacgtgctgcggactttgccgctgttctgttgtaccgtctgcgtcaagttggaacaactgaaagatgcttgagtataataccaaagggccaaaatattcagggggaaacagaaaacaaatagccgctgggatttggcaaaatgccaaaaacgacggtcggacggatggactggtcaaatttaaaaaatattaatgagagacaaaagaccgaattcgctagtcgaattggccaaatgccaaaaatatttattgggtttggcaaacttggcatatagaaaagaaagacaacttatgaaatataaaaagctctgtccaccctgacttgtacacttttccttaccttctcaaagtctgtcggaagtgccgctgatgtttttgtcgtttcgtcgttgatcagaatggcattttgtccgtcgtcgtcgccattttctttggcaaaagatggacggcattccgttgttggcaaaatgtgtaaaataattgtgctaattgtgaacaaatggagaaggaatagtttggcactgctggtgtccgtttggggcgtttgcttctgctcctttggcagcattttcatttttgggggattttcgctgatttaattctgtgaatggcggagagtgagtgaattaaattcggaggatacaaaattatttggggaaggatttgaccgccggggcggaaatgtcggtgaattggggaattgggtgaagatgcgcccaccggcaacagagagcgaccattcgccacccaataacctcattaattgaccctgcaattactcccccccccgcgccatcccaacggatgacccgaaaccaaattcacgcaaaacaatttcaaaattagttgaaaattgcgtttcactgttgcgcaatgtgcgcatttaataaaagggaaaaagggaaagataaatttatgtaaaatatcatcagtcaaccttttgaaatgaggctttatttcgctaattgtgctaattaagcgggcgctaaagcacaaggcaaggaatgttctggaagaataccattcgcacttgtggagcagcagagcatgtcatcattaacacatcactgttctctgtgctatgggaggtcacacaaaacaacaaaatttagaggaaaaggcggtgggagggagaagtgattagtgattgctgctgcttctttgctgttgctaatgataataatgctaatggtaatgatgatgatgaggtggtggtgatgaactttgagcagcattggccctgggggggggggcaaagcgtaaatattttgttgcctttttgtgctgccagcagatgaggaaggagaagaagaagcattcgttgcttatgatgtgttccaccgccccccccctaatttggcctaattattcgctctttgtccgt

SEQ ID NO: 13188 - DNA, 1519 bp, Heterodera glycines
accagtcgaaggctctcctctctcttggacgctttgaccataaaaaagctaactgtagccgaattctctgccgatttgttcaaaagccgcagaaaaaaattgttgagagaatttcaaagcggtgcggtgagtgccgagtttatcctttggacacagcgtccggaaacagctcctgtaccaaaaaagatttgcatgtgtggctcagtggtttttgtaggaaagtcaagggacaaagggcggaggttcgagtccgttgtgctacatgaatatttttatttatttttgtgcaaaaaattaaaaaatgacgatttttgggaattatttttggaggtttttaccaaccaaattggtccatcatggtatcattcgaaagctcctggtgaggagaagctttttctaagcggatgctaaccattttgaagcattagaaaaaagttatgggcgtttgatttttgttttttgaataacttttctaatcgacccattttcaaattaatctgacctatcattagatgcagaaaatttttctctatcgatatataaaatttggttggatttaacaagtagaaaaaattttaaacaggatgaagcaaattcggtttttctctattaatagagatgaagaaatagtacgccaaaaagagagatatctttttctctgcactctctatttattggtacacatctcgctttttcggacggtgtgtggaggaatcatatcattcttaaaaaatcaaaattcccaggtccgtgtgctgatcgcttgtgatgtcctttcacggggcatcgatgttttggacgtcgattgcgtgatcaattacgacctgccgataaacgaacgcattttcgttcaccgagctggtcgtactgccagagcaatgaaagaaggactactcgtttcactgacaacaaaagaagaagtgtgctaagtgactacattttcacattttactttcccacatttttttccctttagaaaatgaaacttaaaaagttgctgtctccgcacaacctttgggagagcattcaagaaacaaagtccaatgactcggactttaacgaagaatgcatacagttgtatgaaaacgcgctaagaaagttgaaaaaacgatttgaacaaaaataaatgatttacataatagcttttaccctgttgttttttagttccatattgttattttcattttttctgttattttgttacccacccatctcaatttccatcgaaaatctaaaagttgttctcgtggtggcggttgtggtattttgatcaaaaggaaataggatttttcataaaattttccggcacaaaatttaattgtgaaattttaattttccaattacaaaatttaaaatcaataaaatttgcattggtatatagaccaacaaaaacaacgtacaaacaaactatggaacttttcaaatttttggaaacattttcaagccaaaattacgttgttttaggtgattttaattatacaaaaatgagatcctggtatggaaggaagggcatccattt

SEQ ID NO: 13189 - DNA, 2539 bp, Heterodera glycines
ttttttccctttagaaaatgaaacttaaaaagttgctgtctccgcacaacctttgggagagcattcaagaaacaaagtccaatgactcggactttaacgaagaatgcatacagttgtatgaaaacgcgctaagaaagttgaaaaaacgatttgaaaaaaataaatgatttacatatatagcttttaccctgttgttttttagtttcatattgttcttttcatttctcctattattttgttacccacccatctcaatttccattttccattgtcttgttccttttttcagaaatattttggtgaataaatattgtttaaactaaataatacattattttggtaattaataataaacgattcctaatcgattttgagtcaattatttattgtcaaaggcaaactgtttcttctcattttgtagttcgggctgactttagtgatttatttatttatttttttgattttctgtcagatggatggccgtaaccataaccatgcccatcatcacgaatcccacgttcaaatttcgaccaattcgctgccgccggccaacccaatcgacggaattgtaaattctcttccggatttgaatggtaaaatttgtctggcgatagtcatgaaatatataacgtcgtttttggtgcattaaatcataatcactctactttaattccatggacggtaaaaaacgaaaaaaattgccaaaaaataattggcgtaaaacaaaacgccaacacacgcaaaaacaaagtatatgcacttacactggtaaatgccttttttgtattttttattttgatcagccataacacgcttcattcccaacaaaaatgaacaaatttggtatctaaaaaaagattttgaaaaggagaatctttttctaagtgaatgctaagcaatttgacatctcagaaaaaagttgtgagagtttcaaatgttcatcacgttataactcaagtcctaggcagctctttctaaccaaaatgctaaatttattcttttttctattgattctaaatgttcaaagtgattttgtacccttataaccaaaattattagaattttcgaatttggtgttttttgtgtgttagagatgtgaaaatagtacgccaacacgagaggaaaagaaatgcaaaaattttaatcactccataactttttagttaacccactttttattcataaaaaccctccaattatgttcgtaatttttttctctatcgatatgcaaaatttggtatggatttaacgtgcaggaaaaaagttaaacgtcacgaagtaaatgttgttctttacattattaagaatgaagagatagtacgtaaaagtgagagaaataaagataaaaagtaaatgtgacagaacgccaattttttcccataatcctatataataaagatgagtgtttgtatctgccatgctttgaattggcgtggcgttttgttattattttgcgttaaaaaatgatttgaaaatgaaaatatttttgttttgttttgcgttagaaaagcatttgaaaaataaatttgttttttgtaaacgaaaaaatttatcagtatattgtttgagtttgatttagtggttgttgtttgtttatttgtttattttgtttttgtgttctttacgtgaaataattatgcttatgcttaatgttatttgaactttaatgaaatataaatgcatatctttggtttgttctgtgactttagtgtgagacactaatgtgtgtcatgcttttgaaaagcattagtggtttgttctgtgactttagtgtgagacactaatgtgtgtcatgcttttgaaaaacattagtggtttgttctgtgactttagtgtgagacactaatgtgtgtcatgcttttgaaaaacattagtggtttgttctgtgactttcgtgtgagacactaatgtgtgtcatgcttttgaaaaacattagtggtttgttctgtgactttcgtgtgagacactaatgtgtgtcatgcttttgaaaaacattagtggtttgttctgtgactttcgtgtgagacactaatttgtgtcatgttgtgccataaggaaatgccaaaaaacaaggagatgatgaaaatgccaagaatgttgtgccataaggaaatgccacaagaaacaagaagagatgatgaaaatgccaagaatgcaggagaatagagtcccagtgattgaaatgcagaagaattgagtcccactgattgaaatgctggtggattgaatcccgttgattggaatgttggtgggttgagtcccattgattaaatgatggtggattgagtcctgttgattggaatgttggtgggttgagtcccagtgattgaatgctggagggttgagtcctgttgattggaatgttggtgggttgagtcccattgattaaatgatggtggattgagtcctgttgattggaatgttggtgggttgagtcccagtgattgaatgctggagggttgagtcctgttgattggaatgttggtgggttgagtcccactgattggaatgccggtggattgagtcccagtgattggaa

SEQ ID NO: 13190 - DNA, 1386 bp, Heterodera glycines
  misc_feature (24)..(24): n is a, c, g, or t
  misc_feature (1344)..(1345): n is a, c, g, or t
  misc_feature (1354)..(1354): n is a, c, g, or t
  misc_feature (1356)..(1356): n is a, c, g, or t
cctaattcaaaaattgactatttntggtttaaaatctattaacaaatataagtaacatctcaatttcctaaattttcggcgccgacggacccattctcagcatattaaaaaatttgaaaaataatatcaccgagaaaatatgattggttttcattatttattttatgattttttattttcagtagtaaattttattttttgagaccaaaaactaataaatctgttaaaaagcacattttttaaaacaattaatttaacttctgaccttaaatttattttaaatttcaaaaatgcaagtctcgacaagcctggtttttcctgggcctgaattttcctgatttttgtcctggaaatgcagatcaagatccaacaaggaaccctggtccaggcacacgcttttttcaaaattttgaactctaattattgtattaccgttagaatattttacaaaaagaaataacaaataaaataagaaagaatttattctcacaatttaaaggaaaaatgagaatactaaaatgaagatacataaaatgctacattttacgatttaaaagaatatttaaatgatttttttaataattttgtaaagaagaaaaagagaggagccccagttggttactgtagcgatatggtaaagacagaatttggaattgctcttcctgctgcttgtgttctttttccagcgatctttctcaccgccgatcatgaactcgtggtaaatagtggtgaacactcctcacatcactactgtagttaaagcctggcaatctgttgctcgtgctggcacttgaagttggcgccatttcgatgtcattggcaccagccgaagccgaactggtcgaagagcggtgacaagctcggctcaagacgcagctgagcaaagctaaagcgatgattcccactacgacaatgatccaaatcatcatgttggtggtggcacgctttttgcgtcttcgtctgcgcgacgaaccgtcgccattggaatctgtgatgaattgaaaattaattaaaaaataaatgtttaaatgattaaattatactttttgccaaaatttccatcgtcccattgtttccgtcgccaatcgctgccaaaatcgttttcagagtttcgcgctgattttggtatgtattttcggtgtttttgctgttttccttttcatttttttcatttccgtttctttcccattcttttggttcccatttttcgccggtttttttagagtttcagttttgttttttttttcaaatttgtttgctttgtcttccgttttctcccgttggcttttcgtccgtttggctgcccgttcctctgctttttaaaaggtttttcttcgtctctcnnctgctgctncntcccttttagaggtataatactttaattat

SEQ ID NO: 13191 - DNA, 1491 bp, Heterodera glycines
ttgccaaatttccatcgtcccattgtttccgtcgccaatcgctgccaaaatcgttttcagagtttcgcgctgattttggtatgaattttcagagtttttgctgttttccttttcatttttttcatttccgtttctttcccaattattttggttccaatttttcgccaatttttttaaaatttcaattttattttcattttcatttttgtttgctttgtcttcaatttgctcccgttggattttcatacgtttggctaacagaaacactgcttcgaccgcattttttcttagtctctcaactgctgcttcatcacacacagattctaatactttaattataattaaatttttaaattaattacccaattaccattcttctcattaattacttatttacctcggtaattaatttaattgcccatttaaatcatccttaattaatttaattacccaattaccttctcctccttttatttctccgagttttgttcttaaacttaagtaaatttgggccaatttcgcgtcttcccgttcttcgattgcttcacatttttctatcactttggccatcgtttcgttttggtcctccaatttttggataaactcgcgcaattccccagtgccatcattttctgccaatttttgctcataaatttggcggtcgatcaataccaaattttggggctttgattttatcacggaaaaaattggttggggaaaagcaatggaacacacaaaaaagacaattgccagcaacattttaagcaactaaaagaatgggtttttaggctgtaatttcggcggtggcgatgggatttgctgggcaaaaaatttggaattttgaataaattatatttgaccaaatcgatgcataaacgattggaaaagtatatcaaataaaacttattctttttgaaagaaaattatggtgacattaaaacaaatgcattaataggtttaaacaacgaattaaagccttaattagagaattaataattcgtttgagcagctgaaatcaaatgatcaattgtgaataagaatgaacagaaacttgtttgaagatgcggaggtttgtgcaaaaaacgtcacagagatgatgatgtctgacaaattttaatgtcatagatccagggcatccggctttttcttcataaatattttgatagaagatatgttttataaaaatggagacacacatccgatctgagggaaaatgttatcagtatggatgagtaataaaaataatacatgtgcgatatggtgagcatttttttatgagataatatacaacagagtatgtatgtatgggtaaccgctcacttcttaggggcatgatgtcacatgtaatgggcgataatgtgagggaatcagtttgaaaatgacatcactatttttattaattttaatttaaattcatcttctcataaatatatattatattctaaatttaaaatttctaataaaaaaaataaatctaaaagggtcatcttc

SEQ ID NO: 13192 - DNA, 1393 bp, Heterodera glycines
aatactcaaaaaacttttcttaaaaacatataactttgattaaaagtaaaaaaatgtttataaacaaacataaaattaacaagatcgagttccggatcagaattccccggtttccagggtgaatggtaaaacttttaaatctattttttatatatattttattaaaattaacatagcaatacttaaatgctttttttaaacaaatttgatgattttttttcggtacgcatgcgtccgcaaggagcatcattttgtagtgtgccttgttgtttttttgtagcacgatttgcctttttgttaaaaactcaaaaacaaggcacatgagttaatatatccgaaaaaaccaggtaaaattaataaaaaaaaatcagcaactttttttaaaaaggttaagattgaagcagaaaatattaaaacagcacatttatcaaaactttgcatttatttttaaaagagagttcgcagcgggggtgagacagaatgccaatttcctttttatgattgccaattttcgacaatccatgacttgaaatgccgatttctttggatttaagaaagaattttttgttttacataagatttttttcttcttaatagggtagatttttaatgggtattttttaaatggaaatttgaacttcgttttttttagttttattacagggatatgatttgtttcgacaaaacaaaataaataattaattaagaaacttttagcatattttgtgctgatagtctttgtttgaacccacaaaattattggccattttattatttgagattttttgctcattaaaactcagttcagtttaattggacaattaaaacatgaacaaaaatgattaaagagttcaaatataaatatagttcatttggcaaatatttgcctctttttatgctcaatttcatcaaatcaccagttccaatttatcctaaatttatttttttttaattcgcaaaattcaattggaaatgcccaatcaaaattctaattaatttcaaatctttgattcttcgataattttttgctcatacataaatttcaatacgcggattgatatagtaattaattttaaataatataaaaaattaaaattactgaaaaacagttaaaatctgacaaataataataaaagtattgaaaaacgaataaaattacaaaaatatttaatataaaataatcagacattataaacattcaatttaaatatttttcaatgccataattgtgatctctgttggtcagaaaaagaccgagaaagttcttttattcacaaatgcatttataaacattatcaaattatttaaataaaaatatcgaggcaataaaaaataagagagacagattttctatatttaaaataaaattttcaaataaatctttattttaaat

SEQ ID NO: 13193 - DNA, 850 bp, Heterodera glycines
aattaacatatgcaaagattagcatttttaatcgttcagtgtaaatcacccaatcgagaagcgttggccaaattttaattttacaattagtaactgaattaaacaaagagaaagtccatagcaaatgctttaataagcaattacaaacagattttttatctattacgtcagcacctataatcttaatattcatatgggacaaattatttaaataattaggcacttttatagcacaggttgctaattgaaaccaaggacctttttgtatgcaattaatgccttaagtgcaatagaacgatgagcacctggacgaagagttcctccagcagcttttcggttacttgtccatccaagtttcgcaaatacactgtgcattcctgctgcatattaacgtgtccagacatattcaaatagaatttgcgcgtttgtctgcttaaaaatagtctaatttctttataaaattatgaaaaaccaaagggttttttttatcttaaaaattgcgaaaacgtgtttctaggggctagcgttatggagtcgcagatcacaaatcataaaaccattttggactactaattcggcattcgggttagagatcgcgaatagtcaatgagtgttagattcgttattttcgggtacggtttcgaaagtttcgggttttgcgttccggataaatttttcgtttcgactttttgtttgtatttttttagattttccaaagataaaaaaagtcaataaaaacgagttgtctagttgaatgtcgttcattctcggacggacaatacagtacccactggattttagatccactccatagaagataaagataaaaaatcaaatcataattatcagg

SEQ ID NO: 13194 - DNA, 2637 bp, Heterodera glycines
aaaaataaatcataaatttgaatgggtgctttagtgggtcaacagtgagcttcactgctgaaaatcttgagaaatttttgacttgaaattgcaaaaataatcgataaaatttatgagaaataaaaatttttaaattaatttgcacccctaattttcaagttttttgtgcatatttggtgcatatttcacgactttatttgcatatttatgcgcatattttggctacttttcgtgcatatttttacagccctgataattatacacatgcggaaaattaaattcaagtcgtctgacagtattctcaattgacattctttcttttgtatttaatacaaatttttaaattttacatttacaataatccccgaattgtattcccaaatttccctcccgttcttcatcaactgttgatcgtgctcttcttgttattttccaaccgttgatcatcctcggaagctgttcattcttcacaattaatgtttctgaaactgtcgttctatttccaaaaaaacaccaaaattcttacgcaaattcaaattttctcacctcggcagtcgtggcgtgcacacctcaatccaagcacaattttgtcccaccatgtcagctctgtcttccctttctcatctgtctcttttttctgttcctcctcttcgtttgcttcctccgctgctatgccaccgacgtcaatgatcggtgggagagatcgcgcgccattccctccttttcgaatcgctgcaattgtgcggcccttcgcttcttctctctgctgctctgccttttctgccacattttgcccaatttcttcctccgtcgttccattctccgttttcccattgctttcattcgctttttcctccactttttcacttttactttttgcctcttttctattgcttttgtcctccttttcgtcgtttgcatcactttcactgatcgacaatgcttcttcattcgcagcagcgggcggtggactaaaagtgagtttggcttgctccaacttttccgttcctttttccgtgccgggttctccctgttgatggagctccatttgaacgtggaaatcgtttgcgtcgtcttcaatttgcgtgattactgtatccagcggaaagcggagctccgtcacatcttcgacggaatggtcaaatcttagagagagaggagagaattgcaactgatgggtctttgaagctgtgccgtttcaaaaatgaaccaatccgaaaacccatcaaattattattctttgcttcttcctctcactttgtctctttttcggtcacttcttccgatgccaacttttcttctcccttctgctgaatgtgcggttgtttatcagcgtcaccttcaaatgcctcttttagtacggcattttccggttgatttgtcttttgttggttttgttgttgttttgggatttgttggcgaagggattccgagggttcgaggtaaggaaaagggacgcaaaaagaaaggtgtagtaagagaaagcaagagaacacgtaaattcgatgtaaatgcatctgaaatatattcaagcccaaaaaatgttgaccaatttgggcgggctttacaactacagtcgaaaatcgtttaagatttaagctggtcacctaactcaatgtgatcaaacaaagccaaaaagaggtgggagcccccgcttgacgctcattggcataatacccttgggcttctcatttatcaaaatgaagtttgtatcgatttatcatttaattaagtagtaaatgcatacatacaaagacaactaagttaagagggacaaacggcggcggatgatggatgggcgagagtcacaagaaaggccaatgagagggagggggaggggggggggagaagcatcggctgagagaagggttggatcgacgggagggagaaaaatcagcaactaattgacagcaaaggccaatcattggaataaagcaatgaccaaaaaatacacgagaacgtcagagaattcaaaaatttggcaaatatcctttttcaggctcatcattttgttggccatagcagcagctggtgcattgatcctcatcgtgtcgtttcatgtaaatacttttttttgcagctttattttgatgagaattgcggtccagacaaatgtggcaaatttattatttcactatggcctgaaaggcacgaaaacatgtttttttcggttgttgttaagctggtttttgattattagcaacattttctagtttttatttttatcaccctaaaaatgttctgaaaaaactattcaattattttggcgttttgccacttattaacaaaaatgggctcttatacacggcgggtggctggacatttcgacaatgaccgtttcgccaatgaccgtttcgacaataccttttcgacaatgccgtttcgacaatgaccatttacgactatatcatatcgccaaaatttaaaatatcaaattaaatataataaaatgaatataaaaaataataaataaatttaaaaaaatatcaatgaaatttaaagagaaaaaggtagttatattttttaaatttaatgaatgcattatctatcgcctattgtgtatgattattaatagtgaagaaacaagacaaaatgagacggacctataatataaatccaaaatgaaacccatttatt

SEQ ID NO: 13195 - DNA, 3511 bp, Heterodera glycines
cgaatggaagattgattattttttaaatttgtttatgaatgatgtgagttctttgatcgagtttaaccaattatttttgtctgggcctttctaattaaagtactccgccaagtggagattataaattcgttcttctgttttaaaagtgataaaagtgaattttattgggtataaataaggtagagagagattttttttgaatattttactcaaaatatgttattcgtatttctcttctttgccactttgtttttcgaactatcaatcggaaacttcatatcttccgaatcgtgcaatggttcttatattgtttagtttgattaccgaaatgtgcataagcaactaacagtcctgcagatggcttttgattcaaaatgggaggagtgcgcaatcacctgctcagcattcgatcgacatttcgcctggactaaaacatgtcgcccaggcccagctggacaaccttgatgcctgattgagtttagtcgtggccgattaactgctgagggtgcctgcccttcactttacgtgggattacaaaacggcctaagcacaccgaatgatgccaacataaatggataattggttgtcttctttgccatggaatcatgttgagctgttgcagaacgaaagtgttgcggtgatcaaggaaaagaattactgcgtataggccagtcaaactttgttggatgtattcttaatttatgtttaccggaacaaaatagtcttctccaacggattaacaaccgagccgatcatcatgatcaccaccaaaatctctaggtgtgccacggcaatggtttaccattctgcaagcaaatgatcagaacccggagggcttaacagtaaaacagggaatttaaatttaaaaaaattgattttaagtggcgatgcagtcattgtcgaaacgcaattccaaacagcgaaagttcataacgattttcacccagatttggttcttttttcaaccatatgcatttgtcactaaatacttctgcctattattgccgaaaacaccattattagtgatgggtgggacaggatatggtggaataaataacatgcagcagcagtacaaccatcgttttgtaaatcaccaattatacttcgtagacccagcttactctcaaatacacacccagggaattgaagcgacctgaagggctctaaatcaaagcttaaaacaaacaccttcataggactaaccctgaattgttgcgaacctatttgtaccagaacgcatttcgtggttaccacataagcataaaaatattttagagaaaatacgtacaactatactgtttaaaatattttttcctattttttaatgtttatttgaaataaaccaatttggatgggaaaattgggtgggacgcgtaaaatgtcaggggacgcgtaaaatgtcatgggacgcgtaaaatgtcatgggacgcgtaaagtatcatgggaccgtaaaaccgactagaaccggctttttttgcttcacttataatacccatttattttttatttctgatatcgtttcttatttcagttttttaattcgttttttaattacataattcttgaatttatttccatgaggcaaattctgtatcaaaaaaaaaaaaaaaattgaccaaaaaaagtgaaaaagttttcaaaatcgaccacttttacagtagcgccaacattttcattgtaaaaataatcagattcttttgcatttggtttaaattttaaaaatgaatttaaaggtttgacatcaatcgacagctcaaaatttttgaaacaaataagctattgctaagcgctgtaacaatttttaaatctttgccgccatatttaaaccgcgaaaatttttttatgaatttatctttttcacattttaattttcttcaattttttaataatctaagagcttgtttcgatattttgggttgattttctaattaaaaaatatataaattttcagttttcacaaatttccatttacccgggcagcacagtgattgtctgcaaaaatatgacggctgaacatagggtcaacatttgccaaacatggagcacaagcggcggatgctgctcaaaaagcagttggaccgaaaaactgacgggcccaatcattgaggacaaaagaattggccaaaaagtgcactgaattaaattttttgaaattattgaattaaatttaaaaaatattttttaattaaataattattatcagaaagttaatttcttttaattgaattttctaaaaaggttaattaaattctgtgcaatattttaaaattaaatggaaaaagaataaaaaattattgaaataattttaatttatttatattattattaaataatttaatttttgtttattattatttacctgaaatgcatattgtactcgctgagtgctttcacggtgacggagcccggaattgaaaaaatgataagcaaaatggagaacagtggcagaattgaacagaattccttaaacaataaatgaaacaatgttttttaaatagctaattattgacagaaatattttgaaggggcttaatgaacttgaaaataatgcttataatatgaatattgttagtccggaacgggatcccgaccgagattggtcccggaacaccggctattcgtgtcccgttccaaattaaatccattatcccatcccgacccagaatttttgatcacgcttccagttttcctcctaaattccggaaccgtctaaaacctatttaaagttttaatgcggcataattaaggacatttttcatcttatttaattaaaaaaatttattaatattattaatttctaaatttaaaatcaaatctattaaaaaaattttaattgagcgaagaatttgatttaaggacgctgcttttaaatcaaggacaaattgccgtcctggaaattaatttaaaaaatataattgcacaccaaataaaagtgtgctcaacgtgacaatgttcaacggaatgtggaccaattgttggccaattgtgcgtactgttgtccacaaaagcatgttggtcagcaataagcacacagcagttgccggttggagaacattgagcagagcggacagtaccgataaggtaattaaagcggagttaagatggggaataacctgtaaaaaataagcgaaattaaatttaaaaaacaaatgtaaataaaaaataatataaataagaaaagggatctattaatattaacctaatttaaaaaagggacccaactttaattagccaattaaatttaattaatatattaagaaaatagacttattaacacaacttaaaaaggagaaaaaattagccaattagtataatcacaaatggacttattaacgtaactaaaaagggacaaaaaattaattagccaattaaattaatgtaattaagaaaagggacgtaaaaatttgtttaaaaaattaatcttaaatgtaagcaacaaagaggtatataatagatttatttaattaaaaatttatcataaataatgtatttatatgtaataaaaaaagac

SEQ ID NO: 13196 - DNA, 3369 bp, Heterodera glycines
cagagcagcagctgatcggaccgcgatcagtctaaccattttgtccaattgtcatcaaatttgtccctccgtctgtcctcccaattttatgcgctatttcgtcccccctcgtctctctctcagtctgtctgtctctctctgttttgcatattattttctttgccgtttatctctgctgtgttccctcctcactgatcagtgatcaaacccatgggacagatcaccaccaccgcatgcatatttagcaaataaaattattgtggaccaattgagttaacaaatgaacagctttttaatgtacaaaatggggaccttttggcactgcctttttggcacaaaaaatcgttttggtcaaccattcaaaactccgatcattgaaaaaaaaaatctcgggaaatttttttgtcttgatcagcactaccggaagcgcctttccatgtttagggcgttgaggcccaacagggcgaaggaaatgtgggcaaagggggaaacggcgccggagggaccgacaaaaagggcagcagaaagaggcgccacggtgatcagacgacgcattagagacggataaattacttcagtatctctgtccatttatttaattttcttcgctaattaatccgtattttttttaccatttttttattgtttttttaaattgttttcccatttttgatggcatcaaaaattgttccaattgccgtttcgccctctttcaactttctgcgccgtccgttgccttcgttggtctttcgtcgttctcttttcaagccgccattggacgcgccgttctgtggcattaaacacggcgatggcaacggtcgaaagggcggcggacgcgcgggcaattgatgacaccgtttttagaagaattcccaatggattggcttaataaattgggatgatcatttcgcgtcgattagtgttaattgtctgctaatggtgtcatcatttcattcgcaccaaatgactaattatttttttggcatttccccccattcccccatatttttccatttgttattcattcctttttgttttttcctcgtccgttgtgaaaaaattgatcggaccaaaatgaagtcaaatggccggccggccacccatcactttcattcattcattcgttcgttattcattccctcatttttcattgggatgaacaaaataaaatctgtaaatggttgtcaaatatttgtaaaatttaaccaaaaaaaaattattttcattcaaattccaatttttacggtaaaatgaaaaagattattttaaaatgccaatcccggcgggagtgtcgactttgcttttgcacgagaaaactttcgggtttttttgggttttcggtctcgagaaattgggggttttgggcctaacaaataagaaaatgagaataaatggcttctgtatagagggtgatccgcagtttgacaaattaatttgcgagctgatcaaaggatgagtgatcaattagttaagccgatattttcattttaaatttaattttgagcgattttctccaaagtccgccgccgaaagtgcccacaatgaagaagctcttcagcgaggtgttcatcatcgcactgctccaactgctgctaatgatggccaactttggccatggcgcagaaaacggcgcgtcaaaaattgaaaatatttaaaataattaaatataaatttacaaattaagcgacgcaaggaaaagctgaaaaggaagaaaagccgaagaacgacactgtggaggagaagggagtggtgtgcttcacggaaggggacactatgaaatggggtcggcatttgggaactctccccacgcataaaattttatttgcatcgggattagcgggattggcacgaaaaagctcgagaattgagcaaagatccgggagcggaccgaaaaagtcagagaaatggcccaacaggggtcgagatctgaattgacattcgagatttagccaaatcggaaggccgggagacttaattggcgagtttttattggtcgagattcttcttagcaaaatacagtagtaaacgtcagactaatcgaattttgaccctagcaaagagaacaaacaaatggccaatgctttaaatgctttcaaattatacaggaagatgccctccgggcacggaatgcatggaatcgaaatgctttaacggtaagcaaatatctcactgggtttaaaaagtgttaattagccctaattgcaattaattaggcattggctacgaagtaacgaagggctgtaccacgaatgggaaccgcacgtgcgaaatggagaaaacgaagtgcgaagcggcggccaagggaggcaaaggcagacacgagaaatgcgcagtttgcgcaacgcatttctgcaacgataaaatcagaaaaggaggtgaaagagagagaaagagagagagcacaccgatcagagcagacagttagagcaagaaaaacaacaaaaaatgcatatttgatcactcactgatcaggcggaattgccgaaattgggtgatcattttgaaatgagacgagtctgatcaatagttaatgatgtgattgaactattttatgccaacgaatttcgttaaaacttaggcttcttcggctgatcaggcataggccacgtcttcggctttagatggcttcgacttcgccttatactatgactatggcttaggcttatgccaggctcaggctaggctaaggcctaggcttaagctaaggttttggcttaggctaagccctaggcttaagctaaggttttggcttaggcttaggcttatgccatgaccaaggctttggtttgtaagtcgtgtcggtcgaccccgtgggcgcttatcacgtatgctttcagataaactgaaatgctacgaagagcagttggtcagctacaactacgacgattcttccctgcgcacctgcttcggcgaccagtgcacctcactgttgtgcatttacggtgtgtaccatagagagtgtgtcggaatgccggtttccgattgccgacatttttttagcttttggaatgccgtttctgataggcacaaatccttagcatgaaccccgcctccctccatgggatgggttggaaaatgggggcctttctctttctttgtccgagcctcgagagtcgagaatttacattttccaactttgtatcggccccggaacaagtgttgctttcccggttgcaattagcggatgcaattattgctaattaagtgcgcgccaacaacaacaccgccttcaacatcacgcgcacctgtgccacgggcggaaatccgtcgtgcgaatggatcgccggcgaatgtgtggggcagcggtggcaaccgtccagtgcagccgtgcactgagttcatgtgcaacacatgcacaaccgccgagca

SEQ ID NO: 13197 - DNA, 1110 bp, Heterodera glycines
atttcgtcactacctaacacttcgtctaattcttgggctaattttcaaggaggaagattcgctgatgtgacaatggcaattttgacattttcatttatcgacaagagaatcgccgccacaattgatgcaacataagtcttaccaactcctggtggcgcattttgatagatcaaacaacactcattccctaacaacagtttggccgacactttttgcctctcatttaactttctcatcaacgggtgaaactcttgaactgccggcgcatgacccaaaatctctccctgttcaccaaccagctgttctcgtggacgacccattaatgccgtcatcagctttcggtggagagtttgatggaaaaatgccagaaactgggcagcggggagagaaatgccaaaaattgagggagtgccggtaggaagattacggaaacggaggtgacaaaaattgggcgaactatgcctgaaatctcaaaaaaaaattaaacgaaaatgccgggggcacaaaatgacggaagggattatatgtttgccatttttaagcatgtttcctcgtccgccaaggtcgacattggcactgtgccatcgtcggaaaccacggcggcagtgtctgccaatggtacggtggccactaccggtgccaacggcacatcggcggacaatgcgacggcggaaagttgggtcggcaagggatgtgtgagttaacaaaacgctaattgattgatccgagtttcgcactttggcacagccaacagaagagtcgcttctccaattgtacattaatgcaattagggagataattaactaattgcctccttggcttgtgattagttattgattgccatttccgactgtaatcaattaattaattaatttcctgcccattttcagggcgcatttgacgtcgctgtgccgccattggtgcccattgtggcggccacttttggttagctttttccactaattagccgattataatgattattctaattgtaattaattttaaaggttgttttgcggcgcttcagcaacttttgctgctgtaagaagtgcgacttggggacgaaaaggagcattaaaaaagaaaggattccaaaattgccattttaaa

SEQ ID NO: 13198 - DNA, 2790 bp, Heterodera glycines
  misc_feature (2630)..(2630): n is a, c, g, or t
atttaagaagtgggaccgggtgaaacagcgcattcggtcggcactgtcctcacaaaaactgctcgccgcttccgtgcacatcgaaggcgggatggtcgagggccaaatgctgcagcaaaacaccatggccatttgcgcacacttttgggacacgtcggcccaaagtgcggagtgtgtcgggctcagtttgggccctgtcggttactccaacgacgacattgcggacgcggtcagggaaaggctggcggagatggaactgacgatggaacgcggaaaattcatacgattcactgtggacaagtcgagtagcttctccagctacaacgcgagaccatcatttttgtaaggcacagctcacaccaataagaaaaattcagtcggaaattgctttgtcactctttttaatcagcaacgatccctctgatcagccttccctttccttctgatcagcccttcctttcgctctgatcagccctttcccttccctctgatcagtccctcccttccctctgatcagtcctttccctctgatcagtccttcctatacctctttttgttcagcaatcctttcccattcgtcggtggcggttcatttgcctctgccatggctttgccattcgattggcaattggtcgactgttcgccggaagtgttggaagcgttttttaataacgacgccgaagaggacgacgccggcggagaagaggctgaaattggacttggcgaaggcatcgaagtgaccgtttgcgcagcacggcgattggagacggtgctgaggacagtgctggagagggaccagcaaatggtacagctgcgtaaggtaatgccgacactttgtctcactttggcttcattttccccaattccgcgcgcagcgtttgttccttctgttcggccaattcgccttctcccactccgcttgcaccgctctctctgcgcgcaatggcggcgtttcccttctctttcccgccaatgtccgttggcattcgcttgagcccgcttacgcgcgactgttcactctttgcgacacaattggcgccgtttgcgacgaattcaaaatcgaacgaatttgtgaaagggattggcgaactgtcgaaacggctttggaagtaaatgaaaaagcaattggcactcattcattcatcccatcccttcatcacagatatccgacacttttcacaaatttgtggccaaattggagcagcacggacagccgaccatttctctgctgtttcccggtctcaaccttttgctcagcacttttcaggtgattggtcacttctcattagacttttaaacattttgaaagtccgtttttcttcattttatcataagttcgtcaatttatctttcccccaccccccaattcagcaaaacttttccgcccaaatgccctcactaatcgatgtcttttctgatcaaattcgccgctctttctccgatgttttgagtttcgatcgcaattcgctgtttctttgcgcttcgatgttggacccaaaagtggcttatttgttggtgcaggaacagaagcaggagggcgtaagggcaattcggaaaatggtaagtcaaaaaagtaaaagcaaaaataataataataaataaaatggcatcgagcaacccatcaaaatcaaaacaatgccatcatcactcccctaaataatgccagttccatcttctaccgtggcagtgccgatgacttcccatgacaattattccatctttttccatggcagtgccatcgcccttttccgtgccattcctttccaacttttccaaaatccttttcgcttcttccaattttattcttttaccatttttccgtttaggtagaacataaaatctccgacccatcaacacttctccgcgttcgttcaaacatcgaaaggtttttggacgtcgtcgagtcgccctttggcttcggcactattcgccgggtgcgtgcgccgataattggcacggcaaaagagcaaaacgcaatgggcgaagaaagggatcaaattgacatggaaatcatggagtatttggacattgtacagttggattcgtccgaaagttgcgcacaattttggacaaagcatggacaagtgagaaaggaaagggaaagagagacgataaaggatggagagagaggagagaaatggggagagataaagaaagaagtgagagatgcagaaatggggagagtgaaaagaggagagctgaggaaagagggagaaagattaagggaagagaaagagagagtgaaaagaaaggggaagagagagggggagagaaatagggaagaggagaacgaaagagggtgagaaagagagaatggtgggaggaagtgagaaagggaaaaagaaagaaactgaaagtgaaggaaaagcttggaaaagcatcttttaaacattttgctggccttggtttttcattcgctttgcttccctttcagcgctttcctttgctctccgaaacggcaaagtccgttttggccgttccggcgaccgctgcgacggcgaagcgattgctaaggcaaatttgggaaggcgttgagagggacgcggaggtgggcgtgcggaaagcgcttctccgcttcaatcgccgcttcgtcgacctcgcggaatgaatccctatttgaagcacctccntccattgatatttttgactcattctctcccactttgtttttgttttttcttacaaaccattacaatccatttaaaattgctagaataaattttatcaatttgtgccattttccccataaattcctttttttcttttgttttttatccaatcggatttttc

SEQ ID NO: 13199 - DNA, 737 bp, Heterodera glycines
gttgcacaccggacagtcgtccttgttacagttcttccaatgcgcaatgatttgccgggaggaggcgcagtgcgcgtactgacactgccggccggccgaacagccgaccatatgctccaaaacgcccttcatcaccgagcagtagggcaatgtgcagggcgcacggttttgtagcggttcagactaaaaaaagagatttacggggaaataataaccaattgtaaaaatgaaatcccatggaaattgaaccaccgacccgttcgatctgctgacacgtgcgtgcgtgcagcagcagcaccaactgttgttggatcaacttgcgcgtcttcgggtcctgtggctgtccggcgcagcctagcatttgctgctgtggatgattgccagccgtttgttgctgctgcgcaatgccacccccgcgcatttgcggtggtcctccactgtttgcattgttcatcgattgctgctgttaaaatgagaaagagaataaaagctgataaaattttaagtgcataattttatgcattaagcgtttaggcgacacgaaacggcgcctaaacggtcgtaaataggatattttcatccatggaatttgaatgttaaagttttaatgaaaatggttgtgttcaaaggtcacatcggtgaggaaatgatgagtcattattattcattttccccatttcttcacatcattaagaaaaggaacaaatattacttttaccgtttaattttcttttagt

SEQ ID NO: 13200 - DNA, 2233 bp, Heterodera glycines
  misc_feature (2194)..(2194): n is a, c, g, or t
  misc_feature (2215)..(2216): n is a, c, g, or t
tcataaaaatttattctctggggtttttggggtccccgatcacgaatccttcaattattttgatcaattccgatttcctaatctaaatttgaacaaaaaatcataatttgaaaaattcaaaatttcgatttttattcgagttcgggttagggattagaaattagtcaaaatacatgtcagattcgtgattagcgacctttaaaaccccggataaaaaattttatggttttttatcttaaaaaaattttgcaaaacaaaagggtccccccttttgtttcaaaaactgtcactttccatatacctagtgccgactttttcctgttgtattttccacttttttgatcaaaacaaatttctgcttcttcttctttactgtttgttatgagtgcgttggacaatcgtatgttttaacttttttaaagaattgtttatttgctttttttaaccaaaatttgagttcgttaatctcccttattaacacgtgaatgcttaattcaattccaaatttttaagaccttttcaatttgcgcttcgcctccaaagaattgagcagaaatgccaaaaaatgtgacaagcaggaaaaggaggaaaaggtgaagctgaccaatgcgctgaaggtttgctttttgatttgcgtttggtcagattttgttaaagtctccgacaaatttctaaattttgtattttttcattttggggtgtcgtctttaatgccaatgcattttttcgcagaaaggcaatcgcgaggtggcgcaagtgcacgcggagaattccattcggaagaaaaacgaggcgctcaattatttgcggatgagtgcgcgcattgacgcggtggcggcacgcgtgcagacggacgcgacacaaaagcgggtgtccagcagcatgcaggggggtaagacggggagagggggcggggaaggaaaatggaaaaagagggggggacggaaatgggatgaaatgcgtacagaattcggcctatcaccaaagacatgccaactttctcatatttgacggactttgtgctgctgtttacactgctatatctgagatggaataaataaatgaatgaaactggtttttgggacttcacaaaagaaaatggggagggtaacccgaaaactgactaattcatcgttgcctctccttttccccattttggaaaactaaggaattggctaactggcggaaacgcatcggagaaacaaaaaaagggacggagtaaacatttttgtttagcattttttgcactttaattttattttttcatctgcacttttcagttgttaaagcgatggagtcggcaatgaaatccatgaacttggagaaagtgcagaatctgatggaccgattcgagaaggactttgaggaccttggttggtccattctcgttaattgaattgtgttcatcttcacaaagcacttttttgcagatgtccaatcggcgacgatggagggatcggtgagtgggcagagagtaattcattcaaacacaaataatggagtttttataaatacatgaagtcgcgaatttccttaaactaacccaaattccttcaaaattccacatttataaaaacgtttcattttttggccccccctttgcctgttcatgttccctttgaggagatgttttgatttattgcttaaaatccatctttgccatcttacagatgaatgccaccaccacactgaacgcaccgcgaagcgaagttgacgcactgattcaggaagcggcggacaaagccgggctcgaactcggtgagaaaacacacatacttttaaatataaaaccttgtttgattttaatttttattaattgatgaattggaaaacaaacaattaaaatcggaactctcaccgaatgcacactttaaaaatttgtcatttttctcgttttcctttttaggcatggaaatgccggcggcgcaaactggccaattggacacggtcagctcaaaggcatccgttgcggacaacgacgacctgtccaaggtggacaattggagttgttagaaagacaaataacaaaaattttgcccatttattatctctttgttgtaattttcaaaatttcagcgtttggccgccctgaggcaaacttaacaagcgaatggaccgacagaatgacgccatttgctaaatcattatgagtgatgatgattcttattttatgtatatcaattcatttctacantttgggtattaataaatgcgnnaagttgtccaatccccc

SEQ ID NO: 13201 - DNA, 3248 bp, Heterodera glycines
aaacggtaatagtgcagtttgccccccccccatttttcgaaaaaattaaaatttttaaaaagtcgtgtaaaccgcttttccttgtggttttcagggcgctgatcacgaatctgacattcattttgaccaatttcgaatccgggacccgaattcgaacaaaaagtcgaaaattcaaatttttcaaaatttacttttgtggtagaatttatacaaaatgacatttcctggtgttttaatgatttgtgactaattttagcttgttttaatcaattttcgagcaaaagtgtgaattttgaaaaatttgaattttcgactttttgtttcgaatttggttccgggattcaaaattggtcaaaatgaatgtcagattcgtgatcagcgccccagaaaaccacaaggaaaagcggtttacacgactttttaaaaatttttattttttcgaaaaatgtgggggacaaactgcactattaccgtttattcttgaccacttttcactgtgaatttaagtttctgatatttgtccaaaaaatccaatttcagctgacttatggtgaagcaacaggaacgcatatcttttcccttctcagttgactcaaagcgttttttacttttgcccaccgattttgtggatgaaaaaagcaaatttttcaaccgtcagtttctcaccatttatcgggcacggattaattgtcttaaagacttaattaaaaaaaatgcgcgaaatattcttggtatgtgttgtctttttgttattctcatcaattatttaaaattaagcttctacctccaataattctgttcaaatcgatgatttatcaaatttttctgccggcaatgatattttgctgatcggtgttgttttcaagaaaatgaaattccgtcaaagcattctttacgagttttcggatgattcgaatgttcccattaaaatggggagaaaagcgggcgacaacctttgcgatgacgaggacatactccaattggaggacgaccagcaggtaaatgaggaatgttctctccgtttaaataagttccctattttattgtcaaaaaccattccccaataaaaatccttgtccttaagactgttaaattgcttggaaacattgacaaacattgttttgtcactggcgatgtcattggagtgatcggctgtcaggaggatgtatcagacaattttgaagtgcgaaggattatttacccggaaatgagccctcaattggaatggcctttggttgagcatgattggtgatgatgtttcaaggttttttcattaacaattccccttgttatgtttagttatattgtttttatgtccggcatttcattagttggcaattttgacaacgatgtccaaacgttttcggcactgatgcagtttcagcggtggataaacggggaggtggaggtgtcaaaggacggcactgatttgagtgatgagggcgaggacgagtcggacactttgcgcaacatcgccagacttgtcattgctggtgattttgcgcgttttgcacagaatgtgcggtgtttacgaataattacaatattcccagaaaatttcacaggacattgaaactcagcgagtttcgatgattggcgccgaacttgactcggacatggactctttttcgcaatttgacaaatttttggccactcttttggtaataattcttctctagcattttaaaattaaaaggtttagcaaaatttgagagttgacttaatgccaggagccagtgatcccgtccagtgcatgatcccccaacagccaattccccccgcggtgttcactttggcggcgccgttccaaccaatgcttaacacagtgaccaatccctacagtttcgagctcaacggagtccgttttttggggacatcaggtaatttggcaaataccttcacaaaccatttttaaaataaaggtcaaaacatcaatgatttgcggcggttgacacgcggaaaggacacattagcattgatggaacgcacgttggaaatgggctatattttcccgacagtccccgacactcttcccggatttcctttttctggacgcgacccgcttgttttggaccaaattccgcacatttatttcgtcgggaatcagccaacctttgaaaaacgaatcgttgaatttggcggaaaaccaacgaaaaggtagccaatgaagcaccaatcattttcatgtttaatggtcaatttaagatgttgccttttggctgttcctaagttttgcaagacaaaatcagttattctgctgaatttacggactcttgaatccaatgaatactgttttggtgcaaatttcaatgaatcgggtcaatagaagttcgagaagggtcatttgatctcaattttatgtttgcatttatttaaaaacgattggccaattactccaaacgtgactttcattgataaacacataaaattgcattattattattattaataataacgacatggattttccatttattatattttcattttcaaaaatgactgattttatcaactttatttttcagtcagaaaatgccatttgttaagtttaagcccggaaagcagtttggtcgctacaacaccaggctgttcaaggagattgtcaagagcaagaacaaagagccaattcctcgcatagttcccactgattcaatagaatcgatgggatttgacgtgttggacccacaggatgcggggtttctccaaaaaatggctggtggtccaaaacagccgaattttcaattgccgccgcatttgcgaaaaccggaaaaaatggttattttggttgaaaatttattaggagcgtttggctggttcttgataattaattatgttttgttagctccgagtgtttgactattagttgtaagtccttttcttttcaggagcatccgttgttcaaatcggaggaatgtttcgccttcgagggcattaccggaatgactgatgggattgacgaggcttgtgctcttatccgggcgacgaaggcacagcccgtgccggaccgtgtttggaattcgcttcctcgggattttttaccggctgatttcgagcatagcgttgaggatgctatttgggcaggcgaacgttttgacccgacattggagaaattgccgaggaaattcgaccccattcttttttggatcaaatacaaaatgtgttatggaacgccagtgacaaaaagatggttggtcaattcattaatggacacactcactcgttcagttggaagacctcaggcatcaagc

SEQ ID NO: 13202 - DNA, 2973 bp, Heterodera glycines
  misc_feature (10)..(10): n is a, c, g, or t
  misc_feature (23)..(25): n is a, c, g, or t
  misc_feature (50)..(50): n is a, c, g, or t
  misc_feature (2949)..(2949): n is a, c, g, or t
tcattatganaatgtcacaagcnnnaccggtgatcatcacatcacgtgcnaagtttccatcattaaacagatcaaaacagataaagcagccatagaacacagaaacaattgtaaccattaacaaatacaaacgaattttgcatttgttatgcctataaattataattgaataaactaattaaggataatacagtacatttcaccaaaaattaatacgatcagtcggtcaataccggtgaaaagcatcgcagtgtaaatagcacctaacaaattatttaataattataaaaattcatacatatataaataaattaccaaaaccaaatgcagggataaatacaatctttgtgggtaaacgaaaatcaattaaattttgtccagaaaatgcgatgtaaacaaacaaaaaatgaccagattggtgaataatttcaaaaaaggagcaaagtgccaaaaggtaattaatggtgccattgagtgacctaaaataataaaaataattaattaaaattatatttgactactttgtcttgatggtgacataaatgactgaaaaattaagggcaattcccaatgtggcgatgatacccaatatggcagcacagctgatcaatttccatttggagtttcatttgcgaattccaaaaagaacttaaattcatttaaaaatagtaattatataaattagtttgttaattaccgttaaattgtttatatcagacattatttcaacagttttagtaataacaaacaattaacagaaaattaatatttggttgggttacaacttttcttccctttatttccaaaattttctcaatgggcttggggcttcgttttccaatttggggtgtgatttaagagtgccaaagtgaagagtgggcgaatggcaccatactttataattttttgttttgttttgtttaaagtgttgtgaacaattgagcccatgacaactatggcgtgataaactcataaacttgttgaattgttcacacgaaatattttcagacattttctcgttatatgttgaaccggattttagaattttggtcgagttcgtgttagggaataaaaattggtcaaaatagttgtctgattcgtgatcagggagggacccccaaaatcatcggagtcgggaaacagttttcacaaattcaacaaaagaatccctcccccctatggcttttgataaaattcaaaaactatcactttagtaaaagcgccgtaatttttcatttaataacaaattaaccaataaccattgtaaaaatatcgattcaataatgtataggcaaatctgtggttaaacattgataaaatcatatttattttttaaattatttaattttcttatttatttagcaaaaaaaaaactaaaatagaaacattcaaccagtcaaaatttttaaaattaaatttcgccttcaatttttgaaataatccagtcaattttttaaaaagattttgctgacaatgacaaccgcgaatttttcagattggattgatcttcagctttttcattgaaaattcattgccctttattttattaataatttttggctttttatcacaaattaaatgatttgatttagcaaatttaaacattaaaaattcttttttactgatggcaattaaaattttattttcttttgtgatatttttcattttgtctgaacaaatttgtggcgtaaatccgcgtcagtcaaaaggaaaaagcaaatccttgaataaagttgaccaaacagaagaagaaggtaatgttattcggcatttaaaaaatttttaaaatttaatatttcactcatggataaaaaaaaatctaataatgctaaatatttttgaaaaaaatgaaattcatccgggatttagaggttgctgatcacacgaatctgacatctaattcgaggtcatggaccccaaaaaacccagggaataaattttcatgactatatattaaaaaattttgcaaaccaaaagggtcccccttattgtttttaatttttgataaaattcaaaaatggtgactttgcatatagcgcctaaaaatattataatgtattcctcagatcaaagcaatgtgcctgatgactgtatgaaatgcccgatttgtattgagaatgtaaactatgatcagctctgtttctgtgatcagataatggcggaaagaatttttggaagcaattcaaataatcaacaaaaaggcacgacaaataaaattattaattcaattttaaatataaatttaaagagtcccacgccttctgcattgaatgcctccggaaatacacagaagcggcacatgaagaaatgccattcgcacgcggtggtttaggactgaagtgtatggcactgaattgcggaaaccctctctcttggcgtttcgtctatctatttttaaatatattttgaataaaattaatttaatttaagaagaaataaagtaccggctcccggatcagctcaactcaattcaagcattggaaaatcattgtgcagaattctgtgtgttgtcagtggaaggtctatgcttggttaagtaagaaattttatttttaattaattatataattaataaacattaatttatctgattgtccattaagatgccctaattgtgattgtgccattgggatagaaacatcggacactgataatggcacaaattctgcaattctaaagttccaatgtcccaaatgtcaattcgaaatgtgccgcaaatgcaaagcgaaatgagatgaacagcacaaagatttaacttgtgaacagttcgacaaactgaaaaattacaaggatgacgaaatattgtaattattgcgaataaatgctaatatagtaattaaaaatggggtgaaaaaaattaaaaaaagttttcaaactagttataataatttaaaaataatattaaaatttaacattaatttaaattttattaatttattgaaattattnaattttttttaaattaaatgaact

SEQ ID NO: 13203 - DNA, 935 bp, Heterodera glycines
aaattaatttataaaaatttgttaattaagctgtggaggcacatcggggcggagcaagttattaacgaaatgtccaaagtgcaaaaaatgtcgtaagttttcggatgtaagcaaatcagaagaggaatatgcggaacgaatgcaaagcgtaatttaaaaaaaataaattgaaaaatcgaaaattttcattttcaaaacgaatttttacggggattttgggggataattaaaagctgtgattttatgggccctttttcattttggattattatttaagtgagttttgtaatattcacttttttgcaaaaagcattctttggtataaaattttgtattatttgcaaaatgaaattgctgtcattggttttctttaaaaatttttaaataaatatttacaaaaataaaaagtttcatgctaatattgtataaataatttccgcattttaataagtttattatattattatggacaaaatgaattttgatgtcattattttacttaaaattttttaaataaatatttaaaaataaaaagttttatattaatattaaataaataatttccgcattttactgaatttatattcttaatttatttcggtaggttcaagtatactctaatagcatatatattttaataaagtttcaccaacttttaagaaaattataacaaaaataataaatgtcgaaaatatattttggcaaaagatttgtagaaaaacaattcggatcaattaacaccattttttcgcttaattgcaattaattatctcaattagggatcagagtttcccttttttttccaaaaataatttaaaaaagaaaattatttaaaatgctcaagcttcgcacaaattttccaaaacatttgagacacagtgaagtgattttgcacgcattcatatgccctctttttttcattatctctcccattt

SEQ ID NO: 13204 - DNA, 1999 bp, Heterodera glycines
  misc_feature (46)..(46): n is a, c, g, or t
attttgttgctgattttcttatgtattttctctgccctacccggtnctttttgctgaccatgatgggcttgctcatacttaaaattcttcgacaaatcaattttaaaataatatttttgttttctttttgtgttctcacatcatttattaaaaattattttaaattaattaattttagatatgtaccagggatgggccaaattgaaaaataaaaagcgaaatgcgaaaagcgaaatttgcgaaactgaaaaatgcgaaatgaaaaaaaagcgaaatgcgaaaagataaaatatgcgaaaaggcgaaaatgaaagcgaaattttttctacaactttttaatagttaaaagcataaagcaaaaatcatttttaaaaattttattccaaatttaaaaatcaataaaaattagggggtatgattttacaaaatttttagccgtttttcgccaaaaaattactatttttgttattttgttctctatttttcaaaatatggtaaaataggggtccggcagtgccgataggcgccgacggaaaaatttttgaaaatttgattaaaatttgttgacagattttcactaaaaaatgatcaaattttgtgatttttatcattttctaatgagaaataagagttttggggcgccgctgagaacagtttttcatcaaattaccaaattttgcgattttgggccattttctaaaaaaataggagttttgggggcgcggcggtgccgataggcgccgccgggaaaaaaaattggaaattttgatcatttataaacaggttttcactgaaaattagccaatttataggtaaaattttgaaaaattttatgggaatttaatccaattcttaggggtgtaaaagtcgcgtttcgcgccaaaaagcgaaatgcgaaaagcgaaacctaggcacatgcctgattgtacccaagcaataacaaattttttaagcttttgttgtttctaaacaaatttctaaaaaatttaggtccattaatgcagagctgaatttcctcgccctgaattttcttgggttttgttcagaaaatccagattaaagacggaattcctgtccccaggtccaggctttttccaaaaactgagcaataatggtttgtattaaaaaaaactcattaaaacatatccctctattaaataacaagttaattttgaatccttgatatgtttctgaaaatccaataaattaatccaataattaatctttaattatatgcctttttgaaattaatctcatccttttttcaaataaatatttctctcatttttctttgttgcggattttcatttgtatttgcccatcacccttctcttcttttactgaccatgatgagcttgttcaacattgagttttagttgtgctgctcattcagaatataatcaaaactaagtttttcatcatattatgtcgacttttaggaattttctttttaattttcatggacagataaattgataccaatgtttttttaatcactcgatcttaatttttattaattggaaattatttaacgctcacaatatttaaaaacaacaacatgggttcatcggttttcctgagttttgtccagaaaatccagaaccagcttaaagatgaatacaggtctccaggtccaggattttttcaaaaaattcagctatcatatttattattgggaaaaaatacttattaaaagttatccctctattaaaatagccactttaattatgaacccttggttcctgaaaattttcaagaaatcatttttaggaaaaaataacatacaattttgcctttgtgaatttaatctcatctttttttcaaataaatatgtctctcatttttcattgttacggattttcttatgtatttgcccttcttccttttctcttcttttgctttccatgatgagtttgttcatcatgttgagttcgttgtgctactcagccggcacatttcattttaaataaaattgggctgttcattagaatgtaattaa

SEQ ID NO: 13205 - DNA, 1250 bp, Heterodera glycines
  misc_feature (1171)..(1172): n is a, c, g, or t
tttgcccctaatttaatatactaattggtcacttttgatgaatccaaagcccacaaaaaaattccaccggaactcctttttgaaatgtgcaaatttgcccccggctcattttgtaaaaaagcactaatcaacaacaattttcttttttaccgcttattacacaaaacaaagcgtgcggatttttggagacgaattgttagtaaataaaataaatgatcaattaattaactgtcataaattaatccctattgataatttgatgtttgttcagaatgaagccgagcgagaagaacatgccttttacacgtatcaagagcgaaattaccatgcacttttaccaagaattccaacccaccggtgcctgggcacaatgttttgtcggctcgacccactggcttaccttgtgcacgaagcagatgatgaacaaatggccgaacggaccatgtacatttcgcttcgtgtcggaacagttgcgcaagtattatattattaatgtgtttggtgccgagggcctttaccgggccgcctgggcattggctctgtaaactctaaaaaaaaccgatgccacgatgtttagcgaaactgattttatcgggcggcctgggccaggcaaatttgtctaaatccgctcgagccggttaaccaaaaataatacctaatttaatacaaaattaccaacaattaatgattaatataagcatctaattttgccctgatctgtttgttacagagattggtcttacaaaatcactttcaaaaccaagaagaccaaatacaggaggcgttaaatctggtagcatttacttttatggaactcccagctcaggaaggagttgtaagaaatttaatttaatttacattttaatttaattaatcaaattatgtaaaattttttaatatttaaaatagttttgaatttattgtttggtttaaatacaaggtatgggaccttgctgaggtcaactttaatgaggatttaatggcttaattttggacgccgttgatgaattatttgcatgaaacccttgttgaggtgtgttttaaatataaataaaaaattaattggaaaaagtgtttttaattttgaagaaacaattttaattgattattattttttatttagaaatttttaattttgaaaaattttttgagaatataattccatgtatannatctttttttaagtaagtaataatttttgattattttaaggaaaaatttcaaagatttagcaaatgattgtcataatt

SEQ ID NO: 13206 - DNA, 1209 bp, Heterodera glycines
attggtgttataaaattttggaaggtgcgaatacggacttttatgaacaaaaacttcaattttatgaataataagaatatctaaaaatatgaaacataaataaaattgatcaaatatggacaaaattaaaaaaaattgattttaaatcttttaaaaattaaaaaatgtattaaaaaatttatttttagtgtcttaaattgttaacatgagaaaaaattttgttccgtactttccgtactattttttacaatgcaccatcgggcattattaggaggaaatacaaatgtaaaccaacctttcttattgagaaaaatattttcaaccaaatatatttaaatagaatttgaacataaaaaaactttaacagtgttcaattttgggtttccttgaaatttttaataataatatcgaaatatagatgatatattgaaaaatatgaaataaaaatgcattctagaagcttaaaaaataaaattaaaatagtatttatttggttttagggtaaaataatatgttaaaaataatgaaatcctgataattgtgattaagaccaaattagccctggaaaacagtgccgaaaaggacattggcattgtcatcaacgataaatgaaaagaaaggacgatcagagcgattaagtgaaccaatggacaatgaatggataagtcggcagctatcataataatgccagtggcagcggccacttcggtgccctgctcactgacctaagcaagcagaatgactttgatttaagcaacaactgatgctgatcagctagctgaccatgatcacagtgatcagtcagacacataaggggaaatgaaaatggatgagagagaaacaaaaagtcaattaccacaattaaagaaagtgaaagaaaggataactgtggaatagccccaataaaataaaaaaaaattaaaaaaaaaaataattttaaaaatgcgcgcacttccttttctaaatattacgctaattttaataaaattttttcatttttgaaaagaataacaaaaatggtccaaaaatttgtcttttatggcaaaaaaatgtccttaaaaaagtccaaaaaaaccaatttttttttttcccccaaattttttttatttttaaaattaaaaccaaaaaaaaaaaaaaaaacctcccaaatcccctaaaaaaaaaatcccccaaaaacacctttttttttttttaaaaaaatttgaaaaa

SEQ ID NO: 13207 - DNA, 903 bp, Heterodera glycines
acataaaaataatccccaagaacactttttttttctagaaaatttgaaaaggaattttatcggcaaagaaaaaatattcaacaaaattaaatggcaaataatttagagcacaaaaaaagattgttatggttattagccgcgaaaggtcacgccaaacagtggcacttcgccataattattggacatcagaaaaatggcaaacggatggtcagcggagaagacgggcgcagggggcggcatggatttaaattgaattgtgaggtaagtggccgccgccgcttcggtgccctcctcattaacctaattagggaggcggcacaatgagaaaaatgaatggttcaaaaaagaaaaagacaaaagtggacaggggaaacgaagcacaagttgaagcataagagatggaaaaacagagccctaatggaatcactagccgttgctcgccggcgtttttcttcaaaataaattgtaaggccagattcggaaaaatttgcgaattttttccaaaattttcattgagatctttttgagttatagaaaaaagcatgtttcagtaccagtgagcctgttcgggttctataaataaatcatcaatgctaggagttctagcttcttacttttatttgtgggtattattttacgagaagaaataccaaatttctgcgcccgattttcgaaatacctacttttggggttgacaccgagaaaacctattctgggtttcagcttttttccgctgaagaatttttttggataatttataaaaaagttttttaatttttgactatttttacccaatttaggccaccaaaacgggattttaatatatatttttttgccatttaagcacttaaaaaacccagcactgaaaatcacatacatatgtattattgcaatgattgctaa

SEQ ID NO: 13208 - DNA, 2415 bp, Heterodera glycines
agggacggaatttggcattcaaatgcctactaattcgaaacccgacttcataagggtttgaaataaaatttttgaatcaacagaaattcagaggcttaaaagattcactcgtacgcaacggaaatgccttttaatacatgggaagatttgaaaaatgggcatgcaacgcaatcaaagtgccaaaaacgaaaaatgagtctcttcaattgactcccaccattaatgccaaaaacagttcatttgcaaatgcatttttgcaaaatgattaagtgcaagtgaatgccgtgctgcacaaaagtaaaaaataaaccaccgcacctcaatgaacgccttctgcaccacttcgctgattttcaacggcccattggcaatgccctcaaaattggcactgtcggagaaagcggtggccatgcccatgttggccaacggtttgttcaattggtgcgtggactccaacttgaacttgggcaacaccacctgagaattggggaggaggggacaatgggcgaaaggaaggaaaagcaactaaggtcattcgagagtctcgagaacgaatccaaaaagggatttgctaatcgggaaacgaaaccccttccgaatattattggcacaataaataagtaacctgcacttcgcgttttccccgctttttggtcagttccagcaactttttgccgtccaattcggccaacagtttggccaacccgaagcgttccttgggcagcatcacgaacatgaacacattttcgccctggtaaggcatgccgagcagttgaagctgtacacacattcagaaaaacgaagtataaaaggatgtgtgagaaaatatgcgacctgatcgtcctcaaaatagatgaaatcgtccttcttgtgcatcatgtccagctaaatggggaaaaggtaagtaaagcgaccgtttaacggaattcatatttttaatttaggtatttgaattaattctttaacgaatcgcttataagtaaaccattttaattgttaaaataattaaatctaatgggaaaaaaaattaaataattctttcattaaattatttgctaaaatagaaattaaaacaaaatttaaataaatgtttgtgattcattcacctctttgctgttcttttcgtccacataaaatgttctctttttggtgaatttcgagtcgaatttgtccgcccaattgcccttgaaatagacagcgttgatcagcaccaaactgaagaaattcggaaacatttatttatcaatttaatttctgataatcaaattcggttaaattatccattgtttattttgaatggaaccgcgtcagttcgcccagagagtcggacgagatcagatcatggatcttctcgtgggtcgcttcttccacaaatgtgttgattttctgatgaggatgcaaaatgtagcaaaaaaaaacaatttaattattcccattcacatttagcaaaatttgaacaagatttaagtgccaaagaaagcgagagtatccttttcaccgagccaatgttagaattttagtttggggttgaattattagtgtggatggcactttttcttcccgacaatttccaaattggcatatgccaacaatttctcctccgccccgccaccttcgctgcccccacactgtccgcaaaatcaaccgcctcgaactgtcccccgtaatgctccgcaatttgcgctttgaacgtgtccagcacttcgaagccgtccttcacgtaaactttgttagccacctccaatgtgtaattgttctgcccatttttgatggcgttgagcaaagctccaaaatatttgtgcacttccgcctcgggcgcgcctaaacgcaacggggatggaggtcattaagaatggggtggggtcattaagagtatgtcgctcaattatcattcataaatagaggacaaaatatctgcccgtgacatttttaaagacactgatcaaaaaaataatcgtttagaaaaacactgatgaaaaaaacgaaaaaatgataagggatttcgttggcactttcccttggttcattagtgtcttctaattaatgtgtttatcattttcacacattttggacacggagtgttgttaagcggcacgattaggaagtagaacattaagccaaaaactcggctacttcgccttccatgctatttccatctaaggaataaaggagagctttggttatcataatttggtaaatcatcaactaattggcatcatttcgtgatcagtgcccttggaaatttcattaaaacatttttagacccataattattaataataggtggtattaataattaatataaatttacaaaagaaatggtattaataattaataaaaatttacaaagaaatctctcttttttttaacttttcaccttttgccagcagttggcccatttctttgcccgtcttt

SEQ ID NO: 13209 - DNA, 1524 bp, Heterodera glycines
aaaaatcctcaaagtttcccaaaaaaaccacaaaaaacctcaaagcctcattttgacaaattttagcctcacagcccccccccccccccggggcatttgtgtgaccgcttttgctcagcttcgcttctcccctatgccatcttcctttctgtggtgccgtaggctgtgctgtgtgccctctccgtccggcggggcacggcaattttttgtgcttcgagtgccatcccccgtcccctcccctttctcagggggttgtcctcctctcccgtctcatctctcccccattttttttggtctcgttattgccctttgtgctttcctcactggtttgtttcgctcaacacttagtttttttttagttttcggcatggcacaaatttatgggggggggggggggaggaagcccgggaagtataaccctgaacacgagaattgccggttttttcgaatttgccgaacactacccaatatacgagcagcatcgacgggagtcttggaacgcgactctcgggagtgaattaattgctcggttctcgagtctcgaatttgcttcagctcttgagtagacgacctgtttgctatactgccctccccccgcccctcccccctccctctttttttggcatttttcgatggatttccccccgccaagtggcacaaatgacaaattggattaggtactttactttgcccgacctactttttcttgtgcgtctgcgtcttcccgaatttaatttgcccggctttcacgggccgccgtcatcgcttctcaaaaaaaacatatttttttcagtattggcattttgtttccttgtcagaaattcttttccaactttttttttacaaattcacaaataaattggaaaaaaaagaatttatattgttttttaatattttctgattaaaaaaaataaattttatttattttttgaatttgaattatgaaaatgacaaaaacatttttttaaattaaataatattttccttcttttacaaattcacaaataaattgaaaaatgaatgaattcatggggacattggttaattttcaacatattgagttctttttaaacattttctgattttaattttatttattttttgatttgaattaaaaaaaatttcaaaaaaatatattttaaatttaaaatatttttttgtatggcacaaataattatttaacattaaaaaaataaatcattaatatattaactcgaactattctgacagcgctttttctattaaataaaaactaaaggcacatagataataaatttcgtataaaattcagtttttttttcccgtaatttttcccaaaatgccaattttttttcatttatttaaatacatacataataaaatagggaaggggatttatagtttttattaaccactatttttatagttttttatttttaacaactaaaaaactattaaatttttgaaaaacaactattttcacctatttttggcggttttgcccacaattttggttaacaaaaaatggcaataaaaaaggaaaaa

SEQ ID NO: 13210 - DNA, 1773 bp, Heterodera glycines
attgatctgtttgctgcttttgccgctttctgatgttttccagttttttggtgcaacgaaaatgcacttttcccgatggacagcagattgatatcatcgttgcagacgacacagagggcaaattcttcgccttttcggcttttctttatgtgccggaattccttttcgtagctctccaaatagatatttttacgttttgggggcatcttgggcattcacactcaagaaaacgaagtaaaatataatttatttgaaaatcgaattaattaaaaatattcgcttcaataaaaaaataagtaaagttattcaattttgtagatttttatttgcaaatccaaaataagaacgaaatatgcacgtcgagtcaaaaataagataaatcttagaaataaggacattttcattttctaagatccggcccctccaaataaggacaaatcttagaaataaggacacttgggaactctgacataaaatcataaaatatgtaccaaaaattgcaaaatatgcacataaaaagtgaaaaatatgcacttaaatttgttcatgtcgaaggcaaaatttcgaaaattcttcaaattcgttaaaatttaagctaaaaatattgaaaatagttaaatatgctatttaaaataattttagaagaaaaaaatacaaataaaaacgatttattaatagggctcggatttatagttttttcactatttttttcctgagctccccgtagcctgaaatgcacgaaaaacatgttttttcggctgttgttaagctacttttcgagttattagcaactattttatagttttttatttttagcaactaaaaaactataaaattttgaaaacaactatttcaactattttggcgttttgcccaaaatttgttaacaaaaatgcaataaaaaggaaaaacacacccctaaggatcaactttttgaaaattttcaaaaatgcaccacaaagaaatgaaaaatttctcaaaaatgcatctccaaatttatttatttattttcttgacaagaatttctatttaaaaaatttttatctcaatactgatttggcttaatattgttaccttttttttgttttgttaaaattttacgattttacacccctaaatttgaaatttttagcaactatttacccatttttagtaactatttttggggttttttagaaactaaaaactaattattttggcagtttttagcaaccataaatcccatccctaataataaatggatgaatatgcttttcctcatttattttctcatttatccaattttttgtgtccttttggccagagaagcacttcaaaaagcatttacctcccccaattttttccgtttttttcctccgctttttctcccctcaaaaaatgtgtttgctaaacgaacaaatttttttttttttgttcaccctttggcccatctgaaagcagcagcaattttatgaaaacaaaggtcgcccgtcgtcttttttccatttggccccaaaaattcaaacattttttttttgttttttaaaaattctttcaaaaaatgattatttgtatttttttaaattacttattatttcttcacaaaataataatttttaattttttcttacgcattttttccaaattttatttgttgtttttgtttttgtttttttattcttttttcgtttggattttgttgtcttaaaaattttcattttttaaaaattatttaaaaaatgatataaatttaatggatacttatttttgttttattaatttcttctccttttc

SEQ ID NO: 13211 - DNA, 5543 bp, Heterodera glycines
tgaaggacaacaaaagaatggcatttattgacccaagaacaatgattttgagctctgatgcgagactggcaccatgctcagaataccgcaaacagctcatttttttgcgtggttctcttcatgaagttgatcaaattgatgctcaggtcaagcaggtgaatgccaatcgcattgacggtttcagcctaaatctatcattggcaccgacttatgctcgccattcttttcttcatcttgcccttgtgaatgtgtctgactttattggccagttttacgacgccaatttcgcaagagaaagtgaactcacattccaacttaaaagtgaggacacggttataacaaagactctgtctgaacaatgggagcaggtgagtgagtccattcgcagcaaaatgtttgggaattgggaacaaattggcaaaatcgtcctgtctataatgataattattgtttttacagactttttgatccggtttggattaatgattagagatgaatacgttggcagaggaacaacacgacgcatgacttttggtggaaataaaacgcagaaaattgtgaaatctccagcacacctcaacatgatgaatctgaatgcatctgtagaatttggtaacgaaattgagctcagtcccgttaagctcattgaacccgcccaaacccaggcatacaaatttgcaggaaaacgaaagagaccagtaaaaaggactcgcttcagttttcgggcgccaaaagtactcattggacttttagtaatttttcttcccaatgcttttgcaaatcccgatgtgaataatcaaatctcaattcaattcacttctccttcaatgatttatctgcttatcattccatttctgatttttatcactatttcagtactgcttcgctcaaaacggaattcagaccttccaatgctcccaaatctgaatgcaatttctccgcatcacgccgtggtgcagacattgattaactccacacccgtccgctgtttaatggacactggcgcaagtttgactgttgcaccacgatcaattgcggatgaactcaattgtcgaacattttcatctgatctggaggcaatgagtgcctcaggccatgtcattcgcctcaaggaatatgctcaggtgaatttgaacattgctgggtacacagtccgttcattaatttattttgtggatgattccgaatttactgtggcccgggattacagtgtaattgtcggttgggatgtctttgaaaaattgcccccaataaaattcgatcatttaaacgggaaattttttgttgggaacaacgaatccaaattgtgctatcgttcaattcttttactgaacgatttgcgcgtgtcggcagagaaaaacacactcattccggccgactcccaaatattggtcgatgcttcaatcgaatcatccccaaacccaaaaaattcattttgcattgatcgacctgacataagtcttattaagaagggactgtcagtcattaatagtgtctcgcctgcgggccagaaacaaattaaagtggcagtggtcaacccaaccatggaaccaaaatggatttggaaaggaacacatttggcatttgccaatgaattgttatgtgaccgaaatggacttttgaaggaaaatagcacaaaagaaattcttacgttaaattctgaacgaaagaaaatggaaattgacccaacatttgtagttgacttttctaaggcaatggttgaaggcaaagatttggaaaagctgaaggcattaattgaagaattttcagacgtttttagtaagtttaggtatgatcttgggcttttcacagctgctgaacatcacattacaaccacaactgaggaaccaatcgcatctgcgccaagacgaatgccgtacaaatacaaagaggaattgaagaagcacattaatcagcttttagaagccggagtcatggttgagtccgataccccatgggtaaccccaattgtcattgtgcaaaagaaggacggtggaattcgtccctgtttagactttcgcaaacttaacgaagttacagtgcccgacaagtaccctctcccacgccttgacagcatcatggaaagggtcggaaactgtcaattttacagctctctcgacttggccagtggctattttcaaattaaattgagtgaagagacgtcaaggaaatgtggcattataactgaagacaaagtgtaccaaatgattacgatgccatttgggctgaaaaatgcaactgcagcattttcaagggccatggctatcgttttgtctggattggaggatacttccttggcctacgttgatgatgtgcttattttcacgaaaagcccaaacttttcagaacacctgacggcggttaggaaagttttggagcgttttcggctttacaatctgaagcttagcccgaaaaagtgcatttttgcctcaaatgagatgaattttcttggatttgttttaacagctgaaggttttaagccaagcttaagtagaatcgaaattctcaaagaaatgcccgtgcctttaaatgttaaggaagtaaagagagtgctaggacaggcaggcttttacagacggcacattgagaactttgcaatggtcgtagagccattgctgaagcttacgaggcaaggcaataaattcgaatggggcagggaacagcaaaacgctttcgacaaaataaaagaattacttactcaagccccgagtctaatttttccagattacgacaaagcatttcacattttcactgatgcatcatcgactggacaaggaggagttttgatgcaaaaggatgacgtgactggcacattttctgccatttcctattgcagcagaaccctctctgctgctgagaggaaatggccggctgttcaaattgaaatgagtgctataatttatgctttaagagaatttagaacgttcattttcatgtcggacattgaacttcacacagatcacaaacccctagcgtttttgctgaagaaatccgaaaccaatcagcatttggcaaggtggctcattgaattgcaaaactatcaagttaagattgtccacgtggcaggaaaagccaacacattggctgatgcactttctcgtgccgctgaggacaagcccttgtcggaaatatacaatgtggatgaactcgaggacattatcgaatttccggtctgtctcgctttggcagcacattccagggtggtcgcgtacccatttttgcacactttgaccatccgacacgaggatggaaacacttacgaagttaatttgttggaagagcaggcaggagatcctgaagctgcagcctacattgcgtttgtcagagatggggaatttccagctgatttggatgagaaagaaaaagagttatttgctgtaggcactgccaattacaaattaatttcgggaattctttattttgaggacaaggtactccctccgaggatatatgtcccaatttcgttacgtggactcatttttgaatcatttcactcgtctcttttgggtggtggtcatttgaattacaggaaaacaattgccaagtgcaaaaaatatttttggcccaaaatgtactctgacgttttaacttgggtcaaattgtgtgtcacctgccaattgagacacaatccaacacccgcgtaccgggaagagatactcatggtgccagccaacacactttttgccaaagttgggctggacttggccggcccctttccagtcactcaaaaagggaataaacacatttatatatcgtttgttggttcaccaaatacgcgatttctgtcccggtccccgacacaaaagcacaaacaattgcccacacttttcttaccaattgttacttaaaatacgatggttgtgttgaattaatcaccgataatgcttctgcctttacttccgaatttttcagggaattttgctccatgctttacattgacaaaaagtatgcctgtccacattggagtcaaggcaatgcgtcaacttaacgcacctttcggacatttcacaatatcctggccaagtacatttcgaagactcagcctgaattcgatgaatttttggatgcggctaatttctgttataatacgtcagtccatgcttcaacgggtgagactccattttttctaatgttcggacgtgacccaattttttgtgttgatcagatcattgatccgaaagttcgtgatccgatagccatttcggatcgtaatgaatttaaacagaagctggtcgttgccataagacacgcgtggcacgctgcagctgatgaatatgcaaaagctcagcgaaaaatgaaggaacaatatgacagaaaggcaaggccacagcaaatcacaattggtgaccgagtgctgatcagaaactacgacggacgggtaggaacatccaaaaaatttcaattaccatggcgcagaatttttcgtgttatcaaaattgagggcatttatgttactgtgatcagttgcacttcgccaaattcaaacccaaaaagacttcacttaaatcaaattaaaaagtgtttcgaaattttgggccctccctgcactatgccaacacaaccagttgaagagaaaaagtgccttgaaaagacacaaaatgtggaagaagtcagttcggaaaggtccggaatccgaaatgaaatggaccccgaatcccgggaaggcgaaaatttagaggaaatccacgcccgagggccggaaacaagaccagaaattgaagcagatgaggagaaaaatgagcagaaaaaaatagatacggaaccaagaaagtatgaccttaggaaaaggacgagaacttgaaaatatcttgtgaattattagcacagtaaccattaacatcaaaatttatttaacaaaatcaatgaaattattcgagatcgatctcgctaaattgatgaccgaagaggtggccttctttttcgggatggacactcgcccctccgccttctgtttctccctctgagcacggcactgggctgccaacacttcgttgtccgccctcacgcgctttccgctttgctcatatttcaaggcgataacccttggccctagcctcgttttccatggctctttaaaaatttgacttagttgtgaatgagaaaattcatctcacttaattccaccaagacattcctcggtttgcttttcggtgaatttataggcttcccgccctttacagtcacaacgggtgtgttcccccacctctaaatcataaaaattgttgaaaagtcattgtctgaacccattttatacttttgaattgttgggccgcccttgggctacacaactccttcacaaggcaaaccgaagctccaacattaatgccacaatgcagaccaacggtgagcacgacatcaccgggccgcttgatgtggaattcaaacggaatttccgcctggcgcaattgcgcaggggagaaaatgtaactgttgtggccgagcggatttgggcatttgggccaacgatcggtgaacagttcttggcccaattgggaaacctgcgtttcgaacttccccccaatgaagagccacaacttaatttt

SEQ ID NO: 13212 - DNA, 1655 bp, Heterodera glycines
aagaaatttctttttgatgacattgaacctagtaaaaaaaaatagttaattgtggaatatacatataggtacatatacaggcttttttcaaaatgtcgaagctctattaaaaactcaaattactaaataattgccaaacattatgccaacttataaaattaatcaaaatttaaaaaatctgacgaattttccccaaaaatctcaaaaattctcaaaagcctcaaaaatcctcaaaatttctcaaaaagccacaaaaatcctcaaatcctcatttcaaaaaaaaacctcattgacctatcaaaatgaagataaatcctcagatctgagagccctggttataatcgagggtggggttctattcgatggggggttataatcgaggaagtacggtaaattttaaaaaatttagtcaagtatgagcaatgttatggccaaacgtacccaatgaaccgggttttcaaacatttttcgccataacttttttaaaacctaacgaaattttctgaaatttttcaggctaatagaggacacaaagggctatcgaataatagcaagacaataaaaataaaaataatttctaagtaaaattttttaattacaaataaaattattttgatcactaaaaattctgatcaaaacattcttagaaagaacaaattaaagtggtcttgctatcatttgattgcactatgtgtcctctattagcctgaaattcaaaaaatttcgttaggtttaaaaaaagttatggccttcctttggtaattctgaaacacacacaattgaagccaatgtctttgggaataatgaggaggaaggaccaatggaacactttcaagattggcgaaaaatggcacaaaaataccgtatcataacatttatgtccaaaaatataaattaattactcatcagcctatcatgagaaaactaaaaacaacagaagcaagtgccaagagtttataccgaagaaaaagtctgcgaaacaattttaaaaacccgaaaaattaggacagaataaaaaaggaaagagttatcgtttggttggctggttgatcacaacctaaactgaaatttttaaaaatttcccggcggcgcctatcggcaccgccgtaccctcctccaagttcccaaaaagtttttgaaaaaatcgcgctgtaaaaaacgtgtccgccagcccctaaaaatttatttttcagcattttttgatttttggaaattttttaaatttaattgaaattttttgaattttccaaaatcccgcaatcccgcacgggatcccgcaaattttaaatgcggaatttgcgggattaatcccgcgggatcccgtcccgcaaaaaattttgagttccactcccgcagcgggatccgcaaatttgaaatttccggtctctactgatcacttactttgtccctcaactttttcaactcctcgatctctagacacttcttctacatcaattacagaatttttgatacgtacgatgatgatagataatcctgacactatataacaccttataccaactcatcccctctcatctctttgctcgtctaacaaatgacaggcgacgtacgatcgaataaatgtgtatttatgtactgcttgaaaccactgaatacatcggctaacttccctgcggtcgccattcatacctttt

SEQ ID NO: 13213 - DNA, 2526 bp, Heterodera glycines
  misc_feature (75)..(75): n is a, c, g, or t
  misc_feature (83)..(85): n is a, c, g, or t
  misc_feature (105)..(105): n is a, c, g, or t
  misc_feature (2282)..(2282): n is a, c, g, or t
  misc_feature (2388)..(2388): n is a, c, g, or t
  misc_feature (2484)..(2484): n is a, c, g, or t
tgataattagctacttgctttctatcaaattattaaattttttgctcaccaatcccaatttccggcacaagcgcncacacttnnntcatattctttgtgtgcttnttgtacattttctaattctttatccttttcttcttgcttttgtttcaatgctttttccaattctttcaaataatttcggttttcaccgttttttcttctgtgtacgtttgttgaaaaaagaaatcaactaaaaaagcataaaaaaaagtcttttaaatttttttatcggaatttatgtgcgttttttaaattttcattaaatatactcgttttcagagttttttttcttcatctcacctacttcccatggtctaattgagctgaaattttactaacaaataagtgcacttctccataaaaataagtcatggacggtaaaaaacgaaaattgccaaaaaataattggcgtaaaacaaaacgccaacacacgcaaaaacaaagtatatgcacttacactggtaaatgccttttttgtattttttattttgatcagccataacacgcttcattcccaacaaaaatgaacaaatttggtatctaaaaaaagattttgaaaaggagaatctttttctaagtgaattctaagcaatttgtcatctcagaaaaaagttgtgatactttcaaatttttatcacgttataactcaagtcctaaactgctgttttcaccaaaaatgctaaaactattaatttctctattaattctaaatgtccaaagcgattttgtacccttataaccaaaattattagaattttcgaatttatgttttttcatgtgttagagacatgaaaatagtacgccaaaaagagagaaaaagtaatgcattttcatgttttatatatgtcttttgaaaaagtgtataaaacataaaatgactgtattacattatgcagaatttttttctctatcagtatgtaaaatttggtgtggatttaacaagtagaaaaaaagttaaacagaatgaagtaaatgttgttttttacataattaaaatgaagagatagtacgtaaaagtgagagaaataaagataaaaagtaaatgtgacagaacgccaattttttcccataattatccataaaaagatttattgtcgctttttttcttttttaccgtccatgaagcatacaaaaaatcggaatgagtagagaacaaaatcggtttatctcagttgggcccgggcacgtttgggcccagcaagtttttggactataacttttttcttgtcaaccaaatccagtatagatggtatcattcaaaagctatagagtcatctgttagcctgcaaaattttcaaaaaattccatcaatttcggacaaatttatggccaaaagtatatcagaaaaccaggttttcagtctttttcggccataagttttttcaaaattgacggtttttaaaatttttctggctaatagaggactcttatttgttagggctatcgaattataataacaatgttggatttgggtgacttatgtccaaaaatgtggtgggcccaactgagcgagtccgaaataaaataaatatttttatactaaaaatgcttcaaatttggatttcaaaatgataaactcacaaattttgatgacatatattttttgcacttgataaaatgtgaaagaaaccatgctaataaattcctaaatggctggaaaaaattttcgtggaagacgattttaaagattagaaagagcacaaaatttgctacaaatggcctttggataaaatggcgcgtattcttctcagtatggagaaacgaagggtcgtaaaacctcgagaatcccaaaaacaaataacaatttttaccatttttaagagttttatgaatattttgctattaatttaccggtgttcaatgaagtctcattctcctgtaccgtttcacatttgttttcgttcacaaaattgaactaaaataattaatttttgaaaattttatgtattattttttaaaacttgcctcaatataacttatgtcgctgtcttcgttgtcttcaaaatcaacaaacatttccaggaataacaatttgattacttccattgctgagctcaaccgaatttgccgataaccgttaccaaccgaaagttgaaactcgggcttcacttaaaggataaaatggtatttttagaatttataaaaaatgttttgacctggtgaagcggcgttttccgcatgcatttgaccttcttctccccaatttctcacatatctatcaaatgccgttgccatccttnttcaagattcacaacgcgcttctaacaatttaacgtttacgccagtgtaaacctgcatcccactcatcagttttttccatgattcttcgctgcaattccatccctncagcatttggcgcaaaagtacgttttgataagtgccttttgctttgacatgtccttcttctccgccctccgtgtgtcatcatctttcaccgtatcnaatgccgcaattgtgcccacaatgatcagaatgatcaacggc

SEQ ID NO: 13214 - DNA, 1732 bp, Heterodera glycines
  misc_feature (12)..(12): n is a, c, g, or t
cagaatgatcancggcagaataacaaataaatgcaacagaaaatgactcattttctgtatgcaatatgaaaaatctatgcatgttatactatttttaagcataatttatgggctgcgaaaaatgggtaatttttgtgaaaacttttaaaaatggctatcattcaaaaaattataaaaaatccaaaattttgcctaagggcgatcctggggaaatgaatttggctttcttcagagaatggtgccaacataaacatttgtgcctcgattttatgtcgtttttgcacatgtcaaacactttgtacgttctctgatcaatgtgcatctctaataataaatttataaacgattaaaaatcataatatttttctaaactacaaaatatatttgttcaaaataaaatttaattatattataaactacaaaaaaacataatttttaattaaccaaatcaaaatttgtttaatacaaaaacgaaagatgccttcacaaaagtgcattcaaaattttaatttaaattaaaattatcttaaattctttattgaaaattcctaaattaattaaaactttcataatttgtacacacaatttcgcttccttattaatttaatcatctttattcacataatgatcatgtctcatgccaggtcttcttctccaccgcttgatcagtttcatctccatttccgattggctttctcctttttgggaatgtccattttgtgtagtgttcgtccactttgttcaacagtttcggattgtttaaatccgcttcatcgcttgtagtcaatagcaaaagctttttcttctgcttctttttgtccataaaattgctttccgcctgtttctgttcctcttggccatttatttgaccattagcattcccattttggctatttgttgtgccaatgccatcatttccatgccttgttccactatcattaccatcggcaatgttgttgttattgctgtgccattcttcatcaatgccattgccatagtccaaatcatggacacccattttgccatggttttcctcagcttggccttccgtcttgtccaggccaaacatgctcaactcttggcctcggttgccattcatagttcggtcttccccagttggcaagtcgatgccatgctcccactcttggccaccattttgcatatcatactcctcattcccatcttggccatcagcgttgtccaatccgacattaatttttaggtcttggccattgtccttgcccatattctgtccttgattttggtttccaattccgtttttgccctgcttttttgtggcgccattcccatgctcattttcacaaaagccacatgtgtgttggcattggattctgatcagtcgtacatagcgaatttcccagcagaacccattcttcttcaatacaccacaatttgctgaccgatcagcacattcggctgtacgctcgacagagcccgggtcagtgatcagctttgggtccatgccgggccttagctttcgtcgtcccgaaaaaggaatagttaaagaaaattaaaaagttagagaaaaaaaaacattaaaatttatatatatgattatttttaaaaatctaattaattctttaacgaattgacacatttacttttctgtttgcatttgctcaaaatttgaagcttttccacatcgaatttggtgagctcaaaattgtccgtaaagtcgacgccatcctcaacaaataaatgaacaaattta

SEQ ID NO: 13215 - DNA, 985 bp, Heterodera glycines
  misc_feature (907)..(907): n is a, c, g, or t
cttgctgcctgcggtcttttcggggggagggtgggtgaacgaactgctcccggtcgtgaatgtgtcgtcttttttgagttttggcattggaaaatttattacaggagaaagagggtgtaaagaaagggtagatgaatggcatcgcgtacaatggcaattttttatttttccctttctttcaaaaggtggcgacggcacactttggctcattgtgtgcacagattgcgccggaaaggcattgccggccctttgctcgtcgttccgctcgattcgatgatggaggacttcgatgtccatacaacactgcccgcactgatcgcagcattggtccgagcagaatttataaattaaaaaaaaagttaaatcgttgaaaattaaattttattaggaacggaaaaccccaatttttgggttctacgacggggcggagttggcatttcgtaaatatcaatttttcgaaggttccagaaatcatgaaatttaatttttacatttcgttatgggtgtacttcgttccctcccgtcctaatttttttttaatttcaaacttattgttagacatttaaaaaaaactgtttaataaatcactaaaaaatttcaaatgtttttttttgaaactttcttataaaaaatttctaactgaacattttttgatttttcggtggagggacgagctgcttcctttctttacagccttaatttttatacataatgtttctttttctgcagagagtgacgaccaacagcagcagccgtagtaataacgtggtccatctgctgccgccccggccgttggccgaggacacggcactcgtccactcgctggctgagtttgtcaaatatgtgatgctcaacccgcaaaagttttgtctttccacgccgacggatggaccaaagaatgaatganaatgaacattgaattcattagtccaatcattagtgtacacaagttttgtttgtttgttgttttgtgtgtgccttacca

SEQ ID NO: 13216 - DNA, 2852 bp, Heterodera glycines
  misc_feature (150)..(150): n is a, c, g, or t
aaaaaatactttttagttaaagtgttcaaaaaatttatttttttgactataatcttaaaaaaaagtattaaaataaaacaaaattctatatttcttaaatatatatgttaataagaatttttattaattacaaaaatattaattttcctntttcctttgaatttccagatttttttggggttccctccccggacgacttgcccaccagccgagtctaattgcttggcacattgtgtggaaaattcgaagaattttcaggcctcgaagtgggagggaggggggggggagagagcagggctggacgcaatccaaaatttttttttccaaaaattcatttgtttagattaattgtgattgttgtgattagtcgttcaaaatgggcgccacagaaagcgttgaacacagcaaaagcgatctgcagcagctgaagggcgatatattcgtcaatgggaggtgacggaccacgtcatcgttctattggcttaattttacaattaaatatggaaaaattgacccaatttggcatacaaattaatctatcgatgcaatgtgccattaaaaacaaatacaccgagccattttggccccaaaaatggttcccttggccgattgggcacaaaaataaatgcatcaaccaaatttggcataaaaatggataatttgccccaattagcattgaaaatgccccctttttcctcctcctagacctttccccgaccaaatttgccaacgaattgtcgctttggccatgggcggcatgcccccgcgggacattttgcgcaatttgcttgtaagttattgttgaggaggtcaacaaaatattcagacgtgtcagcaggaaatgttccggaataaatattgctttgctgtcatgagaatataacattccgtagcctccttcctcctaataccgtcccagtagaatactgtatctgtgtcatgacaactcgtacaaaagtcgactcatacatattgtacgagttgccattgccgcatttttcggtcacgcccccccccccccccccgatttttattatttttactcatcctgggaatttaattttaatgaaataaattttggatgagttaaggtgtcgagcggatgtgtttctaaaattcttgcaagttgtggcaccatcgatggccggtactgtttacaaggcacaccaatttgtctgatatattgtaaaaatgtcaaacttttttttaaagttccggaccccaaatgctgagtcaagaaatcgtcgagaaaataacggtaccgtttgttgtttgcgcgaaagtgcgcgcttcatcagtgatactgtaaaaacagatattattttaaaaagcatttgaaatgtatggtaagctcacgacagtatgccacttttttatacagtatcactgacgaattttttcggttgcgcaattttgcacaaatttttgccatcgcttatcatttttggttaagattacttttagctgtataaaactgaatacccgtccatttttgcttgggagatcagggaccggctgaagcaggacagtttgtgcacggcggagactttgccaagcgtgggttgccacaacccctcgggggaggacggtagcgccggaccggccattcatttatcgtcattaaaattgttttgttaccgattgtaaaggtgttcaatatttttgtaagcatgaattggtactggaacatacatgtaatccatttacagtatgtttgcatttcttggatttcgtgacttcctgttgtttttgaacgttcaaaaaaacagaattattgaattcaaacaaatttccttaaatttgggtcctttatactacaataagtaatgatacagtatcaaaaaataaatggacaataaaaaaatacttttggtagtgaaaggccggttcttcgcgaaagtaccgtataccctcgtccaactatgctactgtattggttataccattataatgtttaaagatctcgtcaatcaacactgtgcttcgttcccatgcaatattgtgaaagcagcagatgaaaagcaaatttgacgaaatcatgaaagaaaggagagggatgaatcggcaaacaaatgatggagacaattatttgattatttttttttgtttatttaatcgtcgcttgggtggtaaacgccatcataattttcttttacattttgtagcaatcaaatatggtgctctttcattcattttgaaatgaaaaaagaatgattgtttggcgttccgttggcccatcggtttgggccgaaaatgtccggtttttttcttttttgcttccacattagcatgttcgtttcgtatcgagttggctccgcggcaagaaaattagaaaatgactcttcactcataaaaaaccgtttgaatataaagcaaaatcaataaataaaacgagtcaaagagatttttcaattactgtgctctttcgaattttgaatatctaacaaaaggctatatttttccgatggatttgacccccgtcggcccttctgtcgctccgttggctttttcttcgtcttcaaccgatgcttcagccgttgaattgccatatgccgtcccaaactttggcacacccactgaaaaattgttgctgggcggggagctgattgccgtgccaagcgctctgttggccgatgtgtgtgtttactctatcattttttcagtgttttccaatgccaattttcgcaaaatttgccttctccctgcctataattcgactttttgttcatgttttggccgaattttcaggcatagaatgaaaacatgaaaattgttattttggaaaaccattcgcaatttttatacaaaaatcccaaacatcgaattaccttccccaatttctcgactctaga

SEQ ID NO: 13217 - DNA, 3809 bp, Heterodera glycines
  misc_feature (180)..(180): n is a, c, g, or t
  misc_feature (189)..(189): n is a, c, g, or t
  misc_feature (191)..(191): n is a, c, g, or t
  misc_feature (1769)..(1769): n is a, c, g, or t
  misc_feature (3766)..(3766): n is a, c, g, or t
caaaatgtcgtggttcggaggcagttttggtgtatttgtgcatcacatgttcatccatgagaacagaagcacgaaacagaggagaggcaccgggggcacacaaaacaccaacccgaccacatgctcagcagccttttggaaccaatgggcgattgcgtactcgaacttttggtaccaaanccatggaancnctgggaatggtaagaaattcaccatttatgggaaggatagcacaccttctcccaatcggatggattcttccgcacgcacagccaacgtcgcttttcaagttcatcagatgtaaaagacgaatcactgccgctggttcgaatttggaatcgccatcaatggcgagaatatatgtgttgtcagcctaagcatcggtgcgaacattgaattattgcacagattccacgagggcaaaatttaggctcaaaagacctgcaattgtttgtcttctacgctcaaatgtgagtccataattcgatgcccgagcaaaaagtacatgtacatcacttgcgaccaacgctttttgtgtcggatcaaacgtttgtctttgagatgcacaaaaagaagtgagcccccattcaacgccagcacaagtcgacctccgtacggagtgttcagaagaatacggctgtacatgtccgcttcagcgttgtcggaacttgacaagacaaagcaaaaataccacggaaccaattgactaattaaataaaaccgagtcaattccatcagaacttcgaacaacagcttgaagtactcattcggaatgcgaccacattctttgtcatcagtccacgagtcatcgaagaaaatatgaactgaacaaatcacggaaagtttcaatttttgtagaaattaactggaaaatataaatcttaggtcaaaaaaaaggtgagaaaaatgcaattggggcgagcttgtcaattttaataaagaccttccaagcggaatttggttccttcaagggtatttttctccgacaaacgaatggcatgttcctcatcaagtctaaaaaatggcgaaaatttgacgaaaaaatgtcaaactttagaatggatttgatcatctgtgccatttcgttccgtgtctcgtgccacatcgtcgcacagacatacagtgtaaggattctgtccatttcgccattaaatattcttgaaatgctttcacggtagttgtaatcggagtcacaatcagtttccttgataattaaaattaaaattgcattttgtgatttcagagaacctttttagcgattgagcaacggaaaacaaccagagattggcaaatgtcaagcccactcatcatcggtgacatcgacacaattcttgatcaattaggtaaataaaaagtacagaacgtggaacaaacatttcgtccatctgatcgaagttctcaccacttataaaacgatagctccatttcatatatgagaaaagccaaatcaatgttatgtagaaatcggagaaaacgccttgccgttgcattcctacaaaaatttcattttaaacgcatcgatgacatcaacaaggaccttttacgcaataaatgctcaagtcaaaatgttgaaaaagagcattgattcgacaaataggaacgtaatgacaaaatgtatagaagaagaagaaaagcattggagtcgtgagaaagacggggtgtccaagcggaatgagttcaagtcgcatcgcagccaaaaagcggaagcaaaagcggagataaaagttgagagaaatgacaacaagcgcaagcagaaagataagtcttanagcgaataagcgaccaaaaagacaattttgagtacttagggccttggagcgttcccccgttgagcaacagagaagtcagcgtaccaaatgggatgttgtgattgcaaagggaaaaccccaaaaatcagcgcggcacacaaaaaacggaccacacaagcgcacacgcgcgtctccgcgttcagttttctcagtccatatttgagctgtggttggctaataagctgatgatacgctcgtccttctcacctcgtacaattcctgcaatacgccgcttgtgtgtttcgtgtccacccaactttcccagtgtccaactgcacacatcagaaaggataacggaagcaaaacgccgaaacggaactccaaatgcgcttgagtaagataccacaggtaggcaccagtgaaaagaacagcgaaaataaacgctgaaggaatgctagcgatgatgcgcatgaggcgccatccaatcggacgattggagtcggcagagctatgaaaacagcgaaaaactcggagaagataagaaatgcaatggaaagcagcgccaagcaaaacacagcggggcacgtccaaaagcggaaaaacattcaaagtcaggaaagaaagtccagcggcacgaagagattcaaacagaatgaactgaatgggagtcgtacgcaacacaatcgggcacaaataccatcggaaacagcgaatggtccgaagcagaagttggccgaaatctgacaagtgactggaaaagagcgaataagtccggcaccacttggatgagccaaagagcagcacaaaggcaggaaaagcgttcgaagttttgaattgccaacggcactagaattaaacaaaatagaaaaaacaaatattgaagcattaaactaaccggatgcacaatattcgtacaatttaactccctcgattaaacgatttgcaccgatatttgtagcaagaataacgacgatcgacttggatacgaaggttgcgagcagacaagtgcaatgagcaatcagaaaaatcccgaacttgaaaagatgcctatattttgtgctttttcgtcggattaccttcaaccattgaagccagcgaacataataagagtctgatttctggaaaatcctttttgaacgagcattggacctgaaggcatcccatctatgatcaggttgctggaaattcattggtcgcagccaacgaatgtaaattctcaatattgtaattgagcaagaagtttcctgttttttctttaaaattcagaattaaaatggattgagttaaacaaaaatgtagtctgtaaaagagctcattggacttgatattaatttactaaaatctaacgtgtaagtggtcaccccttcgttggatattttatttcttctgaataaataaaaaatattttaattaaattatatgtagagaatattgatcatatgaagtcaactaattcaaaattgcttaaaacggtttgaatcgatgcagaactattagaaatggatagttaaatagaattaagggcatgcttgctcttttcaggctgaaaaaaattccgggtcgtccaaatcagccgggaccagataaaaatttcgactttttttcaattttctttttataacatttttggtaattatttaattagtaattactaattaccaagcaatagctttgaaaaagcttctaaacatattgttggatttggtcaactgagaaaaaaatttaaaagttatgagccgggactcaaccgcacgctaaaaagcgctcaaaagcctttttaaattatttttttcaatttctgactgtagtttttttgcttggcggtcaaatcgtcactttttggctacgcggacgaattacaaccgtataaatttgctctactgctgcagtttagcgtccatttatttttacatgttcattcaatgactagggtttgtaattatatggaaatccatatttttttcctggactgttggaggcctgaaacgcatgaaaaacatgggttttagcttgggttngagcctctagggaagggagtctatatgcatattttccatattt

SEQ ID NO: 13218 - DNA, 1623 bp, Heterodera glycines
ttttactttgtccggtccggcaacctttctcttttccgtaagcatttccttttattcgaccctctctttccattcattccacaaacataagaccaatcgcacgatgcgccgccattttattttatttttttttgtcctgcttttcttataaaagtggcgaagcattttgttgctcttcgggaattatggccgattttgggctagcgggggttcccccttaaaagggcggaaaagcgcgctccttctccaatttcgcttcgactgtcacttccttcgattgaaaaaccaaaatatttttatttattccatttattattaaaataatagtttgaccatttcatttatcagctgctgttgtgggggggggggggggggaggaccaccgattgcgtcgtttgcgtgtgctcccccccaatgcttggccatcatattgcgtattctttggtcattggtgataagtccgcccgtttcttcttcttctcaaattctgatcgctttatttcattctcagggattggtgatacaaataaatcaatgaaatttgacaaaaataacaaaatgaatgcaccaaagcgtcacaacagcgtcagtttcactgacccatcaattttgccgacagaatgccaaaataggacgaaatggcgaagttattccacaaatttccaatcgaattgccatcctcacgggtcgctgttgagttttgtgatgcgacacaaagtgaaaaacggaggccccagcagagaggcggcgatgttcgctgttccctcctcgattccctcacttcccatggccattctccaggcgatgatcgccccgaatctgaagagtaagttgaaggcaaagtcaaattacaccaacgaaatttaagaaggccattattcctcgggtactttttcgttggacggcgagggaccgtccgttttttcgtcggtttgctcttcctccgtatcaacgacaggcgctcagagcaacgctttcggaaggactagcgaatgccaattgggcacaacgccaaatcggtcatccgacgatttttgcgtttgcccttcgccgtggaaatacgcgcaatcggaggaaaaagaaagtgagttaatgaagacaatatgaaaacaaacggacaccctgtcaatgattcagcaaatggatatttgttcattttgcactcaaattgggcactgcaaaaggaacgaatggaaaatcgacgggcaaatggcgacggtgccattctctgcgcggaagggtaagcgaaagggcggcctctcacaacgaagcgacgcatcgcaggaacacccaggcgcatttgctgtcgctggtcgccccgtggggcaaaagggtggtgaacgtcggccgaagcaccggtgacgagacggtcagaagcggtgactgccaccgactgttctcacacaacccgaacaatctgaacccatacgaatgaaaggtccgtccgatccgacgcgtccatttcccatcgatgtaaaaatcactcctccatttatggcaactgatgtgtacaaatataatttatgacaaatatcaatagcattcatttatccatttttcctttcttctgctgccgaattgccctttgtgtcgcaactttctctggggcactgtccgtctttt

SEQ ID NO: 13219 - DNA, 3680 bp, Heterodera glycines
  misc_feature (1660)..(1660): n is a, c, g, or t
  misc_feature (1743)..(1743): n is a, c, g, or t
agctgtggaggcgtgccgccgcctggtccctccggcccctgtgacgagaccaaaccaccgaagccgaagcgacaacggcagcgcaaagcggcgacagcaaacagtgtcaatgccaacggcggcggtggcgcgggcagcagcggcggttcgccatcaaaggccagcaagaagggcgcctccggcgcggcacaatctgcgccgacagcgaatggcggaccgggccagcaaacgccgcccattggcggcgcaccgcccggcagcggaggcggcgccataacaccgatgggcgctggtggtccgttcatgggtggtgtgcctggacaggtgagcctgttcaaatttttgaaacattttggatgcttgcgaatggcattgtccggcggggctatcttaaaatccaccattttcctctacaaattgacattttaaggtttaaattagcttttcaagccaacgagtaattaattcttgaacaggttgccaaaatgttttttgaagttcgattttcgaaacacacggcgtatttttataaaagattattctgcatcgaaggttaaaagtggaaaaacgctttttgccattttgacccaaatgtttagaaatttttttaatcgccattttgaaaaaactaattaaaatcttttaatgccaatttgtagaggacagattggagtattaaaatagaataaagaaatttctgcaaccagacttttttgagattttttcatttaatcgcttttcaaaaaaaaaaatttcttttttttattttaatcgaaaattttgaataaagatttcaaattttcggggggtggggcggagcgatatgctctggtaattgtcatttcggcaatctttgcctcattctcctctctttttggcacagttccatccggcaggaatggcaccgccgggtcaataccaccacgaggtgttgacggtgggcgagccccagctgatggcctgttcgtacggggagcatgacgaacggcatatcacgcgggtggagaacacggcttttgctgccgcagcggcgggtggcggtgccatgggaccgccgccgatgccaccgccccagggcataatggtcagcagtgcgccgggaacttcagcgctgggcatgccaccgatgccggtgccgacgacagcgatgggcggcgacaacggtggtaagcgcatatttccgggggttaggcaccgttggaccccattgtgccatttttgaaaatcattttttggcacaaaaccgctacatattttttaaatttattcttctttgcttgggttgaaatgcgaacaaaaattcgctcaatttacagctcctccacaccatttgcttggtgccaacaacgacttcgagcagcacatccaacagcagcagcaacaacaacagcaaatgcccccgggcggcttgtggaatccgctgccgccagcaacaagcgcgggccccggcggcaacggcggagaccaggcgatgggcggaaatggcggctgatgactatttattgtgattggactgcttgctgccgtgcgttgaccgggctgctggtgatgatcattcttcgcgccaccgccgtctctttcctgtaccgtatcgcccaccgtattcctccgctgctgctcacttcgtctctctcctcccttcactctcccactctaactnatttctgttgttgccccgtgttgcgtgcgtgtgtgatcgacccatttgaactttgattgacctccttcctcatccccccccgntctcgttccttcgttccattgccctcgtcaccctcttcttctgtcactctttctttgctcattggcactttgtctcggaataaaaaaaacgatcttttcaaaggaaaagcatgtggtgcgcatctgtgcttcatggacatgttgaactaattttggcacaacatcccattacaaaaaaaaagtgttgtgccaacgatgttgttttgtttccttcgaatgtccaatgacgagagtctcgaaagcaatttgcttttgtaccattaggcattgaagaagtgtgtttcttgacttactgagtgagtgaccaattcctcccgcattttcctccatcccatgccgaaaatctcgtccaacgacacaaaactgaacacatgtgcttctccccctcgtttgcttgcattcactatttcacaaatttactttatttattgttttatttccataatgttttgttgcggatggcagcgatgagacgaaaaagaaatccgtgccaaattcctttttatttattccatgacaccactcaaaaagtgccattttgtatccgcaacctcagctgatcttaatttattttagctgattcttatttttcatacaaaattataaaagctagcccaaaattggcacggatccgccgccaaactttttttttttgtttcacttttgccatttgtggcatgtattcgggtcgcttagtccgagacctcggtgcctcaaaaagctcgagactctcgagtcaaccgacacttggtatcaaacctttcgagcagtacaataccggccggatgcatgtcacaatctcatccccattttctcccttttccacccacagtcccatcgatgccgtcctattttcctcctaaatatttgttttcccttttttggcacatttcaacatgctcctcatcatcattaagcagcacagaagcagagcaaacacaacacaacagcatcacgaaacaaagacaacaaacaacaacacattcattcgaattcattcgatgcgtccactcgcgcaaaaaaaataattatttttaattttatttcgctttttatacatatacaaaaattaattatggaccaaattattaaatttttattatatattttttccattttcctccattcattcgttcattgttcgtttttcttcttatattattattattgctctctcttttcctatttgaattttggtttcacattttcgttttttattttatttttattggagaaaatttaaatgttaaaaatttattatttaattgcatttaatcgagagtaaaacattaaaaaatatattttttgttttatctattagcaatgctttaatgataaatagaagggggtaattaatggcatggctcgagatgtaagagttagtgagaatattaatttaatccaattaaaaaataaaacaaatattattaagcattttaaatatttagaaaaagtgtttgataaattttcgagctaatgaaaagactatgagagaagcgaccatcagacagcagcagacgatgaagtcaaagtcataaatatactaatttatcaaagattattgttatgggttgtatgtgatcaaaatttgtttctcttccttgcttttttctataatgtagttctgcttactcccctctctctgttctctcccctccctctccctatgtctccttatacctttccctccctccccctcgtccctcccctctctcttcttccctctatcttccttctttctctctccctctctctcttcttccctctatctctctccctctctctcttcttccctctatctctctccctctctctcttcttccctctatcttccttccttcctctcttcttcgctctatctttctcccttctctcttcttccctctatcttcctccctccccctcgtccctcccctctctcttcctccctctatctt

SEQ ID NO: 13220 - DNA, 1453 bp, Heterodera glycines
tctctccctctctctctatctctcctaaattctttccatttccccaccacaattccctcattttccatgccattctcccaccattctcggcactgctgctggtgtgggtgtattcatttcaatgccatttaccccccatactttttttgttttttttcttgtctgactgcttttccttcccctttttcactttggttgcctcactgttaagctctgcgaggatgaaaaatgccatttttttgtgccgtccgtccttcgacgcgtgcgtcgctttgccattggcgtcgccgcattttgcttcttccgccgccacgcctttggggccaatttcgcttgaatgggaatgaatatggcgctaacaaatgctgccccccgcctttattcctttgactttgatgactaaaaaatcagtgccattctttttttttcaaaaggaataatttaaatttttgtaacgcggcaaaatttaaaattaaatttattttgattttaaaattcgattatttatttcattattaccacaacccaattaatttattttttaaattttattttagaaatatttttaaaaatagtaaaaaattattttattttattttattttattttattttattatcttttatcataaaattgagaattcaactcatttttttgtttcttttatattaaacacccccccccctctcccaaattactgtaatcgctcgtataatcatacaataccgtattcccgtggcattaaacaaaattttttttaaaattctatacgtattttttgccatttttgattttttgtgcccgcacgcccttctcatttcaaaattatccttctcctcgtctccttggtgactcgaagcaataaaaaaaacataaattagatgaacaatttgtattgaagtgccaaaaaatgaaattttgggattttacaatgttagaaattaaataaaaaaaaattttttttctcctaaaattttttctttcccatccaaaagtgccgaaaacaaaaattcgatttttgcttttttgccgacttaactgatggatgaagcttcttcttcaactgcttttgcttctgcaccgttcactcattgccttttgcgagaaggtcagaattggcattccgtcggtcggacttttcccccgggggcggaagggatgggatgggatgatgaattactttcttccgctccccccccccctttgggttcattggaaaagcgacaaaacaaaaagggccacggtattttcagacggacaaaaagcgccgcccccggggcattccgccggcgtcactttcaaattgggcgttaatttgtcaaaaataaattttccaattttaaacggcaatttgtgtccatttttggacatgaattaaaaaaggccaaagaatgttggccaactttcgtttttagcctaaattattagcggcacggctctttaaattaatgga

SEQ ID NO: 13221 - DNA, 2583 bp, Heterodera glycines
ttgtcccgggtccgtttatcaagcagtacagctgaaaccctggttatgtagtattaccatcatcagaaatttactacgatctacgactaagcacatatgtaatatatacttttagttttttccgtcatatataaaacttaatggcggaaattgatatggccgaatttgagggtgctggtgaacgttataagtttttgatacaaccagtaaaggatcttgcagccaattgggatttggatattgccaaaacgcttgaggattacatccggaaagtctgtagtttattcttaaattgaccaacatttttatataaaagcccaggttgttgcggaaactaaaagaatcgatgccgaagctccggatgatgaatataggcggcacaaagtgtaattaattggttcaccattcccaagaattttacctttttaagtttcaatttcgctgaggccgctttgctcatccacgggacgacgacagtttatgcgcgaaaagtcgactacgtattgcaaaaagcccaaaacttttttgatcaattgagggaggacgaaaacattcaccaccagcagcagcaaaaaggaaaacgaaggaaaggttttgaaattaacaatcgaattgactcttttcttgcattagatgatccattggaagaaggtgctgaagcgacaggggaagagatggacgaaaatgcaaatgcggacgacgcgggcgagggaagggaaaaacgccaaccgaaggctaaccaagtgggtcaaagggaacgaaggtttagtggcgccgcttggtaatttagttggatttatcccgccccctggttttctatgtaattgccttgctatcattgtcagatcaattacgcttccctgggccatttgctcgatcgtctcattgtcagccagcgtcggacttcgcttcttcccgtcgttccaatcgctttttttccactcactgacttcgagaaacgaaatgtgtcgctttgcacgcgcacaaatccaaccgaagtgttcggtaagatggaggacttcaagctcaattcgtgccacgtctatggggtgatttattctaatgttttttaaaaattattatcttcagtcaattgctctgctcgatttcaaaaacattgccatcgtcaacaaattttcgcaattagtgtgggaatttaatctttcctttttgcattaatttttgttttagcattaactcccaaaaaaacgatgcaaattttgtcggtttggagccattgatggagcaaactgaggatgattttaatggtaatattaactccattagattatgaatgcttttcagatgctttgagttgcgcttccaagtcaagcacagaaacaatgcatcgccaaaccgaccaacaggagatcgaacggcgcggcacggacacattggcaccaacccaacttcgacctaattccaatatcgaaaatgaaatgtgtgccatcgaaatgaattcggagttggcactgcaacgacatgacggtttggttgacgaggaaatgaacgagaacggaccaacaccggccctgacgcagcagcctcaaattgactttgaaaatgagatgttcgacaacgactccaccctcgtcccgccctcgccgcgtgattttttagaagtgagtgagcacgaaacgacgccggaaccaacgacagacaatgaggaaggggaagcaccgccgccggacatttcttctttggtgctgtgtttggcaatctttcggttcattggtcccgaattttttttttaattaaaattctgaaaacacatttctaaggctaatttgagccgctgagtacgaatctgaccaccttttcggcctttttcgaatcccgaacctaaagtcgaacaattttttaaaaaattcaaaaatttcaatttcatcaaatatgtacgcctagatgtccgggacaacgctccaattgttgttatttggacgaatatatgtgtcgataattcaacggaaaaaagttgtcaataattatttttagacgtatttatgtaaatatttgaaggaattcaaaattttgaattttttaaaaaaatgtttgaattcaggttcgggattcgaaattggccaaaatggtggtcagattcgaactcagcggctcaaattagccttagaaatgtgtttccagaatttatattaaaaaaaaaatttcgggaccaatgaaccgaaagattgccgctgttttcttataaatgctttgaattttctttttaggaatttttggatccgagtgaaacagtcactgaacaaagtcgtccttttcgtcgcaaagacaattgcgcaatgagtgctgtcaaacagatcaaggcacgaaaccgtcgcatcgaagtttgttcagattgtcgaatttggacacgcttttggaagagggaaggggggaaggctttatttctcaaaatcagactattcttacatttgtcagttaaaaattatcctgtccttttccgtttagcgagactgtcgtgagaaaggcgccccaaatgtggcgactataaaatgttacatcgaatcgcgcattttccgtcaccaactgaagaaacgtgcttatacacttggactttttaattca

SEQ ID NO: 13222 - DNA, 1563 bp, Heterodera glycines
cttactaccacactctctccccttcccctccctcttccccacaattcctcactctctccccttttctctcctatccctcccctctttcttctccccttcccttcacattcactccttcctctccccctcttcttctctcctcttcctcattctcttccttcccttcctgtcccccgcccctctctctctcctctttcctgcctccctttctcctccccttcccttcttcccccaccctctatgcccttttcctccctttctctctctcctcaaacccaccgaatttttcaccggctcctttatgtcccttttcgttattgggtcctttgctgacaacacattctccgacattagcatgtcctcctcttcctcctcccccctctgttccgtttcgccttcgttttgtgccgttccgctcgttccctctgcgagtgctgtgtccaactttttccgaattgctgcgatattcgcctgagtacggccggcatttgatggcatttgaatgtttttgcggctaaattcgatttcacttttttgttttttccttttttcgcggacctttcgttgaaatgcttctctagcactttcttctccgtttcggcattttccaactgtcggaaagtttcgtcgattgtctgaaaataaaagggtgatttgcgtcctttccgtggcatttattccctcctccgaccctaaggtccatgtccaaatttttgtccaattccgacaatttgtccaaaaccgtgccgaactgctccaattggtccttttgtccctcttggattagcatctctaccaactgattgctaaaagacgggaaagaattgcccaatcgctcggcctcggcccaccctctgtccgcagcttcgtcaatgtccctgaacaattcgaaaattttcacacgttcatcaaccatttcaccaaaaattggataagtaaactaaagagaaaatgagccaattaaacgaaacactttcggattaatgtacacaatactgtatgagaactttttaaaataaatttaaggcatttgaatttaatagtaaatgcgttttttattgtacacagtaaatacaacaacacaaaaattaaaaataataaaaaacgtttattttccattatttttcttccatcgatgcgcggagcgtcgcttcgtcccatgggccatggattgtgctgaaaataaaatttgtgtacaatgattttccaatcacttcagagatggtcagtcaccacctttttaggctttgcattcgaatgaaaagcaacggacagaaaaggacgacgaacaaatggagaacgagaaacataaaggcgaattggagaccaaccaaaagggagagggcgaggagagaaaggacggagaacggcacgaaacagaggggcgacagaaggggccaacgcgcaaaaagggctgatgaatggtcaaagtaattaggaaatgactaatgaattgggtaatactgacttttactggtcccataaaaaaagaataaaaaggctgtttttctacggttcttctttccacccgggggttatcggagacagagatcacgaatatga

SEQ ID NO: 13223 - DNA, 2998 bp, Heterodera glycines
attgaattaaatctcaatgcaatgcctgtttggcattgtgtttcttttttattcaccgtttctcagtcgaggccaaaaacagaagagacaaagcgaaagtgcgagcagaagaaaggccacaaggtcggattggagacgagaaatcagaaaaacggaagcggcgaggcaaagatttgccgacaaaggcaaactgacgctaaaacgggaaatgccatcgttaaaaagaaaataaaacattggcacgaacgaacaccggcacatttatgccgtagtcgtggacaaaaagactggcgaaaaagagcagaatggcacaggcgtaaatggtgtcagtgctaattgaagtggtcaatgtcctaaaattgcaattaaacaaacaattattggtcatttatccccctttctcaccttatcaccggagtaaaagcgtaaccaaacgcgagaattgtgacaaaagttcggcaatattcaacaaaatcggaagacgaaatttggaacagatccgacgatcggagaagcgcaaaatgagccaaaagagtggcggaagaagcgaaggaacaaaagcaaaacaaagcgaagggaccgaagacatcggaatggacaagttcaaagcagcaaaggaacagagcgacgaggtcaaaatgagccatgacagtgcacgcggcacaaatggcggaagaaaaagtgaaagggacgaagccaactgaaaacggacagtcaaaaacaaaacaaaaaagtaaggcaaaaaccaaagagactccgtaccatttgtcctgagttggtcgagaaacagtgtctcatcggtgtaattgtcgggaaagggctgccttttgtacaacactttctcccaccgaggacaattacatagccgacctttaccacggtgcattcatagttaaaaacgaaaaaagaaagccaaatgataaaatattgtgtaaatggaatcgaaaaaccaaggaaaggtcagtcatgaattaataagcatagttttatgaaatgattcgtcggtcgacaaataatgacaaagcaaaatgtgaaaagtcaatcctcacaaagaaaagtcatttctttcctcagctacgactttgactttttcgacctaagagtaaaaaatgagagtatttatttgaagccttcgtcaaactcacgtgattaggtccttgaactgcttcaacaccgtgtcctcgcgcctcgtccgctgttcgtcagtgaacgtgctgagcaatcgcttctcctccgcagtcagaatttggttctccttcctcagccgagtcgcttccatggctttgtgccgcgttccgctcattacgtaaccgaccgattcgaacgttgagatttcattggaagacagtccaatttcaccacggcgcggaatgcgctttccctgcgccgcgtacgcggccatcgctgcggcctccccgcgcaacatattgttacgggcactgaacagcaatgtttggttgaatttgcgctccattttcacctcgcgtccaatttcatttcgggtgccatcgtcgggttgagtttctgcagcaaatcttcgggaatttgggggccaatcatcgctgcctcctctttcttgctcttcttcacttgcatttctttcgtgaattcgacccattcgtcgccctttcctccaccctttgaagtttcgtcagaagacccactaaaagaggagaggaatcccttcaacacttttaggtggtatctttcaattatgctaaatatcgcctccctctgataacccctttctctgtccattaattacccctttgatgtcaccgatccctcccttttcgctctctcacctcgttgtgctgctctttcgctttgactttttgtgcttctttctccgcttgctttcctccttcctcttcttccccctctcttttctgcccctcttccgttttcgctttttgtcttccgacgattcgctgtccttcgatgactcttccgtcgtctcgtcggatgtttcctctttcgtggactgatcattttgctcttccctcgcttcctttcgcttccttttcttctcacttctattcttttccgaaatcacgtcccgcttcagctcctccttgagcattcgttctgcgattcgatgttcctcaaacactcgctccaattcgttgtgagttggcgaatagccccaaatgtgccgtactccgaccgccccgagccgttcgcgctcctcccgacgactgaagggaaagccaaggtaaaagccaacaccacatcgaccaattgttcagcaaatggaccaccgacctacgccattgccggtcttcggcttccgttcgtgccaaaacattccaattgtcgccctcttcaccgtccgattcccaattatttcttctcaccgatgttggagattcagttccatttactgaagaagccatctcgaacatagattaaataaattaatcatttttttaatgaaagtatacaacagacaaaaaaaaatgccgattttttcaaaagagaatacataaaactttaccgggattgaaaatcaaagcaaaaaatgtgtaaaaggcaagctaatggaagactaaattaagtttttagtgaggttgactagcacaattaaaaaggcaaaagcagcgcgaaagggcaaatgagctgaacaaatcattgtgaaaatcacaaattaggaaagttaaaggagggcaacttgactacgtacaatacaatatgagaaaaaaaaagaagcaatgggcattaaaaatggcaaaaattagtaaaattatccatcaaaatattcgcttaagggttccccctcggcaaattcgcaccacgtcccatctgaagaaaatgggcaaaaaatattgaaactcactaaaggatgagcaacagacccaattgttcacgtagcaaaatgcattggataaagcatcagtccaccgccaacaaaatccaacgcaacgctccaaagtaaaaaacggcaaaagccgagccgtcaacggagggccatctgctggcaatagatgaaaaagagaga

SEQ ID NO: 13224 - DNA, 3354 bp, Heterodera glycines
  misc_feature (3299)..(3299): n is a, c, g, or t
ctccgtccgattgagtagaatttcctcccattttccgctccccctttggagaaggacggagtaaatgggtgaatggaagcttaacggctcccgttttcctccaaacccgtggacctccatctcttcggaggtgagtttgtgcgggcggagcttatcgataagcggatccgctccgtacgttgtttggcttcccgggtcaaagagcactgcaactttgattatattccggctgtcgcgacttgacttagccagcagccgtcgcatcatcagatacgcgtgcggatttttgcacttgggaaccttgttggctctccctttgctggtgtccacggtggacatccccatggattgaacgatctccccctctcttggcggagggtttgactgatcgttctgttgaaacccagccgtgatcaggtgggtttggctttccacctgccgctgatggaactttcgccctcctggctctcttcccgacttgggggaggaagcggaacgattcccatttgaccgtgaatgggactcctccctcttgaagcatatgaggaagtggtgtttgttgccacagtttcggcaacggtatggtgaggtgcactcctcagtgttgtgaccttgcacaaggcagttgaggcagcgctgctgttctgtcagccgttttcggcgagctcccggtgttgggaacgccgggcactcgctcgggagatgatcagttcccgagcagagcgagcaggaccgaccccatttccttgctggggttttggccctttccggatttttgttaatagcggagaacgccctatattctggctgaggcgttcctccgcgattaaatggccttggtggttggctctgtcggttgttggagtgacggtggtcacccctttgatcccaggcacccctctgttgaggtggggaattgaaggcggatgaacgtggtcgttcatcgcctcggaggacatgtgcacatctctgcacttcctcctttacttccactattgtttgaagtgcctttctgatgtcaaggcacgaaaatgtctttcctgaggaaagctctttctccaccacgtgggtgaggatggagaaaggaagcttcgacttgatcgtcgaagccatgaacatgttgtcctcagattcgccgaagtccattagttggaaacagattcgttccacggactctgcgaagttgcggagcgagagcactgactctcccggcttggggaggtgcagtagctctgcctgcaaggactcagtgatagttttactatcaccgaaccgcttcttcaagatgtcgacaaccctcggataattttcgtccgagggtgggtacaagtcgactgcccgcctagctggcgagttgtggggaaggcaccccaacaaatagatgtgtttcttgaagtcgtcgattggaaggttgtccactgaggaacggaagagcctccaaaacatcggccactcccttggctctcccgcaaattttgggagagaaatgggagggagattcacctcatggcgaggtgggggaggctgaacatgttgaatttgtggaggattggcgggctgagagataatgctcccagttatttcgtcgtcatcctctggaccgatcactccatcgatcgtgtccactgcacctcgggctttgtccgaccattccatgaagtgctttcccgatggcttaaagtcatcgtagcgttgctcctcttgttggcggtcggctccattgaatttgagcaggagggattgccatttgtcattgcaatcctccaaaagccgaatcgctcggcggagtccacggcgctccgctgtgaggtctgcttgaatgctctcgtctgtcgtgtcctttccgagattgaccgtggccgcctcgatgtaggccttggtacgggcggcacaaggcccgatttttgagcggattggcccgctcatgttgattctcctgctttgggaggttcggctgctgatggccggagtcctttaacccttgttggtgaagactcgaagattcggctgctggtggccgtttgtgtctccccttgttgggtgagacttgggtcggcggcgatggccgaatgtgtcttgcctcttgttgggcaagacgaagaagtcggcgactggtggccgaatgtgccaaccctttgatgggttcggctaaatgagtcggctgctgatggccgaatgagtctcgccactggttgggcaagacgaagaagtcggcgactggtggccgaatgtgcctaccctttgatggattaggcgaatgagcggcggcgatggccgaatgagccttccctttgttgggttaggctaaatgagtcggctgctgatggccgagtgtcttgccactggttgggcaagatgaagagtcggctgctgatggccgaatgagccttcctccctttcggtagggagaaagtaaatcggcgactgtagccgatgttcttcaccccttggcgggcgaagactttttgatcggcggctacggccgattgaaggaggtcaggtcctttcggcaaggaacaactgacccctacggggctccaattttgtcgcagccaaggaggcgacaaaaacttttgtggggagcgagggaggcgagagccgactttgccaagggcaaaatcagctgtttgcttccccctttccctttctcggccgtgccttcccaaatgtgggggaagggacggacgagccggtggaagcgaaggcccgcaggagtgagagactcctgcggggaagaccgacgcggggcggacgacgacgcagacgctgagcagcagaagggggaggggaaaaccgtcccgaccaaatcccccggactcctttcacaaatatatatttattaagcagcagcagaaatgaatgaatggaaatgtggaagtgagcatttaatgaaaagggtgccctttttataggccgaaaatgtgagggcggggcacagaggaaaaaacttaattggactatcactagcaaaaagcgtgggaaaaacaaaaacagctggcgatcgataagatctgtcgctgctgtcagcgacataataatataaaacaaaaaaataaattctttttatacacaaaatataatgcacaaaataatttatatttctaagaagttagaaagagttacatttctcgggggcaaagaccgggaaaaaccgataaatgcatatgtaaacattaatttacaataaatatttgtaagaaataaaaaatttaattaaagaagaataacgcattcaaattattaatatttgggaaatttaatataagaatttaagaaaaataaaaacaaatgcatataanctaaatacttttaaagttaaattaatatgaaaaacatttaaattttaattggtaa

SEQ ID NO: 13225 - DNA, 2205 bp, Heterodera glycines
aattggttcccaagtccctccctctctgtcctctttgtgctggcaaaatgtctgcgtgatggcgtacgcttccttcgggtcgcccacttttgtgcccgtcccgtgcgcctccacataggccaccgcgttcgtgtccaattccgcctctctgtacacttcatccaaaagcaccgcctgccgctctcccaccggaaaggtgatgccctgctctttgtagccgtccgtgttgctcttcgcgtgcacaacagtcgcataaatacgacgcgcgacggaacgccgctggataattatggcagaaacaccctcagtacgacaatacctcaaaagagcagggaaacgatacagtatgtcatcggaaggaaaaaatgacatacccatccccggattggtcgaaggagcggcacgagccggcgggggaaagcatgcccaacttgagaaactgaagagccgcagtcggagtcagcgtaaggtgggcacctgagcaaagggcgggcgaaggttaaagcatttaaaaaatgctcaatgtcttaaaatcccccccccccccctaattatcttactgtccccctactattccccccccccactcgctcgcccccctcacccacctgccactattgctgcttcgcattgctcctggcgaatggcgtcgattgccaattgcaaggcgagcagtgaggaagaacaggcggtgtccacggagaaggacggaccgcgcaggtcgaaggcgtaggagaggcggttggagaacatcgaacgcacacagccggtcaaagtgtagccggtgaccatctccggatcctgagtgagtgctccgcccgtttcggaagcggaacagcccacaaaaacgccggttttggtgcctcggaattccattgggtttactcctgtgaatacattatttgtcgacgaaatccctcgccgttttgctcaaccgatggctaaagaaagacactcacccgagtcaatcattgcttcgtaggccacttcgagcagtattcgcacttgcgggtccatgtaattggcctgcaatttgctttttactttgcacaattccctattcccacttgtttcggcgtcacgctgaaaaattgcgcgtcgaatttgcgcaattccttcagttttccgtgccttttcggcagatcataaaagccttaaataaatggggcatttaattgtctgtcattggtggaattctgcggaaataaggccaatcggacctggaggccatctgagttcgtcctctgtgaccaggtcctccccagccaacagcaaatctccgaattgtttgacgttgtcactgcgcgggaatcgtccactgatcccactgatcaccaactcttcctgatcacgccaaaagggccgcgaggacggcgaatggggcgtttgaagaagttcgggggggtccgactcggaagacgggggcgatgaagtcgacatttcgttttggtcagaagactgagcttggaaggagggaaattttcaaatagttaaaaaaaatgggactgttcaaaattgtaagtgacgtcattgtttaagaaggaaagatttttaggaagataattaaatgatggaaaggacgaagaagagaggaggaggagaacgattggaatgggaagaaagggaggaaattcggtgagttggatcagcaccagaaaatgattgggggggggggagggggagggggcgatgattggggccaatcggcggacgaattggcagcaattccgagaaaaggcgaggcggcggtgatcagcgcagcgattgagtgggttaagagaaaggaacaaatcaaaaagcaaccgaaaacattaaaaaattggccaacgcacgaaaaatgagcgaccgaacggatggacgaagcgaaaaaggaccgccgaaggtccattcatccgaacgaagcggagaaagggtcagaggaaggcgaacgaacggaacgcagagggaagaaagacgaaccgaccaaaccaaaccaaggtcacccaccactgctcggttaagcgtcggcaatgtccgatcagtttggatgattcgcgcaataagtgagaaggggggggggagacaaaaggaagggaagggggggggggatttcgaacatcggcaagggaaaacgatgaataaattttgaacggggggggggagtcccatcggagggggtggaggggatcgagaatgctgactgacccttggggcaatgaaagttaa

SEQ ID NO: 13226 - DNA, 1031 bp, Heterodera glycines
cttggggcaatgaaagttaaaatgataggctcacggaggaggttgaggaagaggcggagcaggtcgcctcgatgcgctcccaactgcccccggcgctgctcaactcgcccgccgaggaggaggaagagtgatggtcgctgctgactcctcctcctgtctcctccatctgattgttatcaactgtggcgatctccgttgtcgggatgaggtgaacaaaggggaggagcaaagagaacggagaggaagaggagcaagaagaataggaggagcaaaaggaggaggaggaaagggaggaagaagaagaagaggaggaggaaagggaggaagaagaagaagaagaagaagaaaggagacggacggaagagtcgacggaagaaaagagtcgacggaagagaagagtcgctgttcagaatttgtgctctgccggcggcgctgagatccgtttgaaagtgagcgtaatgaataatattacaaataacaaagtgccttcttcgatttaatctgaaaaggtaatgtgggaaagtggatgaaaggagataatggaggagaaaaagcgggggaaggggcggatgaagacgaaaaaggtcgaaatgtgaaaaatgagtggggaggggggcacaggacgatgaaagtgcgggagggacagagtgatcttcgagacggcggccatcacttcgcctcccccaccccatttagcgaacaaatttttgtttaaagcgcgaacgtagacaccaagtgcgggaatttgccccgggcatgggaatgtgtgaagaaaagttggtaggaagcggaggagcgaaggaagaggaagaagagcggaagagagagaaagaaaaagtgagaggggaaggaaagggaaaaaaggaagaaaaaaggaagaaatgggaggaagtaaaggagaaagagagaagaaattggaggaagtgaaggagaaagagagagcagcaagggtaagggaatacaggaaaaggaggaaaggagtaagctaaaaagagaggaagaaaaggaaaaaaaggtggaatgaaaaagga

SEQ ID NO: 13227 - DNA, 2941 bp, Heterodera glycines
tgttttattaatttattttaaattattttctgatgaataactgttttatttaatttgaattttcgagaaattaattcctttcaatttcaataaatattctatattataaatttcgaactttatcatagttttacttcttttaatcactgttgtgcctcttttaatcccttttatatctcttaatccctgtgtgattgcccgtctgagttcaactaaattttaaaaacgggcgcgaagcgcccgtccaaggccaaaaaattgaaaaacgggtgcgaagcgcccgtatgagttcaatagccgacggttcacgcacccgctagtatatatgttatataggttttgagtttcgtttcaaaaaacaaaatctcccggccgaaggccgggagcgccctgaaagtagtggaagggtcttacaactttttgaggcgcatccgggaaaaatataggttttccggtccaagggccaactgagtaccagggactgatttctcattttttcgtgcgtttgacggctcgtaactttttttctaaatcccgaatcaaaaactttccgctggtaggaacctaagttgaagtgttgtctaaaagtcaaaaaaaattccaggcctctacctatagtaggaagggctgcagaaaataggagaaattcagtaccaactttgtccagttcagtcccaggtgaataccgagtcagggtttgatctgagcgagggggctccagcggacttattgtagagctttgaaagctcgatttttccaaattttaaaatttcgaaaattttcaaaaattttcgagttaggcctaaaagtaggttttggggtttttgaattttatgaatttttaacgaattttcctagagaaatggagaccacttccaaaacatagtttttcgagctctatcgactggtatttttttcggaaaaatttcgattttttcccggaaatagaaaaaaattttggcctgagcgggacatttgagtcccgggctcataactcgttaggggttggttttagccaaaaattgtcttagaacatttttgtagagcttttaaattgctatctaatgaggtactataggtcggaaaaatttcaaaaattttcgagctaggccccctagaaattttcggaaattttttttcggacgaaaatgggggtgaaaattttttttctggggtattttgaggtgctgagcacgaatatgacctttgtttttcgtttcagattttttggaattttttaaaaatttttgaaaattcgtcaattttttggccttcgggattttgggttaattttcgaaaattcataacaaatcgaagggtggatcaattttcatgcaattatattgtaaaaatagagaaaaatcaggagaattttatgggatttatttgggatttctatcttaaaaagaaaaaaagttattccagaatttctgaaaattttcgatttttcagaaaaaaattcataacccccttctgaaaagaaatttttgaaaattaaaatactacaaaaatccgcaatttttttctttaaaatataaatcttattttacatttttatcactttcttacgaattgttacaaaaataaaaccgattttggtattcgggaccaaaggggtgagcataggatttttgagttgaaaaattttttcaccaaaaatcttcaaaaaatatgtctttaggggttatttgggcccctgatcacgaatacgtaatcagattttacttttgacatggttaagacctcagaatccctgtgtgattggggattctgaggcacccttatgaggaggggagaggcaggttcggacccggacggtgtacattatttttctatgcatttttgggttattttcactgtttttaattaatttgaagatttgttttaaattatttaaatttatttttttttaaattaaagaaattattttttgttttattattaataacaaaataattttaattaaatttaatttttcttttgatgaatagaattatttttaagcaaaattagatttaaaaatttggatgcataataattcatttcaaaataaagtaaaataaattattccgtttattaattaaaaaataaacttttacattttttattatttagttttttttaaatttttaaataaacctaattctataaaattatgatattatttttgtacatctcataacaagttaacttttgtacctcttctatttactgttgtacctcttctaatcactgttgtacctcttctaatcactgttgtacctcttttaatcactgttgtacctcttctaatcacttttgtacctcttctaatcacagttgtacctcttctaatcacttttatacctcttttatcaaatttgtacctcttctaatctctgttgtacctcttctaatcactcttctaatcgctgttgtacctcttctaatcactcttctaatcgctgttgtacctcttctatttactttgtacctcttttaatcactgttgtacctcttctatttactgttgtaccttttttaatcactgttgaacctcttctaatcacttttgtacctcttctaaacacttttgtacctcttctatgggcaaattttttcctccaaaattgcttaaaaatgacttttctgggctattttgggccgcttatcacgaatatgacatttattttagtttcagatactttgggttcgtttaaaaattttttgaaaattcaggattttttggcccctgggaatttggtgtaattttcaaaaattcgtaactcgggttagggagggtgaattttcacaatcaaataattaaaaaatgagaaaaaatacggcacattttatgccttttatttggtatttaaacaacggataagaaaaaagatattccaaaatttctgaaaattttcgaattttcagaaaaaaattcataacacccttcatattaggg

SEQ ID NO: 13228 - DNA, 909 bp, Heterodera glycines
cattggccagaatgaccttatttttgttcaccgccaacttctttcttgcatataaagtgccaaaaaaatatatatataaataaaaatgattttttaataaaattacacttaaaattaattgaataattttaggtgcttccgtctgatcccgaaaatcctccaagttctgataaagtccctgccttaactgttggtgcacacgaattcacgtgccatgtgatgccttatttggacattcagtgatttgacttaatgagattaattaatttttgatttgtcgagaacaatatttttattacaatttaatttgaaattgagttaaaaaattgagagatatttttgaaagaatgctgaatgccaaaaatttaaaaaattttccaataggcaaagtgccaagtataaagtgcaaccacaactttgaaatcaagtacatttgaaaaaaggcaaaaaagcaaaaacaaagtatgtacttggaaatcaattacaaataaaccgtatccgaaccctgtaattatgtataataattaaagggttgtgaagaaaactacagtaaactcaaaataaattgggatttaattgaattttgaaggacagcagtactccgatcccccgtccccgataaatctgtccccgaaagggtcgtcgggggtgtttctccaaaatttccataatccatgtgttatcaaaaaacagcagggggcgaaactctgttaccactcccgcccggtctactggtagttgttgttctccggtgacaattgtcacaagtgctggacggagtatggtaatgccaccgacgaaattgatccggttacggtggaacactttcatgtacagcatacggcaatccgagcgtatggttttgttcagtgccaaataaatcaccgacggaaagcctttgatgagtga

SEQ ID NO: 13229 - DNA, 1597 bp, Heterodera glycines
ttcgctaattcctaaaatttttatgtactgaattcttcattgtgccaaattaatacatcaatcccgactctgccctctccaggctccccaatttgctcgaccatattggatcaattgttgcctcaattgttccattaaacttcctctcgaggaagcctcttcttctcaatctcaataccaaatggtcaatgttgattattctaaattgagagtttgcaaaaaagaaatgccaaaattcaaattttcaaaagttaattaacggccggctctttcagtttccattagtgaacgctcactaattaactccaatggaacttgaatttattttgttgtatattgataatgccaaccaaccagccttacccgtatctgcactgcgctgatatccgaaagcacagtgccaaactgttgacgagttttgcggacattgtaaaaaagttgggccgcaaaaatcagatagacgagcgggcacagaattgagaccaggccattgtgcacaacatgcaaccagttttcatactgtaagaacgggcttcattttacaaggtgtacggtacatacagttctttgagttcataccatatttcgaatacctatgcattttgcttctttcaaatgataaaaacagatagatacacattttgtttacctcctcaagatttgtgttacggtagccaacaaatgggtagaagaaccagccaaagtaaaggctactgtacaccgccggcttaatgaatagggcccagtacagtgcgtacagtgaacagccgatgatccaaaacgaggtacgacgcccggagaaaaacaagttggacaaatagggtgagctcagatccaagcagcggttcagtgccaacacctataatgccaagtacgttttttggcaattaaaaacaaaaaaatgccaaccaaatcagcggtgctttcggcattccattgggctaaaaattggggggaaccattttttcaaaaaataccgtctggctcacattaattgccatgccagtgaaataaatcagtgtcggattggagcagaaaatagcgccacggaaattcagccatgcactgaagaagccgatcatgcacaaaatgcccaaatcgacgcagccaatgtagaacaacagcttataacaggagttgtcgcgcatgtgcttccaaatggagtacatgcaggggatgtacagtatctgttccggtaggaattgtatacggtattttatggtgaatcagtctgactttttggtgccagcgaatttaagtttgcaagggtagaatttcgatgtactacatgcaacaccttcgatgtgctcgccatatgtagccccgattttcaatgtgttaggcctcagaattttttttgttgcgatatttttttgtattttttgaaaatttccctttgttttcagggcatcaccgaattgcctaaataaaaaacacccaattagaatggcctattataaaaaattactgatcagattgggttttgttttcgctttttgataaaaaatgcatccacttagtatcacggtaacttcacagtactgtatattttaattttatctacaatgtatttgtaccgtacatacataataaatgg

SEQ ID NO: 13230 - DNA, 3248 bp, Heterodera glycines
  misc_feature (3033)..(3033): n is a, c, g, or t
  misc_feature (3122)..(3123): n is a, c, g, or t
  misc_feature (3200)..(3200): n is a, c, g, or t
aaaattttttggtcaaaaaatgacagtcctatttattcaagacttaatttaattaaaaaaaaatttagttaactcaaaagttgtattcgcttgcccaaaatacacttgatgccaaaaattcgagtattaagaaaatttatgccaaatttgaaacaaataattgcctgagatttagcaaaaagttaaaaaccaaggaggaattcatgaacgaattcaaggtaaaataaataaaatacccaaaaataaataaattgaatgtcagtgcttttaaggttagctttgatcaaaaaactatctacatcaacaaagcagaagaaaaagctgaaattaagagcaataaatattttaatgaagaactaacatatagcatttcaagagaatattttgctggtcagttttatttattttttaaataaaaaaaataaaataatttcgctaatcccaaaattataagccaaaattataagtccaattaattgattaatttaattttttttttgctattttttatacttccaagctctcgtctagccgaatttttttttacccaccatatcttccacacagatattaagaagtggacaaaaaaaattgaaaatatagaaggaaaaaaattatgaatttgaatttctcactgaaaattgcataaagaattaaatattattggtgtataataaaaaataaataaataataataatttaacataaaacaaaatgaattttggttgagaaaaatttttataatttcaaaaaatgaacaataaaatcgaaagtgttatttaagcaaaaagttcaagcgaagaagcaagctcatctgcagcatcatcaaccaagcaaaaatggaagcaattaggaaagatggtcaaatcacttccattgttgggcggaaaggacaacgacaaaaagaaatttgaacagtataaaaagaagccacacgtttttgatatatataaaaaggacagtaggggatgagaagatacagtaggatgttgtaacgtaaggatggatttggatggagacacaaagggatgtgacggatttttttcttccgattttcttgatactgagtcggcacaaaattttgagcaattttttcagatttttccttgaaaattcttaaattgccaattcagtaccaagaatttgaaaagttcggtcacattcctaatggagactactgtatgatttctttctggttatttgtaatttattcttttttttggtaatctttggccttcattggttttaactgtcacacttttttctattattgtaaattttcttatttcgatccattttcgttggaattatacaattttatttcaatttttgcggataaaacttttttattaattcaatttgtgcaaaatttagaaatatttgtacagcagaaaatggaaacttttgataaaatgctttaattacgttatttttcaataaatatcttttaattgtatgcgaaagcataatcaaattaaatatttgaggcaaaaaataagaaataaatttaaaaaaaagaattttcaggaactttaataatttgtaaaaagaagtatgataatgtgatgaaattttttaatttaatttttttttggtataaaattagcaaatttccaaaaagttccccaatcccgagtgccagtcttttccattctcgagtttttcaaggaataatcactcaaaatttgtcaatttatttaaatatgataaactcaaaggccaccaaaaaacaaattataaaaaagattttttaataataacaaatttcacaaattaattctgttaaatcactgaatgtgcaaatagggcatcacatggcacgtgaattcgtgtgcaccaacagttaaggcagggactttatcagaacttggaggatttttgagatcagacggaagcacctaaaattatttattaattttaaatgtaatttaattataaatattttggcactttatatgcgagaaagaagttggcggtgaacaaaaataaggtcattcgggtcaatgcttcaccagggcattgtctaagaagcaaaattatttttaaaataaattaaaattatttttaataaaaaaggaagttaattcacctcttcccaactccaaatggaattaatttgtcacattttttcaattttccctcatcgtccaaaaagcgctctggccaaaattggtggggttcggcaaagtactaaaaaaaatgttcggaaattaaaaaaaaattttttttttgcaatttgttacgcagttttttgctgaattttaccaaattttcctaccttttcactgaagaggacactgctgatctgaaaaataaaactaaaaaatatttcgccggattttttgtccacctgtggcacaatcggtgtgccactttccaccgtaaaattgccaacttttatttcatcaagagtcatatgagggttgttgaacacaaccaaatttgtcaaacgcaatgtttcctaaaaaataaaaaattaatttttaattaaaatagatttacgcattttgactcaaatatttagttttttatgaattcagaaaatatttttattacatctagaaataataatttatttaaattgaaaatcataacagtgcggaaacagatatgaagcaaaaaaagagaggcaagttgggaaagtaaatttgcactttttgaaagaattttggctatgtgccaactaattatatctttttgtccaaattttaatgacgtactttcacagatactaattaacacttgtaaaagatacaaattatctcaccacaaaagatgaacaattggcagattgtctaaacaattttaacaaattgtttgactcgagacttaatctatccagcttttactgccatgacacaaaatttatttagcgaataatatcaaaaaaaagtcggaggtgaaaatgagaagaaaattaatattatcaaacaaaaacataatttaattaattcatgagagaaataaaagtaatttttaaaaaagtaatttaacaaaaatatttagcgccagctattaattaatttaaattanaaaatactagacatttaacaaaatagcttaacgcaaaacaggtactataattaatttatttattttttgtttaatatcctttatattanngattattgaaagaaaagacattgaggcaggaagtaaaaaacaaagatttatttaaattataacccttttttatttgngtcattactagtattttgaaacttttaaaaaaataataatgtgattaa

SEQ ID NO: 13231 - DNA, 1623 bp, Heterodera glycines
tatgtcgaaggtgagcagtcgaaattccccgttaattgccttaattatttaattgctttactttttcggtcgactcgccggtcgtcgcatttggtggtgtccgagtggcgaaggtttggtttcgaattgccgtaattaaattatgcctatgttttggcacacatcaattaattaataattaatgccaggttatttggcttattgtccccagcccacggacttcgaacagtacacttactgttgtctgtactaccatttgggtgttgaccgaccttcgtgctgtcgcttcccatttcataccggtagtgggcaaggcattttgccagctttgaagttttaagtaaaaattttaaaaattatcccccccccccttgtgaaatgccctcaggcaaaaagacataagagaattcagcatcaattagcgatgcattaattgtaattcattcaggtgtgatcattgcactgtttgtttcgagtgttgtcgcctttttgggtaattatggtcaatttacattttatctaatttcattttagttaattaattattatttttagttctattgtttctaatgtgttggttttgcccaatttgtccgttggccaaaaaattgagggaaagaaaagaagaggaggctgaaaatagtggagaaatggacgaataaatgaagagaaaagagggaatagagaaaaaaagggaagtgatcgaaaaatgaccaattgacgatcagaagaagaacagaaaatgagaaaataaagtgccggttttgatattccgaattaattagttattgtttgttttttcattttcaccaaaattcaaattattttttaaaatattttaaattattattttttgatttttgtcaatttttcataaaaagccattcaaaggaatgaaagcaatcggcggatgagtggccacagaattgtgggacaatgacaacgaaacaaaacaaaacaaaagggcgtcgtcacaaaggtcgcttcgcttatcgatgaattcattccgcgatcaatcaagctgctaattgacacactccgaagtgaccaaaaatattccgagaaaagcgcccttttttcattttaaatttattcatttttaaagtaattaaatgacgaataaaccgcagttcatccataatccaaacatttctcattagtgagtgatggttcgaattcgaattcggcactcactgctcatttaaatgacgaacaatcgaaaaatatttacaaattaactattaatgtgttagtttccattttggtgtgtctccgcacacattgctaattaatttcattaacggaaacgacgaaacggtgaattgagagacagaacagacactctttgaaggtgatggttcagcgacggcggttcatttcaatgatcaatttcttgggtttggttttatttttaattgcatttgcccattgattttttttctttttttctactgatcttttggcttttcctttttagcttttcctccaaatgaccgtctcttataatcaggacattatcaacacccattccctcacttttttgcgtgtcatttttcgctggagaggctcagtgtggaaatcggttgggaaaagcgagcccattttgggaaataattttaaata

SEQ ID NO: 13232 - DNA, 1188 bp, Heterodera glycines
tgaaatatatgaacgagcggtgaagcctttgagggaaaaactatgggacggtcctctcggggaagcttcttcttctctatctcagtatcaattggccccaacttcagaaattgcaaatgctgatcaattacgactgggtgcccgtccctctgggcaagtccctccctttcccttccctttgcctttggccaaatgccgtgccctcccctcccccttcagcttattctcaggtcgttttcttggccactcgcgtttacttccttttgtgtttgtttgggcgccaatttcgcatttgggagcaaagggattccatggcttacttcgaatattactttccgctgatgacttttctgcaactgatgtgttacatgggctggctgaaaatggccgaatctttgctcaaccctttgggggaggacgacgaggactttgagagttcgtttcgcaatacgtacgctgaaaaacgacgaaaaacaattcgacgctttttcaggcggttatataatcgaccgaaatttggccgttgggatgacaatggtggacgaattctatggccaactgcccacccaaaagccggacaaattcggcaaggagggcgaagtgccgtcagcgtacacagagttagcgggggtcagtcattggcactttgccaactcaatggaaatggcatttcggctcagaatgagtcccaacatcaactggtcggatctgccaaattggctgctgagaacaatccgagtgttttggaagggacggcggaacgccaaacgccgccgacaaaaagtgggagagattaaaaacaaaatatattaaaaacatttgtaaagacgaacggaagcgcagcagcattttcgggaggtttctgcaaagggcgagcggcgatcgaattggcacggacgacgcgggacggaagcggcacaatcggtcgctgttcggcacacgacggcgatcggcgacaacggcgggcccaataagtgccgaagagggaaaagaaaaaatggtaaaggcacttgggaaaaagtaaacgaaattgaaaaatgagaccaaaactaactttgaatgaaaattcgtggaagcagcgcaaatcgaattcaatcgcttgtgcccctattcgccacttcctacgacaaaatcatttggccgcccccaaaagacaaagagacggacgaacagcagctcaattgtgaa

SEQ ID NO: 13233 - DNA, 1270 bp, Heterodera glycines
  misc_feature (67)..(67): n is a, c, g, or t
  misc_feature (108)..(108): n is a, c, g, or t
  misc_feature (138)..(138): n is a, c, g, or t
attcatgagacagcattaatgaatcctcctagtgtatttctcaagcaccgtaccatcaatgacattntacaatacatcactgatttaccagtgatttatccctttctntaatatgcgaatgttttaaaaatgtaaacncaagcaagggtgggaatttgggctcataattgacagaacggaagaattaggcgattcattcaattaattatgagaaatttggcgcatatggcctcaattaaaaacacttgcatgacaaatttattatcaaaaatgaaataaacaattaataaattctgattttttattgttcgttattatttacttttttgcgctttccagaaagaataaataatcacaacgaatttcgcactatttttgtcccatatatgtccgtccatcctttgggattaaaaggagtgaatttgctgctgctttaatgccctcttccttttggcttctccctctgatcaatccattgatcgttcggtggcattgactgatcggagatggatggatgactcatctcctgctgcttttccctgcttaatttgttttgttatgcctttggcattgccaatttctctcactttttgtgttcaacaactgttcaatttactcatgtcaatctcttcttttcgatctgttcttttggctatgtctcaatgctctccattttttcctcttctttcgacggacggacaaattaataaattgttttattttgggataacatttaattattcatttggatattaatgttttgtagattttgtataatttcatcaaatctttgagaaatgaaaattcattgcatttttttcattcttcttatcaacgaacttttcgttgttcctcttatttttggacaaccaattaaagaaaaaaggtatttttaatatttgcttaaattaaaaaaaacataattttaaaaataaatagtcaatatggattaacactgtcaaatcaagctgaaattttaatggaaatgtgcatccttggaattcgctaggtttttttgagttgaccaaatttgtttttccaaaaattttccgattttcagtgtattagagggtgtcccggtcactctaaacgaatgatttgaccaagttggtgttgaaatatttttttgtcggcttcagcgggaattagcttgaaataattgaaaactccttttcaaagtcaaaatttggcggttttttaacaataagtgattctatagggataaagtttttgaatgatttaaaatacaactcaaattaatgccaacatt

SEQ ID NO: 13234 - DNA, 3678 bp, Heterodera glycines
aatgcagtaaatttgaaacaaatcgaataaaatacctttacgagaagcaaagaaaataatgatgagccatcaaaaaatgaaacattttctttcccgtacctaaaggtgtgagggcggcggaacgggcgagaaaccgcaaataccgtatgctacagcaaccaaaagaaaaacattgcaattgtgccaacaaacaccagcataatcatcctgatcatcacgagaagaaggtgcactgaacaacggcacaaaagagtgattgcttgctgcccgctgttctcgaggcgctctttcaattttcgattcccaaaattttttcgtcagagaactctcgaacatttttcccggtccatcacataaatacaagccaaaaagaagccatatgatcgatcatctctgtacttttgtccaaatcaagaaattgctgtgttcatcatccccaattaaccatttttttgtctccaaattcgggtttgattatttgtttaaaatcttttttatttattgtaaaatatatgtttgtgccttttttttgttgttaaatccattttggcttttccctttctctgcttcctgctgtcgttgtacagcttcgaccggttgaatgcaccaaagttgggcgggaggaagtgctcagctggatttattttttttttttaatttgcattttttcgctaaaattggcaaatttttttgaccctggcattccaaactatgacctgtatgcatagtcgaaaaattgaaatcagaaattatacgactcaatttttcaattatgttcagtgatgccatcatgggattccgtttttcgaatttttggattggaatttcgatttccgaattttttttgggccttggaattgcaccccctgttgtttcaatttgaaaaagcctatcacgtcacacatttcgaattactgtgagtaaaaagtaacaaaaaaatttcttgttttgaaagccgacaccaaattttgttctgaacttacccgtctcgtcagtgtcggttttgttgctctcaaatgttgttgttgttgcggttgcgtcggttgtgccggtgccattgctttgccatccttctgctgttgctgcttttcttggcattgtggtgtttgccctctgcagatcatcatcatcatttgacaactgccaacagttgtattggttgcagcagttgttacgctccttctgctgccggtactgctaccattgctgttgttgctggtcggtgttgctgatgatggtttcattttctgaaagtcgaaatttccgtcgtttttttaagtaataatttttgatcataaaaaaatcaaattcccaaaaatatttttatggaccaaaaacgaaacatgaaaccaaaaataccgaaaaagggggaccaaatgaaaaacaaaatttcatgcatccttgactcgcatttgggctgggccgaaaagcttggcttactatctgaagcctatgttcaaacccgagaattttcgaaaatataagtaccgcaactactgctgcagttgctgtcgctgttgcacatccgccaccaattgtcgtgacatttttgtccgttttaaatggaccggcggatgccgtaactgttgccttttggcccaaagtgccgaccccgccatgtgctgctgctggcttctgcacctttggttggcacgctttcacctgtgatggcttcaacggccgatccggcatagaggatgatgaggaacacatctgttgctgatgtggggctcgcttctgctggtgctgatcagcctcaatcgtcgtcgtcgttattccatggacattgttgttgttgctgttcggtttggcaacaattcgaatccgacacaccgctggtgcgcattttggtgccgacgatgggtcggcggttatgttggcagtgcactttggtgccggtgccaaattgttgttagtccgcttttgtgccgttcgtagaacaccagcagctgctggtggtagcactcgtaaagcattcggctttacatttattgttgatgcagcagctgttctgttgttattcgtcccaaactgttgctgttgtcctccaactcgttctgacactgtttggccatgagttcgttgagcatttgcctttactcgttgccgtttttgttgttgcgtctccgccgtactgttccgatcggttaacaaatgcttcttcgctttggtgctcatcgtcacaagtgccggtgatggtggcactgcttcattttgtaacaaattttcctcttttggtggcatattttgctgttcccggtgttgttgccgtgccgaaaatttggcttcttccgtcggcatcgtctgcgatgccagtaccaatttctcatgctgaagcgtcgaattagccatttgttgtgccaccatttccatatgcttttcctcctgttgctgccccttcttttcctcatctatttttgtgcactttgtttctctggcactaactatttcctttctcatcagtgcctggtccaccactgcttcaagactttgctcaatgattatgccgtcttttttcatttcagcagcgccatcagcagttctctcgacggcactctgcaatttttttgtaatattaatgccgatgatgaagcctatgaattttcatggagcaggatagaatttgtcgaatttgactgtgatggctcgcagtttctacctcatcgagcccgttgaggaacaagcgagcatcaagcaacggcgtgactgaatgtgccgtcctccgtcgtcgcacttttcccggcgatgacggagggcagcatgacggcgtttgttgcctctcccgttcgtccacaagtgcaaagcttagccggtcacgctttttgatcacactgtaaaattcaaatttcattttacctgtgtcatgaagggaataaaatgatagagtttttctattttttaggcatggaaaaacatattatgtgttctaaaatacatacaaccataaaatgcgcatattccaatgaataaattacaattgtaaaatacaaccataaaatgtgtatttttgttaaatcgttacaattgtaaaatacaatcctaaaatgcttattttccatgattaattacaatacgcatttggtcgtgtcgttacaattgtaaaatagaaccgtaaaatgcttattttccatgattaattacaattgtaaaaaggcaaaatacgcctttcaatatatcactacaattgtaaaatacaaccgtaaaatgtttatttttggttacaattataaaatacatccgtaaatgctcattttgattacaactgtaaattacaaccgcaaaatgcttattttccatgatgaattacaattgtaaattacaagcttaaaatatcattactttcttactgtagccgccagtctctcccttttaccttttcagtgccatcccatccaaattgtcaggagacgatttccgaaattggttgtttcccatctccaactgttgttgctgctgctgctgttgcaaattccgctccataaatcgccgattgtccttataatgggattttcgtcaaattaacttagaatacatataggtacagtaagttgaccgtaaagcttggattttttttttttgctaatttgggctatcgtttttccgtctaattattgtttaattaacttcactatgccgtaattgcatggtaattagctaattaattaattgaaaaattgg

SEQ ID NO: 13235 - DNA, 3954 bp, Heterodera glycines
  misc_feature (3936)..(3936): n is a, c, g, or t
cctcttttaatcactgttcttcctcttttaatcactattgtacctcttttaattacagttgtacctcttctaatcactgttcttcctcttttaatcactattgtacctcttttaatcacttttgtgcctaaacgggcgctaagcgcccgtataagttcaacagatttaaaaaacgggcgcgaagcgcccgtccaaggccaacaaaaattgaaaaacgggcgcgaagcgcctaacaagctaaaaaacgggcgcgaaacgcccgtatgagttcaacaaatttaaaaaacgggcgcgaagcgcccgtcttgagcctcaatgtggactaaaaacctctaataattttttaaaaattcaaaaaatctctccaaccaattcgatcaatttgaatcgcttcacagtctaggtagcgaagctccgaaagcgcgaagcgctttttcccagctaaatagccgacggttcacgcacccgctattactatatacgttatattgacaaggagtttcgtttcaaaaactaattccgaccggccgaaggccgggagcgccctgaaagtggtggaagggtcttacaactttttgaggagaatccaggaaaactatagagaaaaattctgcgcggacgactgagtcccgagaagcgatttgtcactttttcttgcagtttttcttctacgaaattttttctttggaccgggatcgcttagctcttgctggtaggattttaagtcagactatctccgacaactttgccagcaagaccaaagccctacgttgggcgcccaaggctgtagccttggctaattttttttacccaaaagtgtacacttcagtaccaggcgaataacgcgcaagggtttgacctgagcgcagggtggctagcagacttattgtagagctaaatgagctcgattttttcaaattttaaaatttcgaaaattttcaaaatttttcaagttaggcctaaaaaacgattttttcgtttttgaattttaagattttttaacgatttttcccagaaaaacgaagaccacttccaacacatagttttttgagctctatcgactggtaattttttcggaaaaatttcgatttttttccggaaatagaaaaattttttggcctcagcgggacatttgagtcccgggcccataactcgtcaggggtcggttttagacaaaaattgccttagagccaaattgtagagctttttaaactctatcgaatgttgtacaatctgttcggaaattttcaaaaattttcgagctaggccccctagaaattttcagaaattttttttgggtttaaaaagagggtgaaaaatatttttctggggtaaattagggtcctgagcacaaatatgatgtttattttaagtttcagattttttggaattttttaaaaattcaaaaatatttttcaatttttcggccctcgggattttgggcgaatatttgaaaattcatagctcacttcactgtgggactattttaatgaaataaagctttaaaaatggagaaaaatatggagaattttatgggatttatttgaaatttatatctcaaaaaagaaaaaagttattccagaatttctggaaaaattcgaattttcagaaaaaaatttatacctcggttctgaaaagtcactctagaaaaataaaatactacaaaaatccgcaattttttgctctattatataaattttatttggcctttttatcacttttttaagaattgttataaaattcgctgggaatggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaacatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaaaaaatgatccaagtgcatcatcctgctgtgcaggcatataagcaggcgcgtgagcagctcactgagcttctccaacaacaaaatcaggaagagcttcgtttcttccgcatgactttgttggatagccgcagggctccagctggtcttaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgttcagaatgcatctggcctatttgactcggaagccgagtcagataatgagtcgtgcgagactcagtcaattgcatcatctgatgcggggtcagtcgcagattcagatgctgaatctgtagcatctgtttcatcgcagcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcgtagacctgacatggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattanatacgcactcaagtaccc

SEQ ID NO: 13236 - DNA, 3820 bp, Heterodera glycines
  misc_feature (68)..(68): n is a, c, g, or t
  misc_feature (103)..(103): n is a, c, g, or t
  misc_feature (2625)..(2625): n is a, c, g, or t
  misc_feature (2662)..(2662): n is a, c, g, or t
  misc_feature (2678)..(2678): n is a, c, g, or t
  misc_feature (2708)..(2708): n is a, c, g, or t
  misc_feature (2826)..(2826): n is a, c, g, or t
  misc_feature (2840)..(2840): n is a, c, g, or t
  misc_feature (2852)..(2852): n is a, c, g, or t
  misc_feature (2902)..(2902): n is a, c, g, or t
  misc_feature (2908)..(2908): n is a, c, g, or t
  misc_feature (2913)..(2914): n is a, c, g, or t
  misc_feature (2916)..(2917): n is a, c, g, or t
  misc_feature (2925)..(2925): n is a, c, g, or t
  misc_feature (2927)..(2927): n is a, c, g, or t
  misc_feature (2931)..(2932): n is a, c, g, or t
  misc_feature (2948)..(2950): n is a, c, g, or t
  misc_feature (2953)..(2953): n is a, c, g, or t
  misc_feature (2956)..(2956): n is a, c, g, or t
  misc_feature (2958)..(2958): n is a, c, g, or t
  misc_feature (2962)..(2962): n is a, c, g, or t
  misc_feature (2966)..(2967): n is a, c, g, or t
  misc_feature (3798)..(3798): n is a, c, g, or t
agcgaaagatgccttagagcaaaatgtagagcttttaagctctatcgaatgggtaggatagtcgaganaattcaaaattttcgagccaggccccctagaaatnttcggaaattttttttcggacgaaaatgggggtgaaaaatatttttctggggtattttgaggtgctgagcacgaatatgacctttgttttttgtttcggaatttttggaattttttaaaaattcaaaaatattttccaattttttggccctctggaattttgtataatattggaaaattcataactcagtgatggtttcatcgatttaactataataatgctttaaaaatagagaaaattcaggagaattttataggatttatttggaatttctatctctaaaaataaaaaagatattccagaatatctggaaaaattcgaaatttcagaaaaaaaatcagaactcggttctgaaaagtcactcgtgaaaagtaaaatactacaaaaatccgcaatttttttctctataggataaattttatttcaagtttttatcatttttttaaaaaaagatacaaaaataaaagtgattttgggattcgggaccaaaggggggagcacatggtttttgagtggaaaaatttttctcacaaaaatcttccaaaaatatgtatttaggggttatttgggccgctgatcatgaatacgtaatcagattttacttttgtcattgtttagacctcagaatccccgtgtgattggggattctgggcatcattttgagggggggtgggaagttcggatccgggcggtgtcaattatttttctttgcattttatcattaagctcaaagtctataaatggagtggaaaatcgcttcctcggatcatttttgaaaaacctagcgtaggaatcctacgctgactaatgacatagcgtaggattcctacactagcctttcctacactaggctaatgtagttatcatactcgagctcaaagtctataaaagggagtggaaaatcgcttcctcggatcatttttgaaaaactagcgtaggaatcctacgctgactaatgacctagcgtaggattcctacactagcctttcctacactaggctaatgtagttcaaatgcactagcgtagagtatccagtgttttagttaattggcaacctgaataaagcagtcacttttacaggtgctatagtgtagagtgttctatagtgtagagtgtaggtgtgttctatagtgtagagactcactacactacactttacactactctccaaaagtctatataagcgcagcgaaattgcacatccgcagtcacttttacaggtgctatagtgtagagtgttctatagtgtagagtgtaggtgtgttctatagtgtagagactcactacactacactctacactactctccaaaagtctatataagcgcagcgaaattgcacatccgcagtcacttttacacgtgctatagtgtagagtgttctatagtgtagagtgtaggtgtgttctatagtgtattgactcactacactacactctacactactctccaaaagtctatataagcgcaaagaaattgcacagccgcagtcacttttacaggtgctatagtgtagagtgttctatagtgtagagactcactacactacactctacactactctccaaaagtctatataagcgcagcgaaattgcacatccgctgtcacttttacaagtgctatagtgtagagtgttctatagtgtagagtgtaggtgtgttctatagtgtagagactcactacactacactttacactacgctccaaaagtctatataagcgcagcgaaattgcacatccgcagtcacttttacaggtgctatagtgtagagtgttctatagtgtagagtgtagattctgcatttgtactgttactacttgtgttgattatataaaaaaaataaaccttcaaagtctataaaagggagtgcaaaaatcgcttcccggatcatttttgaaaaacctagcgtaggaatcctacgctgactaatgacatagcataggattcctatactagcctttcctaaactaggctaatgtagttagcatactcgagctcaaagtctataaaagggagtggaaaatcgcttcctcggatcatttttgaaaaacctagcgtaggaatcctacgctgactaatgaactagcgtaggattcctacactagcctttcctacactaggctaatgtagttcaaatgcactagcgtagagtatccagtgtaggatatctacaagacattgtgttgatgctacatttttttatatgtttagcaaaatatttagttgacagcgaaattatatttctattccatccgagggcagcacagtcagatggacaacacccacaacaacaacatgtcttctaaacaaattccatccgagggcaaccagccaaccgatgtccaattgtctgtagcccctggcagcagcagttccgttaatggaaaagaccacaaaatcttcgttggcgggtttgccttatgatactttatcttccttatttttttgtatttagtttatctattgataccacagacgcttctttgagtgcttatttttcgaaatgcgagcagccgttgcnggtcttcgttggcggggctgctttcggcccctttttnggtctcttttagttcnttggctccctgtgttttgtgttgccggcgnctgcgcccggtggtgatctttcggcgttggtccttttgccgggcggccgtgttgttgcttcttctgtgggttgtgtgctcgcgcttgtctcccgtttgcgttgctctcttgtttttgngcttcgcgctttcncgtttttcgttntgttccctgttttgccgtgtgtgtcgtgctttctgtttttggtgttcgtncctttngctgnncnncccctttntnttcnntctgttggcctgcttnnnctnctncntccntctnngtttccatccgagggcgagcagctgttgcaggtcttcgttggcggggttcctttcaaaaacttttaaagactattttagttaattggccacctaaataaaatgatgccgaagacagcaccaggaagtgataaatcgacattaatcactttaaccgacgaacaaattgttaactcaactgtgaatagaatggtcgcacttgtcacacgaaatcgtaaccatattgttaataagcagagatctaaagtttttagttatgttccctgaattgctggaagagactatcgaacatcattttataagatattttgcaaaaaaagttttcatgcagaaaattttagtgattgtctagataattgtatggaaaatacttagtaatttaccagaaaaaattttcaaaattttttcttagaaaaataacttagttagtaaatttttcggaattttccggcgctttttgccatgacgacgttttgtcccgacaacgtttcgtcgacgacgttttgtgagtcaccgactggctgtgcaaaaaacgccagttcttgagtttattgccccatttcttaactgtatttgactaaaaatggccaattgtgtggttttcgggctgaatcatggaaaatttagagaattttaacgaaatttgtttgggataaacgatttattttttcaataaatttactttagtaatcaccgattaggattggcactttttaccagccatttccgaccattttgggtcatgccaacattaacaaattttctcacgaattccatagggcaaatgtgccaaaaatatcatgaaattcgggatacaaattttttgccaaaantgtttgcaatgttgtaactcct

SEQ ID NO: 13237 - DNA, 5156 bp, Heterodera glycines
  misc_feature (3430)..(3430): n is a, c, g, or t
  misc_feature (3446)..(3446): n is a, c, g, or t
ggtcggtgccatcaaatccaggctaaaaccggcattgtgatttatagaaaaacggaacgctattgtgaacaactcaccaaaattcttgactttcacggaacagtggcggaattttggcaccgaagccaaatgccgggtaggaattggcactgaaacgatttacaaaaatcggatcagtggcgacgcaagaaaggaatacggtaataacgcgtggttttgattatgggggttacggtttttaaattgcataattacgggtaattatgcgtaattagaaagattctgatgattacctccccatactgcttcgtgtgtacaaaaattacctgttaaaatcccttaacgcgctgccaaatgcgccaatcaccagctcaacatctgaacatttatttgctatgacggaatttgggcattcgactgatttttgcacggcacaaaaaaggaaaaagccgagaaaattctaaaattctttcatgattgatcattactaagattatcaagacgagttgggcaaatggctaagtcgatttttctatgcttcgaccaacaatttcggcattggcattttctgtctgaaaactttttcggggcctgccaatggtcgggattcattccttttgaatgccgagtgacttggcttctccggtcaattagtgcaactttcacagtgtaataattataccgttaatgtaatgtttgatcaattgttcgtccacaaaaatgccggaacgagaaaagtcgacggcaaatgccaaattcagcgaagcgcccgcagaaatatactcgagaaaagagggagtgcacacctggggaagggaagacacagaagaatggagatattttaagaagaaggacgacaattaatcactgatcagagcagagaatggatttattatttttttcgaaaatttgaattcaatttttgagaaattttttgacattatttcaacctttttaaaaatataaaaaataaatgttggagaccaaagagtcccaagcattttttagacagaaacacaaaaaagaatttaaattaaaccataatataatttttaattaaaaaatgcataaatccacattttggttttcaaagttttattagctaattaattaattgtccactgggtgccaaattagcttcttaatcaccgcccacctcatggaggcggcacagttcaaaggtgccaccgttctttttttgatgtctcgagttttcataaacaagctgtgtgagatgacgaagaattatactttgatagcgccttaaaagcttacaaaataaatattctcggggccaggaccgcgccgaagcacctgtcaattaaggagaggggtaattaggctaattacacaattaggtaattattttatttgcgcctcccacatgccatgtcaaacagtaccgagtagaacagtgggaattcaccaagtgacacaggcggaaatgctggcgatttggcggtgtcccgttggaagcaaagcatgcgcaattccctgagaaatgccaagaaaaatgccaaaaatatttttggggcttctgcaaattataaaatgccctattccatttcatgtaattattaataaaattggttgatttaaaaaggaaaatttgtattacttgcgcattatgtcggttgattctgaatttcgaattcatacaatttaatgaaaaaataatttattaattataattggtatttacgtaatgtgaaagctctccacgaaacgcgagaagagttccatttaacgccttcacttcgatacaacaaagaaccttaaattgaagaatttgatggggcaacgcaatcaaacaaataagtttaacaggcagataataattttaataaaatggcaaaactaaacaaatgaaaaattattttgcactaattgaaaataattcaaattaatccaaaaacattatatatcaaaggaaattctgatcattaaacaaaattctgatcactttttgaccggcaatgatcagagaaaatttttaaaaaatcataaagaattttaatcaccttccgtttaataattaattacaatgctaatcaaaataatcagatatcataaaaagcacacacctttatgcgacggtgccgtaaacgatgcgccgcccgcctcagccgccgcgcaatcgccaatgtccggcatgagcaccgtgttggacattgatggtggtgccatgttggcccttgcattgttagcaatgccaccgttgcaaattgtcattccgtccaattcgtcggcaatattatcgcccgtcgacagtcgatgaatttcaaaaaacacctggccaatttttaagttttttggtattttgtttcaaattcacttgagccgacgaagcatttgacaaatgctttttgcttaaatttttggccacaaattggagcacaacagcgtgcgattttgagcgaattgtgcaggaaattaatgcgtcggccacttcaaagcccgactcatcattccttaaattgggcgctaatgcaaattagcgggtactgtattatagatgatgctacggtaacacatttagagacgaaaaaggttctgatcattttcgtacatcacttttctctgaattttgcagcccgtggcggagaccaattcggaaacggagaacacacagtagcccatgctgagcacatccttggcgaacagatcacaactgatggaagtgatcagaaataagttgctaccctaattaaatctttgatgagttgcaaattaaatatcatcatttagcttaaattagcttctatttagcatatattaaatatcagactatctgtgaattcagtgaattttatatacttttaaattaattagcttaaatagttgaagttcgattaatgattgatatgatttggtcattgtcggtttttatcgttaatcagtttataatttaattaacaccatcaacagctaattaaaagaaccaattaatacactaattacgaagtgattaattatttcccattggccttacatgtccagccgaatgaatttggccgtattttcgagttgaaattccaccgcaaaaacattgggcaattccgcgctggtgcctttgctcaagagttcgctggcagttgtctttaccgggacaatcatttgcaattaattagatgccattaattaattaatgattagaataaactgaccattcgccacggtctgaatttggcaattatttcaaaaaatcatgccaatttaaaacccgcgatggttgtccgactcgctttcccaagaggcacacgcaattgagccagaagcaagagcaactccaatatttccttttaattggcaaattatgggtaattagcattagagcctggaccggaatcaaggcctggctttttcctggatattgttccaggtccatgctatgtttcggaaagctggtttcctgggtttttgtccaganaatccaggcccaggcncaaaatggaattcatgtccaggctttttttcaaaatgccgagctctaattagcactcaatttgatgaaggcaaacagacactaatcaccaaagacaaaaaaactgactgccaaagaagcttgttcgcaagttaatctttaaaaaaatgattctttgtttggccatgaaagaatttcgaaatatatggttttttattttaatcattttaattgatttaaatttaaaatttgtgtagaaaatggccaaatttttattttcaataattgcttttctgatgcacctcaacttgacgtgaatgtcgacaatttccttctgttgctgactgcttttcttcgcctcatcggccctaaatatgtattaattaatgaattttgggaattttaaaaatttaatttgatttttatatcataaaataattgacattcagtttgtttataaactgttttcgttgcaacatttaaaattggcaccgttttgagctgctctttttgggcggaagcaacggcggtgcgcgggttgacctgcgcaactccaaaatttgccgaagttttgccggtggaatcattccaaaaaataaattaaaatttggtgtgataatattcagtaaataatattattgatgcaaggaaaaatttcaaaggctcgagaattaagattgaacaaagatttgatttgaagcgctgtcgagattctgagactctcgaataacccgggtaatagcggcacagaaactcaacaacaggaatgcccattaccactttaaacagttctctttcagcaggggataaaatgtttattttcaaggatgcccttagggcacgctcaaggacaacccaataaaaagctttcgcttaattatgtatcttatttggaaaaataaattaaaaaatgaatttggattaaaagtgatggtaatatttcaaaattttaaatttaaatttgacagtgaaaaaagtaaaattcgtaaaagaaatgtaaacaaaaagaaagaaaaaacttaaaatgggtagacttttgtcctcaaagcgttgggtaatttgagcacataaaaggacagtaaaaaaggagcgcacattttgtgccaaattttggggacactctcaaaaatgccaaaaaatgaaaaagacgacaaaagtgccgcccaacgaaagtgccgtcgtaccaatattttttaatatccattaaatgtttggtgcgcattgttttttgtcattgaaaatgcaacagaaaaattttgtgggttattcggttcgttttaatcaaattgttttcgtatttttttagttcaataataaaaagtgacaaaattgaacatatgaaggtaatcttatgcttcccatttgccaatttgagaaattttcaagactctcgagcattagaattgcttcgtaaccaatccggcacgacgattcacaacccaaagaaagtaagaaatgtttttgactgttttttaactctcgtttcatgataagttgcattaagaatgccgagagctttccaaatgttttcggttggctcaaaagtctcgatcatttttaattgggtcccccgaaacaattcatttttcgtcgtcgtcggagggtaaaaatgggcggctaccgcacaaaaaaaggaagaaaaaaagagatatgcgagaggcgaagtagggcattgtgtgggtcagcagtttctgtggtgatgcaataaatgccatggcgggggggggggggg

SEQ ID NO: 13238 - DNA, 2233 bp, Heterodera glycines
acgaaaaaattgcgaaatatgtactaaaaagtccaaaatatgtataaaaataggtacataggtatgtagaaaaatcccgaaatatgtaaatatgtaaataaaagtcccaacttttgttcgcaaacacaaaaagaaagtatttttcctactatttagagcatggagaagccaggaaaaaaaaatgtatttacataaaattagcagcccctaataattaaatgttcataattttttgaggcttggtaaattaaattttaatatcttttaaattttttaaatttatttttttcaattccgcaaatcactgatagaaaattagtgaaattttgagctttaattattaaattttaatactctaaaccttttctcatcaagttttacgcattggacgaacgaatcttcaacttcggaaccagtttcgactccggcaccgcttctgtattcggaaccgacttcaactccggcaccgcctctgtcggcaccaccgttcttggcatccctcccgggatcagcgaatgtctcggccgatgccgaatcagacagttttaagacagctgctctgattatggatgcgatcaatttgctgctcatctcaatcgcggtcattctgcttctctgcattatttactgtcatctgccatcattgcctgctgatcggcgttcaatttttccaacaatttggccttcatcaactttgcaaccaccagaaatttcgaattcgcacaattggactgatcggcatgcaacggaaatttttgatcagcatcccatggctgtctttgatcagtgccgttccgcaaaccggtaaccatttagaatatttgtcgaaaccgtaacattttttgcacttttctagtgatcgaaacccgtccactgacagtcagcatttggcaatttctgatcgtcactgtacccatcgcaccattctaatgatcgccaccgtactgcctttcaacagcatgccaatgatcgaagtcgttcaattgatcgaaaccctttgcgaatttctgctcttcctcggcagcgttcggtaatttctgatcagtgatccccactttttttgtctctccactgttcttcaactattcagaatccgccaacatcgcgcccaataccgttttctctggtaccgcagccgcaatttcatttttacgagtacgagtttgtgtcggaacgaagcacgacgagttgggtgagacagacgcgcgtgtgattttaaaaagagagaaatttgtaaattggctttgatttgcatgggataatgtctgactttttgaagtaatccaaattcatgcaaatcaaagccaatgattattggatatttaccataattgggttactgtagagaacactgacgcattttctgctacttaattaattttatttgttactcaaatacttattaattattatctacgaataattctcatatatttttgataaattcccattgccaaattatgcacaataatgtgttaatatttgctaaatgtagataaacttttagttatattttctatttatttccaattataaaatgaataaatttttatgtgaagtatacgtaagtcagagttgtcttgtattagactctagcacggtaattttaacaaattttatgcccaaattgctaatatatgaattaaaaaaattctaagaattgtctcaagtctttgctaaaaattatttttccgtgaaataaaaatttctttttttccaaaatttatcaaaggtccaggaaatgccatcccaaacgcaatgaataatttgatccctctcaacatatttaaattccttttgtcaaaatcaaaagttggcatttttaaagaaaatgattggttggcacacaaaacgagaaaacaaaaatttaatgaaggaacaagaagaaaaagcgggaagagaacaaataatgcaaattcaattcaattccattctattcaaattccatttccgccctctttctcgtctttatggaatttgtaaaaataaaataatttataatccaattcacacaaagacgcatctctccccccccccccccccactcttttggtccctcggcggttggttggttgggcccaaaagcaaattttattcaaaattggcacaaaagcgttgttggttggttggcctgttgtcgtgttgattgatgaaaaatgccccccccccctaactctccaccgccccattattattaaacttttcgcgacacacataagcagcggaggcggaa

SEQ ID NO: 13239 - DNA, 1396 bp, Heterodera glycines
aaaatggaatagctgaaattttatactttatctcgaccgtctggagttgactctcgatgaaattttgtcgagaattggagtcaatgagctcggcgagttgtcgaagaaaatcgagtcccgaaagtccaaccctaaaaactcctcgcggagcgtgggagggagaactatttaattgtattgtaaatacattaataagatcttgagccttagaaattaatccagaaaataattaatttttcccccaaattatgatataaatgccaaaatttatttaacatgtagcgaaggccccaattttatgccctccgtgttacctcttttggtccaacagaatatggtagtggttagagtgctgctgttggaccaataatattaaacaattgaattttgccaaatgcagaaataattcaattccaatccattttatacgatactttcggcttaataacttttccttttttaacaaatttcgcttttttcttagcataatttaatcaacttgagaaattttacaattgctttttaattgaatttaaatttttaatttttcctaattattgaaaaaaaatattaggacgataatttcgttttatttttgccttcatttaattaaacaaaaagaaaaaaactggatttagtgcaagtttgaattttcaacctttagtcattaaaaagttattttaacattttcaaatttaaaaaaaaattcgcatcttttgttttccgtttatttataaataattgttttcctttatgtttaaacttgcttctcatcagcataataggcaacaataattttttttttaatttcctagagcaattttttaagctcaacatttcatttaaatttttgtttaaatttaattcattgtcccaaaaaaaaaaaaaattaaaacagcataaaaaatacacacattttccctttaataaatttcaaaatttcaattcttatgcaataaaaaaaaacccgcgccttttacgtgcacacgcactttttgatggcacacatttaaatcattcaaattcgtcaccatctaactacagtagttcagatttttgtgcagcaaagggattaaatttaatggatctagaaacagtgtgctgccttcaaaattttgacgaaagttttttgcgccaaattcacgcgcaaaatgctggggcacttcataaagtgcgcacggcgaatgaataatatgtacatattgactttctgcacctaatgatgatggtaatgatgaacatgctttttcgctgtggtgatgttgttccattaatactgatgcgggcgcaaaagtggtgggggtggcggatttttaccgcgcgagcgcatttggattcctacccccccccccctccaacatgcccaattctccaattacaaattcacacaaatgca

SEQ ID NO: 13240 - DNA, 1801 bp, Heterodera glycines
  misc_feature (1787)..(1787): n is a, c, g, or t
catacctatcaaatcctaaattacgtatttaatgaaatagaatatcccccatcaaataaagcttcaatttctagggggttgaaaaatagagccccgagggttccaattcagtaaatacagaattatttgtgcccacttttgccgccttccaccgcctccgctgccaccggctcacaatacggctgcacctccacatacgttggcacctccgctggcacaaagcattcgccgttttcattacaagcgcaaaagttcttcattccgcccaccgttttattccagcaaagcactcgaattgcctgaacaggagaattcgggggacaattagcacgcattcagttttcctccgtggcggcagaaactattttttcaagagaggggccatgttggccaattttttttggatattaaaaattttacaacgctaaaacggaaacatttttggtgagctttggtagcagatattgtaaccaaaaaattttattgttccaaattatttcaaaaattcatatgtttttctcttaattttaaggtaaattttcaaaaacaaattattattgataattgcttcaaataaaaaaaatatgctaactttttctcataaattttttaatttttcatttcgatgccacggaattgccccctggctaataattatagccaattagtggcattaatcacactcgcctcgggctcgtaattgcttggcccccgctgactctcgtaaaacacttttatcagcgaactttttgcgccaacggccaaactttcgtcctcacaattttggaagccttgaacaaactcattaggtgagaagctttaatttttgcaatttaataatacctaaagctgctcggcttcgttgaaagttcgaagttcgtaggctttggccaaaatcgctcctctcaatgccttcaaccacaaaagcaactccgttctttggtggcccgttatttttctgctgatcattttcgtcagctaattttacattgttctacaataatttagtattattattgtatttatatatttttcttaatgccgaaatgagccggtcggttcagtaccacagtacatttgagtgccagacattttagagcattatagcttcagagaatttcttcacgattttccgctaccagtcaatttttggtgttgagtctcggaatcaattctcgatctcgagatatttctcggtctcaagataaattctcgatcttgattttcgggattaattttcgaaatcttgaaatcatttctcggtctagggagcacttatcggtttctgctggaccaattctcgatttcgagaacaattcataggtatatgattctcaagttcaattctatcgatttagatatcaattctctatcttggttttcgagatattcttggtcttgactttcaatactaattattggtttgactggcactcaaatcacatttaaatgaacttaaccaactacctattaccaaacaatgtttattattttttattaattattaaaattatttaattatcacccaccgccaactttactgatggtagagtcagattactatcgtcgtcattggttttgttctgcggttcgtttactgtagcataatgtacggaaattaataaggacaacaagcataggtatattcgcatactaaattttgtcttttgttttttgtatttctatataacatttttattatttataaattttaaatttaaaatcttattggacagaatttatttttctaaaaattggcgagaatttcgaaaatggaaatttatttnaatttaatacaaaa

SEQ ID NO: 13241 - DNA, 2019 bp, Heterodera glycines
caattcgcacattttgttatgatgcacgtgactgaaattcttattgtttgaacagcaaaagccaattttttatgcccatttcaataaattaatgtaaatttaaaattttcataaaaataaaaatcagaatttaagatttgtcaggcggtaggggccggcgggaggcgcgggatcggagccccaaaaatattggattcgggaaatttggcctaaaaagactaaaaaacagaacaaaataataaaaaagaaaataaattaacaaaaaactgaaaaattcggtaattattctaggtttttcatgtcccctgaatttttaaaaaattttccagtctaattttttgcgctgaatacgaatatgccatttgtttttagcttttacgcatttcacgtgagttacgtgaaaatttttgtgaaaatttaagtaaaaacgtgaaaatttaaaatttaaagaaacgatgtttgcaaatctcatcaacttttataatgcagattgatagagaaggcgtaacaaaaatttaaaaaatttcatcatataatctgtgacctggcgattaaaatgcatttgatctgtgactgagatttttaacttcttttttttaccataaattggagttaagccctgaccccggccttttaatccttctctccattcgccgacctttttgggccttctcccgacccatagtagggctgggcgaaacttcggtttcgaaaatatcgcggtgttttttgggcttcgaactttggacttcgccttcgaataaaattgggcttcgccttcgacttcgagtgctaagccgagcttcgcccagccccgtaaaatttttaatgcattttgttaaaaaattgaattttttttttaaatagtcaatttttactggaaaattttttaatttccgggggggggggggggggactgcctcgcccctgtccccgatccctgtgacgtgcccttccccgcgctcccccgacatgcgttctccgacgaggaatttttacactgttaaggattgattgcgttgtaaaattaaaatcaaaggatatttttcaaaaatcaagcttggttctcttccaattaaatattttcttgctcttttttgtctgtaattttatgaaaccgtccaattaagatcggacacgtagttgtccaattaagcatgagtgaaatggccgaactcaaagctattattaatcgcctatctgcaattgagaaactaatttcaacaaacaacaacaacacattggcgaccgaaatgactgcgcagttcagcgccatcgcggaccgcctcggcgaaattgagcgcaaattaaacaacaacaacaatggaattggcagtgcggaggataaggagcgaaaaaggagcctcgtgctcattggtcttccggaatcagaggaggaagtgccatcgcttcgagcgaaggatgacgcgaaaacggtggaggaagtgttggaccggctggacgtggaagtgtgcccgtaaatggtctacaggatgggcaggaggagtgacgaaaagaggaaggggccgcgcttggtgaaggtggtcctgccggcgtccaccttccaacgcttcgcgctgatgcagtgggggcgtcgtcggacggagctgaagaagagggctggttgggagcgtcttctggtcaggccatccctgacgaaggaggagctggaaattgaacgagaacagcgccaaaagaagtggatggaatttggacagaagaaaacggatgaaaacatcacgacgcgacgcggaggcaatgaaaaaaacttttgaggtcacctccttttttaaattgtttatattttaatgcaagaagtttggttaacaaatttgacaagttaaggtttttgttattagaaaataagtttaaaatcatagctgtatctgagagttggttgagtaacaaaatagaaaaccccctaattttggaaaatctacccctattccataataagatcagatagaccaaacaccttgtagggcggtgttgctttaataatatcgaatttaatccttt

SEQ ID NO: 13242 - DNA, 5155 bp, Heterodera glycines
  misc_feature (61)..(61): n is a, c, g, or t
aaagaaagtgccttatgttaattatatgactctccttctcctcctcttgacacaaaagccncaaaatgaaaatgtttgtgtatttatacctggaatttggcaccacttgtctgatcacatcatgttggaagcgtccctcggaaggcagacgaggccctccaaaatgcacttcgtccacaaagtttggtgtccttaaaaacaatggcaaaatgaaatttagaaaataagtattaaatggttagcgtgtaccaaccggcttagcccaaacagcacaaatgggttgtgcaatatgcgatgtgctgtctgtggtagttggcacagctctgtatgccgaaagccctcagcgtccgctgactgctcatcagagtcagccatttgaatggccacacatgcgccatgccacacaattccactgcctgttcaatgcaaaattctattattttgagggaattttaagaaatttttagcgcaaaaataatttctaatgctctttcgaacagtatcaagaaatttacgttggttgagaaagaaccaaaaaactatgatccaaaaatactagtccggcgacgttttgtcatttacttttcttacaattgttgtcggtaaaagtcaccgactctgaccactgactgaccaattttgatttgacgaacgccatttgtgctgtgtgacgacggcaaatactgctgctcacagcatggaccggtgcattcggtgctggtgaacacttgcaccttcagaaaggttgtgtcccccttgtcatcacaacggatgaaattcacgctggaccccttcacttcgtcaaggtattcaacctggtaagaaaatttttaaaattaattatgatacaaaatgagccaactaagaaagacctttttacaaattaaggatgatgtataataataataatatatttaccatcatgtccaaatttccgtcttccttcaagtcaaaaaacgcagacattgtaagcccggacaatttgtcattcaacgggggtaaaatacgttcaggcttcttggtcaattcaaacttcctaaaatttagaatagttttttaagtaaaaaatgatgcaatttgtgcttttttaaggtttttttttaaattttatttttacaaattacaaattttcgttataaaaaaatgttatacaagaaaaaatttgaattgtagggaataaaaaactttttattcttttttttgaggggaaacaaatccatccgcattatttagccaagaccaacctcgggtagctgccgtcgtcgggtatattttcaaaaatcattggcgttttgctgccacccggcggcgtcacggtagcgagcaaatccggaaagccgttctgcgagaaatcaccaattcgaaatggcacaatggtttgtccgtcaatctctggcacaagagtgacttgctaaactagacaaatcaattccagtctatagtaatgaacagacagacagacattgtttccccaccccatgggggggggggatacgcggggtacgtacatccaagaaattcttaaaatccaggactttcgctcacaatacaaattttttgcgttgaatattccggacaatttcccaaccttggggacccattcctcagtcttcccaggcctacaaaccctgaaatcaatttggacagttcgcactgtctgccgactgtagcaccacagtcgagcaacaattgtacatgcagcactggcacagacctgaaaatagcacatatctatattttgccattaaaatatgcaagtatttaaaaaaacgagaaaaaatttttcaatttttgtttaaaaaaatttatcaggagttagggggaatgaagtgcatccataatttaactcaccggcatcaaaatgtccaattggccgtccgagtccacgtcactgaccaatgggctggccaacgcctcaccctccgccagcgctggcagctgaacgctcaacgctttgttttcgctccaaacacctcttgagctacttaaaaatagagtttgggagttagattggattgtaaccattgtcaacggtcattttttatgctttttagagcaaatgttaattttcaaaaacgtaggcatagagttgaaaaaaatcactgtttagatttttacataaattgatcaattttaagcatttttgggtcaaatttttaaaaaatcttgtagtctggcggtgaatttttttgttgttgtaaattttaacaaatttgtcatagagtaacgaggaaggagcaaaacgagatgaacctggactggctccacacgaccaatgaacgtttgtccgctgccagaaacacaaattcggcactcaaatccttgtccaaatcggcgaaaattggtgtaaagccggggaagacaccaccactgggcaccggtggaaattggtgctcacagtgacgaaattttggcaccgatgccgaagattgatgccgaacgccctcaaggcagaacagctccgtaaattccttggcgttgtccgctaaattttgtcacgtaaaatcaggcaaaaaaatgcgaaaattggtaaaattttgatttttttttttacccaccactctttcgctgcacaaatccgagcaaatcggtgacaccgtcgccattgatgtccacaagagttggatggtccaaaaatttggttggacaatgcagcggtggggtcggcggaccagggtcaggagaaacgggggtggtgccttccaaacctaagaataagcaaaaatttaaaaaatagtacccaagttcgaatttataataattttaaaaatgaaattcgacacatcattaaaccaagctagttttttcttaaaatctcaattctataccaaaattaaaatttttttcagaaaaatagaaaacttttttcaatctcttttaaccaaaaattttgaataaaatttgaaaacccccaattaatcattaaacgttgtttttataggattttctagattttaataagttgaacaataaggaaaaattttctaataattttttctgaaatttattaaataccaaaaagaaaaacgtaactgttttcatcgcaaacttggtgctcagtgaatgtgtcgttgccgtcattcaggtacaaaatggcagcgtactgcgattcggctgtagtggtgaacaatgccttaactttgtcgatgatgttcaggtcggcttggaacgtctaaaagaacgacaaaagacaaacactgtgcacgggcacaaaagcgacaaggacaaagccaaaaacaaacaaataaagacaaataattataaaaatgtttttgtaatttgtattaccactggttttagcaaaaagtcttttgtggtccgaaatgaaaaattcgttaactttaattttcgtcgagaccaaattcgggaaaactttaaagttatgcaaaagcaaaaatatatctcaaaatacgaaacgaaacaaaaaaggctagatagaaaataacaaatgactaatgcgaaacattgtccatttattgcatacctggatgacaagcaggtcgggacacgtgtctccgttgaaatcacccacggcacaggaaacttggccaacgccggccggcaatgtcagctccgttttggacctcctaaattggaccaatagctgacaatgaagatttttggatcttttttttcaaattaaatttttttttccaattttgagccattagcctatccaataatatcgaattggttcggattcggacactttgttgaaccaacaattttaaatattagcatgtcaaactccttaaaaaactcgcttaaattcgctgccgtcgtttgcttgcaggtaaactaccaacacatcgttttgctgcaccaccaagtccgtgttgccgtccttgtccatgtcggcaatggcacaaacccgtccaggaatgggttgcattggcttgtcaccaatgctgactatggaagcagcggtcacactagccaacagggacatgaccaacgatttcggcatttttaatgcaaagttaggacaataaatgaaaaataactaaaataaaggggagaagggcatgaaaaaacatgacaaattcaataaacaaagactgtcatttggatttttgaaatttttttgaaaatattataacaaacaggtaaaatgaaaccattttcatagaacaagtttcaacaataaaatttggaaataaaaaaatatgatattgttttgtatttcataacaaaaaatgattcccgcacaaattcgaacaatattttaaccacaataaaatggcaaagtgctgaaagtatcatcaaacaaaacaaaaaatcaaatcaaatcctatgagcttttcttcaaaaatgtgacaattcggtcttttaatttgggcaaatgtttgacatgttcgtccatgcaaacgccagcgcacttggccaaattgtcactgaactgcttccgctgctgctcggacagcttactgaagtcggtgccaaattgctgatgctgcttgtcctggctgtaaaattgcaagaattagtgcgctccactttttatgaaacaaccgacaattttaattggaaaacatgttcctagaattttcgaggtcgttaatcatgactctgataatttattcgccctatttcgggtccaaaaccaaactagaacaaaaaatttggaaacaaaatccaaaatttgaccttttcagaatttgggttaagaattggtccaatttggtttttataatttgaaatttactgataacaaatggcacgaaaatttaccaagtgcttatgcatcggttaagttgatcctgtgaaaattttttaggtttttacaaaaatttttgttttattttcgtcacctgccaagccgaaaactcatcgtccactttggcaaccaccgcttggtactttattcggcattgctcctcacagtcatcaatttgtttgcggttcaaagcgcctcgtccttcataacagccggcagagcacaaatgcatctcgcattgcatcttccgaatataactgaaatagttacttaaattaaaaacttaaagcattcagttggtaccaaaaatgtagactttgacaaagtaagaaaaagttttggcctaagaaactgagaaaggtcattgattggacgcgtacactgcagagtcttgtaaaagtgccaaaaacagtggttgggtcgggaatttttgagggg

SEQ ID NO: 13243 - DNA, 1781 bp, Heterodera glycines
  misc_feature (32)..(32): n is a, c, g, or t
  misc_feature (194)..(194): n is a, c, g, or t
  misc_feature (318)..(318): n is a, c, g, or t
aaatcaaaaatttgaaaacgaaaataccgttnccatagcgagacaagcgctttcgatttgcaaacaagcgccagcgaaaagagtgtatgagtttgccaacagactgaatgaggcaatcagaactgccctcgctgggaaagtgaggagcccatacggaaaaggctatgaggggagttcatggaaagactcattcntgagctccaattgagggtaaaggcgggaagaccaaacagttattcggtgcctacgaactcgcacaacatttgaactgctttggcatcccggagaacaatcaaatttctgtagccgactctgtgncagaattatcctcaaaagttgaggcattgagccttgggcaatatcaaagagaaaatgtcaaaggagggcccgacagacgaagatgctattattgccgtcgccctgggcatttggtgagggactgcaaaacaaagaaaagagatgaaaggcaaaatagccgcgggccacaaagaaataacgaatattatgggaatgagagacattggaacaaagggccaaatggtggagaaaattctcgttttgtgaacggaagggaacaaagaaatgaacgagaattccgccggtcaccaactccgaatacgcgccctagggggtacagtaataattcgggatcccccgggagaagagtgagctttggtggaagatttgctgcggcaagaattgccagcccaattttaatggcatttattgcaattctgtctctctctgccccaaatatagctgctaatactgcagttagcccaatgatttgcctatcggatgctccctcaagtctctggtctattccttctgaccccttttgcccaacttggaccccaacagtggaaccgattcccgcaaattttgccatttttaggcaaaatacaatacagtacaaaactgaggctacggcttgtaaatgtgtgaaaacaagcatttcaagaagaattggtttctttggagggaaaatcgaagaaataagtacaagcccagtggaagtcccaacagcgatttgccaccaaatgaaagaaatgaagcattcacccgccggagacttaaatttttacgagggaaacaaaacatttagggcgacaaataattcccttgaggtgggatggtcaagctggcctactggcattttttggagaacaaatgaagtgacaaattgttatgtctatgggacagttgtgttcacccggcacggaagagtagtttacaatatgaccaaatgacaggtgaaatgactcatattccgtacgggtcattacaccagctctcgagacacggaaaaatcgattttccagaatttccagtgcaatttttcaaaagcaaagtcatggcaaatttaaccgaattgtattccccagagaatttcaatgaaacaatggaagtggccaaatttgcccaagaaatagcccgtctctctaagcccaatgcatgggaaagtccatcagaaaagtctgaacaaatggctgcaaatattgtatccagtggattgtttgccttcctcaaaggtggaatttttacaataaatcagctttgggtttttatgtgttgttgttatgtgactattacggttttgattcaaattttgctgccccaacgaattgcccaggccattcagtacctaaatttgtttggccaagctttgaatgttttcaaaaataacagaaaaaacagagacgaaaataacaatgttattgaattaaaaaatgacgaaagggcagtagaagaccgattctgaaaaaaagagaagtgcgaag

SEQ ID NO: 13244 - DNA, 2307 bp, Heterodera glycines
  misc_feature (49)..(49): n is a, c, g, or t
  misc_feature (57)..(57): n is a, c, g, or t
  misc_feature (101)..(101): n is a, c, g, or t
atacaattgtgaaaatttcaatgaaagagacgttatttttatgagccgnaaaatacnagagaaaatggtggaaaaatcagagaagaattggaaattgtttnggacagaaataaaagtgtttttgctaggcatgaatatgaccttggcacatgtgcctattgcgctccgcctattctaacaacctccgaccttccggagagggttcggccttaccccgtacctgaaaagtatgaggaggaattgaaggcacaaattgaaaaaatgttaaaatccgaggtgatcagagaaagttgcaccccgtgggctcacaacattgtccttgtcaaaaagtctaatgggcagttaagaccgtgtgtggatttccggccgttaaataaagtcacggtcccagacccttatccaattccccgaatggataaaacaattttacgggcagctggcaaaaagtggtacagtaccttggatttggcctcagggttttggcaaatcccattggaccacggacgcatccgcagtcgcatatgcaggcgcactaatgcaatcagctgatgagaatcaaatgcacgctgtcggtttttggtctaggactctaaactcgacagaagctaaatttcctccaacacatgtagagttggctgccatcgtccatgcagtccaaaatttcaaacccataatttatggagcagaactgattattttaactgatcacagaccgctcactttcctattttccaagtcaagctcaaaccccaagctgaatcggtggttaatgtcattacaggaatttgaacccaaggttgtatatttggaagggaaagcaaatcgggtggcggatgccttgtccagagtcccgattaaatgggaccaaattgaatcaaaatgtaaagaagacattccctttttgctggtgacagatgaagaaaatggttttgaaattaaccgggagaaaattgagaaagaaaccagtttagacccaattttgtcacaaattgtctcaaaaataaaggaaaattgggccgaaccaattcaggaggagcttaatgtgtattataagcaaagagatcaattatatttggagggaaatttgatcagaaaaaagccactgagacaaattgtaatcccggagaaaatgcgaaattcggtactaaaattggtgcacagggcacattttggaattgtacgaaataaggcaagggcaagaaaccagatttggtggcccgaaattggagatgatgtcgaaaattttgtaaaaagttgttggatttgtcaaaagaatggatctatctaatccacccaaaacggatgctgcttataaatggcctgattccaagttcccattcgaacgggtccatgccgacttagccgggccaatttggggaacgaatttttttattttggttgatgcgtattcaaaatttccattcgtttaccaaatgaattcgactcattcatcggcacttattaattcgctccgtgaattatttggaatttttggatcaccaaaaacgttggtgaccgacaacggcactcagtttgtgtcaaatgagatggagacgttccttcagggggaagggatacgccatttgacatctccgacataccatccttcatcaaacggcgaagccgagcggtttgttcgcaccttcaaagaaggaatgggcaaaatgttggaagatggaaagagcatcaaaattgcgcaatttattttcctgcaggagtacagagcgaccccttgctctgcggcagaaggacaaagcccttctcaaaaatttttgggaagagaattgcgtacggagttggacaaaataaaaatgtcagcaagtgccattgaacgaaaaaggcgtctgttgcccgaggcaaatcgtgaaaagaatttggttacgaaaaactttaagcccggagacttggtttgggtaaaagagccaaatggcaaatggacgcctggtgttttattgcgcccaattggtgaaagaatttggaaggtggagcctgagggatgcaccattagcaaaagtgcccatttggaccagttaaaagcgcgacgcgcagtcactcgacatcattaatacagcacgtaaatgcaatttgtatatattcaattcctcccaaaaaaataaaaataaaaaataaagaaaaaaaatttttgtttttgtgttccaattttaaagcaaaagcatttctccaatttgaaaactaattaaatgagcaacgaaaacactccgcccacgaatgacctggaggccatggaaaagaagctcttggaggggaaaagctgcgcggaacgctggaggagttgaagcgcaattt

SEQ ID NO: 13245 - DNA, 1964 bp, Heterodera glycines
gtaaaaataattccgttaccaaaatggtccgtcgttcgtcccatccgaccgacccaaaatcgaactcattttgtttgtgcgcgtacagacggacctgtgaaaatgaggcaaaacatcaaaaatagggagcaaaaaatttgggaaaaaaatactgacaaaaaaaaaatataccaaaagttcgccgtcaaaaacggcgattggcagcgaaaaagtggtgacatttgtgtgcagaatgagctgagagacgaagttggccggctgtttttgggcgtaagtgagcaaaaggacgggcagcgattggcccggggagagagtgaccgccggatgagaaacaatcgaagcctgaaaatggagaaattcagaaaaggaggaaaattcaaaaatgatcattgaatgtctatctacaggccaaattcgccgaattttactttattcgctatgaggtaaagttgggtcaaaattgaattttaaaaataattttgaaaaaatgggaattggaaaattttaaatttcttaattcttagaatattacgaaaaatttgtaaattcccgagaaacacaatttaaagtctcgaaaagatttgtttgagcaaattccgaaaatgggcaacgtgcctgaaacgccgttgtcgcgttctcggccagttcgacgccccaaacggccaggccgaagggcaacgaattggtgacggtcacttcccggcggacaatgggctccaacgcgtggtgaaaggcggtggcctccgtctcgtgctccaaatcgctgaaaaatgggaaaaattcaattcgaattttaaattttttgttagattttaaaaatttatgtctaaaacccattaacaaaatgcgtcatttaaaataatttcgggtcggaccctgtgtagatgagtgcccggaacgggatggacactttgtagttgccgccccgcgtctccgccaccaccgtgccgcgccgaaccgaaaccatcggtgccagctgagcaccaccaattgtttcagctttggcattgtgccgtccccgtcgttcaattcccatcccattgtcctcttcttcctccccctcttttgccactgtttcttcgccgcccttctgttgatcctccccgtcctctccatcatcattagcatcatcaaatttgccgtcgttctcccggttttcgtcgtcgtttgaatgtttggcgtcggtgtgccgcgtgcgcagcaaagtgtccgtgtcaatgttcacacttgcaacagtcactggtgcgcctgaggggtaaaaaatcatggcaaaaaaaacgaaaaataaataaataaaaatccaatgaaagtatttttttaaattttccaaaaagagttcacagattttttttttacttttttgttaaaatttagaaaactcagatttttcattaaaattttaaaaaatacattcatttttattgtgctatccttttccaattcaacatattttggtattcaaagtttgaaatgccatttctgggagaagagaaatgcccccatgccaccaaaattgtgtttgtctgtcgtccggcactcaccgggcattcctcgggcgtcgcttcggaccgaaatgggcggccgtgactcgaactgcaggtacacgccacggctctggccctccacataaaccgactcaatttccacgccacgctccagcgagctgaacacgctgaacgcgcgcggacgcaccggcccaccgcccgcccggacgaggccaaagtcgagcagatcgaagctgggaaataggccacgccgacgggtcacctgtgtttggggcaaatctgtacataaagcagtgcccgtcggcaccggccgtccgctagtcgcttcttttttctcgaaaagtgtcatagaccccggtaaacgcatgacatgctggccctacgcgacattacccggacaggcaaaccccactcccatgaaaaacaagaaatttttaaaaataaatattagaaaatttt

SEQ ID NO: 13246 - DNA, 1923 bp, Heterodera glycines
ataagaaaaatttcaagaaaaaaaatgtttggaataatttttggaaatcagagtaatcaccaaaaaaaaaattttagaaaaatttctgtttggaaattttaaacaaatttttgggggtggaatgaaatgcacccagacattacacttggctcacctgcactccgattgcgacaaccaacaattgggcaaatgggtcgtccccttccccctcctccccggcgttcggttgtttcttgcgatggttgtgccaaagttgaccttgctgctcttttggcaccgcctttttggcatcgctatcatcgccgcccatttttctgtcgtcggacccatcgtttttttgctggcgttgtgccgtggcatcgtttggtgccgatggcgaggacggggaatgtgttgtcctccaaccatcgccgctgcccattctgcgcagttttgccacaataaacgcggtgctgttccgttccaagttgcccaacactttggcgtgtccaatttcgcgtgtttcaaagggacgaaagcgctgaaaattaggcaaaaggatgacaaaattccaaccaaatgcattcataaaagccatggtaaaaatatgtaaaaaaaagttatttaacgaaacgaaggaattcgtttcccgggtttggtaccaaattgaatttgtgttaaccaattccttgcacaaagaatggcattttaattagcaaacttccaacttaacatgccctggtaaaaaaagagtccagcattttgggaattcatgtcaaattctcaatgataaaatacgccacgtttcttgctcagtaacctctggaagttttttaaaatttcaaacagaaatttttccaataaaagttttttgaaaaacaaaaaaaaactccaggtgggggagagggacgacttgctccgaatttatactctgtaaatcgtaaatccgcatggtaaatagtccccatgttttactcggttaaatggttaaatcccccatggtaaattgtccaacaagttaagtttctacccaatccatcgcttctcttctgccgccacttttgtccccgccgtcccatcgtcgcttttgcattgccaccgttgtgccatcgttcagttcaatgcgcacgttgcagtcgctgacaaacagctcggagacgaccatcgtttttgtgtgcggattgtgcagactcagcggagccgaaaaagtggcattcagaggaagatgaatgcccaaaaaggaccttaattaggggcatcaatttggtggatatatgtaatctagcaataaattcagccccaaataaaccgaaaagaagccattttgtgggaaattcgaaaattttttaaatttaaaatactttaaatcctaaagaaaaattcaaaacaaaaaatggcacttttgtttttttatgatttaaaaagcaacatattttggtatatttttcattcatgaacattttcttatgtatttttcgggggaccaaacagcaaaagtgtcaaaaagtgaatggatggataagaaatttttgttaccctcaagccaaattcggatatttgcaatgagttaatactgctcaatcctagtgttaccgtatccggtacgggtttccgcccgtctcgccctggacgcggtgggcaaatgtgccgacggacgtgtgcactttgatcagttcccgttgcgggccgaactgctcgaggactggcagaaaatagacgcgaaaagaagtgcgttgtcccgatgatagtgactgaaaacaatttgttgttggtaattcaatggtgaaaaatatgacagttttggcacaaattttattttttgcctctgcaaaaaaaaatggggaaatttgacacaaatataaaaaaagctggaaattggatttgtaaaagtcatccccagtttcaaatgaaatttgcaggttatctttgatcctgaactctgga

SEQ ID NO: 13247 - DNA, 2217 bp, Heterodera glycines
cgtcagattaattaatgttgaagggagggaaaagaacaaatggcaaggaaatgatgacaatggccggggaaattgaaatttaaaaacggaaaataatcaaaattacattttcctgaaaattggaatttttttggatttttattttttattttcagtacaaaggcaaaaataagaaaaagcacctaattaggaagggaaagctgcattttacgccagcatcacaagacgacggtcaatttatataagtcttttgaatggcacaaaaaatgtaaatttaccaaaaaaaataacagacatttttaataatggaacttaaaaaataaaaagggatttttagtttaattttcattccaaaaaatggacaattttcaaaatgaatcaaaaaatgaaacatattatcaaaacggataaattgatgaattatttgtgattttttgtcaaagaggtaatccgttaatggaaggcacagacaaattttgaagagagaaaaaaaattgaataaaattatttgaattatttcattttgtcgagataatcagccgcggattttgatagattcacttcgaattttgggggattaataattaatgtcgtcgaaatcccatgacggttaatacaaaatgcaaatcgcaaaagcattggattttgtcgacgtcatttcttgcaccgacggaatgcgaaggatcagaaaaaagtggaaattcaatcgaccgaataacgccaaatgaatacgataatccaagtaacatactgtagcgaccaaattgttgaaatatttaaaaatttgggatagaaagagggattttagtgatttatttaataatatttatgctcgtaaattctccgttggatttgcaaatgttcgccaattttttcccttatttttaggcaaaaacaaaaacaaataaaattaacaatattcatcatgattttctgctcaattctccactgattgtttggcatttggccgaaaatttgtccctttcttttggcattgtttttcgcttttcattcattcgattcactgattttaatttcgaaatttatttttggcatttctttttttctcggcaaatttcatattctcgggacaaagaaaaaagagaaagaaacggcaaaatgttaaggaaagcccagccaaaaaaccaaaaaaaaaacatttaatggttttgtgaaaaattatttttatttttttatttggcattttttctgagtttattaaaaatctaaacttttatgtcttttcgaattctttcttaaaaacagaaatttgtggtcaaaatgagatcaattaatggctgcttctccccgcctttcgctttatcgtcggccaaatccgacattaaacaaatttctgtccaatcgcttcggggaaatgccggccgcctcccatccaccgctggccggagcccacaacgcgcggaattggtggttggcaccgaagttggcattctgttgaggcggggggggggaggggagttcaattagcgttcttcgaattcccttaccattcgctcgccactgccgtcactgatcggcattcgcttgccaaaactcatccgaaaagcattccgatcgatgtccaacggacgcgggacggaagaacgaaccgcagggaatggcaaaagcaaagcctgggaggaaaagcggcaatttattggcttattaaggcatttgttggccttaccgcgttgcgcttgccgaaactcatccgaaaggcatttctgtccattttgaagctcagtgggacggtgccatcgcgcatctctcttttggccattacaaattcctgaaaaatgctcttcttagcagaagatggccatgggccaaagaatttcgcagggaattaattcattttgatgaattgccaattcaaaagtgtcattctccagggaatgccattctccgttcccttggctttaccttttcggaattggccattctcaaaatcagcagctgaacaccgacggcgaacagaagggacaaagcgaaggagcagcgcatcgaacgaaggaaaagtgagaataaatttaatctattaatttgtaaaaaaatgaattttgccagaaaattataagaaattggcgtactctttcatttttgagactaattatagttttctgcttttgatcggaagcacattattgtaaaagtgaagtgataattatgcctcagagaattaattcatttttaggttaataattggcactacggaaa

SEQ ID NO: 13248 - DNA, 1283 bp, Heterodera glycines
aaaaaacatccctctaaatctttgagataaaaaaaatgtattttaattaacttttctttataatttcctgacaaaagagatttataatcaattaattgctctaattactttaattaactcattatttgataaattaatttgcatattttgccatcactttcaatgcccccggaggggatgagtccgttaatttctatcggaaattaattaaaatattatttaaaaagattcaactgttcttcctattaatcactattgcttccccacaccgccaaaatgaccccccgctgagacagaatgccatttcagatgaataaggaaatggcatggcaccatcgaagcaaacacaacgccaaaaatcattgccaccgacaaattgggctcaaattgccggaaggaaaattgtgccgacatcaaaggcaaacaaagtggaaaataattaatggaaaatgaaacattttccaaaatatagcaaaaaaaaggcgggagggaatgctgtgatttaaaatcataattttatttgaaaatagttgtactctttatcggcaaaatatcacataaatacaatattaaaaaatgggaaagtacagtaattaaaaaagatggttatggtagcacaacccaatggtaggggggataaggatacggtaatagggatgggacgaatacggtaaattgcctcatatcacaagagaattaagaggcgattaggttgtagttgatgaaatcagagtaaagcataacaacagtagaattagacagcacaataataaaatatgattctgaagaaataacccttaccataagcaattaatgttggccaatgatcagaaacaaaaaagcattgccaatttgccatgtttttgtcattttgtccgatcgtttatcccccacccctcccccctaatttgtgccaatttccccctccaattagtctgatcagtatatccctgctgcacttctgctgggctgatcacactcgcctcatcagcggcagcacattctccgtgtagccattgcccgggtacgcttggttgccgatcgggtcgtaccgaatgtccacgtagaacatccacgcttgcggccgattgtacccgtagccataggcgtaaggaacgcatgggccggcgccggaggggagagccttagagcaaaaaatgtaatggcaaaccaaccgatagaaaattaaagtcggctcgttagtccagattaaacggattgccgcggggtgtgccatgtcttaggcgcaattgatcacctgaatagacacgccgactccgatg

SEQ ID NO: 13249 - DNA, 756 bp, Heterodera glycines
ctcttcttccccccccctttcccctctctctctttccctctccctgtcgaccttcgtctttcgcgccccatccttctcaaaatcttccggtggccaaagattgcaaattaaatgaccaacaaaaactcagaaagttatgaatgtgtaaaaatgggtggtcgaggccaatgatgacgcgaaatgcgcgacagatcatagaataattcagacagtgactgatcaccaaagtcaacaacagtgaaaggaaagagacagacgaaggcggagaagagaatgaatgggaaaagaaaagtgagaaaatcggagagatttccccgggggtttttttgagggatcacccgccgatttcatttttctgatcagtactttcacaaacttcttctgctgatcggaaattgaataattttcattatgaaccaaccgctcttttgaagcgttctttgtcgaattgatttggatgaattcgcttttctcgcgcgtctttttggatgaattgccgaatttggtaccacttaaaacggcataatttgtactttcttcgagtgtttggctcacatcgtcgcccatccgcgaaagttcccacggctccgagccgtacgccgcgccaaaaatggacaaaggcggagaagtgaccggcggacggacggtaatgtgcgacggagcggcggttgaataccgcgggacattgtttatccgacgggacgcatatcgcgaagagaaactgccatatccgtaagtgccatagccgtaactaag

SEQ ID NO: 13250 - DNA, 4099 bp, Heterodera glycines
gcaacatctggccaatgctcggaaaaaacattcatggcattgaattgcccgtcggaatttttcatcgtttgcgtcaattcaccccgtcacttctcaatgaatgtccatcacttcgcatttccaatgcatattacttttgtttcttccccgaattcccatgcaatgacaatgccgcggcatcggatggacaagcggtggccaaatggcttttcactccacttcaagacaatgtgccaaaggtgttcaactgttggttgcaaaatgatgaagcgaatttgacgtccaaagttgaagttttgattgatttggcacttttatgggcgttgggattttctgacaaaaacattaataactacataattaaaaattgtgcggacaaaaatggtcttttcctaagagaaaagtgccacattttaccatttcatttctttatcaatttgctccatattttaggcttttgcctcggcttcatctccgtccaatttcatcatttccatttcgtttcctttgccttttgcttcctccgttgtaccatttgctctaaccaacgaattgactcgggagcaattggtgttgaaaagaactgacaataaccgccgttttctgctgattcgggctctactccagtttatgcgtccaatcgacttttatgcgtccaatcgctttttatgtatcaaattatgtttttttgccaaaataaaggttttatgctttcatgagtcaaaagtttgccacactttttatgggcagccgctgcctttttccattagtcggcattgagggcagtcgccgtttttccattagccagactttgtcgaccctcgtgacagacaagtgcatacccaaggcattgaggctacgtgggggtctctgaagacatctcttcgccatttgcgtggctcaaatgaggatatgttgccgacatatttgtatcagtatatgttcagacgatttcacggaaattccaaaatatatcagcatattttggaagaaatgagacgcaattatcccgtgtagtgtaaaagagatttttttacaaaaactggcaagggataataattttcacatggtaaatattattggatacataaaaaatgattggacgcataaaacattgattggacgcataaaactttgtttggacgcataaaacgtgattggacgcataaaagtcgattggacgcataaaaaacaattggacgcataaactgaagtagagccaaatccggtatcttttttgcataaaaattccttattagcctcattctttatcattttcgcccgcacaattgtaaatcaaatacattccaaggtgttcgcccccgaaaatgcatcatggaaattatttttaaaatatttatttctgtaacgttaattattgtaatagatcgagcccggatttttcagcaccaaaaaatgacagcacttaattcagcatcaaaaatgctaaattaagcacgaaatatgcatgaaaatggcaaaataagcattaaaaattgaaaaaagcataaaaactggtttttagacaaaaaaatttgtcagataacaataaattcaattttccttttcgtactgacaattataattttttttagcaaaaattgacattttaagtcaaaaattttgtcaaaaaaaatttggggtgaatttttgagaaaattattcattttcttagtgatgtatttttggaaaattaagtcgattcttaagagggtatctttgaaaatttttaggtccgttctaaggggtgtatttttttctgggagacggtgttttcaaaaacatactattgtataaagggatcctagtaaatttgtttccatatagaaagggaatgtgccaggcccgaataattaaatggtgtccttcccgaatttaggattccccgggattattgcgatttccccaatttcctattccacatttaattgcccagttccctttaagtaattctccgctctttatatttccatgtccttttctttaacttctccattatccaattaatacgatcgatttatttatttaaaaatggaaaatggttgtgattgaaatgtgaaaatggaattgcgaatttaatatgaaatcggtaaaaacggaattatgagtttaatgtgaaatcggtgagaacgaaaaagatttgagttccaaatgtattttagtgaaaaatagccaaaaagcaaaatcctgagggacggcctgggatgggagtgggaaggaaaaccaaaggggaattttatccggaatcgaaaaagggactcgggataacgataaaaaagggacggagaagaattccttctccggagttgctagggaaagatgtccggggagcgccaactgattctccattttccacgggggaaagaatcagcgaaaatgctgatccttaaccccgccttttttaggggtactgtaggttacaatagcgacaaatacaaaactcaaattcaatcttcatcacaagtttaatcatttctttctaacaccgtcattcggcctaagcctaaagcctaggcctaaccaaagcaattgtaagagttatcgttgtaatgggagcaaatgtaaattatattgaagaacaaaaaaattaattaaatcatatttctacagaattttccgttccccagtttttttttttatattttttgttgtagaaaagatataaattaacaaaaacgaatgataaataattcacatttaaaattgtattattatacatataatacaaataaatattcaagtttaaacgatccaacgaatcagaaatattttatgattttttttttattacctcttttactttttctttgtcatttggtgtgaatgattcacgctaaaattaaatttgtattttgaataattaaaacaatatcacttatcaattagaaaatatttttgtaattactcataaaatcaaaaaagtaaaacatttacctatttttattttaaaacttcaaaatcgactcatttgtcagctgcttaattaaaaatcctaccatcttttattaatataattttagcttttacctgtccaaaatcttctctgtgattgagtggaaaaccattctaaaaatatttttttaacaaaattaatcgaatttttatttcaatttttataactgcatctgaaaatgacaccgaatttttatttcaaataagaaaattaaataattttaatttgaaaattatttttaaaatttgccatttgaattatattgaattttgaataattaaaaactaaattttcaatattccgggtttaatggtcaaacacatcatggccaaagctcactcatttctatttcgagaatctcgtgaattccaaatttgctattttaagcctttgcaacaattagaattaattcaaaaatatataaataccattaatgttgatgtgagaatagctatccgttcttggcatggaattggtcgactgatattttttcgatggcatttgctcacttatcatcggatcgtattttgaaacgcaaaccccaccaaaagtgccattggtgttaaagaaacaaataaaaatgaagactaaaagcatgtttagcatcatttgaaccgcttaaataaaaaagatatttttaattttagaaaatttagtaattaaaattaatagagctgcttgagataaaattttcgggacaagacaagcaaaacgagaaacaaaaagtcgagcaattttcagctcgagaattgagagcgaaaatttaccccgggatttcaagaatctcggtcagcctttaatcggcatcagattagaaatttgtttttctttttattgtcccagagttattataatgttatcagaaattttgctctgttaagaatttttttttaatgtattatgaagaaagaaataatacgaccaaaaaaaggctaaatttttttataaatttttgtttatgataaatattaatagaaagctataatgttaaaatttatctagcataaattaaggaaaaaataaagctttagaattattatacatacaaaaatttttaaagtaatctttggcttctcaaatcaaaattttttattaataaaggagaaaaaaatgaaaaatattttctggagttatcccaaatccgac

SEQ ID NO: 13251 - DNA, 2856 bp, Heterodera glycines
tattatttttataaaatactttttcagaacagagttctgaatttttttctgaaaaatcgaatttttccagaaattctggaataacttatttattttggaagatagaaattccaaatgaatctcataaaattctcctaattttttgctatttttcaaactttattccactaaatttgaccaaaagcgaagtgagttatgaattttcaaaatttcactggattttccagggcccaaattgtgaggatttttcaaaaatttttaaccaccttccaaaaagtctgaaaccaaaaataaagtatatattcgtcttcagcaccataaattaggccataaaaatgcattttggctaatttaggagcaaaaaaatttttcatgaaatgcaaaaccatggggtcccccctatggttttgaatttcaaaatcacaattaattttataactttttttagactcgtgataatgagatgatataaagcacattatatagggcttaaaattccctacaaaaattgtctaagaagattttttgctaaaatcaactcctgccaagttatagacccaaaactgaaataagcgctcatttccagaaaattttctatttctaaaaaatttttgaaaaatttttctgaaaatgccaccaatcgatagagcgtgaaaaacggttgcttgaaagtggtcttggttttcccgagaaaaatctacaaaaaataataaaattcaaaaacggaaaattttcgagggggcctagctcgaaaatttctgaaaattttcaaaatccgaaaacacggatggatagagctcgtcgagctgcacaaaaaagtaattagcaccatcacgctcagatcaaaacacaccgagttattcgcgaaattcaaaaaatgccaaaattggttttcaaaattcgccgaagtgtacaggccaggcctttgatgctagggcctcgcccaagaagaaaaaaatttcccaaacattccaacttagtcgcctcccagcagaagttttttgctccgggttcccagaaaaaagttttggcccaaaaaccgcatgcattttttataaaaaagccatttcagcgccgctggcgctcagttggcctccggaccggaatgccattatttttcctggatgcgcctcaaaaagttgcttaagcaatgccacattcccgagcccctcccgccagcggttcccgagatttttgttttagcaatgagttgccttgtttctttagtagtatataaactagcgggtgcgtgaaccgtcggctatttagctgggaaaaagcgcttcgcgctttcggagcttcgctacctagataagctatggttgtggagattttgaatttttaaaaaattatctggggacttttaggccgcttcgcggcctcgaacgggcgctttgcgcccgttttttaaattttgttgggcttatacgtgcgcttcgcgcccgtttctaaatttgttgggctattaaggcagcttcgcggcctcagacgggcgcttcgcgcctgattcaaagaggtacatcagtgattaaaaaacgtacaaacgtgaacaaaaaatcctgaattttcaaagcacttgtaaaagtgacagcggatgtgcaatttcgctgcgcttatatagacttttggagagtagtgtagagtgtagtgtagtgagtctctacactatagaacacacctacactctacactatagaacactctacactatagcacttgtaaaagtgacagcggatgtgcaatttcgctgcgcttatatagacttttggagagtagtgtagtgtagtgagtctctacactatagaacactctacactctacactatagaacactctacactatagcacttgtaaaagtgacagcggatgtgcaatttcgctgcgcttatatagacgtttggagagtagtgtagagtgtagtgtagtgagtctctacactatagaacacacctacactctacactatagaacactctacactatagcacttgtaaaagtgacagcggatgtgcaatttcgctgcgcttatatagacttttggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtagagtgtagtgtagtgagtctctacactatagaacacacctccttgcaattttccaccttaccaaatttcgaaaaataagcactcaaagaagcgtctgtggtatcaatagataaactaaatacaaaaaaataaggaagataaagtatcataaggcaaacccgccaacgaagaacttttatttttataacttttttctaataaattataaaaatgccaaataaaatttataaaatagagaaaaaaactgcggaaaataatacgtaaaatttccttaagtttaacatataacacatttaaatattaaaataattgaaatttaaaaaaaagtggtagagtaattattgggaggaagcggtggttgttgcaaccttagatgtaacataacatgtaacatgtaacatattaaattagaaaataaataaacaataaataaaaatttgtgggttatttatattgaggggacagttgaagtaacatgtaacatataataaacataaaaagcattaacttcatcttatttttctcaatttttgttgttttattgcatataaaatgaccaattctattttgagttatgaattttcaaattttaacccaaattcccaagggcaaaaaattgcaaatttttgcaaaatttttttaaaaattctgagacgcaaaacaa

SEQ ID NO: 13252 - DNA, 1217 bp, Heterodera glycines
tgtgattacttctgcgcccgtcccccggacaaaaagcactttttgcaaattgtccgaaatcacctaaacactttcattttgttgcgtttaaaatgtcaaagtacacctccaaatactgaatgtagtcgtccacttcgtcctcaaagaaaggcggcttcggaagagaaaaaagcaccaattgactgcagcgcgagtgttccaaaataagctcattgagtcggattgccccgtgcattttatggacctttagagaaaaatgcggtgacggaccatcccatttttatatttctaatatatttcgcatttcggtttccagttttgatgacttttctcttttggcttcgataatttccccgccccccccccacttattgtcaaagttcgtccattcgttgacctttcttcggtccaatgcctttaatattcgctgtctcctctcagtgtcaacgcatgtctccgcttgtgcactttctttcctggaaaaagaacggtcaattggctgtgccgtcacttcgttgggtggacattgtctctgccacttggactccctccgtcgtcccttgcccttccttccgtcctttcgtctccgtttgctcttccgatgcgtcttcatcagtcgatgcctttgtctgttcctcttgcgtctcctcttcctgactttgcgtgttaggctgaaatgcaacagataaagggagtccatttgctccaaatgggtcggtcagtcactccaatgttcgcttcgtcgttcagttgggtcgattggagcgagggcattcctcgtcgttgcatttgcttcagcattttggtcctttcctccataagcaaagtccgttcgtaagcagtagtcgacagttctgggtcattgagttctgtcacctgacaatgaacgcacaaaatgaaccgtccgatcgctttcccgcgcccccaccaaaatttcggcatcgattcgcaattggtaaacgtagtgttggagctgtttcttcagttttgcgctgttttcttgcggacgagcgactgcaacgattcgagttttgcaactgcgccaaactttgctctgtttcagcagaaaagtgatcagcacacacagtccgccatctcggacaatccaataaacgtccaaatagccactcaatttaacgttgctcggaaattcggttattcccttcgccaccaaaagtgccattccattgaccgcgccagccaacaatttgtcttaa

SEQ ID NO: 13253 - DNA, 1285 bp, Heterodera glycines
cgccttcagttgcgacgcaaagtcccacaatttcaggtaacgcaggtcgaccaattcctttgaccagggcatcgactgaaggatgagcagttgcggtctaaatgaaacggcaatgtccgattgtgtgatggcacgcatcccgaacctccaattcttcggatgcgggtccttctcgggaatctgcatgagactgtattgtgccgtactcagtgccaaaccgcgaatgccatcgccccattcttttttggcacttgggggtaatcggaattagaaaattgaactatcaaccaaacgaattaccctttccattcgacatatttgtaaatgacaatgcaaaaaacaatagacaaaatggcatagtgccaatgtgtgctgaacataatgaagaagcaaagagcggccccgaggacggacaacgacctaaaagaaaagaaagtgtcgccaattttggctaatatgggaccagtgatagtaaacgaaacgaggacgccaattaggagcacccaaaatggaatgcaaagcacaaatgatgttaacgaaggcgtaacacatcagaaagaaaaagtcgagcacagccgcgatagtgtccattgcgcccatcaaaatgccaagttcggcgatgagagtggtgagcagcaagccgaagaagggctaaaactgtccaagtggaagacaacccgggcaatcggcatgcctcatttttcttggtcactttggcgaatggctggaggaagggaatgacgtcatctttggcaatgctctgcaaaagacgaggcgcacctatttgggatggacaaatggtgacgagcaaaaaacatttccatactgcaaagacattgaagagcagcaccgaaagtggacaggaaggacccgaccaggacaacccattcagtgggccatgccaacaacgcaacgaccattcgcccgtccaatgagaggccggtcctttggacgagttaagcgtgaatgggaagtgggcctacccccgaacaattttatccaaacattcattcgaaaaatgaattgcttttaaaaaaggacgcgggggagaaaagcagcgagagagggggcgagggaatgaaatgattttagtttttacctattttcccattttcaccacctattttcgcatttttagcacctaaaaatcgtatccccataaatgaccatttccccgccctttgtccacgctcttctcccacatcgtcctgagaaattcgctcacgaaaggtgaaatttcagtgaaatatatctcccacttgtctctgatcagctcgggtttgat

SEQ ID NO: 13254 - DNA, 931 bp, Heterodera glycines
ttcctaagctcgggcagtgccccccccccccattcgttactgtgtcatatggccccatcctttcttatcggtccatgcaaatgctctttcttcgctttaccttcggtgctcgtcgcactcaattcggaatcactgcgattttttccattgctgttaaatgggaagaggaaatgaatttaaaaatgatggaacgaatttgtgagaatgcattgcctttttcgaggccaaaggatgcccatcccatcgccccggtaaccaatccgaaccccaaacaatggacggagtgccaataatgaattcccgtggcactgtccgattttaccttttgtctttgccattcgccgccactttcggtggacagattaaattgctgtttcgttctgccactttcttccgcatgaatgtctttccttgaaggccttgtctgaaagaaaaaaagaggaaaagtataaattatcgaagggcgggcggcaaggccaacagaatgaattttcaatgatagtaattgggtaattaatttacaaattgatactttcatttgaaaaatgcgtgtgctttttgtgggggtggcaatgggtgcaaataaataaataaatgcgcactatgcaacgaatgcatccaattcactcatctcaactcatcctcgccctgctttggttaattgatggactaatcaaccgatcaaacgtcgattttcctttttgagcgctcgttgcggtgatcaatcgctgccccgccccaattgattaataattatacattttgtacctcacgctgtttattcaaccaactctgtatttctaaaggttggctagcagatgattgatctggtggttaattgctgatccataacaccaatgggccccccgcccacgccggtggggggggggggggaaggaggaggaaagaagcgattgtgaagcgtctgaca

SEQ ID NO: 13255 - DNA, 952 bp, Heterodera glycines
attttgtaatttaaaattttgttgaaaaagatttaatttttattaaataaaataaaaatctgaaatttcaatttattaaaaaattttataagctgtttttgtcaggttttctaaagcaatcacataaaaataattaatttattcattaattaaccaattaattttactcgctcaaatatttatatatttcgaatataaattaatataattttttttttaatatttttttgaccactattatatatttgtttcatacaatgttgtggacaacaacatttccgctcaactcaaatccatcattatttttggcaattttatgccaccatttttcatgtcattaataaaaagcttggtggacggacacacattagcacagcggcggagaattgtccacccaaaattgatgactttatagggggaaagcgatattttggagattaagcatgggacgcgtaatgggagggacattaagcctatttagccgttggtaggggaaacataggcgaaaaaataatagaaattggaataaaaggaatcgtgaaatttagaatttaaaaaaattctttattagctaagctaattaaaaaaattagtgaaaaaatttaaaaaattaaaattttttttttgcaattaaaaattataaatttttaaaaagaattattcttttagttttggaacggcaaaattaaaaaaaaaattattatgctaatgattaatcttttataaacctttcttacacagtcattgtcatattttttggtcaccccataaaattttcgaaaattttaaaattgatccaaaaaactttttaacattgagagcacagaaaaatctaaatacttcctgcaaacttaatgtttggaatttttaaattaattttgctcttttaattcgaaaaaataaacttaaaatgaattttcattttacgatcttccactgaaaaaagtaaaaa

SEQ ID NO: 13256 - DNA, 1860 bp, Heterodera glycines
attcattatgattctcagcatcaatttgcattgatgttgacgcaccgttttgctagcaaaataatttaaatcattaattgattaattagtgaatggatttatttatggtcgggcgggcactcaccgcccccatttgtaccaacaattttgtccaaaattgcctttctgacacaatggtacaattgaaatttttgaaactcattttgaactttttcaaatttggcattttcattacaccaataagtgtaaaattgctgatttgcttcttcttgacgctttttctctacttcaagctcagtcttcaccttttcaagttcaataattttggcttttaaactgcttatataagaatcagtgctttgtcccgcaacaaatgaagtgcctaataaattttaaaaaattaaattttcttgaagcctagaattttttgtaaataaaaaaacgtgtaaaaaaacttgaacaaaaagtctcacaaattttcacttcaagtgaattttcaggtaactcgctggaaaaaattttcaaggcgggatggtgacaaaacctacaagttccctgacattaataacatggctagaaaaatctcttgatatcaaaagatccgcccccattcgtttttgataattttaaatcaatcaaattttaaaattttatttaaattttttcttctaacatttattacgtaattaaattattaattaaaaaatttttattataaataaattgtaaatttccaacttgcacttccctgccctgagttttcttttccatctgaatcggatgagtccgggccaattatgaaatcaccaacgccaatgcttccatgcatatttatatttaataaagatataataaaaattagttttttcatttttttttttttttgcaattttatttcttacgatataaaattatgtaaataaatattttttataaattattttttgtagattaaacacgtaggcggaaattacaacaatataatcaatagtaaatatgcagaatagtttatgtaaaatgaatagtgttttaaaaaaaaaatttttttgtggcaaaacgagagttccgacggggaaaattttgaaaatttgttctgatttattaaatttctaaaaatggccaaattttgcaattttggcgcaattttttagatttttggggaggaaaatctttgaggtgctaccaataaggaaaaatcacaaaaaaattcttagcaaaaatactaatgaaacaaaaattgcaattcattgaaaaaatattaaataaatgactttttaaaatcaaattagtttgtttttcccatacaaaactgtaaaaaattaattaaaataataattttttttgttcatattgtaataaattaataataattattatattgtatattattcttttaaaaatcaataaaactcagtgtgtgtttcgcatatatcagactaatttatctcaaaaaaaattattattttattcatttttaataaaaatgatttttttttcaagttcgtcctcccgtgccaccaaagcccacagtgatcaggcacactgatcgatcagccactttacagtgggacaaatatgccagctcagcagcccaccaaccgatcattcgtttctcaattttggttgccaaaatagaggacagttcgcttcgtgttgtttccacgccggacaacagaacggtgggagaaaaacaatttataaattgtaaaaattatttttatttaatttaaaaatttttttttttatttctcataattttattgtgccaatttgaaaatgattttcatgattgtgattgaattttaagctgttaatataaagtaatttattattgatacataaatattttcacaaatatat

SEQ ID NO: 13257 - DNA, 4317 bp, Heterodera glycines
aagactgactgacttcgttgtagaacaaattccagtccacttgaacggcgacgtccaacggcacacaattgtaaagcaaatggaagtgcgaaattagcacgatgcctttgcccaaattggcgccgaggtcgttgcacatgtcaagtgccatttgggggttaaaattcgcgttgaaagtggccgagccgatttgtgtggcttcgaacatgtcctaaaatggatgaattagggtttccatttgaaatggaagaacggaacaatttcttgtcgaacaatcatctttttgtcgagcaacgattggacagtccgttccacaaaggacaacaattccgtgtcgtcagtgtgctgaacaccgaacagagaatggcgtagaaatcggaagagatcgtcgagtgaggagcaaagctgagaaaaggaggagcaattggacaatggaagacgaatgacccacacactttgagcacaatcaaatccaagaagaagccttccaattggacttggtcactgagtccgcttagacacggctcaatgggtccctcgtgcattttcttgaactaaaagatttctcatgatattttaattgccaattgcccaccgtttgtgcctctgtcccgtggtgcaatatcacaatgctgtcccctttgtcgtccaaccccgccctgcccgcccggccaatcatttgcaaatattgtgccttcttcagctgctctcttccaacatgaggacttcgaatgatcactcgtctcgcgggcaaattgacgccggcggcgagcgttgaagtgcagcaaatgacggaaataatgccactctgacaaggaaatggagaatataaaatggacagacataaagaagtggtggccaactttgtacgccccctccaccaattggcgttcgtcgctggacagtcccgagtggtggtaagccacgccgttgcgaatgcacgcactgagcaccggacagatgaggccctcgtgttcgtccataagtcgaccgatcagtgcatttctctcatcggctctatggtcacgcaattgtctgaaaatgggaaattacaaaaaaaaaacaaataataatgtaaatgccaacttcggactgaaattggacagcatttggcacacgttttcgcagctttgtttggtcggacagaaaatgagcacagatcccttgagcaaattgcccaacaatttgaacagtccgtccgggtctctcctctcgagttcctccaaatgaattcgttttttgtgacccccctccccccgcaattgtccgactttgttgcccttctccaattccttctccatcctccactcgccctgctcgtccaccctgaacagtttgtcgtgcaattttatcctttcaatcagcgcaacgggtcgaaaatgagttcggaagagattggcaccaagaaaacggcacagttcagaagcattgccaagtgttgcggacattccaatgagctgaactcgttcctgttgctgttcattggtgggacggaagagcaatttgcacagacactgctccagcaaagcgccccttccgccctgctcacccaacatgtgaatctaaggaggacataatgactcgtaaggtcattagggcatttccatttatgacaaattgggtgccaaacaatcatttatttgttttgtttttacattttcacctcgtccacaatgaccaggcccaattcgtgtgcccttccgttctcaatcaacgaattgaccagcccattagctttttcgatggtgcaaatgtaaatggatttggccgtccgtcgtcggatgggtgggaaacgccctttcgccgcggcgtattcctccacaattattcccaatttttcttcgaaagaagacagggaaataacctaaagggtaagatggaataatcggaagggaaaacggattttacatacggaaattataaggaattaattgcacaccttttcctgcacaattgccacatatggcaaaatgagcaaacagttgcgtcgccaccgcacacattccctgagcatcatcagttccgcgaccaccgttttcccggcccccgtcggcagccataaaacgaaattttccctcccttcgaccagtcgctcatcctccaaacattcacgttgccaagctaaaacaaaaacaaataaatattaaagtaaaaaaacaaaaaccgaaccgtaaagcgagtcaaagtccctaatgttctgatacgtatccaaaacgtccatcgcgttggacactccaacatttatattattgacccagaaaaacagcaaatgacaaaaaggtaggattaagtttaagcaacaaattaaaaatcaagaaaaaagcgaaataaaaaatacttccgaatgactgaaaagaattgaaaggaaaacagaaaaacggagtgtttaagcccagcaaccaaagaatgagggaaagaaactaaaggggcaaaaagtgagggacaatggcaaaggaataagcgcactttggacgatagaaaaagggaaaaatacgatgaaagatgaaaaagagacaatgttttacacaaatgagaaaaggtaaatatgtaaatgcattgtgaaaatagaaaggtaaaaacaatgcaaagtgacaaaagagaagaaaaaagggggaaaatggacgaatggccataaaatcacttgaacatcggcacgacaatgagaattgggaaagtgatcagcaacagcagcaactgccccgcttctccagctcgacctcctcagcaagtccaaagtatcggatcagtcccggatggagtctaaaaacaaacacttattgttagtaagtgattcgagaaacttgtcaaaataatttggaatggaaaccgaacaaaacccacctgaaatgcaatggtcggtccgatggctgaagcagaatttccccatccaaattccaagcacccgagtgctgcccctgctccgcggctttgtccgtgtcctcccctgacggaacgatgagcgcctcgggcgtgaacttccaacgggacacccggtacactttgacgtcggggtactcatcgggaatgaaacgagcgccgtacatggccacctcgaataaaaagcgagtaaaaaagaaacaattcgcaattcgcaatacctttcttataatttgtaagttggtgaaacgggagactttggggactggcggaaaatttctttttgattatttaaagtaaaatggacaactcactcaatgccaaatccatggtgccgtcattaagcccggtgtatggcgcaagaccatagggagtgaatggcgaaacgcacggaataacacagcaaatgacatgggtaaagttggcttgccaatggaatgggaaatgctcatccggagggatgcgcctgaaacaaagacgatcaaattcaaataggaaatgtccatggaattgttttaccccgagcaaatgtcgcaatggccgacgcatggcggaatgttggcgggggaggagggaacgtcgacgacggtcgaattgacagtcaaaggcggttgggaggagctgagagcgaaggaaacacgaccgaagtatgtcgggttgcggacggaggtgcgcagtgcggaatatacgtagcggacgggccccaaacatcggtagctttccgagtcgcgcaacacatcgccaagcctaaaaaaacggacaaaagcattggccactcaaaaccatttcgtcttaccatccgcacgaaatcgcatcgccagaaaatcgtgaaagcagcccattttcgtagaccgcacaaatgtccaccatccgttcgtttcctaccgccacgtgaatggcagcggtttggtagtcgttgactccatgcactgtcgacacaatcgaattggccgagccggccccaattatgcccagccgaatgcgtggcctctccaacacggtttcgatgttgttgtaattcttcccatgctcaatttgtgtgctaaaaaagatgttaaacttcttgtttatgttaaccaaaaccgaatgactgtggcggagagaatttcgttgaaaaggccgtcgccaccgaccgaaacgatgccgtcaatgccttcccatgggtcgacgctgaactcgcgcacaatttccaacgcgtggtcggccctttccgtcttgcgcacttcgtattggatgttggccaatttgaaaattggctcaacctttattgtttggaagggtttaacagtaagccattcattataaattcgacctccttctcccaaatggaaattgcgtgtcctttgccaccgaatgggttgatgaacaccaacagacgtttcggtcggtgtttttgggctaaaacttttcagttttggcgtttttattaaaaaccaaaaa

SEQ ID NO: 13258 - DNA, 2669 bp, Heterodera glycines
  misc_feature (2641)..(2641): n is a, c, g, or t
  misc_feature (2663)..(2663): n is a, c, g, or t
aggtcgccgatgggttcaccgggtgaaaccgatgcgagtggaggcgctgtttgtgttcccgggcgaacgttacgacattctaatcaggtacatgggccaaacgaacacttattagccggattgatcagcataaaacgaattccccccaattcagaggactcatttcccctcgtcggcgtttataccgaataattgtcgagacgatggaatacattaattgggattggactcatacgaaagcaccgaccgtagggcttgccaatttgtactatgaagactttgttggcacagaaaaggcagtagatgttgacataggttggcaattagcgttattttccaatttaatttcaaattatctaaaagtggattggacacatcgccaatgcacgcccgaggcaaaatgcaatgtgctgaattgtccctttgagcagtttccgccatctttgaatttgacttgtgtgtccgcccatctgttggagagtgcggaaccaatcgaagacaccgaacttttggaacaaaaagtgttccccaaggactcgtttcacgtaaacatgcgtaattaattaattaattaattaccctcatagtattcatcaattaaaccgtcattaatccgaaagagtcgtccaacggaccactcccccctcgtcactaattgttaaattattatttaaaatgatttcctcacggcacaccggtggtatttgagcagtctttgtgccttctcttttcaggaagtgttcgccaatatgcacgcggacaatcacttcgacggttggctgtttgagcatccgtttggaattgtgcgagtttggcacaaaattcgcacagaattgcgcacgggcagcggcaagggctgaaaacttacggcccggaaggcaaaagacacgaaaattttccagaatttagatttttctttttactaattatcctgagttgtggtttccttaaaaatttttgtgtccggacgggtagaaatttcgggtcggggtcacttcagcgcggaccatttcggctccgccaattttgaactgccataacttttttgtttgacagttaactgtagccaattaggcattttgaaagctttatttgttctcgacatttacatgtcaaatttgaaaggaattttcaaaagtaaataagttatggcacgcggtgccgaaaagccaagtttttttggccataactcttttgtaaaccgacaaaaaatttttaaattttgcatgctaataaagaaccttaagagctatcgaatgataccaaaaatatttaatttgatgataatgagaaaagttattagcaacggcgccgaagtgggcggtccttgaagtttttgggttcattgcgctgcatttccataagtttaaaattatgaatgtcctccccccccccaaatttaagccgtatttcaaccgtgacaatttgagtcgtattgcacggctttgcgacacgagcgaaagctgcagcccaaaaacgaacgcacattgggtgttttaactgacaatttcggcactttttatcactttttttgtcaaggaccgttcctgcgattgttttgttcacttcaacttcacattgggctccgtcgttcagatcaccatttacaacatgggcgacatgggcaacccccacgggccggtacgatttcttagggccaaaatgcccccaccccgaaatttgttgcagggctattcgcacccactccatttgcatgggactcatttctacctggtcaaagttggcttcggcggataccacgcgaacaatggcagcatttggacaatgaacaaagacatcccatgcatcgacgataaagtacataataatctgagataactcgtatcaatgccttcaatttgtatcaggagcgttgcgtgggactgaaatgggccaactcgacttggctgggtggtaatgtgccggccatgcgccaaaggccgtcctcgcgggacacggtcaacatcccggtcggcggatatataactatacggtaagcgcgcgcgtccctttctttgactgaatgccaaatttatttccgatttcgcgctttaaatgccggctggtggttttcccactgtcatctgatgctgcacaatatggtcagttgattttctaattgtaagagacccattttaattttaaattaataaagggcggcaccgcttttgcttttcgtgtcggcaccgacgaacaaatgccgaaaccgccggacgcatacccacactcatgcggaatataaagacgaaaagtcaaattggggacgccatttttggcattctctgggtgtcaattccaaatgtttttttaatgaatttaatgaccatcaatatgtttaattgcccaaatattgtattttacatacctttttttacaattaaaatattttcatttaaataaaagtccaatgactgagtgaccgtttggccagcaatttaataattccattaataatacgttgttttgactttcaaatgccaatctccctctctctttttctttccaaatcctccaatcgcattttccttttgcgcatgagtgaatgagtgccgccgcctctaagagtgccaaaaggagcaaagtgggccaattaagcagaagggcgcaaagagaaaagctgggtgacgatggttttgccgantggtggtcggcaggatggatgnaataat

SEQ ID NO: 13259 - DNA, 2212 bp, Heterodera glycines
  misc_feature (1200)..(1200): n is a, c, g, or t
  misc_feature (2050)..(2050): n is a, c, g, or t
  misc_feature (2090)..(2090): n is a, c, g, or t
  misc_feature (2124)..(2124): n is a, c, g, or t
  misc_feature (2130)..(2130): n is a, c, g, or t
  misc_feature (2140)..(2142): n is a, c, g, or t
aaaactttttggtttaaattttttttttcgtggtgggcgaggcgaattgctagaggcctcctactgtaacagtatgcctgggttaaatgacaaattccagaatactggctctatgtatgaatgccctccgtttttttttctttttcacattttcgccttctgtagatgtatgaagtgccattcccgtcgccggctcgtcctcgcgtgttggttgagcttggcagcgacatgatcgcttttgaaagcagcgatgacagtcaaacgccattgacgggtgctaattttgtggagacgttgaagtgccttggcacggaaaatttgctctacgccatgctgctgacactgcttgaacaaaaggtgtttttgttttccttcacagcgaatagagcaaacatcttacaattaacaatacattttgtcgaatccgtggcattcccaagatttaaagtttcctaggccttttttttgaaaaattctttgtttttgtaaattttcacaatttttcggtaactaacgacgggggatgccatatttgaaaacaaatatttatataaatttataccactttcttttgctcattgtcagcttcttgtccattctcttcgtccttggctgctcacctgtgtggcggagacactctgtgccctgatgttcccattctcatggaatttgccctacatacctcagtgcccgttgccgttgggcttcgttttcaacgcaccactttcattcatggccggcgtcgattcacggtcaaaatttgtaacttctcctttttattccgtaaaaattctatttcctagacccatttttagtaaaatttaaaaaaaaagaaggatgccttaacattcatttcattaacacaatgtttgctgaacattttaagctattttgatctctacgaggagcctccgtcggatgtgacctgtttcgacttggacactgcaacaatcagccaatcagcggttcgcaaattgtaccaactgtccatgttgccgaaaaagccgctgaagcgtctgcgtgccgcgttggacgaaattggcacaaaaattagtgaaaaacagcccaagaaaggcagcggcgctggcggcggtgccatggactacgagcaaacacatgcccgacgaatgcactccgaactggcaattcgggatgcttttttgaggtaggaaaatttgtgataggtctctttggagaggnggggggggggggggtttggaaattttttaataattttgtacagatttatgtgttgcttgatggacggctacacggattttctctgtccaatcatggattcgccgtggaaaaagggtgccaccgacgtgtgcaaactgtttgattgggaacactttatgcaatcgcgggacaaaaattccatggaattttatgcaaaatttcgcgagaccacctgcttcaatcggttcatcgaggaacggtcgggcgcaattggcggcgcggaaccaaatgaacaaaatagtgagtggcacagtagttggttatgtacatgtataggaacaactatgatcaaaaactatgaaaattttttttgagcgatgagcaaaaaaagtagggatgaaaatttcgggaaaattactgtaatcttacccaaaaataaaggctattttttaatactggtattattctgaaattcaaaaggcgaggacgcacacaatgagaacggcagtagcaaggaagcaccaacggtggaggacaaaagtgttttctatgtgttctttgacgattgcatcgcaaaactgcgagcaggtaagagggaaatgattttgaaaaaggtgctaactataaaaataaaatttggtgaagattgacaacatttttgagcgaattcgatttttttttttaataaataatttgcttaaacaaacagaggcaatgattgctgaggcagtaagggagaaaggagcacagcacacaatgccgacacgcttgttgctggacaccgaatcaatgatggccaatcgaactgttgtatggatacaattaattaattataaaaagtaaaaaaaaataataaaaaaaataaaactanaaatataaaaggaaaagaaaaagaaaaaaagataaactanaaattaaaaaatccatttataaaacgaaaacaanaaattngcctaacatnnntgtgcttggtatttttctaaaaaaatataattctaaatggaaaataaattaaattttaaaaaatctcttt

SEQ ID NO: 13260 - DNA, 2033 bp, Heterodera glycines
  misc_feature (5)..(6): n is a, c, g, or t
ctctnnagagtcggaagaagttaagtgaattgtgaaatgatactagacaaaaaaaatatcaataataattcaccaccatcgatgggatctgaaccataacagagatctaattaagcgttttcttttacgttcagttttttatataaaaatttcgtcaatttctcttctaaaaattaatttacgaatgtgagtaacatgtcggtttttttaatgaaatagcatatacttttttttaatattttgtttttcaatttagaattatttttttacatcaatagaatttcggaaatttgatatggttttggaatcttctataaaataatttttctattttaattgctttctattaacaggttgtcaaaagttcttcctgcaacgaactcggcaagaggtgcgcaaagcattgactgatgccgcttttttgcatcaacaaaatgcttcgtattggccccgttccgtgctgttttttgcctacacattgtggttcatgcaattgcctgcgctgttggccgtcaccaaaaacaaacgcaaaatgctgctactcggattacgggtgagcgagccattttggtacttttaggtcgtgcactacattccccggatttttacaatttttttatatgtatttttcttataaaaataatttataaaattttctacgaaggcaattgactatctaataaaaccaatggggggggggctcaatttttgcttctcggtgaaagctttattagagggggagctgtacattagacattagtagaaatactttattttactaaattattttgcaaatgtaaggtccttacacggatggagcaaattggagtgcctttccatgaccaagtgtgctaccgtttgttgatgcatctgtgcggcgcctatggacgccctgaaatggcgatcattgtcctgaaaagaatgctcaacatggggatcatcccaaatgcaatcacatacaaagtgtaccacaaagcactgatccaagtgggtgttttattttgtgcgtgttcagtgcccttggttagggttagaaagaaaattcagaaaaatctctagaaaaaggaaatttttctttttacaaaattttcaacgtttaaatattggccttttcgccgcctttcagagcgaatggccctccgaactgagtttgtcggcaattgctgcttggcgtcgtgtgcagtttaggctggacgtttgtgcccgctttcgtgcaatgttgcccaattcagcgaacattttgccaccaccggcaacgcatgaacaaaagctgaacgacatgacaacattgtcaaccacgaataccacggcattggaggaggaagaagaggacgatgataacagcaaggactgctcaaacattgtgcaagaaatcggtaataatttttaaaagaatccttaaaaatttaaaaaaacagacttttaaatacgtatgcaccttttaacatcaaaataaaaaaattcaaaggaattatttagaaaaatttattgttaatatttatactaaaacaaaattaagagaaaaaaaaaatttttttttttaatgaattctggtgaaactttaaggaaatttgacattacaaaatgtgcacaccctaacaaattcagtaccaatgaaaattgttgaaattgacgagcccatttgtgagcagcagcagcaactcctcaccaatcatcacttctgtaataacaacaacaacaacaataataataaaatcacaaaagggaaatcgacaacgatggcaaatgccaatttgtttgatccattgggtgcctctgttgaattggagaccgccctcaacaatgtttctattgttggcaatggcacgccagtatccaggccgccacaacaccaacacaatccaccgccaaaaccaccgagggcgtgggaaaaggttgacaaacgaagaaaaattttttggtagatagatgtaataaagatttacgcgccaacggattaggacaaaaaattcgctgcaaattatttttttaattttgaaaaaaaaaacaagaaatgtccaaaatttcggtta

SEQ ID NO: 13261 - DNA, 1541 bp, Heterodera glycines
ggggggtaatttaagcgagttttttttttgaaaatttatttaatttcccataaatgtcattgcaattggttcgaaacccaaaaaacatttaagatgatatgtcaatttatgttaaaactatgggaaaacatggattttgtttgttggaaaaaaaatttcgttttattttatttgataatttacagaaaatttggacactgtgagtcgggatgatagccttgtttcggatgcacgatcagcgtcaacatcatcagcagcagttggctcaccaagcatcctttcgttggcaaacaaaatgcgtaaacgagcaatgagaagtgagttgaatttgctgaagcagtttaacccctcgcccacaaaataagaattttttgcaatttatctatttaaatgttagttttaaaaatcatcaagaaaagcttttaactttaaaattctagcatacaacgaagtggttggtcaaggtgtcatcaacgatctgctggaacggtccggactgaacagtccggcgcaaattttcaaggaagccaagctgaacctgagccgatcatatcgcgctgctgatcagtccggtctgtcaacaatgtcctcatcggacgacaatttgttcgccagtgatcaaaccggagcaatggacttattttttgtaggcacatatttatttgtacgccttatttttgattaatattcgccataactgttttgcttgttgttagatttgtgctcaacggacacgagatccagtgtcaattcactattggatgaatgacattttgccagatgatgacgctgaactcagggatgtttggttgcggtacagtgctgggccagtcagttcacctgaagaatatttgggtattttttaaattttttttcaaaaaattaatttccaagaaaaatattataatatattttaaaaaattcaaatttaactcacaaaatttttttgtgagtgcaaaggatttttttggaatggtagcgggaagccaattcgttgttaattcaattgaaaatttttttggttgtaaaagaatgcatatagatagaagacatgctgtaatgtgaatcatcatacactcgacagcataagacaggcatttacaagaagaaaatatctaagacgagaatactaagaacagaagccaaaaatcaccactgattatgggtgagcgagagagagacctgcgcgctgaggaaatttgcagacaagcacgggcgagtaaatgaacacaatgaaattgcgcatccaagaagcccaaggactacacagtgaagtagtgccacaatgaaatcgaaaatgatctacagattttgcccacctgtgatgagatgaaacgccacaactgtgcctatttgcttgtccagcagcagagtatggcttgacccgatctccaacttgtcaatgacttccattcagtcagaagaggcctaatcgcgcgactgacgccctgccacacgcgcaccaccagtcaatccggcgcccaaaatcgaccaggccgaccctttgttgacctaaggaccggacgagtaggaatttactt

SEQ ID NO: 13262 - DNA, 2277 bp, Heterodera glycines
taacttcgtctttccgtagcgcgcagcacagtaccttttcgctatataaaagcacgcaaatatgatgcaaaacttcattttaatcagacgattttttgcaaaataaaatgaatacttttaataatgttcagcaaaacatgccggaagaatctaacaacaacaacaacaacaccagcaacaataacagcgtcaatgctaatgctcaattatggaaacttttacgaaaaaagtatattctaacttttaatctttgtcattgctgctcacaaaaattgttcaattcgacaaaaaacaataacaacagcggcggtaattaagcttttgaaactgatcagtttggaggcgttaaggtgcaatttgttatgtgcagtgggtgtgtttcgcttaatatgaggttgagcgacatgaattgtgcaaataaaaacaacgattacaacaacaacaatcgctttagaagcagcttcactaataataactcaacatttggcaatttcgaaaacaatcgcacgcactttgacactgggaataatcaaagcaacgcatacaacaacaacaacagcaatgaaagtggacaaatggtacataacaacaatgccggatggatgaattgattacctattttataacagactaataattttgctaaatagttcattgcatttaatcaccatttcatattgttctaataaatttaaatattaatcattataaatttctttaatcccctttggtgtttgaatacacccgtaaatgtgacaagcgcatcgccggtagcggcatgatgcattagtttctcttttgtgccggttcagaaatgccgcacatccctttgttatttgaatttgaccccgttcgcatcggtcaccgaagcgtcggaccttggctacacagatggccacgatcccgtctcatataaaagggcacatgggaaagtcgccctctttttttttcaccattcacccccaaaaatgaattcccagcagcgccaggcagaacgtgcccaactccgtgcaaggttaaacttgcttgtcgacgaggtcgactttgtggtccaagggctcatcaacaattatcaggccgatggattgatcaacgcggtaagttttcttttcatttcttttgctgtctttttgttttttttgaattttaattctcgattgaacaggcgccggctgatgtacagctaatggagatggataatgggcatgagcaacagcagcagccgtgggaactggacccgccaatgcctgcacagcaattggaaattgggccacagctcccggatgcgtgggaactggttccctatcagccaccacaatgggaccaagttgtgcatgtggaacaacaacaacaacaacaacaccaccagcaacaacaacagcatcagcaaggcgcgtgggacgagggatgggaggagcagctttcgccaaatgcgttagcgcagatccaggacgaggcggatgggttgcgccaggatttgagtaagaatttcgggtcggggtccctcccataaaacgaaaattaagtggttgagagatttgttcgtgtggggcagccgcagcctacgtggcccggttaccatagatgttcggaaaatttttttttattatgcactaattaataattaatttagcattttggctcgacgagggcacggcaggcattcctgaccaacaacaacaacaacagcatccgatgcagggatgggaaactccgcgcacccactttgagcggcccgtgccgcagagaacgcccagcccttcgggagatgcgccggcggcactgatcagagaattaaatttctccgatcagtgcctcctgtgcatgggtgagcacgggttggactgcgaagtgaccgttcgcggcaacaactgcgggtgtgtcacaatttgtgacacgtgctgcgaaaatggctggtgggcgaggtatgcggatgctgcgcgcgagcagtccgcgcggcagctcgaggacagcctcgacccgtggactgggctagtccgcttagatgaggacagtcagaggcgttgggtaaacacacaaaacattgattttctgataaaatttaatttggttcatgttttcaggtcgaggggcacgatgtgcgccccaagtgtctcggctgccagacgagccgaatcgactacttgatcggggtaacgcggccgcgccgctcgcaacgcacgcgcaaggccacccactgcgccttttgctgttgatggatagtgatgcattttgtaggatcacacaattgatagtatttggtgatttaaaaataaa

SEQ ID NO: 13263 - DNA, 2076 bp, Heterodera glycines
  misc_feature (1212)..(1212): n is a, c, g, or t
agtaccaatgaaacaaacctccaaatatgccgtttggtcttcctgcaggtggaggacgatctttgtcccgcgggtgacttcaggatcggcacaattgcgaatgatgaacgagccaccagctgagctctcccattggtagcaatcgtcgtcattgtgctttgatgtgacgcggtcggccacagagaaagccgagtagaaagcggcgccaaaatgcccgggcattaaagcgccaatgccagtcttaagaaacaaaagtgttttttagatttggggggggggatcaaacgaaaaacaaaacctgaagagcctccatgaacgccttcgttccggatttggcgatggcgccaagattgttgacgaggtcggctttggtcatgccaatgccagtgtcaatgatggtccatgttttatcggctttgctcgggtcgttttcgatgtcatgcgcctttaaaaaaagtttcacaaaaattatgtaaaaaattagccaccaattctgtcaaacaaaccttgcccgtagtgttgtccaactttggcatcaactgcgcgatatccgattgaaacgcaaaggtttccccggattttccagcaaaaatggcgaacacgatgaaaagcagtgcggcatgggaaaaagacatttttggaatatctaaattaaaaacaattaaatacaataaaaataacacatttaaataatatatatttaaataaattttaatgtgccaaagcaacacttaaaccctacggcattgttcctcctccccagcaagcgtccctccacccaccgagtatcgacgcgaaaattcaaatttgaatttagcgccaaaaattgtaacaaaagtacaggggtcactactgatatcgttggggtaaatagcatttcttttatttttcaaatattactagttatttacaattaatgagactctgagaatttataataaatgtattttatttttattttataatttggtgattgttacaaatttattgattgcagtaaagatttaaataagattaaaacattaaaatatgctaataaattcaatatttggtaaattttttcgcttcactttgaaaaataacggcatcaaccgttcaaaatctgctgggtgccaatttgattgacactgtgctattatgttaaattctttttgatttttttcaattgattaatgtccagcctttctgtcgaaacccttccatcccaactanataatttttaatatttttaaaataaatatttactttatttatctttttatacaatagtacatttttcttttttctatcatatgatactatatcaaattgattacatatattatgtttaagcagtgacgatttaaataaaatttctttttgaataatatgttttattttttttgaagattggcaattacaggtttcgacgattggttggttatatgcgccaaatattattaaaaatatgcacctaatttttttcttttatgatgttttatgcctttttttgtaaaataactttgataattactgattttgtgtcattttaattgtttttttccagaatgcgggcctatcaaccctctcaccctagacaatattgacatagctttttaataaatattcattttttaaatattttttggtatttctttctgttaattatttttaattaaaacattttatttccttttttttatatccattcttttattcaatagtgtcacatgaatttttgatattttctttcaatttaattatctttaattaaaacaatattcctattaaaaaatttatatagtgaatttaaataattacgacagtaatgtatttaaaattgaaggatttgcaaagatcgcaagcgggaaagtgtaaatccatttattgattagttttaaattattaacatttaatgcgttattttgaaatatattaccatggtacaatttcttaatatggtatttgtaatatttaaattgtaacatttcattaaagctcaaaaattatttaaattattttgaggttttgtttaaatgttctgatataattaattgtggaactggtaaggataaaaaaataatattaatgtaaatt

SEQ ID NO: 13264 - DNA, 4241 bp, Heterodera glycines
cctttttgttaagtgcgccgttcgttcgttcgttcagtccaacttttttgtcctcttttgcgccttttccttcagaagtgccgctcaccaatgcctttttttcctttttttacattaatttcccaatttttgatttgatccctttcatttctcctcatcccatatccctcttccccttattctctcacctctccctcctttctttctctctctctctctcctctttctctctctcctctccctcattatctctctttctctctctctctctcctctttctctctctcctctccctcattatctctctttctctctcttctatctcagtttgtctttcttttctttctcactttgctttttggcacattcgctgcgcttgattcctccgattggacttctttcagtgcacaaacattccgataaaagtccacttgttcactcttctgcatcgcccccgacactgtgcccaattgtccgatcactgcgcatgtgccatttcgccgattgtaattaagtccttcacaactgaaatgtatttcataaattttaatgtttttaatcaaaaaccgttgtccggcaccggcacacaaattcaaacatttggagagaggcacagaatgcaattctttgctcagttcgcccccgacccattgggaatacaaatggcgactttgtgggtaaaattggtatagtttgtcatttccgaaattggaaattgtcacctgaacgcggccccctcggggtcgacgcatcccattgattggccctcgggcgatgtctccaaacagtggaggtcataaagatcgaccttcagcagaacaaagcatgatcaatctcgaccagtcagcacttggccagcccacctgtcccttcggctcggggcgcagcgaaccgcggccgtccaaataaagcaaattgcaaatgccggacgatttgtcgaagttgaaggaacggcatttgtcgggagagtgagcggcacatctaagaaaggcaaatcattcgttggccggagaaagtgccggtcattcactcacttttgggcacattcgcgcacattcgcctgcaccgtttccactacgtgaatggcaccgtccccttcgggcagtgctgcatttaatgtccgcacgattttcggacttcgcgccccctctccggcgctgcactgttccgactccaagcgacagtttatgtcgaaatagtcgaccacaaagtcgtcctcctcaggaatgaacaggtccggcttagaatggcgcgactccgcgttcaaaatgcattcttgcctagggggacaaattggaagaggaaaggaggggggggggcgggggacggactcactcgttgtaataatacatcaccgatttacacacaaagttttgtcccgtctcaggaggagggctgaacaatgaacagcttcgactcgtcaattaattaatgaatattcattggctgactttgtgcattggtccaaacacattgtcactgacggcacattttccatcacaaaagaggcaaagcccaccaaaagcatttgcggcactcgcgtaaacgacggaacgccgcggcacgtacgcggggctaagaaaggagcgcatttgaggctgggaatagcgaactcacaggcaaagcatttcttctcgaaataagtccatcccggcacttcggccaaattggcacggcccaaagggcgcgagcgttcgtccgacaaaacgcaactgcgcgtcaagttactgtacatgaacgatttgcagttgaagtcgtttgccttttgagggaaggggtcatccaacacttcctcatttgtccattttcattgattcgtttgtccgtttttcgttgctttttctctcttttcgcccaattgtccgttttttgttcctttttctcttttttcgtccatttttcggtttttttgttaccgtaacacttaaccgttgcgtgcacaactcttcacattcgctcagctccaacccttcaaaactgtggtccaattcgtccgacaattggcgtccttccaccgccacgtattgcgttacgtacggtgcgtaacattgtgctgcaattgcgaattgttggtcgttcaaaatgccgcttgttttgaaattgtcaaaatgccaatggcactcacatccggcgcaattgttgtccaagtagatgaccgtgtcctcgtgctcgtccacgaaaaggtcaggccgatccaatcggtcctccgtgttcaaaatgcattccgcgtccacagggtaatacatgaccgactcgcattcgaagccgaacgtatcgaacgcattcagacaagcggacagacagcggtggactgagtcggcggagaccacctcacgcgcgaaacccaccaaaatcttttgttcatgaacgtcgaaatggaaaggcgaggaacagatgcgctcactctgcagaaaatttgggggaggaatcagtggcataatgaaaacggattgagatgtgaccgaggggactctgccaaaaccaaaacaaacgccccagggatggaatggcatggcccttcccattaataccatttggcaatttcccttggtattttggcactttcacccaccttcacacaattcttcgtcaccgtccgtgtcgtcatttcttcaccaaattctgccacggcaccttcagatgccgacttcggaccgaccaattggcattgtcctcccccgccggcggccaattgggtgtaacggacgccaacgcaatcctaaagagggacaaacaaaacaatgaacttacgccagtggattaaacatacatttgcgacggaacaaagttcggtacattcgagaaaccctccggggacgggcgccgatcggagagggacagtgccggaggcgacggaagtgttgtggtggaggaggaaaacaggcgaatcgcccgcagggcattccgacaaaagtgctaaacgcacaaaatggccattcaacaagagaccctcataatcaatcaattggattattttggcatttcatttttaccttttgtttttgctccattaattaagttaattacccctccccccaattataatgctttgttttcagtgttttccgttcgacccatagaatttgctttgtgaaaagcaattcaggtgaaggtcacccgcaagagtgtctcctcttcttcgtcaagataatgatgattaagatgacggtccgccaaaccgccgtcactggcgatggaaaaggcggcggagaacacaaatcaaaaagcaaaccccccagggctattcaaagaggaaagacattggcacatcaaaaaaaacttacgaatggactgatcggcggagatggcaatgacaaatgagagaaaaaagagagggaaaagcgatcggacggaaggaaggccaaggcgaagacaatgcctttctcttctgtgggggaaaggccaactggacaaagagaggcgcatgcttaaggaaaaatgggggaaaagccaataaaagggaaaagcgagggaaaggaaagaaaaagggaaaagcgaatattttacgaggaatttgatcggaggcttttgctttgatttgaccatatacaaacggcgaaagtggctttctcttctccgtttgattcgcctcagaagaaagcgtcaaagaggaaaaagggatggaaaatgtggaaggattgagggggggggggcaattcatcggaggaatgaaaaggattttggggggggggggagggaattgggatggacggacgagggggggggggaaatgccttcgttagcggtaaccggcggtgattctcccaatacttatgagtctactatgactatttaatcaaattttcatctctctggactattaccttacaccaaagcatggaaaacaattgtgctttttcgcatttaatttctatgcgttttcccttttcttaattttttacctgaccatagcttattctgcaaaaaaaaattgaaattctttgctcaggtatgttctgcaagaattggtgaaatccgagcgcacttacttccaggacctggcctctatctcaggttctaatcccttcgaatgccggaccaattcgagaaatcgcaaaatgcgctcctttcatacggctacatcgcctccctgcggcaaatgggactgagcgacgaggacagagagaaagtgaagatcattttcgccaacatcgagcacattctcgactttcaaaaactttcttcttgaagaaattgaaaagagtcgaacgatcacgaaccggcgggccattcttcattaa

SEQ ID NO: 13265 - DNA, 3455 bp, Heterodera glycines
cattcggctgagtcctaccgtttttatagcgcttgctttaacaagaacgaattttttgcgcttgctccgcttactaccaccctctccccgttgggaatggaaaaatttcatcatttgcgggtcgctgccaattttttgaacaaaaaatcgatgacctttcggcacatctgctctctgtcctgtcaagtacatcagtgagtcaatgtagttggacctaatcaccggctttttgaagtttgttagaatttcgccggacgacttatcgactccgtacttttcggggtttcgttcaatcatttcgtgcagcttatcataatgctctgggcctgttttaagctccaaaaatttttgttgtctctttttggttagccgcaaatcggtctcaggcgcagacgtatccgtttcttcaccaaagctggcaccattgggagtttgaaatctgaaagcctggaccgattttcgtcctatttatttatttatttttttgccatcctgcccgttcaattcttcaagcttgttgaggtttggtttctgtatgcccatatacggggcaatgttttgtggcgctgtgcctgtagcgttttccacaatcaccttttgtggtttgttctcaatcatgtccttgatctgatgcctctgtttgtacaaccacgagtggcgtttcattttcacgtccgcacccgttttattgtcatttagatttttttggatgctggcatcgatcgctgctttttcggcttgaagtgagtccgttccacctgcgccccctttcagcaggttgataagcgccaaatattcactctccggtacaagtagcatctttttagtgtgcttcattttattgttgtgccgatggagttgcaacaattttctggaccagatgttcagctaaaacgctcaaaattggcgccaaaatagctcctaaagctattccgctgccctgttgtagcctctgcctggctgtgcgctcactacgtgaacgtgcaattgctcggtaatagtctgcgtacacggccaatcgtctcctctgtcgccggttgaggcgaaagttaaattttaaaatatttgcacaaatctcaaccaatccgagaatttgttctacggatgcgcctttcagcaaatcgtttttccttttatccgattttgttgaggctaattttttgaaaaaatccgaatttgcgcgaatgtatggactgaactcgtacattttgcgaaccaaaaaaatttcccttccttaaatagttttttagcgcacttgtttcgttcattacacttattctacaggtaaatatacctcacgactctccccggggaatattttgcttgtcaaccgctcattttccggagcatttgggtgcatgtttataaccaagtaactgaacggttgactagtcgcttcattgtacgcctccataaagtaattgagtcgttttgggaaaagttgtgacccaaccgttctgacctggagttgaccagacgggttccttgtcagcaccaaataatggctgttagctcgcgctgttctaatgttacgcccgtataggctttgggtgacaaaaataacgctgacattccagttatgtgaaccacgtgtgaacagcagatccagaaaatcgcttcctacattcaacattaaatcatcaagcacgaggagcagtggtttcggttggctctggatcaacgcttggtctggcaaaccgttgtacgtctcaattccccgcttcatcagatcaagaaccgactcattcatctccgagtagcagtacagaatttttgcaggcggcgggtctattagttccctgtaatttctcaacaatttcatcaaccattgcgttttgccactaccagtggcccccgacaaaattagagtgaatggcgcaataaacatttttatgcatacgttaatgcatcttcctctttatttatatagagatgttgacacccaatttgaccccattttatccccacttcgacttaatcatataattaaattgttcttctacttttagcaaggaacaataatcaatgtcccaccaaccatttgctaatttcgaaattgtacggcttgaagcgatgatcattgggttagaaatcgacaaggaacaactccaacgagatgtttatcatcttaaaaataggaaaacacaaatccataataaaaaatttgaattgctacaacaaaaggaacaattaataagagaaataaatgtgctgagagagacgaaggcaactctggtcaacgagacgaaagatctgagagaagaaatattggaattacgagatacggatggttccactgatgacccactttgcgccgtttgttataccagaaaagtcgtcagcgtttaatgcaaaactaattttggatattttagcgaaattatgcatgcatcccatgtggccatcgtgccctctgcaaccgatgcgccgaaactgtttcaattgatgggcgttgcccgttttgtcgtgaagaacttattggggtgtttaaaatattcagtccctaatttttcgtgaccgaacacacacacacccacacacattgttaattgatgaatttctagacttaataattacaaaatgtttttaatgaataaattttagcataaattataagataattatgtttgtctggttggcctaatggttagtgtgatgggctgacctgtcgaaggttcggatccgctagatggataatgaattaaaagcaatataataaggttgggacaaatggtcgacaaaatggtcgacacttcggacaaatggtcgacagggatgggggcgggccatttgagcgccagtcactggtgttcaaatgggaccgcagttttccatggcgctcaaatggccggctgagcgctgggactgaaatgtcccggcgctcagatggccaggggcgcctgtccttacactactcctcttcaatcacgaagttaataatttttttcaaaaaaaataataaacaaaaaaatatgattattatttattgttgttgaacgcgattaatcaaataaagacaaataaaagaacctcacatatttgaagtccaacaatttttgaaagaataatttttgtccgactaaacatgggggcatcaagttgaaaaaataaagaaaatcatgaatgttttacaaaaaatgtgggactgatcagaaaaatgtccttgattatagcaatttttcatattgaactttgctttaagagcgtgtgatttttcaaacaaataaaaaagagacttacaatagaaaaccagttagttctacataaaaactatttatttaaagaataatttacacaattaactgcaattaaaaattccattataaagaattttaaatattttttcataaaaaagatacgtaaagtcaaaaaaaaaattaaaaattaaaaaaccaattaatttataatgaatttttgagtatttcatattactatgaataaataattaacattaa

SEQ ID NO: 13266 - DNA, 1823 bp, Heterodera glycines
ctcacatttcgtccgcatattcttccatccgtttctccatgctttgtataataaataataataaatattcggctagaaaaaattaatttaatcaaattacgtaaaagtaaaaaatgcattaaaaaaagaaaagcgtaaaatatgaaagtgcttggccctcttcaattgataaaacaacattttgtaaataaaaatgtacatgtaagaaatgaactgtataccatttcaaaattttaatcaaaaagaaaacagtgtggtgatcaattaggcgacaaaaaacgcattaaaaaatcagactgggcagagcgagagaaagagagaggggaagacacaaaaaggggtatcattatccggtgggggtcgattgggccccgccggttgggccccgccgattgggccccggtacgattgggccccgccgattgggccccggtacgattgggccccatggggcagtcacttttttagtcgacttttggtttactttcactaaagaaaaattattacctatgtatatttttaaataaaaaatggtttttttaatcgttaactttgttgcacattaattaaaatgtatttttttgcatgttgggttcgaacctggacctccgaaaaataggaatttaacccactgatccaccgttttgtccgtcattatcgccctaattacccacaccaattcatttaatgggctttttaaaaaaaaagaaaatgggggattaataggtgaaagagatcgtaaaaaattttcgttgagtttttaaaaaaaagttattgccataacactagagttagacctggacctggatccaggtccaggtcattttttgacaacctggatttttcctggacctggattttcctggatttttgtccaggaaatccagtccaggtcaaatgtgaaaaaaaatccagatccaggtccaggcaaaacaggaaaaaacctggattttcctggacaaaattttagaatttattatttcaagtgaccgatattttttcaagttttcaaaaaatgattaaatatatttaaaaacaaattattattgtaaattagatatttttagatgttcccaagcaattaattgaatttttcaaacatttttttgatttttaaaattggtttaaaaaaatccaggtccgggcctggatccaggtctcgagaagcctggatttttcctggacctggatttttgtccaggaaatccaggtccaggtccaacatggaatccaggtccaggtccaggcatttttcaaaatgtcgatctctacataacacttcaaaaaactggttgtataaaaacaatttttggcataacttttttgaaacaacacagcgaaattttgcaatctaatagaggccttttgaggctattgaatgatatccaataatgatgaatttagaggcttctagaaaaaagtatagtgcattaaatttaccaaattattttcattgtcgtcgtttccttttttatggtcgtttaaactgcaacagagccgccacaaaatttaatttttgaggggggggggggtcaatgaattgagaaaaacgaacccaaaaattccacggaatttttacaacttttttttttacaaaatttctgcccagcaattagataggtgtgtgattttccattttcagtaaagcgcctcacaaacaaagaattgtttttcaaaaaaaagcgcgtcattggccctcaatggtgcgtttccgggtccattcaacaaattcgtcaatcagcaccggccaggcgccctccgcgtcgtagttgctcatgtcacactcgattttctcccaagaattcgaggaacaggttccaggt

SEQ ID NO: 13267 - DNA, 771 bp, Heterodera glycines
cgagttgttttaagaaatttattacctttgataatagattcgtgattagcgacctcaaaagccaccaacaattagttttctcgactttttatgacaaaaaaatttgcaaatcaaaagggtcccccctatgggttttccggggtgtgtaaactggaaaagtgccaaaatcacagtaatatatgcccaagtgtaacgttttccaaaaaaaaaaaattgcaccacaaaaaccgaaccacaaatttggattcgaacataatcggacattaaaattcgaaatccgagtctaaaatcatttttcgtactgatggtggtacaaaagtccatttttaccgtaaattcgtcgggggtaaaagcacaaatttaacggatttcagaccaattgtttaatttaaattttctaaccttttctttttgatcccttctaagcctgttcattgctcgtgtttctttggcgattaatttttgaattatctcgatgaagacttttgctgcaaataaaaaaattggattaaatttacatgtgaggctacgtaaagttcccgtactttgcgtataatctgtaaggagattaaaaaaaaagcttttttttttgataaacttttttagggtcggggaaaaatgtgaattttgtttaaacaattaattttgactttcttttcgatccgggttcgggattcgaattggaacccaaatggatgccataatcggttttccgaccctgttcgactaaatgtgacagcaatttaaaatgtcagagtaggaggagatgtt

SEQ ID NO: 13268 - DNA, 3217 bp, Heterodera glycines
tgcgagaaagccgcaattgattgggggcagaatgccaagtgtcccgcttttagggttttacaatttcgaaaattttgtgaagccaagaggaagcggattgtggaaaaaatggaataaaggagcacatgggagaacctcaaagggagcgcccgtagttcagtcgtgttagagcattcatgtggaaaggccgtgggttcgagtcccaccggggggttaaccttttatgttctaaaatttatcttggcacccattcagacttggaaactctgttaaacccatatatttttaagggcattgagggcccgcgtggtgcctccggcaatgtcggcccggctggcccgcccggcttgcccggccccatgggggcggccggataccaaggcacgccgggaaacgagggcgaggaggggcgcgagggcgcccagggacggacggggcccgatgccgcatactggtaagcctattttggctggcacatggcttttcgtgccatcttttgggtcaaattcgaatttgcagcccctgcccaaaccggtacggccacggcggtggtggtggcggcggcgttcatggtcgctcaggtaaaacgcccgaagaatccgatgaaaaattatcccgccgatcagagatcagcatgggttaggatattatctcatcagatcaagttgactagaacacagcttaaacgcggattagcgtcgttcttttatggtttgatcagttgttatcccgatcatttgggaagttaataatgccctgatcagatgcccacacttaaatgattaaatgtgggctgcgattattttctgggttatcagttgaaaaatcaattgggcattatcagatgttttggaaagtgtcccgagaatcggctaattcgcattttaattgttttaattttaattcgtttttaaagctggcggcaacgctggcgatcgcttccaccaaaggcgccgaaagtgacgttgaatttcacttcgacggtggaagaaggcgaagaaaataacggagagacggggaatgtgacgacgaaaatgacgacattagcaaatgatcaaacgaaacgaaaagtcggaccgaaaaagttgtgattaaaagagaaaaataaacggaggaaggaaaaatcgaaaattatggacgaaaccgaagcaattcgcataaagtgaaggtattggctattataagccaagtcccaaacattaattacattcttcggattgatattttaggcctatgtcggaatgccgatttccgatatttttggctcggaattccgatttcctattgcgaaattttttgatggcgttggcacatctctctggtttaggcctaacgatatttgatgtgccattttgtttttttaaaaagaaaagtctgacatttttgtagcctctgacgaggtctcctttccctcagaggtccataccaacgccaaaaccaaaaaagcagcaaaatttgcaacaaaaaagattaaatatttttcatgtttttaattcagttgcaacttctttttttggctcattatgctgaatttactcaatttattctcctttttgtggttgtattttgctctttttcggcttagttcaaagggatgattaaataaattagccaaatgtgggcttaattagctcaaaggtgctgcggaggaatgcatctgctgctgatgcacatgtgtgactcgcttcaaaagtggaaccaaattagcagaaggaaacgggggacacactttttgggggggggggggggtgggcttatactcccccaattatgatcgaagatggacaactattagccactgatcagatgggaaatgacatgacaaccaccccaattatatggtcaatggctcttaaaagggaattatcagcaaaaattggcaagtaattaaaaaatgtaaaagggaaaacaaagggaaacaatcaaacaaacaaactataacctactaattagtggatgtaagagcggcttatccgccacatcaaaaagaaaagtttcgggcaataaaaaataatttgcaattatttttttcgactttttacataaaaatcggttccattcaaaaaacagagatggaagaggcatttctctgtttgttttttgtcaaaaaaaaggaaaagcaaacgcgaagagccgacaaatgagatgaaatgtctgatcggatcagcaggatcactgatcaaaagttggcgaccttttgctgtgcaatggcgatgttcgtcttccctttggcttattccctcggcttttccctttccatcggttgtcccccttaaaagtttagcagaagcagcagcaggaccttcaaacggttagcagattattaacgcccgataagccccgccccgtgcgccgccgtcgaatgattaagcgactgattaatcgcataaatcaaagcgacgacaaatgccctcgttgttgcggaatccgtgctgctagctgctgatgggaatgacacgaagctgctttgcttcgcctatttaaatgctgtcgccctggggaattaatctcacaatcagtaaacaaatgcatttttttcaattttcattaatttttcattccccctgagggttatcggcttaaataattttttgttttttgggtaaatttttacaatgtccgtccaatacgccacaatcggtgccatagccttttccggcaccactgtgctgctttgcctgctcgcaatactcatggtgcacaatgatctgcaacaaatttggctggaattggacacggaggtgggaaatgggaatttgatcaaaaaatcgaacgaacaccgtataccagacggtatggtattaaattgattacagatggaccagatcaagttggagacggacgacctgtggacggatttgttggcgatgggtgccgggacaccgtcaaatagggaacgccgccaagtaaaaagcagagaaaaagcagcaaatttacaaatttgggtcaattcaaattaaataatcactaccaaaaatgttaattgatctgtttttgctctgagtttgaatacgcaattaatccgatcatttaaccttcacaattgtacgatagatacctaataattaaagatcggatttctaggtactaaaaatactgaaataggtactaaaataggtgaaaaaagtacaaaaaaatggaaaaatccagtgtcattatgcacaaaaatgactcatttaaggcaatttcgcccgcacaatagcaattgtcaagaaaa

SEQ ID NO: 13269 - DNA, 3319 bp, Heterodera glycines
tttcagatgtttaaaataatcataatttttaaaaattcaaaggcacgcgtgccaagtggtcaaacatattcgggtggcgccacacagtcaatatccaatcctagccaaactcatcaaactcgagctggtaaaaataaaatatcaattgtttaaactcacaggttttgggtttgtacttgaattgggaagtatgtacttgaaaaaaggacagcagcatacatgaaacattagaattgtgcttgaatttaaatatatatataaaaaaagtgccaaatgctgaaggtcaaaaaattcggctattttaatgcaaaacaggaaatggtaaattgttgagaaattttttttttttgaaaaaaattaaaattctctttaaatttggcgttttggacggaaaataggtccaagaaaacaagaaagttctttaattcgttatgctgtagaaatcgatggagaaacatggttttctctaaaagctcttaatgttggtacaaattcctatttacttacatttaattcatttttcattatttaaaataagttcctgttttatatccattaatattattttattttttatttttagcaatttataaaatacaaatacatttgttttgtataggatacaattgatatacttccgtgttatttctttatatagaagctatctataaaaattttctgttatataactcagggccaaaatgtttaaaaaaaacttggttttgtgttcttctacccataaattactgaaaattaatgaaatttctgtgcataagacaatcgaaagacataaagaattaaaaatctaattaattttgagcaaagttatgaatatttttctttttgcctaaatattcatttgattccaagccacccatcctcaatttcagggcgaacccatcaaccatcatcttctggacatgcatcgaattcatcagcaaatcggggtataatatataaattgcatcaaatggttgttgcttttgtaaaatgttcaagtttttcaggtcatccgcctccaactcatccaaatgaatatgatcttggtcaataataaaaaaattattattaaaaataattaatttatcataaaaatcaggcaaatattctataatttaataatttgtggtatgtaaatattaaaacaattaaattagcaaagaaatggtagatcagctgctggtcagaatgcttgcttgtctgtcacgttgaaagtcatcggggttcaactccgtgtaaagataacaaaaatttgcaattttttgttactgtcatggtgccaaaatttgattgccctaatttactgagtgcccaaattttaagcgaaaaaaaatattatataaaatttagcattccaaaaaattgcctttgcttttatttttaatttgcctttttttcttaatacattgtgccgtaaataaaatgcattccacggcgccgggcttggcgccggcactgaagacttttgcacgacattaaaattttgaattaatttctttgcaaatttatgattcaatttcttgctctttactgttttgtgttttgttttgttatcttattaaaaatgcacttaatttcaatttcataaatttaagaattgcaatttgcccttggcgcatcgtattatgatgatgatgctcaaatggttccaatgacaacggcaaatgactcacaaattgcggaggatctgcaaaaaaagtggcagctggaagaagatgcagaattagctagacgtttggctgctgaaccataggtagaagacgaatttaactaaatgggttttccctattagtcagcaaaatttcaaaaaaaattttgtcaattttcaaaaaagttgtatgcaaaatgtttgattgcttttaagcaaaattatgccatattttgtcaaaaaattagctgaattggttgggattttacgaaacgacctagcacactaagaaaaaaatgccaaaataatgacaaaataagagaagtcggaaaaaattttccacaatacgcaatcatcagaattagataaatgaagtttatggataaaaatgtgtattttttaaatataattaattagaaaacctaaatttccatattagggtgggatttttaggcacaaaaaatcacaaaataggcattgaataggcatgaaaaccctcgaagattggcttacatttacggagctgagatttgcggcgcccagccaaagcgacacttgcggcgccgacatttgcggcgcagacacttgcggcgatgacacttgcggcgctgacatttacggagctgagatttgcggcgcccagccaaagcgacacttgcggcgccgacatttgcggcgcagacacttgcggcgatgacacttgcggcgctgacatttgcggcgcagacatttgcggcgcccagccaaagcgacacttgcggcgccgacatttgcggcgcagacacttgcttcgatgacacttgcggcgctgacatttgcggcgcagacatttgcggcgcccagccaaagcgacatttgcggcgcagacacttgcggcgatgacacttgcggcgctgacatttacggagctgagatttgcggcgcccagccaaagcgacacttgcggcgccgacatttgcggcgcagacacttgcggcgatgacacttgcggcgctgacatttgcggcgcagacatttgcggcgcccagccaaagcgacacttgcggcgccgacatttgcggcgcagacacttgcttcgatgacacttgcggcgctgacatttgcggcgcagacatttgcggcgcccagccaaagcgacacttgcggcgccgacatttgcggcgcagacacttgcggatgacacttgcggcgcagacacttgcggcgcccagtcaaaatgacatttgcggcgcctccataattaatgctcaaaattaaatctcgaacacccttttgttttcctaatgtcataagaaattattttcaagtgtaataacgaaccacagaatgttcatttttaaaatatttttttcagcctggtctttaagaaatcttttgaattttgccgaattcataaatttttaaggcagggccgcgacgggatattgtaatgaagaagtcaagctatacgctaaagcaagtaaagcggcggttgataagaggcggatttgcctcggaacgcaatggccaagtcaaaagattggatttcgcccaaggcttaacatttcgcccaatttttttttattaaacgaaggaaatacataaaataaaaaaatttatttgttttggggtaatttaattctgcgccgcaaaagtcgtttttactggccgccgcaagtgtcggcgccgcaa

SEQ ID NO: 13270 - DNA, 1536 bp, Heterodera glycines
  misc_feature (1092)..(1092): n is a, c, g, or t
ttttgatatttttctgagaagttttatatgtgaaaatcgatctataaacctataaattttcaaaaatcctataagttgaaaaagtcttagaaagaacagaaaatataaatttatctcaaatctttgaaaaagaaaaaattatcgcaaatttttcgaaaaaaaaatacttaattttgaaggcttaaaaagcgtagggatgcctaatgattccctgtaacacaggcatgcttctaaaaaatttatgacacttttttttcaaaaaacgcaaaatttaacgaatttacgaagcgtccgtccgtatttaactctatttttttcctagaaacctttctctattaaagtattaacctgtctcattattgtaagttattttacactttataaagaaagctttatttttcgaaatttcatttttttcaaatttataattaaaaaaatgtaataaagtcaattaatctaaaaaaacgaaatcgaatttaaaatttatatgtaatttttatttttgattttatttggtggaatattttttgaaaaaattatcataaatttataatttttatacataaacaataaaaaatgtagtgttcctattcgtaattaatgaaatttgtaaaaaaaccgaaaacgagtgacttagcttaaactttttcaaattaattgatcttggtattggaagttagctttacgtatcctctactatattaaaatttttaaaaaatcttgcaaaattcacaaatccgaaaaatttagactcactaattttgtcgctaacttttttgaaactcaataaatttttttgaaatttaacagaataatagagaaaatatttttctttctttgttatggcttaattgaagtttgaacaattttcatgcatttaaaacaaccttactttttttgtatgaccataaaaactttgttggttaggacttttttgtaaaaaaatttttaggtttttaaaaattaaaattaccaagtttaaataattagattatatttgagctaattatgatttatttttagcaattaagattaaaacaataattaaatttaaatattatgatcattgacactttttcacttcgtcacatncaccatttcggcgctagttacaaagagtaaccttttgaaattttttttcacctatttaatgcccaattattttatttgcatatttaattaatgttataatagtatttaaaacattcactacatcgttattattaaatcaataattataaacttatcattagatatttattctgtattggacttaaaacaattacctgcatttcatgccataaccaagtcatgaaaaaatagatatttgataaaaaatcacatccctatttcttatatatttccgcacaattgatttgacaataactacaatttatatttattttttagatcattcgttaaaattgggagttttgaccaaatattagcagattttcattaaaaaattattaattatgtcatctttttgacaaattgggtcttttctgtttaatataaaaaatttaccagaatttt

SEQ ID NO: 13271 - DNA, 2560 bp, Heterodera glycines
ctttttgttccgttttcaagtcaattaattgtcaatggcttcatcttggcctttattaacagaattaattaactaatttcaattattttattcgaaatattaaatttaattaattttgtttttcaaaattttcgttaagtcaatcggtctcggtcaaataaaatgtgtttcgaatatataagaacacccgaattttcttgagcttattctaactgaaattttattatatgcatgttaatttttggaaaatatttaaattcagcaaatgtgtggctaaatcacaaaaattaaccatttttaaaaaatgcttttatattatagctagggtggggatttttagttttttaactattttttctgcggctttatttcgacgagaaatgcaagaaaaacataattttagctcggaaattcttcgttttaacgccactattcatcactaggaatcactattttggagctttgccattaaaaaaaaattattttggatgttggccactaaaatagttttttgccactattttggcgtttctccactattttggtattttttagaaaatttcccaaaaaatggaataaaaaacctaaaaagtaactggaatcagtgaataaaattgtttgcttaagtttaaaattatttgcaaattaaaaaacagctatttaaaaaattacatccctaaaattacttaagaaaaactatttttaaccactaaaaatcctatgcattaccagaagcactgattttgtgcgatttgtttggtggttttaaatgacatttgcacaaacgctggtcagatccgaagccaagttgagcagctttatccatgcaaaacttggaaacatttgaaaagctcgaagtacagccccactcttggacaaatttgtttggctgattacctttagacaaaaaaagggatttggaccgaattctgaatgaaacaaattattaattggcagattaactgtcatcgcatttgattgcatagcataaatcagcgtctgaagaacattggccaactgaggttttgttgcccagagtttcatgaccaattttgcatttgtttgcaatgcctgaggacatttaaaaaaattaaattatgttaaaaaatgaaagcaaatttaaattaaaaaatgaaagacttggagttggaagcacaaggccattgtttgagccgcttacaacagcggaaacgcacaaggaattgtccgggattgggccgatgtaagcctgggccaatgctcgtcccgtgccatgaatgaggtcatcagtgtcataattggcatcagtgcagccccactcagtgatcagttcaatttggttgttattgttcactgaaaattgttggtttcaaataaaaaaagtacagttccttatttgataatcaattaaaatctttttctttttttgcaaaaaaataaatctaaagcattgttaattgattacttgtagaacaattaagcatataacaatagcgctgaaattgactgcatgaactgtcggagctttcataataagtgagcaacttggaaaggtacgctttcttgcacaattggactgcaaatgaattcggaaattattttacatttaaatcaaaaataataatattaattttttgattaattttttttaatggcacaaaacagaaaaataaataatattaatttacccggaattgggaccgtaatatgtgcatttgacattggcacgtccattttcccaaaattgtgatagcattgtttgttgatgatttgtttggcttccttttcgtcgacaaattgttcgggattgtccatgcgaaattcattgagttttttctccgtacatccccattttgtcaaaaatttgaactccaatgattgcttactccctaaatattatttagaaacctattttggcattttgaaaatttattttcgggattttacaggattaagaaacgtattttggcattttgcaaatttattttcgggattttacaggattaagacacctattttggcattttgaaaatttattttcgggattttacaggattaagaaacgtattttggcattttgcaaatttattttcgggattttacaggattaagacacctattttggcattttgcaaatttattttcgggattttacaggattaagacatggcattttcgttggagaaaaggcaaaaaaaatttataaaaaatttgaattttttaaacattttgccaaatttttattaaataaagtaatgttaaacaaaaatgcccataaaaacgatcatccttggcataatatgttaacaaattaacccaaattttttttttaaaattttcttttcgttgaaattaaaaaattcaattttctttgacgaaatcatgaaaatttaatatctttcaaaatatttttgaccaaatatcgaagaataacaaaaattatcggaaattcaaaaatttttgttgttaaaacccgttcgaaaatagagctgaattttaaaattcacctggcgctgccttccggcattgcctggcccaaaaatttgtaaatcttattaaaaaaaccgaaaattttcaaaat

SEQ ID NO: 13272 - DNA, 993 bp, Heterodera glycines
  misc_feature (967)..(967): n is a, c, g, or t
attttacgggattttacaggattaagaaacctattttgtctttttgcactttttattagtacatgcaccaaaaatgaaatttatcagaatttttgtcgtacatccccactttgtaaaaaatttgaactccagtgatttctcacttcataggtattacaataaatttttttgaaatttagttgattgttttcttgagggcgaaattgtctgattttcgctggggtgttcagatttccgattttgtgccaatgtccgggacgcattgccaacaaagaaacagaaaataattgctggaaaattataattttttgacaatttgttttaacctaggtgaaaaaagaattttcgagtcacgtgtagtcctaagttgggccccgacccctccccaaccccgaactccaacttttttggccatttttcgggttaatcccgaccccgacgcttccgaccccgacaaaccccgaccccgattttaactcaaacttggggccgggttaaatatacactcctaagaatggcattttcgttggagaaaaggcaaaaaaaatttataaaaaatttgaattttttaaacattttgccaaatttttattaaataaagtaatgttaaacaaaaatgcccataaaaacgatcatccttggcataatatgttaacaaattaacccaatttttttaattttaattttcttttcgttgaaattaaaaaattcaattttctttgacgaaatcatgaaaatttaatatctttcaaaatatttttgaccaaatatcgaagaataacaaaaattatcggaaattcaaaaatttttgttgttaaaacccgttcgaaaatagagctgaattttaaaattcacctgccgctgccttccggcattgcttggcccaaaaatttgtaaatcttattaaaaaacccaaattttcaaaattttttccggcagcgccttttttggcactgccggtcccganattattttgttatacagccagtttat

SEQ ID NO: 13273 - DNA, 2663 bp, Heterodera glycines
  misc_feature (2582)..(2582): n is a, c, g, or t
  misc_feature (2587)..(2587): n is a, c, g, or t
  misc_feature (2616)..(2616): n is a, c, g, or t
atcatctagcgtttcagcatcttcatctgaaaccctcgttcgttttttattcattgcttccaagtttagcagggttccttgtatattttttaactgtatttcaatatttcttgtttgtgtttctttttgcaaagatgcagaacaggaatgttcaaaatcattttcagtgtcaaaaaattcgccctcctccataaatgaatcactatcatttccatcactttcaattacacctaggttttcgaaccctacatgtttgatctttttttttgacaaatttcaatttcggggccttaaataaagtcattgcaaggcttacaaatgtattaacctgtgcaaatgttggcttccttaggtgtgggtgctgccatttttggaatagtctctgaataaatcggcgtcttggctttgtgatataacaaaaaaatttctttttccatgctttattcgtaaattcacaggaacatatgacttccgcattgttttcgttaattgatttaagaattaaaagcccatattcattcagatcgggtattgtatttccgcatccacgatgcgtcagctcaataaatgcgctcgaatcgtttttcgtgatattgttattaatttcattcaaaattacacggcatgtggacaaaattttaaataacgtaaaaaggaataatataaatattagtcattttgattatttttttatttttttatcagcttatattagaataagcgatatgtttgaatgagttggcaaacatccttgtttcgttggcaaactcaacgtataggaggatgtttgccaacctggcattattagatttattcgtttttcattattttatttatttagaaatgtttcaaaacattagaaaattttgtaataagtgctgctttaataatacggccgttgccgtctctgttgtgccacccgtcgaaaccctattccccaattcaacactttataaacggagaattttatgcgcatgcgaaaaaaggaaaacttttctgtgatgagcaaaaaaaaggtcgtcaaaattttttgaccccccccccatcgtaaaaaaattggccctggcgcaccccccgtgcgccgatcgtacatcgtaaggggtcgggcctggcgcaccccttgatcatgtatgatccaactttgtttagtattttgcccaatttgcaaggcgcggaacaaacatttaatattttgtggaaacaaagatggccgaacaaattatcgaatgctttaaggccaaaaatgggcggcgaatgaccgttctgggtgcagtgccggaggcgacagcggctggtggcacggcgggagcggcgcgaaacgcgggcgaccggtcgagaagcgccgggagtggcgtggcaccaccaacggcgaacaacggcccaattcttagggtgaatggcatgcacccgtcgattttcaggtgggcgaactgtgagacaatcgtagtctaacgctaagcgcacctgaattttttaatgaaaaataacgggattttcctataaatgggacatgggggagtgaaaacaggacgcactcgaattcgttcaaatatacaaaatttctttcttgacatgaaaacaaaaaaaaaaggggtgaccaaccttactattgccggtatgccgcccgtaaaatggcaatttaagaatttgttggccttgttttatacagactaaacgaaaaactgctatttttttggcaaatttgggttctattctggatccattccaatgttatcattaaaaacgaccataaaccgattaaatatgttttggattttccaggccgaccatcaacgaggtggccacgcgtcacattgccagcaatttggccgtctttctgcaacatgttaacgcgaagaacagccgggcctgatcgcgattgtatgacaatcaaggataattaaggctgagccctccctccctttcactcactcccccatttataaaaattctctacgaatttgttgttgtttgattatgttgtgtccttcccttcctcaatttgtccccattcatctgatcaattgaattttgtttgtcaatgaacgatggtggtgaatgtgcttcttttttgcccatttgtcgtgttaattatgaccacaagatctgttcctgctggctttattctatcatgtttctccctccctctttcatgttcccttttgtttattggataaattgaatttcctcctcattatgattgtctgtcataaacccatttaggtattaaaaacaatgagttatggttgctaaaaatcttaaaaattgttgtattcattctctaattcaaaaggcaatttggtaaacacttttgtgctttttctgacagacctaatatactaaaattggaacgatacagaggaaatcggggctttagttcaaacaaatagtttgctttaattttaaattgtttttattcaaaaaacagcaaaataaattcaccactaaattttttaaacttttcgcccttattttcgctaattttcgcccttatttaagtccttatacaaagtggactttttcaagtccacccctactcattacgaaggcccttcccttggtcagcaaacatcaataaattnctgtntgttttcttttgcctgttctctccctggncgtctttctttcattttttctctgtctgctgctgcttaatgaatgaa

SEQ ID NO: 13274 - DNA, 1460 bp, Heterodera glycines
tctattatttttgcaaaagaaacataaaacaattgcaaactgataagggggcctgtggttttttcatcgggtccataaaactgcgaatgtcctaaaattgttctggaacattcggctttatcaaaaaagccaagatctgctagccggtgaaaaaagctaaattaactcaatcatttcatgaatcacaaagtgattttccattcttctagactcaagccaatttcttactcattttcattctaatggctttcccttacgtcgtcaatttgtgtgccaacgaagtatgttcaaatctaattttaactaaatcaggcaatttaaatatcacatcataacctttgacccaaatttatttcagaagcctaattggtcctttttattaacacttggcccaaaactaatgaaattcatcaaaattaacaccaaacttccccctgaactgaacaacgaactgctccattttgttcccgagttttactatcgaagggttttaatcagctctaattttttagtttattacttttttaataacggaaaacgaggcaaacgattgaaatgcaaagtatgccaaaatcgaaagttaacaaaaaatcagttattgttaaatctaattttctatccaatttaatttaaatgttatgctttttaaggatgtagcagagagagaggccgggacgacttacacatttggcgcaggcacacccattcgctcttttctgccactggatgaacgtcatcgcgttgcaaactttttggcaactatgaatatctaccagttttttcatcctgcggaaggcggcggacattacgctctcgtttcattgcgaatgagcggaccggacgaggtgaaacaccattattttgatactttcagcttttttttggacgagaaaaatgaaaggaaatttggaaatagcacaaataatttgctttccaaaaaatatgaaattattaaattgatttctaatccctaactcaaacgcgaataaaaagtcgtaacgaaaaacttgaattttcgactttttccgagtttgggtacgcgactgatcaaagttagtgtcgcatccatgatcagcaactacgaaaaccccctataaaagaaaagttccatctggtttctgttcttccatgaccaaaatttgcctaaaatccatttttataattttaaacacagcgacagcagataagaagctactttcaacgagagggcattgcaatgaatttcgacaaccgtttttgcaccagtggaattcgtctgtttctgatgaacaatttggtaattatacaatatacataaaaagggaaagaagacgagctaaaggttttacatccagtggcaacccccctggctgctaacggagaatagaaagaggaaaactagaaaaaaattatgctcgcatattgaagagtacaacaaataaagttcatccttaatttaaaatttatttaaagagagtggg

SEQ ID NO: 13275 - DNA, 1159 bp, Heterodera glycines
  misc_feature (1136)..(1136): n is a, c, g, or t
ttccaagtttgacgtcccaattcaccgaacatcgaaagaaggaaaaaataatttttttgcatttttatttgggacaatagggcaataattgaacgaatcaataaaagtgcaccaataaataggttgaattataattaaaaatcgtcatttttttttaccaaaatatgttaacaaagaaatagaagaaaaagcaacaacgaaatgtggtgaaaattacatgagaataacggattgtttagcgaattcgcacactttgcgctttgtcattgtccctccctttgtctttcctttttcagctggcgaccgccgacggctgtttccgattgcgaggagagcccaatttgggggatttcttttctgaaatttacgaacatccgaatattttttgaattttcccagttcattttacccaaatgattccgcggaatccattcaaagtcgacgtcgtttttgttggtgcccatttcatacgctttggtcttcgtttggtacgattgggcggaacttttgccggtgcctttggtcagctgagaaattaaaaaatatattaattgaaaaatgctattcgaacttttgagaaaaaatgctgggcaataagcaaaagcacaacgataaatccgagcagaacgatgtacatgaaatagctaaatgaaaatgcgaaaaatgcagttaaattgcatattattgaaaatagatttttttaaaagaataaaatactttttttattatgttaaaaatgctgtcttttaaaaattatatcaggagaacccgataaaatatcatttctatcttggtaaaaacatgaagaaacgtacgtttccgtgttgaagccactttcgtcttcttggattgtaacggtttcattgaaaacggcactcacaaaataattgccatcctaaattgaaggaaggtaaaaaagcatgcatttttaaccaactgaataatcatttatcccattttggccaagaaagatcgacccaccgtgtccacatagtgcaaattgacgaccaaaccgaggggacggccaacgaatgcgtcggagggaataaaggcgtaatcgaatgacgcctcctctttaggctgaatctttcgttcataacgtacggcggagaactgaaattgttttcatttactcngtctcttcattttcgatgactac

SEQ ID NO: 13276 - DNA, 1384 bp, Heterodera glycines
  misc_feature (46)..(46): n is a, c, g, or t
  misc_feature (67)..(67): n is a, c, g, or t
  misc_feature (81)..(81): n is a, c, g, or t
aaaaaatttttgcttaagacaatcttaaaaacaagcacatttacanagttataatttgtgttttttnttattttttttgtntaaattaaaggttttttacaatgtcaaatctcgacaacccgcgcattttctaccaagaccgtgtgttcagcaatgatgcagcggacaatgtgttggatggagcacgtgaaatggtcgctgagtataagcgactcgatgaaatttaccaacgctttattcgcgagtttagcatcggtggattaaacttcaaatatcggtccatttagtttgtctttgcatttgaatgcctaaatattcgcttacagtgaagaattgaagctcaattacactctgggcaattattcgctgattgtcgactttaatgacctcgcaactttcgacgaagatgccgcgggcaaaatcaaacgctacccaaccacatttttaccagcggtttttacccatcagaaaattgaaaagataacggttcaattacagctcgagtctgccgtgaaaagagtcgtcgacgacattacacacccgcgtccgcctggagaggaggaaatccacgacatccaagtcattgtgaacctcagcgacaaagcactcggaattcgcaaaattaaggtactctctcatcatcctttattcgttttattacaatgccatgttcagtcctcagatgtctctcaactcgtcaaagtttcgggcattgttgtggctgcgtctcaagcgcgttcccgagccaccaaagtcacgttgcaatgccggacctgccgacatacaattgtggaccgcgaaattcgtgccggtctcgagggctttcaattgccacggcaatgtcaatcagcgtaaaaactgaccaaaaaaaattacttacacgtcttcgacttgcattcttagcaatcagcaggctgccgtgggtggccaacgatgtccgctcgatccgtacatggtgttgccagacaaatgccgctgcatcgatttccaaactctgaagcttcaggaattgcctgaggacgtgccgcacagcgaaatgccacggcacatgcaaatttatgtggataggtaaatttggaaattgtgcagttttacggctttgattataaaacgcattttgcagatatttaacggacaaagtttctcccggcaatcgcatcacagtcactggcatttactcaatcaaaagagttactggagggaaaaaggtcaattgtgtgtcattacgatttgtcgttattcaattcttaaatgtttagggcggtaaagaagacggaaaggcgggcatgtccggcattcgaactccgtacattcgagcggttggcatccaaagtgcaatgactgggcttggtcgtgccgaccaaatgcactttgcacctgagga

SEQ ID NO: 13277 - DNA, 2416 bp, Heterodera glycines
gcagtgcgcgggggctaaccgcggctatcattcgggacccgcactcgggcaagtgccatcgggacgggctgacggaaggaggatttgtttagcgctctttcataatggaaggtggcgcaatggttttggcggacggcggagtcgtgtgcattgacgaattgacaacaatgagagaggacgaccgagttgccatccatgaggcgatggagcagcagacaatttccattgccaaggtgcggtcggactgtccccccccctggtcaaatgatggctaattttttgagttttcgcccattaggcaggaattacgaccacgctgaactcgcgctgttcagtccttgcggccgctaattccgtttttgggcgttgggacgacagccgaggggacgaaaacatcgattttatgttcgaattcccttcggtgaaatgacagtcaaaatactgcttttaggccaactattctgtcgcggtttgattgtatttttgtggtcaaagaccaacacgatcgggccaaggattcggtgcgttgtcatacttttttcattttttgttcatttccgtttagcaattggccagacacgttgtttctgtgcatgtccgtgccatggacccccaggcgcaagtcctcacttctgaaaacgacgcaaccgcttcccaaacgcccctttcgcagccaatcgcagctaatggggtgaagaacttacaaacacaacctaagctaatgttgtgaaaaaggaactttcattggacttcctaaaacgtttcatcgcttacgctcgcgccaattgcgcgccgcgcatttccgagtcggcgagtcagaagctgatcaatcagtacgtgcaaatgcgaaacataccgaaggatcaccagcagaaacagcaaatgcgatccaaaagtaaggagaccgaccgactttctaattacaatgcatttagttttatgggtgatcaatttttccgtaatttttttgcagagcatccgcaatcggccattccgatcactgtgcgtcaactcgaggcggtggtccgcctcagcgaggcgcttgccaaaatggaattggctccgtttgcggaagaacgccacgtggacgaagcactccgactgttcaaagtgtcgaccattgctgcggcgcagagcggcaatctgtcgggtacggaagcacaacaaaatattcttgcaataataaatattcaacaatttcctcaaccttttttcattttccaacactgaccggaataaggaatatttctaattttgtatttatgaggcctttttccgtaggagtcgaagggtttacttctgccgaggaccaggaatcattcacccgagtggagaagcagctgaagaagcgcttccaagtgggcacttacgcatcggaacagctgatcattgaggaatttgctcgccagggataccccgagggattggtcagaaaggtgttttgttcgcaccaaatgagaagaaacggattaattattcgtttttaggctatcgatttttatgtgagaaggggcgatttgcaataccggatgcaacgcaaattgctctaccgatttaaataaacatgttattgcgacttacaaccttgaaattttattcgatttatttaacttttctcttgataaatttgaaaacttttttcattcaccatgactgttttttgaattgaaacaaaaattaaaaaatcgaatgtggcagtcgattttacatttgacttggtgatcaagtcctcgacttgattaattgcaacaaaaaaataggacttgatgccaaaatcaagtgcgacactcgattttttcgatttaattgaaacaggatttttgcagtccatttcgcaaaaatcaagtcgaggacctggtccgaattgaaataggtccctggatatgagccctttaatatatttgtcaagataaattcaagatttatattaatacatttataatttatgagaaagtttcggaaaattgaagtggtccaaatgagtgttaaaatggggggtggtgcgtcgtgcacaaattgatgctgtgtaaacccattgaaattgtgatcaattttacaagattaatcttcttcatcgctaaggatttcgccctcgctcaattccgcctcgtccaccactctttttggtcgcttttgcggtggcggctgctgcgcttcaccagctgaaaattgtgcgattaatcgactcagggcaaatttcggtcgtttacttgacgacttcctctggacagaaggcgcggtcgttgccttcggagttggcgaagccgcatttgtcgacatgcccttttgatgagatgctctctgataggacggcggcgccctggacaaaatgtcaaacagaataaaacgaaaaaaataatcaaataaaaaatcaactaatatgatcaattggagacttccattcatacattaaaaa

SEQ ID NO: 13278 - DNA, 2546 bp, Heterodera glycines
agctcatcaagcttcggaaaattaggaaaattttcgctcttgttcgcaaatttggaaagagctaaagtgatgacggagtaaggatggatattcaaaaatttaattaaattggtaaaattattattaatttgcgaacatttctcttaccgcggtacacacatctggcactggtccgcatttcatggtcattttctttcgccataatggcgtcgttcaattcgtaaatgttcgaacggcacttggtaatctgaaaacagaaaatttcaataaaaacggatttaaatttatttatttcacagcactgtgtttttcatcagaattaagcaatcgccgatattttccagcaaaaattggtcaaaaacaattgatactcggcaatttgtccatttcaaattaaatgggataaagcagaccaattccaagatgagctcattgggaagtaatctttttggcattttcgaaagcggagagagagcccagaaagaatttgaatggcaaaatcattttaagagaattatatatacagacgaaagccttatcttcataagatttgaccatgggggtggagagacaaaatttaagaggatcaacaaaatgtggggcggcccttttgggcggcaaaatcaaagagaatcagaaaacggcattttagataattgtggcagcgaaagaaggaggcaattaagacaccaaatttcatatattaaaatgcaaatttatcatttgcattgcgctactcaccatttgctgtttggacggcattgtctgctggtggcagtgacaaacggcgagcaggttaatagattagagtaataaggtaaaataaaataatataaaataatataaaaatgccttttgttgggcagggagggaccaaataaaaatgtcaatctctgcctgagaaaagttttggggtttcaagcctcggactcgtgcaaatatgccactttttacatcccctaaagaaaaacttcggcactctcttttaaaacggcccctaagcatcacaatgcccaaaatttcataaaaaattaaataatttaacacaatttgcaaactgtataaaacaaggttcgaaactgtgcttgtttcaatgaattatgcttaggtatttttgaaatttaatatgtgcaaaaaaggtaattttgagaagcaaaaaaacgggccatcgaattaatctttgtaaaattttattttaaatttttaatcttatttatagttatttaaaaaaattacgaacatttgtgtaaaatagcagaaaatccttaaatttctcacaagaaaaatcatataaattagaaaaggacaaaaaagaaagaaattagaaattcattctaagaaatttaatttttaaaaaattcattttgaatgaatgcatattacatatttagtccgccttaatcattgccagtacaaagaaggggggacacgggtaaatatgtaataacattaattaactgattggcttaaattgattccgagttgaaaaagcataagtacgggaaattccaccgactcttgaaaaagccgggtatccgatctgaattcggtcgggaacccggaggacctaatcgggacgaaagccaccaattctcatgcatttttcatttaattccaagccctaaaaaactaaatcgtgttaaataaattcattaaacaaattagtaatacgattagtaccttccccaattaacaaaaggaaaaacaaatttaagtaaagagcttaagagttttccactctgtatttagtataggcaagatgggatcagcaacacggcaaaaagtaaaaataacattaagccgctattttcatagttcttttaagaaaaatatttgaaaaatattatgggttacaaaattagatagagatgcgatacaaaatgttactactttttcgttctttttttattactctttttcttttccattacctaatgctctctccctttttcccattgcctctccctcccccaatcaccaaaaaaatgtcttttttttttgtacaatacttcgaacgctcttttgcagctatattctgtgtcgagaaaaattggtaaaacgtttttagaattttcatattttttaattgaataataagtataaatttatttatttttttgccctgacttggtcactttgattgtgcctttgtcaacttttgtcatttttgcatatctcctgtaatgatacttatctacatatacagtttgtcaacatttttttaatacatttcattagttcatttttacgatgtcatattttttgtgttttggcaacgtatgaaattcattgaaaaaggccaattttggcgaataatttgctacaaaatgcaaaagatcccatgtctctacgactactgtacgctgacaatttacctgttcagcaaaaaagtactgtataattcttaagaaaacagtgcattttacagttatttttgtgacttcgaaatttcatattgtctccggaatcccagcgtacagaagtcgttgggacatgcggttttttgcttttttgtagcattcagatcaccctgaagcagggctgca

SEQ ID NO: 13279 - DNA, 1651 bp, Heterodera glycines
gagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatcccccccccccctcccccgcccaaaatgaaaaattaaaaatttttacaggaaaaattgggacttttaaattttttttgtcgatttttcttaataaaatcattaaaatttaaaaaaaaaatttgcccggcggcacctatcggcaccgccggaccacgatttactcgattttacggtgctaggacgaagtgacaaaaatatcagtgtggcgaagtgacaaaaatatcagtgagagactttcagaggggtggggtcatttcagtacgaagaaattaatttaattaattaataatattatagttcatttaaaaacttgaaataattcatgcttgcacaacttttggtgctgatcaaaaaagtctcttacatcaacttgatcagatcactcctttgtagtgaacggggacacctaaaatacactgaaaatcggggaaattttcaaaatccctagggggttgggaaattttttctagagaaaatgggcaagcccactggcaagagcacaaaatttgctaccgaattgttattggaatagtggttctacgatttgtatatagaaagttatacttggttgaataattgatcaccataaaagatcaatttttgatcaacgccataactttttccagaagcatccaaattaagcatacttggtatcatttgatagcccgaagtgtcttctatttgcctttaaaattttaaaaaatttggttatggttcaaaaaagttgtggcttgtaaatttcataaatgatttggtaaacctttgtgaccacaacttttttgaaactcaacgaaattttttgaaattttacaggaaaatagagaacacttagggctaccaaaagataccaaaatgtataattttgatggttttagaaaaagttatgatgcatgaaatttatcaagaaattaggtggtcgtgtattttttgtggccgtataaactgaaatagagaacaaatatatttattattattagcttattattcaattttaaattatgttattaattaattaaattaatttattcgtactgaaatgaccccacccctctgaaagtctctcactgatatttttgtcacttcgccacactgatatttttgtcacttcgtcctagcacc

SEQ ID NO: 13280 - DNA, 3258 bp, Heterodera glycines
acagaattttgtgttcacagaaagggtaaatttttgagttgatgccggggcagagaatggttcacaaaaaggcaacatttgaacaaaaagatgctccagtgcgatccatttcgaataggcgaatggccatggttactccgacattccctgaatgaaaatttggcgcacaactcaaatatttcttctttaaaatgcatgcaaaatcaaatggataaagagcaattaaattagcaatacattcgatatataaaatgacaactatatcattgaaaactttgcgaaatgacatgtgagataaatgcgctaactgggcccttatttaactacccattcaggcatatataataatattacttaatttcgtaaaaatttacatttagtacgagtccatcaatgtaataactgattcgaaagctattcacatatgtatatgattttgtaaatccgacaaattttcttaaaattttgaaaaaaaatcaagtacttgataaaagtcataaacaaaatcaatgattttgcaaaatctgagctaagattcgtgatcagcgtattttttaaccctagaaaaaatgtaaaaaaaaaattgaaatttaactattttttttacatattttgactgaaaattgtccattttaaaaatgccttatgcgtttttaattaattctatgcaaaaatatttaatgttaaaaagaaataaaaaagcatataaaatattattatgaataataaaaaaaataaactaaaataatataaaattttttgactatatgggataaggcaaaaattgaaaaaccctgaccccgaacgatttgtcaaccccgaattttccaaccccgacgtcgtaatttcaattaaattttttgaaatttaacagaaaacagcatatttttatggtcatccaaaaatgtaagatcgttcaaatgcattaaaattaattcacaatgcccttgataagaagatatcccaaagaattttctgttattctgttaaatttctttcaaaaaattttatcgagctttaaaaaaagttagcacaaaaatatgagtctaattttttcagaatttttgggtaaaagattttgtaaattttgctacatttataaaaaattaaataagaccgtaaataagggcgaaaaaatcgcgaaataaggtccaaaaagttccaaatttaggggtatattttttaaattgcttttttaatgaaaataatttaaattaaagtaataattttattcttacagttgcaaacaattcgccaaaaaatgtaaagaatatttttttcactgtatttttaaaaagaattttgaatttcacattaaaaattaaaaaatcgcgaaataagggcgaaatgcctaaatatggacaaaaacttattttaagggcgaacatctaaaataaggatttctaaggtcataagggcgttaaaacgcaaaattttcgaacaaaaaatgtgtttttcgtgcatttctcgtcgagttaagccgcagaaaaaataaggataaacttaaaaatccgttccctaatctggacagatattcaacattatatcaaaaaaatgattattccaatttttgcaagaggtaactgaatttaacttaccttattctcctccttaatttgaaagacacgagccgtcaaatatttggttgaatatagttgtcgttcacaatcgtaacaaaacatatttttgtttttgccaaaaaattctttattttcgtccaataatatttgccaaagcgataaattcaattcccgacgagtctcgttgctttcgctaaaaatggtatttttggtatatatttcatttttttatattttagatttagaaatttaaaaattcttgaaaaatgaaggactgactatccgtcagtaatggacaattcgtcaatcttttctcgacaactcagaaatttacagtatttttcaaaaccctatgtagttggaggaggcagtgcctacaggcaccgccagaagaaaatccatttttggtccagctgtgccgataggcgtccgctggagaggtttttgaaaaactaggcttaatttttaaacgtttttcttccaagggttaaaatataggttaaaaaaggagaagaaaacgacaattttgtaatctttgccaacaagattttgtattaaaaacatccctttttgggttatttaaattaaaaaaaaagtaaattgtgtgggttcatatattaaaatatgcttgaaatgaaagccgagaaatttgcaaataattaattaaattaaaaaatttgtaacctacataacaaatcaataaaattaaaagaaaaataaaatatatttaattactacatgggaaatgaaccatgggaaagccaaagaaatcgagatgactcatccataagcaattttaagattaaaatttagataaaataattattcatttaaaaaagcatgaattacaattttattatttaaatttatctcaatttaagtttatttaatgctcactcgttgtgtggccctcgagataattctatgtccacttttgtattcaaatatctggcactaaaacgaagttcatactgatacaccttgttaggtgctttttccaaattgatttcaaaggcatttgttatcactttcactgaatcgctgatggtaggaaaacttccattgttgctgattttgtctgttaaaatgggttaattattaattaatacgttctttttgcgttagtagtttttttggtgatattctgttgttattgttatccttacaagacctaacttagtcaaatttctaaaaatttcgctaaatttttctaaaatcacaataggaattttttagtgaagcttttataaatggtaaaaatttcataaaattactagagaaaaagtaacaacaatgaatctcctgactcagaatgtgttggatgtagagttgcacgggaccggcaattttgacaaaaaccgggaccgggacttgccgttaccagaaaagtcgggaccgggaccaagtttttcaaccgggaggaccgggacttttccaagagaacattttttgaaaaagttttgaaaaattacaaaaattttaaactaaattcatagattattaatatttatgattctgtaaggaactttaaaattgagcattttaaacggggatattttgaaattttgacatttcatttactgagtttgcccccaggcgactggtttcttttttttaagcgcactttttaaaagccactttggcgcgagggaggggaatcgggcggtttggcgccgcc

SEQ ID NO: 13281 - DNA, 5248 bp, Heterodera glycines
tttattgtaatttatatttggttatttttgtattgtttgtttataatttttatgtttaataaaaatcccctttagtatttcgatgaaaattgatttagtttggttggtacgcatataaattcatcttatttaaaattgacagcctataattaattggtaattgttttaataaaatttataaataactcttgcaaaataatctttaattgtaatttacaaaaatatttttgttatacctgaatttataattcataattttattagttaactaattgtagattattgtagatattttgcattaataaattgtttttgattttttcctaaatacttatttttttctatgatttgtttatttaaattgaattctatttatgaaaaatatttagtttgataaaagtcattatttagttatttaatttttttcatttctccttcactaatgacttattaaattatacgcaacgatcctgttacattaaaattacaccttctaaaaaagaataagtcagcctatttatttacttattttcttgattctatgaaaggatgaataacatttaatacatatttgtttctttcggatttatttattatatattttttttcttgcctccattcaaattccatattcattaataagattccaataatgtgaactttaagttagaaattacattaatttattttttatcttttatatcttttttagattcgttttacagatactgtttgaatttttgctcaaatataattattctaattcgataactaaaatttttggttaatacttatcactgttgattttatttttaccattttttctaatttaatataattatttcattttaattataattagaagcaaaaatattttattccaacgcaacatgaattcgaactaaatcgcatgtcttaagcacaatagttgtgtaaagaaatattattacataattcataatttttttgtaagaatctaattctgttgttcaatgtatattaagtaactatgtttcttctatatataatatttgtgtccctcatataattacactatactaccatgctttatattattaattcttcttttgtagcttttgaattcaaatctaatacatgtgtgaaaaaatgattctaatttatttctaaattaattattaatttgaattttatttaaaaataattttaaaaatttcatttacattttacatgattaatatttaaaatataaacataaataataccctagcaccaacttgcactcagagccaacttgactttttattatacaaaagaattttaatagaaagttttttgttttaacttgcattaattatttcatcactaattgatgcaatattatgggttgcttacttatgacggtcgaaatatcatttttaaaatgtttagttcattgtctaacatattaattaatgcgcgcttttattgaattttatcacgaaaactcattttgatggttatcattattaaaattatttatttctgaatcattcttctatatttgctttttgtggaaaggttattgaatatttgtgttatattattaatttattaatgcattgcttccaactgaaattttatgatctaaaatttgtccatctataatcaacgaagtcaaactcgcaataataatagataatattttctttaaataaattaaatagtttattttttacaaacattatatttttaatttcattcaaaatataatgataaatctcgtttaatctgagattaaatgccgtaataattattcaaacttaacataaaaaataaataatatttcaaatattacattctatttataaagaaataatcgcacaactgcactggataatgtttgatggaataagcaaaaaaatagttcatttactcattttttacgaaaccaattttgtatttgatctttctttatacttgaaaaactttctatttgaatataacatttataaatcacgggggattagcaggacaaaacatcgtcgaccgaaacgtagtcgaatgaatttttggaccatttcttttttctttctcaaccaaattaaacattcttgctgttattcgaaagaatttgaaaaacgctattaaattgcaaattttcaaaaattttattcatacgggtaaaatttgattgacaatgaacaaagtattggttcaataagtctgcaccgttcacggggtgggggtgagaccaaaaatcctgtcctgcccacgttcccctggacgggggcgggggagatttcgaaccctagtcctaacaactacgaaattattgacaattttcaagaaagaatttattgaacgaagattattatgcttccgtgaaagatgatgctgaggctatttaatatctgagtgtaatctgtttttatcaattattttatttattgcttttgtttgatattttttatgttttaagcttctcattactcaaaaccaaaacacttgcgaaatcaaatgatttcttttgtattcgtatttagttttctttattggagctccagttaactgtttcggtcctccggtttaaatttgtttataagtttaataattaaaaataaatgtttttatatgtataatatagaattatttttaataatttttctgccatcattcatttatttaaattaacttattttcatgtgcggattaaagcattgccaattccgataaattaattacatggtgattaatttcgaagccattattattttagggatttttttcagaaaaagtgttttcttttaaatatcatattcattaaacaatgaattaagttaagatttatatttatatcaatttgtcttataattacttttaagcatttcttttttcttgtcaatttcatttcattagttgttttgtttcaattttcgattttaccatttaataaattttgaatattttaaaacactattttatttttacaatttttatattataaattttatatgcctttttgaattatttataaacatctttttaatttcagtatcgtgaggatggaaattagtttcaatcaaaaaatcaaacgtgtatttagtcacaaaacacataattcgcattgagttcattataatttcttgaacatttttgtgtttataaattatttagtaattattttaatttgtctatgtttttttgattatatttttaaaattaatattttatttaaaaagtttgattagactctttgggcggaaaatgcaatgcatttggaagatattttttaattaacaatatttgattttggtttatttaattcaattttgattttttattaatttttatcttttgattttgaaataattacgatttatttttatcttttttaattagaatttgtaattcgcaattcgtattttgattacaatatcattgtgctcataattgaattctcatttaatgagctgggctaatggtgttattgttattaattattttagtaaagtactaaagtttttccttttaattgtttattaaatatttaatttttttataaaattcactttaaaatgtgttcaaatattaatctattaaattttatttaatcaagtgccaccaatgctaaaagacgtaccattttattatgccgtttaaaattagttgtttattaagatagaaaagagaaattttgaattaatttttcatactatgtcatttaatattattttaaattatattttcaaaataaaattatttaataatttatgaaaaattaatgcacacaaatttttcaagcaaaaaagaaaggtgtttttttttatattgccaagaaaaatttttggtttttatcaattaaatatttttattatcattaatttatatatataatgatacattttgtgtgctactaagcgaaataaattgaaatcaacattgatctgaagagtaccttttgattaactggtccggatgattactattccttttttaaattattattattatttcgttttgtttttgggtttgtaagtattttttataatacattaattaaaccagtgccaaaaattcaaaattattttaaatatataaaatattttcagtcatctcgtttataaatagaaaagggattgggatgaaaattcttcattgtttaatagattattaaatatttaaagaaaactttgaattattaatatttataccaaatcatttcatttatttttgagaatgggatacaatatattaataacatgttgtattgctcatctgaagttatattggttaagccccagaattaaattagtgaataaattttaatttagatagatatttagttatttaaaataaattattataataaatctttattatttaatatttcttagcaaatttaatttattcttttccataatatttaattgtttaagaatttatatttaaattcacagcaaattgttgaagtaatgaaaattggatgtataaggagaattcattcaaaatttacttgcttatttctctctgcgacgctcggtattatgctcatgcatagatttgaatagttttaatatatttagattttaaacaacttcattattttgtcctataatattttttaaaggaatttatattaaatttcatcttttctgttactgaaaacattcacaaatcatcgtgatggattgaccatttatcgaaacgatccctttttgcgttcattttacatttaaattatattgtgttttatttatttttcccactttattcacttcgttttggactcagatttccctcctcttcaattaggttttaattttacttcgcttttcttcaatcaatttccctcgtctcgtctatgtcttttcccaaggcccaaattttcaacaaaactattcctaccaatctcagcccgttcaaaatttttctcatcacagccaaatgaatcaaatcaacaaaatttcccccaaaatcaatatcgacaagcgcctaaaaatcaattttcgaatttttctccatctgctctttcaccccaacttttccaagaagaaccaatggctaggaggaataaagcctccgaatttcaaaatgttcactatttgggcgaaaattattgtgacatggaaaatcggcaaccagttcgagaccgattttcgcaaaattatttccaaaatgattatgatgaagagctttcttatgctaattggaattcagatcgaagccaattttcccaaaaagttttcatcaaacgcaaattcccccaaacaatttcaattcactgaaa

SEQ ID NO: 13282 - DNA, 1439 bp, Heterodera glycines
ctctcaggtgccgaaatgcatttattctttccgaccttttgattttgtttctttcgactcgacagatgtgtgactttcttgaggacaaatacctccgtgagcaggtcgaatcaattgaggaaattgggttagttttccaactttttagttgccatttttgtatttatttttagcaaaatcatcaccaatctcaagcgtgttggaaagggtttgggcgagtttctttttgacaaggaatttgccgagaccgactgaatgaatgtgcattttggacacattcaatgggttgccactgactgaatccaataactttgcagattgtcagtcatttacgaattttattaatctctccaatggcgttcattctcctttttctccgacatttataaacacgtggataaattaatgaatgcgcactttttgacgaacaaaagctttgctaatttgaccgaaatcatttttgcttttgattgcccatttcccatttggtttcattaaaattaaatttaaatggtcgacgtcgaacgtttgaaagttgccttcgaaacggtttttgtttattttcattatgagaattcttgggtttgaaccggttgactttttcagtgtcccccttcgtcggttcgcaatgtttgcattatcgctcacgttgatcatggaaaaacgactttggctgattttttggtgtcgtccaacggagttatttcgggtaactgcaaaatgttgtagtgattttatttatttatggcatgtttgttattttccttttgtctttcatttgcgttttcagctcggttggcgggcaaattgcgttacatggactgtcgggaggacgagcaaatgcgcggaataacaatgaagtccagctccatatcacttttttatgaaccccttctgctgaatttgatcgacaggtttgagaggacggcagatgaggaatcagaagactgcgttatttttcggacttttgttttgttttcacttttggaaccctcatttattattttcagtccaggccatgttgactttgtggccgaagtcagttcggccgtcaatttggccgacattgccatcctcgtcgtggatgcggtcggtttgactaacaatactatgaaaaaccaactcattattgctaatccatggcatctttcgaggtggaaggcgtctgttcccaaaccgagtcgctcatccgccaggcgctgtcctgcaaattggacattttattggtgctgaataaattagaccgactggtggtggagctgaagatgcgcgagcaggaggcccatcgccacttacagcgactgctcgaatctgtgaactcgtgcctttctcaggcgatccacggccaattgctggaggaagactggcacactttcgagcaggtcgagcggacaattaaggagaatcaatttatagcacgtagtttgacagtcattctg

SEQ ID NO: 13283 - DNA, 3651 bp, Heterodera glycines
  misc_feature (49)..(49): n is a, c, g, or t
  misc_feature (64)..(65): n is a, c, g, or t
  misc_feature (67)..(67): n is a, c, g, or t
  misc_feature (76)..(76): n is a, c, g, or t
tggtttcattaaaattaaatttaaatggtcgacgtcccctattgaaagnggccttcgaaacggnncnagcggatgnctcttttgagaattcttgggtttgaaccggttgactttttcagtgtcccccttcgtcggttcgcaatgtttgcattatcgctcacgttgatcatggaaaaacgactttggctgattttttggtgtcgtccaacggagttatttcgggtaactgcaaaatgttgtagtgattttatttatttatggcatgtttgttattttccttttgtctttcatttgcgttttcagctcggttggcgggcaaattgcgttacatggactgtcgggaggacgagcaaatgcgcggaataacaatgaagtccagctccatatcactcctttatgaaccccttctgctgaatttgatcgacaggtttgggagggcggcagatgaggaatcagaagactgcgttatttttcggacttttgttttgttttcacttttggaaccctcatttactattttcagtccaggccatgttgactttgtggccgaagtcagttcggccgtcaatttggccgacattgccatcctcgtagtggatgcggtcggtttgactaacaatactatgaaaaaccaactcattattgctaatccatggcatctttcgaggtggaaggcgtctgttcccaaaccgagtcgctcatccgccaggcgctgtcctgcaaattggacattttattggtgctgaataaattagaccgactggtggtggagctgaagatgcgcgagcaggaggcccatcgccacttacagcgactgctcgaatctgtgaactcgtgcctttctcaggcgatccacggccaattgctggaggaagactggcacactttcgagcaggtcgagcggacaatttaaggagaattcaatttataagcacgtagtttgaccagtcattctgaaggtttcagatggaaagtctgctccatttcgacccttccaaaggcaatgttctgtttgcttcggcattgtacggatacgcttttgcgtcggaagactttgccgacctttggaccaaacgaatctttggacagcaaaaaattggggataaatcgccgaatgaccaccgagaaattgtcaaggcacagcttaacgccaatctcttttcttccgatcacttttttgccacaaattctaaacaaattttaccgggcgcagaacagcgcggaaaaaagccactcttgggttttatattgcttattatttacctttgctatttccacccttttcagagcaatttgtgctggagccgttgtgggaattgcacaggtgcgcattggttgaaggagacatggacaaattgcgacaaatggctgcgaaattgtctcttcctttgctgaaagggaggagagccgaagaggtggcaaagggagggcgggtgggtttaggaaagaatgaccgatgtgagaattgatattaagtatttaaataaaaattttaatttataaaaaaccaaaataacccctaaaagtcgaatttctgaattagcctcccccaaagccaagagtttggctacgcccttaatggagactgtcattgcttggactccgctttgttttcctttactcaattttccatgcctttttttttaaaggcttttaccgaaatgatgcgtcaatggcttccgcttagttcggccgtcgtccgcgcctgcgcccgaatgcgttcggctcagaaggctttccaaacaaacaaccgacttgagcagctgttgcccatcggatgcgaagttggcccggcccgtctttgcttttgccattcattctatgccctttcctcttttcgttctcttcgtcccctgtcatcgatgccttacgcaactgcgaccccatggacgaattgactttggtattttgtgcgaaggctttcaaagtggagaagcaccgattgtctctttgtcgtgtgatgagcgggactctgagaattggtataattaagaatttaagaagtacattttaaccgactttttcaggtgatcagcttaatgtcctccgacattcggcgtcctccgaagatgtttggcattctgtgaaaattggcactctttttcttttgatgggccgtgaactgctccccgtagagtgtgttcctgctgggcggatttgcggcgtcgaagtatccgacgggcgttggataggcggacaaacgctttgctcgagggctctggccgtcactgaagtgccgcggatgagttggcatcaaaagttcgccgaaccactcgtccgcgtgacggtaaggccgacaaatgccggaatggccgaaatggaggaattgcgaagtgcactgcgacaattatccgtgttggactcagcagtgcgcattatcgagcaggaagacggagatttggcgatgcttacggctggcgaagtgcatttgcagaagtgtctggaggtggataagggataaaaagcattttatgtcattttaatcgattgatcgcttcagtgattcattaaggatttgaaattactcggccaaaccgaaattgttgtctcagagccaatcgtcccatttttggagacactaatcccagacattcgtttgcccttctccagaattttaaaagatcatgaaacagtaaacctttcgttgtttttttaatttaattaatttttcccatttgaggaatgttttttgcgacaattttcccttcgcataactctaagggctgttcctctccatgatcaaattgtcgaactaatcaaacaaaacgataaactcattgactcattcgtcgaaggttctgtagtcattttcactggtttaattacattagctttaaggtgcttttgactccaacacacgttccaatttgactacgtttcgttcccaattgtctctttgtgcttccgattgtctttccaaaatgaagggttcctggtgggccaaacgttctgtggctgaaattcaaggacttttttcgcgtattttggccttcggcccatcacgtgccaaaacgaacattctcttcaacggatgttccgaagaacaaaagaatatttcatgttgcgaaggtggccaaacggggaaaacattatatcaaataatgacgaaacgatttaggtaatttgagcccgctggaccaagcagtcattgcgggattccatttggcaatgtcccatggtccgttatgcgatgagcccatgcaaagtgttggcattgtgttagaagggtgggaggaggaggaaagagtggcggagggtacgaatggcattggcactttagaaggggaggaaacggtggagaaatgcgacgatggtacacgtttagaaatagtaaatgttccaacaattcttttttagcagcgaactcattggcaggtgcccaacttcaaggacagcttatttcagccattcgtcagacttgccgcgccgcactcaaaaaacacattggctctcttcgtctgctcgccgctttgtatcggtgcgccgttcaaacgccgacccaatcgcttgggaaagtgcaaacagttttggcacaaaaacgggcaaaggtgggcgacataacatatccaatcacacgatttgatcgtctttcaggtgctcagtgaggagttaaatgagcttaccggtctctttgaagtggtgtcccttttg

SEQ ID NO: 13284 - DNA, 2585 bp, Heterodera glycines
tccatgaaaaaatagccaaaaaaagatcaggccatgattgttgagaacattggtcccgaaattgttttttaattcattttttctagtggtgatctgaggcgctgacattggcctttttgactcctaaagaccgaaaaatttttcgaaaaagacattttttagcaaaattttgtcaaaaaatagacctaaaattaaattttcttaaaaattagttaatttatgtcaaaaacaagcaaaaaatgaaaaatttcgattttttggtcggttttctctagaaattgtctttttttcttttaaaacgaattcttataccgtatttcaccattttagatttattttaactagaatttaatgaataaaatttctagaaattttcaaaaatttttaaaatatttttgaaaatgaaaatatgtaagaaaaaagtttaaatacattaataataagcaatatttattgtttaatagataataaatagtacaggccaatcagggtacatgtacaggttttttcaaaatgccaagctctatttattatagagcaaataaattaaataataattaaatttaaatatttcaattcattgttacttttgacacttcgtcctagcatctatggcaaaatataaacaaggaatcagggatgggccaaatcggaaaataaaatgcgaaacgcgaaattccaaaaaacgcgaaattgcgaaacgcgaaagcgatacaacttttttaatagtcaaaatcataaagcaaaaatcattttttgtaaaattttattccaaatttaaaaaatcaatacaaagcttttttgaggcgcgcttttccaaaaaacattttgggaagagggggcaggcagcgccggcaggcgccgccgggaaaatttttgaaaatttgattaaaatttgttgacagattttcaccaaaaaatcttcaaattttgtgatttttgtatcattttttaatgagaaataagagttttggcgcgccgctgagaacagtttttcatcaaattaccaaattttgcgattttgggccattttctaagaaaaaataggagttttgggggcgcggcggtgccgataggcgccgccgggggaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctggcatatatgtatttgaaaaaaaataattaaataataataaatataacagacaaaatcaggcccatagccaaggcaaaattccaaaatgaatcacagaagtctcccaaattaggtagtctttttggcaaaaaattaattaataaatgggctaaaacttttttgttttgtttttgtcttattccacacaatttcgatgataaccaggaatagatttaaggcgaagtgtaaaaaaatttcagatttcacgagtttttctagttatgggcctggagattaaataataaattctcatttttatccccagcttaaaaataaataatttctgatcagatcattatcaaagctgtttttctgtttctggatcgaaccaacaaaagctcgttcagcggtcaatgcgcgcgcctttctcgagcaaatattagagaatctcaactttgttcgttagtattgcggccttcagcgcagtaagcccatcagaagcgacaattgcgatgtccgccccgccgttttccacaagaaatttgactaaaaaacaaatatttttaatttagcaattaaatgcggagaaaatcacaaaaatttcgggaatttaacgcaattcattaagattgctttgatgtttgtttgaatcagaaactcaaaatttttaaatgaaaatatcgaattttcaagaaatgaaacaaaaattcacattggaccatttcaaaaagcacaaaatcctgctatgtataataattattgcattaaattaccaatttgcaattgcccaaccatacacgcaacaatcaatggcgaacgacctgtgcgtatataaataaatcatcgtacatatgcagtaaattttgaaaacttaggaaaaaatggtatggggaccggtgaatttggggacacacgcgtttcggcgccgcgcgtttcggcgccagcccagtttttggactataacttttttctttgtcaacgaaatcaaacattgttggtatcattcgaaagctgtaaatgtcctatattagcctacaaaattttgaaaaattatgtaaaggttcaaaaaaattatggccagaacaacttaaaaaaccagattttccaacttttatggccataaatttgttcaaaattgatgaaattttttggaattatgcaagataatagagaatctgaagggctttcgaatgataccaataatttttgatttggttgacatagaaaaaagttatagtccaaaaactgggctggcgccgaaacgcgcggcgccgaaacgcagtagaccccc

SEQ ID NO: 13285 - DNA, 2396 bp, Heterodera glycines
cataatgcaatatctcggggcttaataggcctctgcaaaacaaatatttaacaattttcacggcttaatcgtctcattcataattaaataactctcggctgttcacctgtcgcacgtagttgtgtgcctgcaggcattgccgttgaaaattggcatccactgtaaagcaaaataattgtgccaaatttttgtgcataatcgtccccaaatggaggggaaagcaccccaaaaaaatgagtcagtttcaaccagggttgccagatgaaaattttcaaaatcgtcattttgccaacaaaaaaccagcatttacgtcaaaaaccattatttcgaaaaattttattcaaaatcaaaaaattcaataaaaatgtttttttttgcggcgcgctttttccaagaagaaacatttcaccataaatgacaaatttttgagattttgggctaattttttatggaaaaattggaaattttaccatttttaaacagattttcactgaagattgacaattttaggtcaatttagcgctttgaaaatttcattcaaagaaaaacaaccatcattaaccccttgaaaccagcaaaatgatgatactagtaaatcaacacatctggcagtccaggtttcaaccaatttataaaactgaaaaattttgaaaaataaaaagaccacgattcagaaagttaggcatactgtaatgggatcactgtttgcaggcagttttgttcattggtacaactattttttaaatacagaattcctgttttttaaataagaatatgctgtttttcgaccaaaaaacttaccccaaatttacttaatcatttcataatgttaatttgaggtacagttttaaatacagtatccttatttttcaaaaaacgaagatacaatatgaccggcgcatttgccggccacgcccaccccgccagataagtaccaaccgacggcgctgcatttgcccggcctccggtttacatatttcacatcggtgcatgtctgcataagctgccgatccagatcaccatcagccagttcactcatgtcagaagccatgtgcgtgtccgagtaactgctggagatcagttgagcatccgccgttccggcgctgctgatcgggcccagaaagtcggccgaatggggtgatctgaaagcgagggatacccgtatttttttgggcaggtgacgggaattttcagttatttaatagtcaggattaacttttggcatttttgtttgtaagtcagcaattttggcatttcaattatgtttcttcgaatttacaagttttgtgtggttgacccaattaaaaaaatttgagtcagactaatttgataaagttgtaataacaagcaataatgttcattattgtaaaaaagatcaaaaaatttctcagaaatttatattgttttttgtctatgaactctcagaaataaaaatgccaaaaattgctagtcgcggaaaagtgccgtaactcatgagttgtgagattatgccatctctgccatttactgattgtgctcactttgccgcgccatcggctgcaccgtcaaatgtccggcttggccccacatggtttttgtcatctccctttttgcggtcgtgcgtcgactgtgacttgcgcaggaatggcggaaagccgacccgaccgcagccacttttgcgctgctgctttccgttgctgacagccgctttatctccaccggcttctccttcacggctggcatcgcgcaatgatgccgactttgaagcgtcaccaaaaagacggcgcattcggcaccgaatctgctggaacaacggcatttattgttgcaacggatgatggtggtggcggcgttccatttaaggcatttttgcttttagcacacactcgcttcactcacataatggcacaagttgccatttttggcattgtgctttcttagcggggatggagagcggggaaaggggcatggtagtgaatatttggcgtaatgccactcaaaattgttgagttcaattccaacaacaactatgactcctcccctggggcattccagctataaatgggtggggcttaggagaagctgtacacatttcactttttgccaccatttttggcaccagcctgacaatgatggcacattttcgattgttctggctcgccctgctggtgcccggccggaacaatgggctaataaaatggattgggctcgagtgtggaggatgggctactgctggtccagtgtagtagaattgggagaaaggacggcaaaaaatgggataaaacgctaaaataggggaaaatgaaagagacaggccgacagagagaaaaagcaaggcgagagagtgtctgagagagacatacaaagagtgagtgaaaaacattgaaatatttggctgagagaaaaagccgggcgag

SEQ ID NO: 13286 - DNA, 1953 bp, Heterodera glycines
aattttttagaaaatttaataaaaaataaaaatttgaccgaaataaaaaacacgagtacaattctggatcaaaaaagcgaaaaatttatttgttttttaaatttttgttaacaaatctcagcatggccggctgggacgtgcgaaaaccaaaaaaaaaatttttgaaaacgtaagaaaaaataatttctcataaaaccaaaaaagaaaattttaaatccgaaaacaaaaacgaaacgaaaaataattcctcacaaaaccgaaaaacttttttttaagttttaaaacgaaaacgaaacgaaaatattgtattatacaaataattttattgctatatattcttttattgatttcttatgattagagctccctaagaaatgacccgaaaattttttagaaaatacacccttaaaatctaaaaattttctcaaaaattaatcaccaaaatttattttattttttttcttgtaaaaaaaattttaggcttaaaaattttccttattcgaaaaacattaaagtatttcataatcatttaaatattcgaaaaagtcggagcattggagaaagaacaggagaaaggaaaggtgaattcagttaaatgacaaaaatcaattaaaatttattattccgaaaaataaattatttataattttttaaataataaaaattgtcttaaggtgcttttaaattttcgaaaaaattgttgggatgccatcgcttgtcccgaggggatcgaaattgttggcgataagaatttgactgtccatcataaggggatatataaatttataaaaggtaacgaaaaaatgattagtgaaaaaataataagtttccttttcaaaggtcgacgtcccgtcttcgcaaaacatccgatttcgttggacaattcgaccgacattttttactttgaaattactgtcctacaaaagattgggtactaactttataattttggcaaaatgccaagatttaacatttaaaaattcaattttttatacattttttcagagattccatcttaggattcgccgtaaaaccggcacgaacatggattgaatttacttctctccaatacgcacttatgcatatgaaaacgatggctgtttaaaggctacttttgtaaatggagtttacttttccacagagaataaatgccaaatattcctacggtgtcggcgatactgtaggaattggcgttatttgtgccaatcgacagatcgttttcaccaaaaatggacaacgtttgggtaaaaattatttatatagctggttaaatacagtcatggttaagtataaagtttttcagagtttttggctcataaaatatttgattctatttgcaattaaacaactgtccgtacacttgatcactaaaaatttggggcatatcacctaactttaatgcatttttatttttaattggttttcaacactaaattttatatactgagtgtccgtacacttatgaccatgactgtatttgaaaaactattcttttttgtgcatttgagaagaaaaaaaaaatttttttttctttttttcatagattcttccgattttattgttgctccatcgtttggaggccaattgtttccattcgtttctttggttcactccggtgccgaaattgaggcgaactttgggcctaattttcaattcgatttgaccactctttaaataaatatttttgcaaaatctgggtgatcatttgttatatttttgcattattttcatttgcgctttatttagtttaaatacaaatgcaagaattttgaggagaaaaaaaacaaaataattttttttattagtactgcaatactgaatatcacaatcgaagggatttgaccaatggaattaatttaattttaaagtttttttaatttagccattttttaaattttaataagtttttcaagaaatattatttcatttgtcactgaaattattcgtaaatta

SEQ ID NO: 13287 - DNA, 1927 bp, Heterodera glycines
tcgggttttctttgagctttttccagatttttgctttttcctttatagaagcttggagtgaaataggataattgacattttttggttcctttttgaaggttatttttggtgaaaataaatccattgcatcaatggattctttagtgaacctgttatatttatgctctaagtcaaattcggattgcaatgagtcatttaggtggaagcttaagaaggaatttatttgatgaatattttttgggtcagattttctatagcttattactgggggattggttttctgtaaggaaatagaaagatttatgaagagagattcatggtctgaatttattagactgtctttaatttcaacctctgagtggtacaaaacgaaatttgtcgagaagagtaaaagaaaaagtgaggtgatgcttcatcatccatcgtccgtcatcattcgcttcttttcggcatcatttcgcttttcctccgccggtcggaaaagaggcgggccttttgctgctgctgtgttggtgttgctcctgctgctgttgttgctggaccatctttttccggcgttgctctagcaccgcctggtgatcgccttcaaattggacaaaaaataattttaaaatccattaaaacgcaaaaaaaaaaatggaatttgatttttgttcatgtcacaccctcaaaaaacccaaggtacatttagggatgaatttgtaatagtgatacttcaaaacatttgcgttttttgggcctagaatcgaatccaaaatttttcagctgttttcgaagatattagcccaattataaaatttaaattttatttgcggttgaaagagcaagaaaacaaattaaaaaaacttagaaaaaattttttcaattaattttttcgggggggggggggggataagcggtaaagaagtgcttccgggtccgatttttcgaatccgttaagggcaatattatcacacacgtcctacgctctctcacccaatgcgtcgtaaaagtcgtcagcggcgaatgcgttcgggtcgtacacggcgcgggcgaagcaggtgcccttctcgtcgatgccgtacgcgttgcgcaacgcctcgtacagtgccgggttgatgtagtccttgcgccgtttgatgctcgcgtgcatgtccacgccgcgctccttcttctcgaaaaaggcgacgaagcgttgctgaaatgaaactttgaattggaggaaccaaaaaaaatttagaaatttagactaaaaattagggctgtgttttattcaccctccacggccattgcccccattttttttttaatttttggaattttttagttatttcatatcgagaaaaattccaccatcggtgatgtgaaaaaattaaattggatttttccattatcatcaaattgtgtcttcagaaagaaacttcggtacttgggggttttgggactcgatcataatcataatcgccaagatccggcgcgatatatttataaccctcgcgtgtttgtgaattcgcagcttaaccgaaacaatgaacggccaaatcgaaacgagtttccggttcgggactcaaatcaccgaatgcattcacaattcgccaatcaccaaaacgagcaatactcggctcgagatgctcggatgtaccaacatttgtcccgaccagaggcaaattcgaattttgtgcctccattgaacctgcaattctccgaaaatgataaccgacgcaatcatggccaatttccgaatccaagaaatttccaacaaaatcccgaaatggtttatgcacagataaatccccctgtttaccaaaaccaagcgttccccggccctaacattcccatcccgggaatattatggaataacaaaagtcaccctctccaccaatatgcaacacaaggagaaaatcccatcctgaacggacggaaggagtgacaaatcattgatttcttc

SEQ ID NO: 13288 - DNA, 2403 bp, Heterodera glycines
gggggggggggggggataaggcgggtaagaagtgcttccgggtccgatttttcgaacccgttaagggcaatattatcacacacgtgctacgctctctcacccaatgcgtcgtaaaagtcgtcggcagcgaacgcgttcgggtcgtacacggcgcgggcgaagcaggtgcccttctcgtcgatgccgtacgcgttgcgcaacgcctcgtacagtgccgggttgatgtagtccttgcgccgtttgatgctcgcgtgcatgtccacaccgcgctccttcttctcgaaaaaggcgacgaagcgttgctgaaatgaaactttttgaattattattttaccagtgcaatgatttgaattggaggaacccaaaaaaatttcgaaatttagactaaaaattagggctgtgttttattcgccccccacggccattgcccccattttttttttaatttttggaattttttagttatttcatatcgagaaaaattccaccatcggtgatgtgaaaaaaataaattggatttttccattatcatcaaaatcgactcaaaaacccgcaaattattcattttgggtcaaaagcagcagatgcaactaagaaaaattttgtatatcctatatgaaaaattatgaaaaacacgtcgcattttgggccgaagcaaaaaaaaaaatttttttttcagtcggattcgatttttaaaaaaacgcatcgtcatttctaagccctcgcacacttaatagcccacaaaaacccaaaattcccatgttttttgtccaacgaaccgccaattcggggtcgcactcgccgcggggtgagggcggcaagtcgcggtgctgaatggcatcggccgacgactcggccgccatgtcttcatccatcggctcgtccgccgagcacaccgaccggggcgtgtagccggggcccggcgttgaaccgccgccgccactgctgccgccgacgtcgagcatggcggagtccttgaaaaacaatttaaattgagaaaaatgtattttattgttttattaggatcggtgtcttagggatgcagaacaaaatttcgccacaaaaaaaaataaaaaaatttctttaataatttcataatccaaaaacctaaatggtgttactgaaaataaaatttgcaaaatttcaagaacacaaaaaaaaatttgaaatttttttgggtacttttcggttatgcggccacacccctccaaattttaaaaaagagaaaaaaggcgccaatggtagcgcgcacaattgtttatgtggcataaaagtcgctatttgagccaaaatgtcaacgaaagcatcatcattatgctaattgcagtcgttgtcaaaggtaagtaaaaaatttcccattaaatggtacaaaatttgcccaaaaattgaggaggacatgttgggaaatttcaaatgaaaatttttcatcattcccaacaaaaattgctgaaaatttaccgaaaatttggcccctttctccagcaacaggtccaactcctcctcctcgtcgtcctcatcgttccgccgtcgttcactgccgaacacgtccgcctcgtcgtcgtcctcgtcgaacatgtccgactgacgccgcgggggacacggctcctccaacggcaccgccgccgccgcaagcgctgacgacgaagacgatgaagacaattggccagcaaggcctggaaagtaaatgaagttttggattttttaaaattttaactgccaatagacccctcccccctctcccgatggcggccatttttaaatttttcatttctatcgggattttccctctttaaaaatgccaattctaaaattttgccaatctttttaggacttgcggcacccggaagcgtgcccggctgactcgacccgtgccaccctggcccaaatacccacccccatttcctcgctgtttctgctcctcccgcggttgttgatcaggttcaggttggccatgtcggctttgctggtgctgcccctcctcgtcactgtccgagccgtaggccaacaaagagttcattattttctccgcttaataagaaaagcggtgctacttaacaaatgatcattttgaatgttttttaaaaccaaaagggactactctcttggtttacaaatttcttgtgataattagggattcgatttatagttgctaaaaagcgccaaaataaacccccaaaatagttgctaaaaatggggaaatagttgctaaaaactttcaatttagcgtgtaaaatgacaaaatttattcaaaaaagctacagaattatggcaaattaatattgagatacctaaataatttttaaaattaaaaattcttgtcaagaaagtaaataaataaattttggagatgaatttttgaaaaaaaattcatttctaaggggtatatttttgaaaaatttcggg

SEQ ID NO: 13289 - DNA, 1480 bp, Heterodera glycines
  misc_feature (1411)..(1411): n is a, c, g, or t
  misc_feature (1428)..(1428): n is a, c, g, or t
gtttttttttttttttttaattttgggggggaaaaggccccccccccgggcgcggagagccgagtgagtaccttcggtgcaggaaaattattaaatttaaaaattttttaattgctttttaaatatgccaaaaaatgtaggctaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttttcagaaacttatcagaagcgccccaaactttgcagggatactgaaaggaaaagaattaacctgttttatcacattagcttgtcatcagtttttataaaaaattttcaaaatcgccccaaattttttttacagcttaactaggccctattaagcttcagaaaatctcgcatgaattctcatttttaaattttttatagatttttaaatgtttggattttttttggcttaccaaaacttcatcgaacctggttctttctcgccccaaattttttttacagcttaactaggccctattaagcttatttccagaaaatctcgcatgaattctcatttttaaatttttaatagatttttaaatgtttggatttttttttggcttaccaaaacttcatcgaacctggttctttctattctctttcaaatcgccccaaattttttttacagcttaacaaggccctattaagcttatttccagaaaatctcgcatgaattctcatttttaaattttttatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaattttcgaaaatctgagtctttcgtttttatttattttttgcaaaattaattcttaaatattttttcagaaagnggtctgaaacgcaccanatttatttacatggtagttaggcactctgatgctttttctatcaaaaaggga

SEQ ID NO: 13290 - DNA, 1964 bp, Heterodera glycines
actataaacttttctctttgtcaacaaaacccaaaattcttggtatcattccaaagctctttacattctctattagccttggaaaaagcaaaaagtgaaaaatttattaagaaaaaatttaaaaatttttagcaatttcatgctataacttttttgataattatctaaccgacaagcaataccataaaaatagcttctaaacatgaaaagctttcgatgataccaacaatgttggatttggtggacaaagaaaaaaagttgtagtccaaaaacttgctggggcccaaccgcgaagcccctactaaagtaaaccgttctattgtcaaaagtaatcaaattaatttaatttaaatttttttgtttttttatactgtatataataacaaaattttatagaaataattttattgtttttacaataattatttttcccccaaaaattcctcaccctaattaggcgtaaatgcaattattgaataattatttgcccaacccacctgtgtccgtcccggttccagcctcaacactttccaaacaacgcggttcctgcctcaactgcaggtgttccccgccgccaccagcggacgaattgacggccgaaattggtctcacggggacgggcataaaatctataaaataaaaataatttaaaataaaaaaggtatataataattttaaaaatatttaaaatatacttttttaaatatacctaaatcttgtccaaatattaataatggaaagaaaaataaaaataaacccaatgagaaatgcattttatcttaaaatgaaaaaataaataaattgttattgaaataacgaatcaatgttgatgagtgactaaggtgtgaaaataaatcacgttaattaaaattaaaaaaatatattaacgatatttaaaaaataaattaaataaataaaaattgccatttaacaaattatagataaaaagattttttaagaatgaataaatatgaagcgattcttgatcgatcgtgacgagagtattttctaaaatttgatgattaattgaaaattaaataaattgaaataattcttattaatctacaaaaaaagagttcaataaaaattacttattttatattttattattttagtcgtagaaattatgtataaaaaacgaaaatttcaagataaattactaagtattgtattatattataagtctaaaaataaaaaatgattaaagaaattgggaataatatatatacattttttataatggaacgacgacaaattatttgctggaattatgtaccacacgtaaattgatgtgaaaaattggggatgctacgaacgaacaaaaattggtgtggaaaattgcaattgttgatgttgttgtctttgacggagcgcagaacctcccaaaagcgcccaaataaacaaaaataatgacgaaaagcggaacaaaaatttataaaaaaaaatggaaaatcatttttattggcaattttagaaaatttattaatttgtcataaatttgaatggttgatagccaaaaaaaaaacaaagcaaaaaccatttaaatgcaaagatgaaataaaaaaaattaattaaaattaaaaaaaataattttataaattattgaaaaaaaaaatgttttacacattttcatatgaagtgttttttacgcactatttattaaaaataagtaatattaaataattaaaaaattaatttgcatttttttaaaaatagttttgtgaattatttgaaaaaaatggtttcacattttcattaaataacaatattttttttaaaatatgtaggattcgaaaagggaccaactttttgagaaaacaaacccccttaaaatggtgaattctcagacatagtagcaaacagtctagttaatttttacccagttttaaaaaatggttgggccttccgtgacagtttttatttatatatttatcattatctttatggatatttcgtcaaattgc

SEQ ID NO: 13291 - DNA, 2447 bp, Heterodera glycines
  misc_feature (27)..(27): n is a, c, g, or t
  misc_feature (64)..(64): n is a, c, g, or t
tatttcgtcaatttgcaaatgttttanaatgagggagggatgggtgtatatccgatcacatttntcattcaattagcatcgtttccatgaactccgccaagaatggtttgctgctgtttctgatcatccgcctccggcggtttgatcatcactgtttcaaccttcgctcctccgagaaattttcgctgttcttggccattggtgtcgttccgaggtggaatccatggccatgctccacgcattcttcttggctgggcatcctccggtttgatcaccactgtttcaaccttcgctcctccgagaaattttcgctgttcttggccattggtgtcgttccgaggtggaatccatggccatgctccacgcattcttcttggctgggcatcttccggtttgagctgtttttcaccaccaactccgccgagaatgtgttgctttggtgcatccaaattgtccacatcgttaccataggcgccgccaagaaatttttgctaaatgttttttgtgaaatttttttatttaaatcctttaattattgtactttggttgcgtctgagaaatgggctaaatacacaaagatgacaaaggaaagaagaggaaaataaaagttatgcatttttatgaaaatggatcttaatttatgaaaataatttttaatttaatttgaaattattattctaagtgattttattgtgaaaaattttttccttaaatattcaatttttcacatttggaaggagcatagaacaaaaaatcatttgatgaaaaaataaaacaattgtggttgatcctgtgatccctgctaaaacgtgagtggttttttgttggtgattaagaaattgttttttgacgctttaactcgcaagaacaatgtgaaaaaagaatttgagaaaacggaaaacaaaaaaataatttaaacggaacattccataattaattaaaataaaataaaataaaatataaaactgtaattttacagtaatcaaaattaaaaataaatacattaatttaataaacaataaaaggaaaataaaaataaaatttatttaaataaaacataatataaacaaagaaaatttaaaaaaaagctaaaattttattttaataatacagaaaaaaaaacacagattaaaataaatagaattaaaaattaaagaaaataattttatttaccatgagaaatttacacataaatatgaaatgcatgtaattacatcatattagaacattggctaaatcacaatttttaattggctatttatataaaaaaatcaaaaaaaaaaattaatttaaattccgacaaatttcactttttgcctttttttgccgctaaacttgtggccaagtgtggctgacgatggtgctggcccggatgcacaatgatcggcacgcccgggttctctttagtgcaggcacgttgatgtgcctgatgggaaaatttgccgatttgaggccaagaaaaatgcaaaaacaaaatattataataaattgtaatggtaaagcaaaaagaaaataatttaaataattaacaaagaaaaaaataattactttcatttaaactttcatagtgaaattaaaatgaattaaattgttttttcattaaattatcaatattcatatatgtatttaaatattttaaatttttaaagcatatttaaaaaagaatttaatttttctttaattaattgtttatagttaacataattttttagctaataattaattttttctttaaattcattaaaaatattaagaaaattttaaaaaactataaagatttaattgtttttaataaaatttataaaagtcaaacaatggcacaaaaatatttttcatttatttaatggtttaatttttacctgaaggcgttcgggcgcaaatttccgaccacagttttcgcagcggataagctgagctaacgatgcttcatatgccgccatattggtggcattcacatcaattgaattgtccgctagatttaaaaaaatatttaattataattattttaactgtaatttaattttcatttttcaaaccttttctaacaatttttgggggctccggctcagtacggcgtacttcttttggcaattgatcattttgtattttccacttcttcaaacactgtggctgatgtattcctattaattggtttataaataattttttaatttaaaacgattagcaaaaatggctttcttaattaaatattttttataaattcttttaccaatgctttttgagccaaattgacggccacaaatgtaacaataaatgggttgatgagctgcagcttttggaggcccgggcttcaaatgttccttaaattattgtttagaaataatttattattgtttaaaaattaaattaacatacataatggtttaaattgtttgccattaaaccaggactaaagttagctaaacaaattttaaaaattaatttaa

SEQ ID NO: 13292 - DNA, 4963 bp, Heterodera glycines
ttgcttactgtatgcacggtgaaaatgagttggacccttgataacaaactgagaagaagcgaaacaatcgaaaacagcaatggtagtgatgaaacgatcctctgtattttgagaatgactccattaaaaagttgggaaatccgctttttaccgtatccccctacagtatccaattgctcttcgctgatttcgacatcatttaagctcaaaaccaaatgatagtgccaaaattggggcacaaaaaggaacataatgagcagaaaaagtgcgtaaaacattgtcagcaacatttccattccctaatttcaattaaaatatttgttttaattaattgggttcaattttcaaaaaatgacttacatttaccaccataaaagggatgtacattttcgattcgtttctttggtaagcgtacagtagcgaaacatagaggggcacagtaataatgcacagtaacaccatgggcattgattgggcgagcattgcgcaaaagaggccgaaagtgtgcactgcagtgccgagcacaccgatccatttagcacccgtctattacggtggagggtgggcgagattacggtattagtgaacggacgtaccaacacatgaacagaaccgcacagacagtagaaatcgggtgcgtccattgaagaatgtgaattctaaaaagctcaatataaaaatatgcttttgaatttaaaatttaaaattattaaattgtgaaaatgaaataaaggtgcactcattgattcattttattcatatttatttctgatttaaaattgaaaatgggcgggagagggggaggattgggttggataaagcagtgccgagggaagagggccgaataaatcacccagcccccatcaaaagccaacccaacccaccatcagttcgtggcattggcaatttacatttcacaattggcaattgatcaataatcaaatcaatgctgttatggttaggtcgaagcaatggcagtccaaaaattgattttgggaatttcattgtttttgttttcgagaaatgaataaaatattttttataaacttttcagtgatggcctaattgtgttgtctctcgagcagccctaataatttagtgatgctcgagagtcttgtgaattttcggttttgagcatcactttatgttaataaaaataaagaaatgtgaagaaatggacaatcttataatttataggataattaaacagattaattaattcacacttccaacaataaatattttcggtttctttgttttggtccgtcaaaatttgctctttctttctttaatctgtccgtttctcatcattcattttgatggtttagctcttcccaaccaacgcattaatacttgaactgctattattggcactccttaacaaaatttcttttaaattgtcggttaaatcaaaaagattcgctgaccatccaaatgggcccaatggcatttgcgaggagcagaaatcgtcggccgaagtgaaaagattttctcgggggctttttggtcgagcttaaattggtacaattttttaagtaatagacagtcccattagtgccattaatcgcccctttcttctcaccgacgggcattttctccttctccacctccaccaccacctttttgccacttttttgcgctgcttctgccgctgcgccgtatttcctttgcgctttttgtcctttctttggtgtttcttccgctatcacttccacatttatactcggtcgtcttaattaattgttaattgctttttttatttttaaattcgctcaaatgggttcacctgattgtgttctttttctgtgccttcagctgcaaaatgccattgcgcgtgaagtgcgatcggattgtgccggcgtccacgtcctccggcactttgtaacttcggtgcagctcccgcttcacccagctgtgctcgtccactcgttcctcgtgatggcagtagatgaacaaatggtcggccgacagatttatctgaactttgtgaatttggaaaaaaatacttctaaattattctaaattaatattattaatttataattaaatatgttcgaatttgcctcaatttcgttcggcttgaaaaaggcgacgtccaaattgacctcccaaccatccctcccattgtgcacttgcacaacgccgtcttcgtgccgaaataaaaaaaatgctttgaaaataaagcaattggaaaataatcacttgcaaaggccaatcccacagatcggtggccaagtcgtgggttacttttacaatttgagccatttttttgattgaataaaaaatctgaaagataaaggcattattaaatgtaaaaaatttataatataaaataataatttatattaatataaaataaatgtttttaataaatattacttaaaataattttaatttttaagcatttacacgtccattttatagcatcgatcaaacaatggaaaagtgaattcgatacactgatccatccctttgggttttccgttaatttcactgttgggcttttattttctgtcttttgaccaaagaataaaaaatccgtcaatccaaaaataaaaaataaataaataaaaagagagaaaatggaaaagaaatttgacactttttaaattccattgaaaataaataaaacgaacgttggactgctttgaaataaacggagggcgtctattaaaaaatagttatttatttttagcttttttcgttttcatttctcaacacatgaaatgatttttattgtgagactttaaactttttttagattaagcaacaaattaagaattaattaaccatcgcatgacattggcttttcgtttggcttttccttcaaaagcttcttcttcgggttcgtcgtttggtgatcaattcgatggatcactcagtcattgcttgtccaattcgatctgtcgcggcacactgccaaagaaatgtgccgcttcatcgatcacttttgggtcggtgttcggcttcagattgtccttcagctccacgctcagtttctcctccaattgtctgactctttccactttctctttgggtgttttcgtttcgtctgttagtgtgccgaaaatttgtttcattgccattttcgcctccagcgatacttccgaatatgagacgattgtgtccaacgctttttccaccgtttttcgcgcttcatcgattgcttttttcagcgtttccttaatcatgtccatttccagcacattgatcacatgaaggaggccatttgatcagtttcccaattttagaacattttgttggttgtactactaacaaaaagccgatttccgcagctttttccgctttgctccgttgacatttttgtgccgtcctgctgctttaccttcacaatttcgccctgcttttccgctgtttctagcagtacgcgtctctgttccgcttcgctcaattcgttaaatccgtccgtctccgtcgcctttttcagcgccaccgtcgctttttccactaatgcgtccacatcgctcggcacaatgtcctcaagcgtcgtcggagtgccgcgctcactgcgcgcaatcgcatcgcatgttttggtgtgcaacaccttcaaaaagcattgatgagaagaagcaaattaaacgaatcaacggccaaatcatttaaattagtgcgtctgacttgggccatgcaaagttaatttagaaataaaatttaaaattttaaaaatgcgtccgatggttaagcactgacaaatgagtcaacaaccaaaacaaggatttaaagaatgtgccaagcaatttgttgctccggtccttactttgcagccgatgctggtcgcttccttggccaatttgagttcgctccaaattgcgctgtacgccgagcgacgcctgcggctcattgccggccgattgcgcggttccttcgcccttttggcttcgtccgttttgctatctttggcatttttggcgagcacaacaatcacaacgatggtcagcagaaggacaggcgaaagacgcatttgtggcaaaaggcgttgaaaagagtgacttttgttggccaactgttgttgttccttccattttgatgggccattggcattttataggccaatgctttaccttttttgtccctttttaaaatttatttttgcactttaaagcattcactccttccacaaggtcatcattttgcgttgcttttaacaaaggctttcattaatgaattagctgaaaaaggaaaggccatcgcggcggacggacttttgacgggacggacattctgttggggaattcgatgtgttgtgttcgcgcaaatcgatgttggactaataaaaaatattttgtttttattggggggggggggaagcgcaaacgacggactgacggaacaaaatgattgatcagtctcaaagattagccgccgttctaccagtcatcagccgaaaatgttaaaaggtcatcgacaaatgtgcacgaaaaatgagttgaaaaaacaacaaataataaatttaatattattaatttaattgaaaatagaaattcaaaattaaattagttgggaaagttacaaacgaaaaaatattttgttgattgaattcagacaacattaaggaaatcaaaaattaaaaatgaagcatcaaaaaatgaattataaaagtgaataacttttttattttcattaaaataaaactgataaataaaattttattatttacaaaggaatgatggagaaaatcaatacgattaaattaattgtccgtttatttatcgtacattttcatttttcgtttccaacggtttacaaattttgtctttttattttaaatttaatttttattttttgaatggcgtcggttcaatctgagcttctaatcggcgtggacgttggaacagaaagtgtccgagttggcctttttaacacaaccggcaaacttttgtcagtcgccaaacgcgaaattcgaacatggcacggcgatggtggcacagggaacaaagcacag

SEQ ID NO: 13293 - DNA, 1112 bp, Heterodera glycines
tgttaattgagtgtaaaaatgatcttcgtatttagccgagtaagaaatttgcggataaggaagtggtgaaagagatgatcaaagttgcccagcccgtgcttaaatggctcaaggaggcggaagaagggtcggacgagtcggaggacgacgatttggacgttgcatttgacgatcgaagccgcaacattgggatgacagtggaggtggaaaagggagcaaaggatggggtcacccgtgtacagaacggccaaattgcaaccaatggcaaaatggacgatgggaatgcagacgacattgacattgacaatatctgattgtgagtggcatggcgcggtggacggtaattcagtgatgttgcaagaatttgtgatcgtatgccgaagactttcacccaccccttttgttcattgcgataccaccacatttttgttcgcttttatcgtaaaaaacttattgtagatgtttttaacacggatagtataatacgcgtactttcattgagcaaatgtcgaatccatcacatgcatttcttcttctttgtgtgtttcgatgattgaagttgcgaaccattccatttctgttcgtcctgcatattttaactaaaagattaaaaagtaatgaaagtatataatatcttggaaccattcaagatcagattccccccccccctcaaaaaacaatcacgaccgcttttgcatctacttaccgtaagtccaaatgcactttggaacctcggcccaacaaatgcccaacagccggcattcctcggctcttcctgtgaccaaatgaaacctttggcatagcaataagttgcgaagacatttgccaaatcatcggtcgagaaaagacagagcatttccattcggacaaggaccaacaccttgcaagacaatagcttttctctttcctcggccaaagatacatagagattacccgatgatataataccctctaaaggaattggacggaaaggcgactttccttttccgcaccttttcaatgactgttggctatgtggacatgttgtgatccgtcaaaattgtgttatacaaagtgcccgattctaatccgctaattggcaaaacgttgaatgatcggtgtaacagaatttt

SEQ ID NO: 13294 - DNA, 2154 bp, Heterodera glycines
cgttggtcgacgagcatcgcgtggcggtgggtgaaagtcgctcgcccacctgtcaagacattggcattttgtgtgcattattcgcacggtccgtcttgagcgtttagtagagcatccttaaaacatttttgggattggcttccttctgcagagtccccaattcgcacatttcctatgcaaaagtgccgttccgattgccaatgcttcggctgtgctccaatcgatctgtccgtgtttgagtcaccctcccattttgccattctccccctccccccaatttccccacttggccctgctcaattttccttcgcctggcttcgatatgtgtctttttgaggtgcgggtgtacaatctgtctcgggttttgatttggacttcttgccaaagcttttcactcacaaatccctccggaattgtaacggaagcgaccccaatttgacggagcaagtccatgtccatgccggtgtcccatttggtgacagcggctggcgcttggcaaaacctgagcaaacggacacaaattgaaaagggtgtcatgtcgtcaaagggtgcgaagtgtgatcaggcaccccttccataagccgcccaaatgctcggcaattggcggtgttctaccagagtcgaccaattccaactgttcactcagcatttcagaatgaccggaaacaatcgactcggactgatcggtggaaaaaaggcctttgttggcaagtcgatcgacgaacgaatcgaccaaacaacgtttggcatcaaccgaatggtacatgagctaaacactttgccaaaaaagaaggaaatggtcgattcaccggctgagtgaaccgcgggttgtccaattcgttgtgtccgtaccgccgccaacaaatcaaattgacaaaaacatctttgcggaatttctgccggaaatccaatgccaattgagcagcgaaaatcacatccttaagggaaagttagccggcggacattcattccgttccgattttgtggaccgacttcgaccgattcggcattgacgtgaatgaccggagagtcaatggccttggcaacgtcggaacaatggagcgaagaacggccaacggcactttcggcagtaaaagcgatttggttgttcacaatcaaatgaatggcaccgccgacccgaaaatgactgagaggcaaagggaaatgccgagaacggaagcagtaatacactcacgggacctgagacaatgccaacaccttaaaagataaggaaatctaggggatggatgaggaccaatggcacaattggtccctaccgacctcccaaacgatgccctgcccagtgaatgctccgtcgccatggtggtggacgggaaggacccgctgaagagggaaattggggagagtgctcagtgatgagtgaacaactcacgtcgccaacagtccctcgaccgtaatcgcccactctgaattcgaatttgtccgaccgacgaactgtctgtccccttcctccatccgtccaaccctccccttccatgccttctccccccccccccccccctctgttcgacctgagtgtctgagcccgggcccgagctttgccggagcaaaccgcgagggaaacctttgggggaaaaaggggaggacacacaattcactcgtccaaaaaaggaaaacttcgagatgggatgggttgggcaatgtgctgacatgcacacgaccaccggcgggggattcgtagtcaaaatgggagtgttggtgggtgagcaccttcgacaattaaagcattacgccattttggcacttttggattcaaattcgtcttcaattattattttttcatcacatcgccaattcctttcacatctccgggaaattcggcaagtccgcgcatctgagaaaacggactttacgaaagaaaagcggcggatttgggaacctttcggaacaattggccgggagggaaacggaaaaggaccgtttggagggcgagacgacctttggtgggaagagatgagaaaggggggggggggggggagggcaatgaacacagtgccaaaacacaaaaacaaaccccgatgagcaccatcaaaaatgaactgctcggaaggggggggggtagagcgggaggatgaagggaatagtgcaaaaacgaacttcggagatgccatgccgaggacacagctcaagcaa

SEQ ID NO: 13295 - DNA, 1952 bp, Heterodera glycines
  misc_feature (84)..(84): n is a, c, g, or t
  misc_feature (1858)..(1858): n is a, c, g, or t
  misc_feature (1874)..(1874): n is a, c, g, or t
  misc_feature (1928)..(1928): n is a, c, g, or t
gctgatcagtcgggcgacaaagaatggattgtcaagataaaatcttgccaatgctttgggtttgcttctgccaagacgagtgtntggtcagccaaaaattggagacttgtacaaattttccgaaccgtttcaatgaataatttttgtgtgttagcagatactttagcgcttaatgcggtaagatgagctgccaattgtgaggagtaaacaattccgactgattcatcctttttcacctgatcagctggtaggtgccaaattacttctaagttattttccggaatttccgggatgaaaagaccctctctttttgacctttttaaaatcgtatccgtttccaaatttaacttatttttaaaattgatcatttcgtcaaactcctcttttggaatagcaaatgcttggtcgggaattatgaattccttattttcgcagtcccttttaagtgaggcatttacaaaagtgagagcaaaatcaccactttttgcagcccaaatatctgtcgaataatcccctgaccattttgcaattttaacataagcacattgttgggtccgatcgggcttccaaataagactgagctgtggacacctacaatttccggcctgatagtcacatgctgaacattcatttattggtgggttcactccttgggacccataacgggtgaaaacaatccgtacacataacaatttgcgatttcgtaagttttccaaaaaatccccgcaggccagattccccaaccaacatccaacgaattatttgtcgccttcattgtaccatttaatgaatacaattcgccctcggggactcatttctgttggggtccatgaaggacaaaaagggttagtcgggaaagaccaaaggctggatggcgcatccggcaaacaaatcataggacccgccgcgccgttttgagttaatcctggtgctaacatcgacaaaaggacgattagggccatgaaaataggactcgccaatcttgcggcggcaaatctccgtcccctaaagtgtactcggcctgatggtgaatttgcttgctcatatccttcattttcctgccgaccaaagggagtcggggttcggcggtttctttgattttctgacccattaaagtattgcctttctcttgtaaatcggttcgccatttgccgatcgtttctttggttcccttgtcctctgcaatttgccgtaaaattttgcctctgtcatctctacccctgtcccagttttctctaggatgccaattatttgatccccagcggcggccatcattatttgatccccagcggcggctatcattttcatcttttttctttatccgacaatcccttacaacatgcccttgtcggcggcaataatagcagcggcgcctgtcctggcctttgaagtctccgtccctttgctgggttagggctaatgtcaccacacgagttgagagttcggccattgaatcggcgaccgagatctgagtttcccgcttagaggccaacaataactcaaaatgctgcgcaagctcatatgcccccgaataattggcaggacggcctgcttttacctcaaattggagatcgggatttaaccgttctaaaaattcttctaacagccgtttgcgaattgatccctcattctctccagctaatgcagttctaatcgcttcatttaaacgatttgcaaattcatatactttttcaccgggcgcttgtctgcaaatggataatgcttggcgtgcaatggacctcgtattttcattttcaaatttccctttcaaatgattaagtgcgtcacctaatgttgttgggtgcgggtcaatcgaatccaattcggcacgtgcttgtcctgtcaggaggatgcgtanacgactcaacttttgngcttcagtcaactgggggtaaagcgaaagcatatccctcaattcgaaatcgatncggaaattgagactggtgggtttc

SEQ ID NO: 13296 - DNA, 2189 bp, Heterodera glycines
agtctttcttgcatttcgaaacgaaccgtcaaattttccacctttgtttccatttttgcccatttctctgtgttttcaaaattatccatttcttccatattttccaaatcattcatcgatctttccaactcttccaatcgaccaatagctttttgcttaggtatttccgctgtaaaatttgatatttcttgttgcacagcgcggaattgatggtaaacggatgactcaaatattctcatccgatttaataaattagccatcgtttggttttcctcttgcgaaaaatatattgcatcaaaatcagaacccattgagcatgcgggcatttgtatgtttgagccgctctgcgaattattcatattttgctcggtcatctctcccttttttttctcgattagcactcagcaaaactgggaatacacaatttgaccagcttaaatctttaggagagggtctggcacaaaagccccgctggaagtacacaactttgaccagctaaatccgaatcggcactgagcctcggcgtgggcaccaagcctcagccaaaaatcactttactcagaactgttggacctctgtcccgggtcgtggcaccagaaaagtgttgtgtccccggtgggttcaacccttgtctagagccacccaaattccaaacggacttttaagaaaagtttattaaaacgaaaagcaattaaataaaaagcaaagcaaagattaaagcaattaaatcaaatgcaaattaaaagcaaagcaaatgtaaaagagttttgttgggaaagcagcgagaattgagttggaattggatgggggatggcttgggtcgtccagaacaacacaaaagattaaagtacaattagttaaggcaaaattaggttattagtaaaaagtacattaaagtttaaaacaatagattaataatcaaaagcaattggaaactgcggactcaacacaaacccatcacgtagaagaagtgaggcacctcgttttgacttaaattcgatgaattgaattaattcttgattagccgtttcttcgttcccagtaaaaaataattattttttcactaataataattctttgttttatttcagtgacgaaaggttcagtgacgaaacgttcggccagcctataacctgcaaaattccaaaaaatcccttcaattttgaacaagttcatggctaaaaaggttggaaactcaagttttttgaaatcttctggccataactatttgaaccttaacgaaattttttttgtggtcaattcttaggggtgtatttttcgtttattgcttttatgtagggtacgcctggtccgagtatttggccaaaaaccgggtccgagtgggtattgccgggtatagaaaagccgggtcctggtccgagtccaagttttttaaccgggtccggtatcgggttgaaccgggtcctgaaatgcgcagatcaaaatggattcggcagggcaaaaaattgagaatacttataggatttagcaaatcgtgactttttatttacgaacctgttcttatgactcactttttgaatttttttttttttgtaatccagattatccaatttggtttttcgaaatttttattttttcggagcttaaaacatccaaataataattattaggcgtagaattatatggaaatccatattttttcctggagtgtgggaggcttgaaacgcaagaaaatcttgttttttagctttattagaagcatctagagtgaatttctatatccatattttccctatttttccatatttcgcgatttatgaacatatttccatattttttatgtccatattttggcattttaaaaaaacctctatcagaacggccccaccagctaaattagcctttttttaccccctaaagatcggaaaaattaccgaaaaatctttttttttttgcaaaattttctcgagaatattgaatatatttaatttttttttaaattggtaatttttttgtcaaaaataagcaaaaaaagcgaaaatttcgctttttgtttactttacatttagcgaatttaaagaaattttgagaaattacaccctcaatttgaaaaatttatgtccatattttgtcattttatgtccatattttgagattttcgcaattttatgtctatatttcgcaatttgttgtccatattttatggccatattttgcgattttgtatc

SEQ ID NO: 13297 - DNA, 323 bp, Heterodera glycines
  misc_feature (309)..(309): n is a, c, g, or t
ccccccccccccctagatacgggcctgtttctacctttgctaaagtgtggaagacattgggccatggagctcagaatggcctcccgtacggatgggtcttcgtccttgaacagttggatgatgcaaggcaatggcaaagtgcaacaaccggtggaattgctaaaaatttgaaactaacaacggattggtcactgagaaatttattctgatacgaaaatttttaatacagtttttgcagcactgacttcaaaaatgctttgaattggaataattggttgtttaacgttagaattttttttgtcgtcacanaaaaaaatttcaat

SEQ ID NO: 13298 - DNA, 2229 bp, Heterodera glycines
cgaccgccaccactttcggtcgttggccatggccatctcccatcacgcgccaatggatttggatgaatggattaaatcccccccccccccccccagcggcggtcggcgccggcggcggggcgttgccgctcctctcgccgcccgtctctcgcggcggcggtggggctgggctaagcgccaaaaatacacacacacatcatcatcattataagagcagaagcagcagcagagcaagaagcagcaaaaggggcacatcatccaatttcaaagccatccatccaaatgcaatattcacacacagattcatccccattcattcattcgttcatcagcggtaagtcacggcgccgccgctgcctttccttctccgattgactataatatgtataacaatgtatgtgtgtacatacaccgccgccagcagcagtaggctctcagcatcaaactatggttgtgttgtaccacgagatgatttccagcagagcagtccaaaagctcaaaacgccgctgccacacaaccgcgggccgccgcctccgctagcgatacctctgggagggggggggggggggacgggaaaaccccgccgttggggagaagccgtattcatcgcccgccgctgttttgctgctgctgcgcttctcctcatgatgatggttggtctctatcattgtgaatgttggggctttctcgtcgcctcctccttctcctcgcccgttttgtgttatatcttcgccgcaggcgtcgtcgcgtttaatacacacaccaaacacaacactcacacgaccgcccgcccgcgcccgacggcgccattctctcttatcaccgcaccgcaccgcgccacactatcttttcaattatcgccggccatttctgtctctgccgatattcgttttcctccgttgtctctctcccactcccaaattctcggaccgggtcagtttagtacgggccgttttagtacgagcgcacatttttccactataacttttttatttgttatccaaatccaactttcttgatatcattcgagagcccttcggatgctctattagctgcaaaatttcaaaaaattttattaagtttaaaaaaagtttgagccagaaaagtttgaaaatctggttttttgagtttttctggccataacttttttgaagcttaacaaaatttttcgcaatttttcagattaatagaggacacttagggctatcgaacgatactaaaaatgttggattttgttggcaaagaaaaaagttatagccaaaaacttgcgctcgtactaaaacggcccgtactaaaccgaccccgaccctgtcgcttggcttttaattgcaaaaatttggtaaagttttggtgaaatttttcaacaaatcagaacgaaattacaaaaaaattttccgtcggcgcctatcggcaccgcccgaccctctcccctcgctcatttcccaaaactttttggaaacatgcgccgtaaaaaaattgttaaaaatctgattttctgatcccaaatgcgctgaaagttacgaattgcttatttcttccccccaaaaaaaattctaaatggtttaaaaattggaaaattttttaataaatgcgcgatccgcggtccgcggcaatttgaatgcgcgatgcgcggccgcagttttttttttgcgcgatccgcggtccgcggccgcggcaatttgaatgcgcgatgcgcggccgcggtttttttttgcgcgatccgcggtcgcggcaatttgaatgcgcgctgcgcggccgcggtttttttctgtgtgcgtcccacccctggcgcgaacgccatgtgtaagggtcggggtcacttcggcgcgggtttttcggcgcggggttttttcggcgcgagcgccgaagtggccgcgccgaagtgggcggttcccatgtggaaggcgcgctctacaggacggatcacatcgttggaatagcttaaaattgggcgcggaaaagcattcaaaccggtttttgaaccggtttaaaactcgaaaaattgaggaaaaaggtggcctcctgaccttttagcacctgcactagtactaacaaattgcaccgcctaagcgcaaaaatgtttttaaaagtgaatatgccaatgaatttcaggggatcacaaaaagcaaagcaggagatgaatttgcgcattgcatcccatgcaattttgacatttctttgttgtccactggaaaaacggccattcctcatcatctgaagacggaaaa

SEQ ID NO: 13299 - DNA, 1781 bp, Heterodera glycines
  misc_feature (1773)..(1773): n is a, c, g, or t
aaaagcatttcattttgacattgaaatttaaaacagtcaaaaaatttggaacgcttcacgaatttgcgtgtcatccttgcgcaggggccatgctaatcttctctgtattgttccaattttagtatatgtccatttggaatgaacaactctcaccgaatggacattctttatatatgaaagatgagctttttaagcaaaatttatgatgggttgaaaagcagagaggcacatcgtctctctgctgccttcttttcgtttactctttttctttgtccaatattctctcttttcatctcacatttctttgtcttcactcataaatttgtattgtctctcttcttttttgcccatctgtgcatgtgtcttacgctttctgtgagggaaagaaaataaggacgacgtgtaaaaagagtgaagaatttcagccaactgacagacgatcatgggaaggaaatagtgcacagctaattggaaaagaaacgagtgtgcctgggaagagagtgcccttctctttccacaagcctctccatctcttcaccactttccaccccatctctcctttcttctttcaatggcctgtcaattgaactgcctgctgttttctaaacttacctggctggggagttcctgcgatcacaaaggcagggctcctgtggcgaggctccaccattgcactttcggtcggggctgacccgcagggcggtcccgaactgggataggcccacagctaaatttttgagtgcgggggacggcgttcgcgcctcccctttaaaagatttgcttggatttggaatttggatgttcaaaacttcttcttgtcctttaatttgtgagtccaatttaaatgcgatttttttttgtctgtcttggctttgaatgacccctacaatttacatatgacctgctctgttttcaccacttcaactgtttgtgataatagtattgggttcgagacaaaggcagaaaaaatggcaaaatacatagacacaaaatagacaacataaaatctttggaatcttttgttaacgctttttaatagtagaacaagtaaaaattaaatatttgaattgtaaatgaaattattaaatattttaatgttttttttcaaataaggacaaatttttaaatgaaatattttatttaaaatttgcgggtcaattttttgggaaatttttcacacttcttaggaaatttttccggatcaattctttggggtgtgtttttcatttttgttgaggattttttcgaaagtccaaaataggcacattaagcacaaatccgaaataagcaaaaataggcattaataaaagtcattgtagacaccccaaaccaagcggaaaacgcctttttttttcatctgtgcgtattaagtgctcagaaattttaggcatttgcctaaaaatcgcatctgtctattggcatttcacctttaattatgtcctaattgttctacaatcatttgcaatttagaaaaaaattgccaaccaaagcgattgttttggggtgattataaggtagtggtgttctgagatttgaccccgagaccgagactcggccacgaggctggaaaatggcggtgatgaatcatttaatgattggctgctgaagcgatgccaaaatggggggacggcggaggcggtgggtggttcgatggaaaaatgatgaaaacttggatgccaatttgtacaaaaaattttttttttttgatttgtgcgccttccaaaattgcattggctaagtgtaagccaagtgaatcagtggcattttccactnaataaatt

SEQ ID NO: 13300 - DNA, 3813 bp, Heterodera glycines
  misc_feature (2516)..(2516): n is a, c, g, or t
aaaaggttttttccattttaggtaatttatatttccgatagttttttataatattatttttccaaataaatgtaaaaatattttttattatttatgttttatttttccccattttattttctattgttttttatttttctcttttttattttgggttttatcttaggatttcgcgttgtcgcgacaaaaaatttaacatttctattccactaacagccccactaattacaaccgaaggttgtgagtttcattgattgtctgcctcaaaaaagatggtgtttaatggaaggtcctcaaggttgtcacacgcgaatttagaaaattagcatttttattgcaggcaattcatttagagaagtcattaatttatttgttatgaagttctttcattgaaattagtttaaaaaccctttcttgccgattacattctgttctaaattgtagcaaatgagcctatttttacaacctattgggcatttactataattgtaacctttggcgtttctaattgtaaaattaaaattataagaacagttttttcagtatctacgcccgctattttctaatgatattttttagccaaagaataatgcttttttgaggtatggggtgccattaaacaattggcaacatctggaatattactcaaaaaggtatccttctactagcttccattaaatctttgaaagaaattttcaattttttcaaactattttcataaaatcctaccgaattcatttttagccggccgattaaattttgactgttatatctgaaatgatagatcattaaatagaaaggaaggaaaacgtttgggctaactcttcgcttcttcagaagaaaatttattgatatcattgtcctatcagataatcgcggttgtagaatttaaaaaaacaaagcaaaagcataatctattaaatgaactaattaaaagcagaattttttaagaatgtgcctgaatttgtctattaatttgtggcccgttaaacatgttttttcaataaaagcacatcaattttgaaaaaggacctagtgaagaaatgcgtatcgccattgtttttatatgacaatttttacggcgactgcctgaacctttcttgaaatttgagaaatttgttcaattactgacgcctttagatgtacggctattcttaatatatagcaaaatacagaacattttaatagaatagaatattttttaaatagatgggcatttattgcgaatatttgataggcaaaaaatttaacatttctattccactaacagccccactaattacaaccgaaggttgtgagtttcattgattgtctgcctcaaaaaagatggtgtttaatggaaggtgctcaaggttggcacgtgcgaatttagaaaattagcatttttattgcaggcaattcatttagagaagtcattaatttatttgttatgaagttctttcattgaaattagtttaaaaaccctttcttgccgattacattctgttctaaattgtagcaaatgagcctattcttacaacctatttggcatttactataattgtaacctttggcgtttctaattgtaaaattaaaattataagaacagttttttcagtatctgcgcccgctattttctaatgatattttttagccaaagaataatgcttttttgaggtatggggtgccattaaacaattggcaacatctggaatattactcaaaaaggtatccttctactagcttccattaaatctttgaaagaaattttcaattttttcaaactattttcataaaatcctaccgaattcatttttagccggccgattaaattttgactgttatatctgaaatgatagatcattaaatagaaaggaaggaaaacgtttgggctaactcttcgcttcttcagaagaaaatttattgatatcattgtcctatcagataatcgcgggcgtagaatttaaaaaaacaaagtaaaagcataatctattaaatgaactaattaaaagcagaattttttaagaatgtgcctgaatttgtctattaatttgtggcccgttaaacatgttttttcaataaaagcacatcaattttgtaaaaggacctagtgcagaaatgcgtatcgccattgtttttatatagacaatttttacggcgactgcctgaacctttcttgaaatttgagaaatttgttcaattactgacgcctttagatgtacggctattcttaatatatagcaaaatacagaacattttaatagaatagaatattttttaaatagatgggcatttattgcgaatatttgataggcaaaaaatttaacatttctattccactaacagccccactaattacaaccgaaggttgtgagtttcattgattgtctgcctcaaaaaagatggtgtttaatggaaggtgctcaaggttggcacgtgcgaatttagaaaattagcatttttattgcaggcaattcatttagagaagtcattaatttatttgttatgaagttctttcattgaaattagtttaaccnccgccccccccgcccttcagaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggctcgggtgggggccttccccccccaagcaacagttggtcaatctgttgggtggtattgatggtaatggcaattagtgtcgcgtaaatcgggagaaaacgttttgatattttaataatttcttccactaatttcagatgcccaattgactgcctatacaaatttgccatcaaacaaatgtaaaaagattgaggaatcggatggcagcgtgttttacttcattcacaaccacgaagaacacgttaaaagccgaaacattgaggagaaacttcaattttgacagtctgttaaaattatttcatgctaacacaaattattttggtattagaatacttctgtgtgctccgatctgcttgaatatatctgttga

SEQ ID NO: 13301 - DNA, 857 bp, Heterodera glycines
gagtaaaatggacagacaagccatttaaggctaatgcattagctgactcgaaaagggacaaagcggcgaatcgaacgaaagaaacgaatggcgaacaaatgccattctcacggaacggaaaatgaacgaatggagcgaaataagcgaatgttcaataattatgcatccaaatagaacgaaagcgcagcagaaaaatagacgaaatggaagttttaggggggggggggggggggagcaaatggtaattagtaaagtgaacgcggcacttttcttttccatgccgaagagaagattattagaaagggagtgttgttaatcgtggcaataattataaaaaagtcatgtccattcattttctgttcaaaagcccggggcttctctcactgtgttcgttttatgagagaataatgagaaatggacaataaactcatttagggcctttgattaaagggggggggggaataatttcaaggggaagaattgaaatgaaaatgaagcaaagagaagaaactctccgctccgtccgttctgtaccgtaatgtctctgctgctttggcccctttctcttcatcagcgatcccagatgtgcccagtgtttgtctgatcggaagagcaaagtgccggctaatgggcaaattgcctttaaaaacccttcggggctattgccagcccattcgatgcccggacgaagcgatggatggccgggagaggaagaagcggcccttacccttttccatcgaatgtcttctgtccgccccttgccaaaaaagccatcgcttttccccccaaatatttcctcttctcctccaccatccccttccatgctactcttcctcttcctcttctgccgcttctcc

SEQ ID NO: 13302 - DNA, 2217 bp, Heterodera glycines
tgatggtcaggcggagtgaagaagccgaagtgagcttagtaaagacattttgtggacatttggccaaggaaagcatttattgaattttaatgcaatcaccgcttataagtgatttgcttttgtgcttttgccaatgtttggccactcaaatccctcccgccccctttaaattgttcaagttttttctcttaattgtgccgttgatttgccatttgtccaaggccattgtcaattccatgcattgttatcagccccgtttccatttggtcgtccatccgtcgcccgccgaatcgaacgctcagaaaaattggcttaaacgaagaacgtttgcttttccggagacaacttttatggcggtgacggcctatcagaatcacagagtaattccaaaagaattgaaaaaaggagggatgggaaaatgaaatgcctttccgttatgcgcaacccctaaaaatgtcataatcccgacaagggaaaacaaacactcttttaacactattctcgggttgttttaggcactaatcaaaaaccggtgggggtcgaatgggcgctgccaaatgggcgacgccgaatgggcgccaatcaaatgggctccagccaaatgggcgccattcactattaattatatgatggcaaatgatatcctaagaaactttgtgaaatttttttagccaaatgagttgaaatatttttctgggctatattaactcactgatcacgaatctgcaatcagattttacttaggtcatcgttaaggccttagaatcccttcgtatccgtggattctgaggcattgattctgaggagtcaggttcgaatcctttcagtgttaactatttttaatgcctttttggtcttattttcccatgcttttaatctgtaaattatcagggatgcttagggttttgtttaataaaatttttaaattaatttgattaatttttgacttttttcaacaatatgaaatgaaaaaccagcactatttgtgcacaaaattgtttaagtttttggtgtttgattcattccgccgttgggcgccaaccagcctccggcccttccccaaaattttgtatttgataaattatttgcatgcaaaacccctgatgttcaaaaatttaattagtttggagaaaaaacggcctggcgcccatttgattggcgcccattcggcgtcgcccatttggcagcgcccatttggcggcgcccattcgacccggtccgtcaaaaactggcgcaaaaaactatggttttcataatatgatttgtatttggttttaagaaaagaaattaagtcataccaattatatcaatcgattcaactcaacgagtggaatcgattggtactaattacaggttcctacgatttcttaatcaaaagttacagcccaacaacttggtgctgaaattgggcggaccaattttcaagtttagccaggctagacatgtttctggatttacaaaaaagagatattttttggcttctttcgaaaaatgatagataaaatcctatgatgaaaatcttagaaaaagcatcggtttttgcagttttgacttcttgattagcgcctgaaataatcttagttgtcgggggcacgacacttttaggggcgcggaaaaacggaaaattaccgaaaaagaacattttttaaagaaattacactatttttttaatcggttttcaaaacaatacagtaaccaaacgaccaaattattgaaaaagaaaatttcatcggttagctttgacccaaaacatggcattcaacttacatatttcacaaacattaaattctttttcttgccaattatttttagtttggccccggttaaagtgtcgtttaatcggtcgttcattccctaattaatgcccaatgatttgagccaatggcggcggcctggaaaatcaaaggaacaaaacgaaaataacaaaaccttttccgctcagatcaccgaattgaaaatcgaaagtaatcccttcgcaaagggatttcgcgaatgcgatttgccctttggttcgaataatggcgaaagtgacggaatatcgacgatggcgccgatcgtccgaataaaagcgaaaaatgggacgggcgcagcaatgcaatggttgctcaattgtccaattgcatttggacttattgtcaatgaagattcagggaatgggagaagagaaacggtcgaaatggtgaaaaagagggaaagccaggcttccagatctgagga

SEQ ID NO: 13303 - DNA, 3408 bp, Heterodera glycines
cctcctccgccactttttctatgatcggcgatcaccgcctccgcccgccggtgttgcctctgctgatcgcttttctgctgctttccaccacagtttcacacgcgctggcccagtggaagaacaatcaggtgaaaaagaagaagcgcaacaaatgacaacaaaaggcaattaagcccaattagttagtcaattaattaattggtggtggaacagcaaatgaaatacatagcggtcgcccctctctcttcccgccgtactaacggaaatttcctccgaatgaactttttcctatgaataaaaatataacaatttaaaattattatattttttcattaccacaaagtgctaaaaaatgggaaggaatgcattttttaaaggtacataaaaataattttttttaaagaatttaatgggaaattggtactgaactacacttactgaaattgttgatcattggttgaattatcgagtaattattagtttgtgaccattcatatatttaaatgtatcataatatcctgagggctcataaaccaattaggaatgattcaaaaagcattttccattaaattttgaaaaattatagccaaataataaattagacatatgactcaaaataaaattgcacctcgaaaacagaggacacatgagctcagctggctccgggacgacgaaatgcgcgctttggccaagctgaccgacgtgcagtccatctggtcattgctgcggccaatccttgtcgagcgccaagttggcactccgcaacacgacgcggttgcccatgtgagcaagttcggcagggtttttggttcatttcgttgtaattgccttggctacattaattaaggaattactaattaaagggagtgccaaacgttttaatcatattttcagctggaagattaaacaaaacatcttttggggccttattttgaacaaaaaaaggaaacgagttctttggagcattaattcggtttattcacaattcgcccgcttaaacctgaagagattaaagcaataaattggcaacaattaaacttttttatgctctcaattagcggcttaaagtgcaaaaattctacaattgcccattgtttcagtatttgaagacaaaggtggaggagttcggcttcaccgccgaatgggacagctttatggcacacactccgatgggggtgaagcggtttcacaatttggtggccactttcgatccgctcatccatcgacgactcgtgttggcctgtcactacgattccaaaattaattccggggtttgcacaaattaattcttggattaaaatgatgaggctaaaatttcgtttttctgctatttttattggggttttacctattttttagacatttttgaatattttacatttttaaattagtgtccatatttatccttattctaagaaatggaacagcttcaaaatggtccatttttggaaaaaatttgaaaaaaatacattaaaaaatgctcaaaaaaattctttgaaaagacgggacaaatattatatttttttgacaaatcatacccaactcatcaatctcacattacgtgccgtggcattttttgagttgcgcggtcttcattgtgacttttcctggacggattgggttgggtttggctgtctgttgggtttacccactttttaactagtgctagatttattttggcgaattttcattccgatttttttttaaattccctaaatttcgacgaaaaaagggatttacttgattcctttttttacaattaaatgattttatacatagaaattcgggcttcttttcattgaatggaaaaattaacaaaaaaaggccataattagtccatttttctattcacaaattcccccaaacagaaaagttttcattggcgccaccgattcggcattgccttgcgctttgctgttggacattgccaaaacgcttggccctttgttggcgtccagaacaaatcaggttcaagcaattgtgttttttccattggtgggggaagggatgaatcctgaaaaattctcaaaaattcctaatccaaaattttaaaaattttcagagaatttttcacgactctccccttcccccactatttggttgcttacttgagtttgggaaagaaaggtgtgagtggagtgagtgagtgggatgccgtgttcgggacaaacacaaaacaaatacaaattaaaatttattatttactaaaacagactttcaaattacccaaaatgcctcaggcatttaaaaacttttcaaattgcttgcattgtttgcttttgcatattattcggcatcatattaatattatttcactgcttctgctgacactgaattcgcatattcttctaactttaaaatgctttttagttttgttgcttttttaaatatttatatggcctgaatttcgcattcattgttcaatcaacttgattttgttcagttggttcgttttgtaaaagttccaattttacagacttttcgagaaaattttgtcataacttttattaatcacaatcaattaaaatcttgctatcatagaatatctcttggatagttctattaagcacaaaagattttcttttattccgtttcaaaatgattgtgaccaaaaagcccaaaaaatagccataactaactaaaaaatgaataaaattttcaaaaatttttcatgctaatacataatatttggttgtgtttaagaagagttatgacgattttttctcggaaaatcttaaaagtggcattttttacgaaagtcaatgattgccaaattttagaattttactaattgtgagcattctttttcaaaaaatttggccttctttccatctcctcatttgccaatttcctttgtttttgccgccgtttaccttaaaaaggaaaagcctttcttttcgagtcactgctttcccaaaacagcgccagcaattccaatttcggcaccctcagcaatggccagttggcccaccatcgtcgccgacttggccaaacattggccaccgtcgtcgccggcggcgggcgacactttttgtgccgcccccaccgccgccaacatccagcggtggcggtgccattttagcacagttgccacaatcgcgtgccagcgttgtgccaaactcgtggccgattccgccacagtcaccaccaccaccagcaaacacgaggagaggaggaggagaaaaagtggattcggtgacaaaactaaaagactaaccaaaaattcgaattaatacacaaaataaaaactaattcctgcaaattaagaattgaaagtaacaaattatcaaataagtttaacaataaattttcttaatttcgttttcggcaatttatagaaattaaaataacattagacaattgaaaaggccacttttctgctttttcttagtctttcgatgctcgggt

SEQ ID NO: 13304 - DNA, 1123 bp, Heterodera glycines
  misc_feature (8)..(8): n is a, c, g, or t
aaattaanttgactataataataatatttaaccatactgtttataattttcatgattttacgaatgaagagataatttattaaaatatgtattaaactaagttgttaattttcaagtcattaaataattatcaacattgataagcgatcttaatttgttcttctcaaatacatattcatatagaaagcggtcatttgaccaggtcatttggcaatggttatttgacccggtcataactcccaaaacatgagaaaaatggcagcaaaaaatggttgtaatttctgtagtatttaaaaaataaaaataaaatgccaatttcattagttgcctacaaattaaaataacataatgaaaacttaaaaactaatctaattataaaaaaggaatcattgaccttttaaacatataagttgttaaatgaggataataaaaaatttattttatgaactattcaacaattttctataaccgattagatggaataatgaatattttatgatattaaatatgtacattcaaaaaatataataaaataaaaaaaataggtacatatttcaaataattctaaaacaaaattatataaacatatcaatattataataaaaggtagaaaattgaacaaatagttaaaatataattaagcaatttatataattacttatgaactgctcctcaactttgcttggaacgcaattgacttagagtacaatgcggcaaagaacaagaaaatttatttttatcttacctaaatattcaattcagataataaatacattcaaaaataaaatataataaaaattaaaaaatgcaagtaaagtaatttttaaacaaaatatataattaaaatagaatactttaagaaaaaaaaaagacttgatgcaaaagattaaacagaataatttaaaatctaattcttctttcttatggccaaaaggttgtaaaaatctttatttttaaatatgaatacggagaaaaattttatttaagataaaatttatgtgatggatatataaagataaaaatttaattatatttttcaaacctcaacaatagaagcaataccagaaattttaaaataaatataatttataagtagggttcgaagttctatgcagtataaaat

SEQ ID NO: 13305 - DNA, 2477 bp, Heterodera glycines
accgccgtatgggggagcgcctcccgccgcatacgaaccgccgtacgggggagcgcctcccgccgcatacgaaccgccgtacgggggagcgcctcccgccgcatacgaaccgccgtacgggggagcgcctcccgccgcatacgaaccgccgtacggaggagcgcctcccgccgcatacgaaccgccgtacggcctcccgccgcatacagaccaccgtacggggggggggcgtctcccaagcttttgacgatgtcgacaacgcctttaaaatcttttgatttcagtctttgtctcggtcttcgagactttcaagactcgaggccgagactttattaaacctattttcttttaatttttcaaaattattcctttttcgatgggaattaaatcatatttttaacatttaaaatcataaaatattttcatttttggcccaaatttgttcacaagtgtacaaaaaatttcaaaattttcgccggccactccccgggaaattttcggcatcgaaatcattaatgaaaacttaccgctaaggatgtggaatttttcggccggtggagatcgttggcgaaaggaacgtgagggcgaggcaaggcgacgaggcttgatacgtccacgtccaatgattcccccaacaagcaaactgaaaaaagggcagaattgtattattcgaaaataaaacgccacccccactccctaattaacatacaaaataaggaaaggaatccaaatcttcattgaaataaagaatataaatatttataatatttattcttaaaaaataaatttcaatttaattgaatattttatttaataaaatatttgactgaattattaattttcgctgattgcggtggaggtgggtgggtatcgctaatagcgaaaacagcccatggggtgaatcatttttgaattcacaagtccatcaatgattatgttctgggaattgatggctaacgatattcaaaaatgaatgaatcaaaaaaaagcaaaaataaattttatattaacatatttttaaaggtctttacgaaaaaagcaattaataaataaaaagtaaatctgtacaattctgacatatttaattgagaaaatgaatagaataaatttaattaaaatttaataaataaatttttcgatatgtacatttataaaaaaataaattcaataaatggagcgcattcggacaaaacgagaaagtattaaaaccaattagtcggaattagaaaagttaaaaatattaatagttagttattatcaaaaaaaaaagaaaaaaagtatgaaatttatttgaacaaaatttttatatttaccaaaagttttatttatggatatttacgttaaatgggaaaatgaataataaaaaaattaaatccctcactctcttttcatcgtcatcattaagtttgcattcgtttctcaatttttttaaaatcttttaaaaattctctgtttttttaaattttctttggacttaagctctcggttctcaaccccttaaatgctctgtttttaattatttttagcatttggatgctttggcactttcgatgtcgaaagtcaggcggcacggagcagcacatcagcgagcaaacgtcttaataagctccacatatttcttcttgtgtcaataactcttgtccaaacgaaattttaaaaatttttatacaaactaaataagaaatataattatcgaaaatgtgaatttaaaaaaaaagtatggaaaatgccaaagaaattgaagaagctgtgggttcgtgagagagattttatggaactgattttatgattttgaaaatcttttcgattgtatctttgcttggaacatggcgaaataaaagtacgaattggcacagtagaacattcgtaaaatattccataaaaaataaaatataattcggaaaatatgtaaaaagaaaacagaaagaaagccattagaaaaacggtgctatgtcgttacataaaaaccatcaaaaagggcgttatataaaaaaccatcaaatgaaaatttccaacaaaaaactgcccataacttttgacaaagccaaccaaaaacttcaacaatcatggtatcattcgaaagccctagatgtttagaagatatttataagctatttctcagtgattaatcagctctcaaaaaagttgtcagttgaaaaccgcaaaaaaggcagaattttcaaagttttttatttctatctttttttatagttcgaaattttttgtaatttttagtaggctaatagagcctgtgaagagctttcgaatgatatcaagattgtttgattcggtcaataacttcaagagttatattgactcaaagttggctcagacggagttggccagacggagttggcccgttccgctacttttaacttacaataatattaaaaatagaaaaaattctatccataaaatttggtaattttctctggggagattacataaatcatctattaatcattttttattataaa

SEQ ID NO: 13306 - DNA, 3372 bp, Heterodera glycines
  misc_feature (3149)..(3149): n is a, c, g, or t
tttatggaaattcatttaaaaaatttattcatttacagtaaagcaaaaaaaaaagaaaagaaaaaatgtgccaaagtgagttaagaaaagtcaaacaaacctcaaaagaaaaattcgaaaaaatgaaaacaataaataaaagcaaagcagtaaacgaaaaaacaaacttctagcaaaaatacagaaaaatttacgtaattcttttttttaaaaaaattattcatttaaagaaaagcaaagaaaagaaaaaataaaaagaaaagaaaaatctgccaagtgaattaagaaaagtcaaataaacctcaaaaaaaaatgcaataaaaaaaaagccaagcaaatgtcaacgaaaaacacaaaattatggaaaaaatacagaaaaatttacgtaaattgattaaaattttttaatcatttaaagcaaaataaaggaaataaaaacggtaatggaaaaaatgaaaaaatgtggcaaagtcaaagaaaagaataattaagaaaagttaaacaaacctcaaagaaaaacacttaaaaaatgcaaataaattaataattatacatgaatagagaaatggaaaaccaagagtacaaaatcatcccgatttgaaaattaaggaaaattaaaaacaacaagggaaaaaaagtctgtatggcgtatgcatttttttttgatcattcaatcgtgctttttttttttgcgcaggccaagcagttctgtgttgagtgcgagcatccggttgaccggcgcacgcatccgctgggctgccgcgctgtgtgtggcctgtgcatgcgctacgacgagctgcgcttcccatgccggcgccagggcggcgacggcagcagtggcacgttctgccaacagtgccgcttcgtgttcccgaacgcggactgctttgaggcgcaccgccggcgcgtggatgttgcgccggcaccgcctccgggcgtcgccgccgctgccgccgctgctgtgcctcacggtggtgaggaagcaacgggtggagacggtgacgacgcggtttctttagctgctgctgttggcgccgctgtcgcgccagcgtttgcggaccgccgtcgcgggcggccccaccgttcaatgtgtgaggagcggcgcctgtgtgagtggtgcaatgtggttgtgtgggcgcgaagcggtccgcacgtgtgttgccgccgtccgcagcagcaacagcagcagcagcagcaagagaatcgcgcagttctgcagcaacaacagcagaaccaccaccatcagcaaccgtcacgaccaaaatgtgaaaagtgcggcggtccacacgatccggaacgaacgccgcacttcatccagcccaagcagtacgcgcgccagtgccagtggcgacgcggtgcggcacgtggcgcccacgacaacgctgacgacggagccgttgctaatgctgcgactgctgttgaggatgacgacgatgatgataatgtcagtgaagaggaaggggcggcagctgttgccgagcgtgatggtgctggcgatggcgcacgcggacgcgttcgaaagccaaagccggtgcgcttcatcttttgggatgttgaatgcgcacaggagcgcgtgggtgagcagcaggagcagctggaggacggtaaccaattcgtttttaaatgatgatgattatgcggctttgcttacgcagacgaggcagaggcggcacactgcgctggcgacgaggcaggtgcaatggatgcagttcaacagcagcaacagcagctgcctgaactgttgaagcacgtgccggtgttggtgtgcgccgaggtgatctgcgagcgctgcatcgcctacggggtggacattgagcgtgagccgttgcgccgcgcgccccagtgccagtgcggtgtcccgtggcgtggtgcgaaccggcgccggtggtgctctcgcatcggcgaggagctgtttgacgacgacgacaccggtggaccagcgaccgcacaacaacaacaacaacagatgccgccggatggattgaacccgcggcggctgcgcttcttctgcgacggcgagccgggcaccggacgtggcgcaatggcccaatttgtggactttttgctccacaccggccccaaagggacgcgcaccgtgatgttggcgcacaacggggtaagagcagcgagggggtggggggtggcaaccgattagtagtgaaaaaaataacatttttcagggtcgttatgacgttcacctgttgttggaggagttgcagcggcggggcgagcggccaaagaaggcggttcagcacgggctgcgcgtctacatgctggagctgcgcgggacgcaccagcgccagctgatctgcaaagactcgctgaacttcttccacgcagcgctcgccaccctgccgcgcacctttgggctgcacggggtgctggacaagccgtttttcccctaccatcacattcgggagcagaatctggatgttgagctgccggccggcactctgccaccagcagcggcctacgacccggaccggatgcgtgccgcgcagcgtgccgatttcatggcctggtacgagcgcgagctgcaccggcccggacggcaaccgtttgtgctccgccgtgagctgttgcgctactgctggaacggttagttgttgtcggaaatgggggtgcgggagtggtggaaaaatgtgctgtgcatacagatgtccgtatcctgcgtgccgcctgccttcgcttccgggagttggtgggcgaatgcgcggacggcatggagcccttcctggcagccacgaccattgccagcctggcgatggcggtgttccgccaacaccatctgcgcccgcacacaatggtccacacgccggagggcggcttcctgcgcgggcgtcgcgcgtcggccgagtcgcgccgcttcttcgcactgctcgccgccatgcgtcctgacttgggcccgttgcgcaccgcccgctggtcagtcggagagatggtggtggacaacagcagctggggcggcgacgacgacggtttccgcctcgactgtgtggcctacagacggccaccgttgcgtcccctctgcatcgagttcaacggctgctacatgcacggtgagtgttgttgttgttgttgttgtcaattgcggcaattttttcccaattacgccattgtcttcaggctgccgtgaatgctatccggangcgtgagatggtgttggccggtgggcgcagcgcaggagctgctgtgggcccgcacccaacagcgggcatgggagttcgccgagctgccgggatgcaggtgcagtcggtgtgggagtgccagtttcggcgcatgctgtgcaaaagcccgcggatgcgcaagctgtacaaggagcgctggtggacgtccggtccaatggttgcgcaagcacgccctgttcggtgg

SEQ ID NO: 13307 - DNA, 1652 bp, Heterodera glycines
ggtgggcagggggtgggcagggggagtaggcgagaccttccgggggagggagagggacggactaggctcgaatgtattcgtcacataaatgttgaatagtgtcaacggcgcgtttcagcagcagagggtcgcgcactcccgtcacaatcacggtgccggagatgaagaaaagggctgtcaccacaaactccgcctcacccatgctcccctcctccgtcccgcccttttgttggccaccaatccgcaaggcgcagcgaaggcctgggaatgtgcacagatcaaggcacgcgcgtgccacccccacaatctgcccggccaaattgttgttgttgttgttgttgttgttgttgttgtcattgtcatttggtcgcttcccactgatggtcatacacagcaaaagatgctgcgccatcccctcaatgttcaagcggtagggcatatgaagtgtggagaccaggttgcgcaactgcaccccattgacgcgaagcgagcggccgagcgtcggaaagccacctcgccggagtgcatcggcgacacgacggcacactcggtgcgcttcgtgccgacagagtacgtgaattttctgcaccgcaacaccaccaccaccaccaccaccatcaccaccaccaccgccaccaccaatgccagttagcaccacacgcccgctttggaaaataagcgcagttgtggtgccagtgatggtgttggttatggtgttggtggtggtgacggcggcggtgctcgtggtgctggtgctggttgaaccggtgcgcagacgcatcacaatggcgtgaaaacggcgagggacatattcggtgcacgcaccgttgcgtgccaatgccaagaattggtcgcgggtaaagcgctgttgttgttgttgttcttgttgctgtcgtggagatgaggccgcttgagcgccacacgatttgaaaagagaaaatgtgctggtactattttgcacaaaatatttcattttgatataaccttgcttaaaatcaacaagaaattagaattttatctcaatgtgattgacgcatcaaaaatgagagaaaaaaatttgtatgcatgtcaattttcactcatcatctgcgcagcccgcgctttcctctttattgtcctccgtctcgttggggtccgtgggcgatgccaccatgacgtgcacctgcacacactctagcggataataggacatgtgtgcgccaccaccgcgctcaaccagcgccggcaggtttgggtggcgcaaacggacaccgtgtttggcatagaagtactgacgcacctaggcaaaaacaaaaaaatgcgcgcggtgcttcttcaaaaaacattttattaccgtgaggttgagataaccgccgcatgcaaaggtcaggttggtgtttagggcacttagcgcgtgcgcatgtagcgcaatgttgcgctcgctgggccgcaaatggacggtgcgcagcagacagcgctgttgcagatgggccagcatgtgcgcacgtgggcccttggtttggagcagcgtgtgaagctccctcacactacacccattgttaagcccacacaaatagtcgatgagcggaagcttgagcagctctgtcgccgcttgttttcgtggcgggctgttgcagttgttgttgtcgtggtggtagtggtggcgcaatatg

SEQ ID NO: 13308 - DNA, 3170 bp, Heterodera glycines
cttcctactttaaatttttagtaaaatttaaaaaatcgtttaattatgatctttttttatgcatttctgcctaatggttaatcccccccccccccaaaaaaaaaaaatttaattcctgaaaatggaaaaaaagccttgactgatcagtcagtgcgtgattgattgactgatcacctttcttcagcttggcactgaattcgtcgctcccagtgatcagtttaatgaattgttctgtctgaatttcttccaaccaacggatggtttcgtaatttttctccatcatttgcgacacttccgcgtcaaagtccacgccaatttttggactcattggcttaaaacatttacgcaaatcatttgacaatgcatcaacagacttcatctttttgcttttcagtacctagcaaagacaattaaaagttgagtgacattggcatttgttagtgccaaaattgtttttctattgggttgtttcacttaattatttgtagcccacacaaacgaattcataagttttgaactaattaatgtttcttgtttattgaataccatttaaaaacaaaatgtggacccttagtaacagggatgtttcggcatgccgatttccgacattttcgggctcgggattccgatttcatttccgaatttttttttggaccatcggaattccgattgctaaatttttgagccatcgtaattctgattgccgaaattttttcaaccgttggaatgccaatttccgattaccgaaatgcgtccggcacacatccctgcttatttgttagttagtaacagcaccctttctctcagttcaccttttccacaaaacttttggacgcttcaatcatcgaaatcgattcaaaattcttgattttccctaattgctcatcctcatcaaagtcataggtattgtagtacaaattaataaataaacgtaggccctcatcacacactgttgcaagacgttttgccaaaacggtggtgccattctgttttatggcatccttaattttggcatccatccaacggacaaatgctattatattgaagcgcattgcagcaataattgacagggaaagatcgtcagaaaaaaggacatcaatggcattggtaaaaaacaactgatcatcgtaaaacactgaaaaagcattaatttttaatgaaactcgaacatctttgtgttcttgaagtttttttttatttaactcaaaacattttcggaatttctaaaatccatgcatcccgcgcgggatgttacaaattttaaatacaggatttgcgggattaacccacgggatcccgtcccgcaaaaaaaaaatgttgcgttcaagtcccgcagcgggatccgcaaatttgaaatttccgggctcgaataatttcggcgtcatttttgtttatttattttctgcttgttccagtttttctaaaattccaggctcggctcaagccaatatttttttttaatcatagataagctaaaaacgatattcattccaagtaactaatagaaaattaaatttaaaaataaaataatataaattaccatccgtattatacaatttaaatggccctacacattgaaacatctcaacaaatggcacagataaaatttggcacaaataatgttttagcctcgtataagcgccctgtctctctctgatcgctgatcggaattgatcattggaactcaaatttgtcttcaccagctcaaacaatggtaccatttttctggactccacaaatgcattttcgattttctgttcggaattgcatgccaacgatgggtcccattttggcaacattttcttgctaattattgaagaaataatacataaaactagagttgtacgggaccgggacctggtactgaaaaaaacgtacaactgagtacctaagtcccggttttgaccagttttgaccgggaccgggaaaagccccggttttttcccggttttcccagccaaaaagtcccggtttttcaacccgaaaagtcacggtcccagtttatctcaaaattcccggtcccgtacaactctacccataactcgtcaaaattgttcaaaacaacaacaaacttgaaatgggataaatatgacgttaaaaagattaagctattctgaaaaaggagaagctgtgaattttttttaacttgatacgctcagataagcacgaaaaacacaatttcagcttgatttggattgtctagggatgacttttataatgcctatttttgtggctattttctggattttcggaaaaatccttaataaaaatttaaaaaaaatgaaaagtacacccctaataaatgacccaaaaaaattttcagaaaaagattgattaaaatattcaatgactaaacgacctcgctctcaaagtgaatattcgccaatgtcaaaacaaagcgacattcaccaacttattgactcacaaatgaaatttgccaaaaacaccattgatgccctaaacaaactccaagattccttcacccttgaccaaaagccaattctctcccacttaatctccaccttgtcgactcaatttgaccttttgaactcatcgattgttcatctccgctctgctgacccaactcaaaaagacgtgcccatttcagcagaggagttagaacgacaaagaagtgtcgtgataataggcctgcctgaacataatgacatttcaccatctaagcggggggagatggaccggtccaaaatcaattgtctattcgattcgctggggatcgaatgcggcaccatatcgtaccgaatgggccgtccttacaacccagcacaaaaaagtgcccgcccactcaaagtgctcttgccttcccgtgcttttcaaagacaagctcttgtggaatggcggaacaaatcgaacacaattcgtagcaaagacccatcgcttcaaaacgttcgcgtccgcgagtcattgaccaaagcacagctggatgaacggcgtcgtcttcatgcacagtgtgtcgaaaagcgtcagagagacggtcaggattggattgtctatgcaggaagcgttatcttacgggaggaaattcacatttttcggcgtcaaatgatagctaccgattctcgtaaaaattgactcaagaccaaatcacctaagcatttctcaaaaaattttcaaaatttaaattgctgcttaattaatattaggtcaataat

SEQ ID NO: 13309 - DNA, 1528 bp, Heterodera glycines
tttttccactataactttttttctttgttatccaaatccaacaatctttgtatcattcgcaagctcttcacatggtctattagccttacaaaagcgagaagattttcaagcctggaaaactttttattaagaaaaaccttcaaaatttcgactttttcgcaattttcatgtataacttttttggtaattgtctaatcgcgaatccatagcttagaaaaagcttttaaacatgttaagctttcgaatgataccaacaatgttgaatttggatgacaaagaaaaaatcatagaaagttataatggaaaagcatgctggcgcccaaccgtgtgcgcccaactgagctagaccgcctagtttactttgttttggcgcttttagccagctttgtctcactttctgccaaaaaattgttcaaatgcagcagttggcataatgccagacgaaatgtgtttgaatgaccaattttcatttggccataaatttgatttttgcctgccacaattgtgcgcagaaaatattctgaaatagcaggtgtcgtcgaaaatttgcacttgccatttttcaaatttcgttcaaaatcattgaccattcttaacaatgttggcgtaatgatacgcgcttcaaagccttgcgacaattttgaatcgattttgtgcgacatttgttcaacaaaacaactacagtatatggctgggtttaacatttctgaaattgtattcatttttggatttctaaggcaaaaaatttcacgaaattcgagacccaaaaagtcaagtatcaatgctttagctcttttttgctaggtcgtttcataaaaagttgcacaaaatgagcgtttcgtaaaagtgccaattttatcgatttttagagaaaactcaccattacagtaatttcattttttttgatagcatatggtagctgttgttagcgtggaaaattttaaaaaattttttattttcatgaagttgtgaccaaaaatgctcaaaaattaattttcttctgttttaagaaaagtttttagtagggagtaatttaaaaactgccaaatagttaatttttaggttctaaaaaaaaataattaaaaataggagctaaaaatgggaaaatagttgcgaaaaactcaaattaggggtgtaaaatcgtaaaattatccaaaaaagtaacaaattaagccaatcagtattgagataatttttaaattaaaaattcttgtcagaaaataataaataaattttggaaattaatttttaaaaaatttttcatttctcagggggtatatttttctgaaatttttttgggtcgtttcttggggttttttttcgttttattgcatttttgttaataatctttggcaaaatgcctaaatagttgaaaaaagttttttaatttttttttaggttttttggtgcaaaaataaaaacaaaactatgaatcccatcccggttatgacaagtttttctcgaaaatctgtgcaattggcactttacgaaacgcccataatggcgctttttcagggctctaccagaa

SEQ ID NO: 13310 - DNA, 2422 bp, Heterodera glycines
taaaccttaatgaatttctgtatcccaccgtaacccaacaaaagtatccaaatttgtcgctcattctgttgactacggtatttcatagaagcaacccgagaatatatcatacttttcgggtattaaaaatgagttcgggttcgacaatccctgcccccgcccaaatgccaaaattatttcccgctcaaaaaaaagcaggtacggcacctcgatcagcttgactacattgggatgtgaaagctttttcagaatggcaatttcgcgctggacaagttgaaggggattacgatgaaccgccagatgaagcggattggcattctttttgcgaatgggcggcggcttgaagcaggcgtagtttttgacgagctgaaatttgaaaatattaaattttaaaaatggaaaatttaagaaattaaaaaaaaaatttttttttattcgaaaaagtaaatgaattttacgcatattataggaaaaaacacccaaaacttagcgtaaggaatgaaactaaaaatgacaaataaatcgccaaaattaatgttaaaaatgcaaaaaagttttaaaaatgattacttaaattgcaacagaaacaataccggattttctaatttaaaattgctttttcgaaactcaaaaagtgccgaaaggggggaagaaatgaaaaggaaacgaaatttcgtccattcctgaatggcatgggttcaccggttccccacattttttcggcttttcctcgctttttgtcggctttttcccgtttttatcttggccccaattaatttttaaaaatatatccaaaaatttgtccaatcactttcaatttgtcgagcactttcattgcgtacaaatttttgtcctgctcactgtacgccagcttcacaatgccgtaactgccttgggcaatttcttcctaaatttgcgatttcaatttgcgctttttgcgccaacttttgccgcccgcccctccggcgaaacaaatgaaagaaaaagcactgaccattagccgatactaaaaagggagacaaaattcattaatggactgagcaagaacaggtaaaaattagaatatttgagaaaaagaattgttaattaaaatgcaattaaaaattaattctcaaaaaattattcttaatttgagaagtcgcgttaagctaaattaggaggcaattaataattaatgaaataatcaaagataatgggcacttaattgcatatagtgcgaagaagcattgttttagtcggtaattaattccaaaataatccctttcactcgaattcgagattaaacaaattaaaaatgtagttaaagggtaattaaaaataattaacaagtcattagctgacaatttattttgtctaatggctcgcctggttcagctgaatgtacgaactctcggcaccgtcccccgtctcgacaggatttgtctgaaaattaatttttgtttaaaattttgaatcaaatttatcaagtataaagcagcattgtatgcttttgtttgtgatcagctgcataagtattaacgggatgggagatgaatttccaattttttaattcttttcgttttttttctcccggttttcttttgtcctaatcattcccgggattgaaatcggtagttgatcaagaccagacagaatcaggctaaattctgatccgacaataaaccccgggacggtcccaggtgggtggggggaggggtacacagagtatttatttacccacccccgttctcccccccccccgacccaagaccattccaccccgaaattttaaagaaaaaaatagtatttttgttgaaaattttcaattttctttgggtagaactcggaattttttcaaaaagatcaagattacgagtccgggaatctctacatgagacgcggtcaggctctcgtcatcagattgggttctccagtctcgagaccggtccgtccggcgccccgccccattttattcattcattcctcgcattcctcgcctcacctgaatggtcggcggggccaaatcactgctcattttggttggtcgaagcaactgtggagaagcaaacattttggcacaataaattgggtgcataaatgcattttttgctatttttaaagccaaaaaagtgaaacaatcaaatgggacaaatggccaaaatcgggggacaattgccagagtgttggacaaatggccaacaatgataaccagcaggggaatattgacatatttgccaaaaaggtatgtcaaccggaagacaaatgttaaaattgtgcgacattgccaaggtgggacaaatggccaacaaggctggccagggcggaatatggacattttaccaaaaaggtatgccaacaggaggaaaatggccaaacttttatcaaaaagagaggaagttggccaacggaaggcaaaaagggttaaaataggccaaataggcaa

SEQ ID NO: 13311 - DNA, 4658 bp, Heterodera glycines
ttgtgggctttggaatggtttgatggcctagggaaggtctggagaaaataaacaaataaaaggtttcttcccgcacaaaatgaaaattcccgctaaagtgacggcatttaaaagttcgcgcattcgccgtagtgattcccccttcgccgaagccaactccgtctttttcccccattcgctcgtcagtcgctatttccggcaaagagttccgtgtaaaggggcgggaagctggcgagcacattggcctggaaatgattgcaaattcacattttcagataaaattcgggcggtgccgccaacctccgcggcgcctctgtccgtttggtgttcgctttgctggtccaccatttgtaatcggaagcgtcccaaacatttgcgatgcgtttttgccaattcccgcaggcgcggaaggaactcgagcagttggcgcaatgcctcgtccccgtccggcatccgctggtgcaactgaccccccaaacagctcttcaactgtcccacaaacgcttccatgccgggcgcctgggattggtccatcagcacaaaggcggacaaaagggcggtttcagtggaagtcaattggaatgagctgaggtactgaagccgactgataagctgaaaaggaggaaaaaaataaatgggatgacaaaaagggaaggacaaacgccaaagaaacaaatggcatattggacaacggtgtgtttgtaaaaatgccaattcgtatagtttgtttttttaataatttcaattaaaatctagaatttttccaaaaaattagggatggattttttctccagaaggttgaaaaatcatataaattttagctttttcgaaaaaaaatacattgttgttttttagaatggttttaattgaaatttaaaaattgtgtgtgttgcccattgttcgaaaactgccattgacccatggacaacaacatttgaacatttgcgagtcgcttttcccacctctttgccaaattcctcgtcctttctgtccgaacagcgaaattggtacacgggcagcaccaaattgttcacatgcaatgtttgactttgctgatgatagtgctgaatttccgtcccgtttcatttaattttttacgcaatttccccctttccccacttgtgccattgcaatgattgccaagtcgaacgttgtctttttcaatgcgtgtattttgtggtcctgctccaactccagaaactctttgaccattttggcgaattcgatgatacatttggtaacattggtcaactcattggcgaacttcagccacccatcggcacggttctgaaaaataaaaaaaatagaaaaacaatgcagcgatcttttggaacttgaaaaaatttagtaatttatcataaattttgaaaaagcgcttttcttgaatttttttttaatttttcggggaaaatggcaaggggggggggaaagagttgctcctgcagaatttagtcatttggactacaatatgttttgaaaaagaatctttgcttgcagttgcctttccctctgtaaacgataagacccccccccccccccctaagagaaggcgcctttccaaccgcacccttcgcccgcctccattcatcacataaacgcatccccacaagatcgaactcaccccccccccctacatcccccgcttcgcctctccagctcaactcatcgaaatctctccaaaattgccgcccaaggacaccaacagtcggagggtggcgcgacaattccccttcccaaaacgcatttatcccttcgcgctgtctgatctcccactgccaaaagggctctgtcacgcactggaactcactcactctgggcccatccaaagcgcacctttgaatgatggttatcaccaacgccgccctcaaacagcgaaaaccgccgccaaaatcaccccccaccaccacaagcaaaacaacacaaatcaaacaaatcgaatcgcatgcaaattcaaaaatgacaaaaaatacgaattggcaaaagacaaacaaaaatgaaaatagaaaaacggccaaacggaccaactgaccatgttcatcagccggtccaactgttgcgggtcgaccattgtgccgaaagggtcgtcatcaatcggcaaatggtggttcaaataggcggaatacgcctgctcgtaggcgaagtccacgcgtttgatcagatcgtcgtccacagttgaggagaccaaactttggttgttcaacggagcggaagcaatcgacgaatcagcagtcaccggataccccccacttaatcagacgaaaaatatgcaaatgatagcaaaagattaaaaaaatgccgacgcgctgacctgctcgatggtacggcagcggagtgatggatggcaccggactgggaaaacactgccgcatttggcgaatacgaaatgggcgccaacgcatgatggggctgctgttggtagagcagtggcatggcggaggagctggattggcctggacagtggcaaaaataaggccaaaaggacgccattttcgcactgaccgtccattgtgtggaaagagggcatttcctcctcgtggtacgcgttggactgatggaccaactgttgttgttgatgttgttgcagttggtggtgggcgtggtggggatgggtgcccgggggatggccgtaatacaacggcagaggcaaagaagcggaggaaacattctgcgcattgtttgagggcggcgaatatttaaattcctgctaaaataaaacatgaaaataagcaaagcaaaggaatgttgcaatatgaatttgaaaatgatcactcactttgaaatccctgcaaccagccgaactggcggaagatgaaccaacgggtgtactcggtccgacagacggaggagcggacaaatttgggtgggactgttggggaggaaaagcaccgggcggggcaatgacggaagaaccggccggcaacgtggacagagcacagaattcgccgtttcgctgtttatggagacggacctaaaccatttgggatgaaaatttaccaatgtaaaagcaaatgaatggaaatcattgccacgaatgcgacaaatctttaaagctatcgttcgcttatcactcactcacctcatcttcgaccttttcccgctgttttttggacattcggccgaatttgaccgcctcccggctcattcccaactccaaacattttttaagccgacagaactgacatcggttgcgactgactctgtccaccgtgcagcacttttgccgcgcgcattggtaattcaccggggcattttgagaacgacggaaaaagccctgaaaagttgacaaatcagtaatgaagagacaattaatattgatgaggtcattcaaagtaagggaatattatgccaatttaaataaagttccgcactttgcatccttcgcaagtgatgacgccgtaatggacgccggaggatttgtcgccgcaaactttgcatgggatcacttcaatttgcgctaaatatttaaaactatttacatatgcacttattgttaggaagatgaatttaagtggaaaaaaccaacagaattgaaactaaaaaatgcacaaaaaaaatcggattttaataataaaaaacgggagaatcccaaagggcaattttactgataaataagcacacccattgctaatcatttatggggtaattctgtgctttcccatgaaatacgcacgttcctcgccgggtcctcccgggtgcacaatgcgttcgttggacttttttctgtaagttgtggacaacactcccccgggcaataccgtcggggaacactttggcctatgtttggccgactcggcaatttgcgcggcattgtcaagttgtcgcaatttattattcaattccgtcgatgactgaaacgaatgtgccgacgaggaaattgggtaaatgacagcagcagccgactcaacgacacggacagtagcggacgacgacggagggaaaagcgcaccggaaacatcgcttcctccttctgagacagcgaatgccgaaacagttgatgctgacggagagtgcggctgaggtttgggagaaggcaaagcgatgttctgcttaagctctgacagctcgtgaaatgtcgaagcgatggacagcgcggttttgcctggcactttcgcctttttaatatttgaaattgccctaaggccgtcatccaaaagtaacagatgagaagaatgtctgagttgttgttgttgcgcctgctgatcgccatggattcgaattgaaagcgatgaaaaggacggtgccgctacagaagctgtatcggaagatgtgatcgccgatgaaatgggaggagaaagcgcggttttggacgaggaatgggaatggttgataggaggggcgaagcgatgatggtccatcgtggtcacacaaagccggggtcaggtcagccagaggtcaagacaagacgggaaaggagtgctcagcagaacgaggatgaacggattgaggagggatgaggcgacacaattatatttgggtcacataagttggaagtgggccgagccggacttggtttcttgccgctatgatgtgatgtgtggtggacgaagcaaagggacggacggacgggtcgaaggtcagcgaggaaaggacgccaaaaacagaaagaaagacgaaacaaaacgatgaaaagagtgggagaggagaggaaggagagagaa

SEQ ID NO: 13312 - DNA, 2253 bp, Heterodera glycines
  misc_feature (2235)..(2235): n is a, c, g, or t
  misc_feature (2248)..(2248): n is a, c, g, or t
aatctgatatttttgttgaaatttgatactttctgacaagtggatcactcacccactcactcactacagtaggctcaacatttaaggagttacagtaggcagcaaaggtttaatgtgttttttgtgcaattcaacgatttatgtaaattttgtagcgtagcatttttctgtgatataaattctttttggcatattaacttctacaccactaaaaattggggtgggtgctgacaaattggaaaaattctgtggtcagacactgttggatatcaaaaaaaatacttttatcgtggtaaaaacaaaataaaacgcattaacttttgctcccaaacttaattgagttaacatttttttaaatttttcttttttttattgtttaaaataaaaaatgaaaaaattgcaatttttagttagcatttttgaggactttttttaaataatgaaattaattgagagagagcagaccgaaatttctacaaataaatttaaaatgaatttttaaactttttgaaatgttagccaaattccatcctaagcattatataaaatctttaataaaaattttaaaaaattaaactgttagtcacattttaagaaaaaaaaatttgatataaaaagtaatgaattgatgaatattttttttgtaatgatcaaagttcattgcgtttcaacacaacaatgcattcaatcttagtaatttcatctaaatatgaaacatattattaacttaaatgaactttcattttgaaatgcctcggtttccattctcgaaaagttcataacgcccacgggcattgcattccaacgatctgatcacatttgattgtccaaatcgctccataaatgacgcacccatgttcttgtcctcattgaaccactaaattatttgtgccatgaaatttatttagcaaattctttggcaccacaacctaaatgaatccgttttagcaaaaagtttctatcgcaaaatattctcgacaaaatttttactattttttcattgattttggaacttccaaaccccaatttgcttcattttttgggataataacaacgcgatttatgaaatttttgaagccagcgaatgatatttttcaaaaatttgcttaaataatcattaaaattttaaaaacaaatatccttgcttttttgcaaatcgataattgagttaaatcaataaattttaaaaaatctattaatacctgtataattgcttctgtctcctgttctaatccgcaagtgattgtcaaacggagacacccattcccatccgtccatttttcaaattttgtatattcctcgccaccaatcacttttatgtctgtacacaaactacatgcagtaaacggcgctaaaaagtaatttaaaataaaatttaattcataaataaaattaaatttttagtgccggtttcttcgatttattatgcgcataaaaccattaatttaatctcttgaataatttaatttgggttcttttgccatctctctatgtttttttaaataaaccctgaagaaggaagcataagaaaataagtttaaatttcaattttatctaaattagggtttgtttttaagcgattttcgttgaatgaaatgtcaggttcggcgataaaatcccaggtccaatttgcggggaaggccttgaaaattttcaaaatcttggatacgaatttttcacgacttgagttaaggaacacctagttaaatcataaaactctaacattcagtcgaaataaccagtgaaatgtccgtaagaaaaaaaagaattcaatttttaaaagttgttttagattttttgaggtttttagtgtgatgctcagtggggttaattataatattttcttcataattaaataaaataaaaatattttctttacatttctgcgccacataagaactgattttgttgacatgctcactcaactcagtgaaaacaaacagaaaactcaacgtcattataaatgccaccaaaatcaaaccagaaatcaccagctttagaacagagcatctctttttggcatgaaagtcgaacttaaaaacaaacaaaccaattttcgagtaacagaacggaaaatttccaaaaaccaagaaaaatgatctgaattttaagtaaaattgcagattactaacaattttgactttgtatacaaatgaaatatatttatccgatccctttctaagatagaagtcgatggtaccatttttaggtaagcggcgacaagtttcagccgangttacaaacccgnggact

SEQ ID NO: 13313 - DNA, 3048 bp, Heterodera glycines
  misc_feature (2978)..(2979): n is a, c, g, or t
  misc_feature (2996)..(2996): n is a, c, g, or t
  misc_feature (3006)..(3006): n is a, c, g, or t
tgatcagattgcttactttctgtgccagttgaaggtgaacgactaatatttttgccttgttcaacaatatcggcggcatcaaaattcatttttaaataaaggaatataaaaaaaatattatatttttattgatcggaatgaaaaatgaatgagcaattcaattggatattcatgcagtttttcttgtcgtctcacttattcagatgaacaaacatttattacataagcaatatatgataggcttgccgagaaaatggcttcaaattaataattccattattagtaattattagggaagggatttaaaactcacaaaatttgaaaaagttgattttattacttaatccgtagtttttagaataattgaatattttgcaaagaaataccttagtataagcgctaatagtctgcaaaatttacaaaatttccgtccaagtaaaatttttttaagaaaagccacataagcatcatagtccgtgcccgatggactgcatttccaatggactctaaaattaaaaaaagagtttcttaatttttaaaaacaaaaaaaataaataaatcattaaaaagacgatttttgctcaagccaactccaaccgaatgcatattttgctgttttttcggagtccattgccagggcaccaggaaatgccgcgaccctcgactgaggccgctggataacggctgtttcggtgttgcgacagagaaactgtcccgcagcgacaaacggcgtgagcgagcaaattgtacagcaaaccctaatttgcctctatttttatatggaatgataaaatttatgcatttttttgtctggggatgaaaaagggtgagacattggtgaaaatgatgtactattttatttaactctagtttctttgtctgacattcacatcatcattaacacactatttttacggttggttttggtatttcctgatttatttttttatattttatattattatttttttaaactcgaacatatttatataagaaataaaatttgaaaatttttgaaagactggttatggattttgtatatattttatttttcatataattaatgatagatttttgcaatttccctctcacatttttaatctcatgttgttgaaattgttctctccctgtaactcatcaacaaaatttttatcgttgagcagatttaaaaatatttcctcgataaatgcaatcaaaatggagtcatcttcaaattgcatttaaaggaacctgagaaataaatttatgaattaagagttccaaaatttctgtaaaatgactcatcaatatttgtattaataagttcaattgtaatttttcatgcttatcccaaaggtttttgtggactaattacagcaaaaaaggattgattatagaatttttggtacagaatatgggtcgaaatcttcataccgtaactttgttattcgttatcacattcttcggccaaaaaaaaattgtttattctttcatttggtttctccttttattcaaaaatttccactttctttaataatcaatttttcactttattaaagcattaaaagatttaattatgttcattttattaatgccccacggaaaaagtgcttttttattccttaacattatttctaaatcgatgtttaactataaatattatatgatgattagtttctttattttttataatatacattataatcatcagtaggaatattctaaaaaaatcgatgctttaccaattcactgctaggaaattttttgatttcgacagaaatatcataaactttaggaggggacttttcgacagcaaaggacatttcgacagcaaaggacatttcgacagaaatatcataaaatttaggaggggacttttcgacagtagatttttcggcagtaaaaagtaattaagtttcacatttaggtgtgtaaaagcgtaaattttttccaaaaatcaacattaagccaaatcagtattgagacacataatatttaaactcaaaaatttttaacaaaaaaaaaaaaaataatttttggtgatgaattttagaaaattttttatttcctagtgatgtatttttgaaaattttaaggatcggttcttaggggtttaatttttgtttttgttacatttttattcataaattttgagcaaaacacaaaaaaggtcaacataggttttgttaaacttcttagggttcaaagaaaataaaaacgataaaataggtgctaataactcgaagagttgcttaacaatcaccaaaaaacatattttccatgctttagggccactggaagttcaggaaaaataggtaaaatctaaaaaacatatttctatgtagtaatattatttagcaatacacattatatgttaattaaaaagaaatttagtaaaactgacaaacaataacttgttttatgattttcaaatttaatttttgattttggagatggctaaaaattaattcggcgtaatgaatgaaatttgttaagaattttacaaattttaagtaaaaatttctccatttttctcttccgtacgattacaaattctcggcacccctaaaaaaaccaattttacaactggcgcgacctttggagacccgcatttaaataccggacctttagggatccgaaaaatttgggcaccgaaacgaccctttccctggggcccatccctgatataaagcaaaagaattacaaaatttcaggtttggatccgggtgaagtaagtgatttttctgtattatttttatgcttattcaacattcagtttataaatgtttagtatttattaaaaatttattttcaaaaggaaacaaataaaaaaagataataatctcttttcccttgattgcgtcagtagaaaatgcgtcagtaataaaaatattttaaaataaagagcattaagtattgtagtataaattagagatcggaccggtcggtttttttttagtatttttcggtcttttttgattttcggtttttgaccgaannaaccgaccgagaaattnttgagttttncggtttttaaccgaaactgacccgacgaataatcaaaaaccg

SEQ ID NO: 13314 - DNA, 1813 bp, Heterodera glycines
cagtgttagacaaaattgctcatacgccaaaatagcgcattttgcgtaactttttgcgcgctatttcaaaatttacactggaaaatgcctttttcgcactatttattttgatctgccataactcgcttcattcccaactaaactgaacaaaattggtatctaaaaaaagattttgaaaaggagaatctttttctaagcaaatgctaagcaatttaactcatatgaaaaaagttgtgggaatttcaaattttcattgcgttataactcaggtccgaggccgctgttttcaaccaaaatgcggaaactaatcacttttttattgattctaaaagtcaaaggtggttttgtactcttctaaccaaaactagtagaatttgcgaatttcgatttttacatgtgctagagacatgaaaatagtacgccaaaaagagagaaaaagaaatgcaaatttttttcatcccatttttgtaatgttcttcgccgaaacttttactcaaaacactgaaagtttgttcattttcctttttttttatcggtttgcaaaatttggtgcggatttaacatagagaaaaaaagctagacatagaaaagtgaatgttgttttttacataattaaaatgaagagatagtacgccaaagtgagagaaattacaaagaaaaagagaaacgacgagatagtactaggcttttctctgcacagtggagttgacccatagtgaaacaacaacaaagtgtgaaaacaacaattattaaaatagatcaactgatcattggttaaactctattaaaagttcattgtgaattgttttccgtagttgttcagtgccttttgttgtctcctcaatgttttcgcttggcattcgcaattcatctgcgatttctgccaatttattgaagcggtcagcggaggtcaaatcggccatcaaatccaattcagtgatgtggttgagcttaaaattgcattattcatataataaaattggaggcaaaaaaacaaacgacgaacaaaaatctgaattgaatccgcaaccaaattctgggcctttttgtacttttgttttgctgctaatgcgatgccaaagacgcaatcaactgaaagtgcttacaattagctatgtcgatttgtagaagaaatctctttaaactcacaaatttcctggagttccgtgaaagtcgcgacggaacacaaagcggcggatgcgatttctctcaacgcacgcgcaggcaaagcgaaaagcaattgaatctgtgagggaaaagcacataaattaaaatgtttatgaaagagagaccaaatggggcaaaaacgggcgaagggaatgcgattggcccatcggatgggcgacggggcgaagatgggagagcaaaatcagtgcgggaaaggcggaaaaatggtgcagaacgcccaggggaaggcaatcggaggaggaagaggaaggacgaaggagaagggccatccgaagtttgtggagacaatccgcgagcagatggtacagagaggggtacctgaacaacgggcgattcaccgacaaatttccctgtttctatgggggtttggtttcccaataatacgatggataccgtatcaaatagggtagaaaattcaaaatttcatcaaataagatcaacaaaatcatgaacagagggggaaagggtctcgccaccttgtgaaaaattcgtgggccgacattttgcacttcggctgaatgtgcagcgaccgctgctgcgccgccggagtgccaaaaacccttttgatgagagcggcgaacagctgaacatgcgcattccgaacctgaagggcgaaggggaagga

SEQ ID NO: 13315 - DNA, 1452 bp, Heterodera glycines
ttaaaaatgtttttcatttttattgaagctgtcgaaacccttggcgatttgtgtcaaaatttgctgtcgtacggacggcgacggttcggcgagagaaatgtccaaaaattggaggaccatttggcattccgactcggagacggggcgagcaccttttgggtgggaacagagcaaagagagggcggacaattgagtctggaaaatgggaaaaacaattgctaacgacaagtttgtcatttttcgacggccgatacacctcggaatcggaggccaaaagtgcgttggccataaaatccgcgcaaattccgccgccgccgtttccgtccgcccccacaaaatcctcccagccaaagtcgcagttgccctcttcattgccaattcgatcgatggccaatcgcaaaagggtgcaaattgcgcgtggggaatgggccgagtcgcgaggaagcgctaaaatgggaaattgcaaaatgaaatattatattagcattggaaataggcttacacgcaaaagcgacaaattcggagcgaaaccatcgcctcgattcgggcgacttcagaagggccggcaaaaatttttgttcgattgcacaacgcacaactgcctaaattgacggtttcatcgaaataacagtaaaattcgcacttccgtcgccaacagctgtcgcttgatccatttcatgtgcaagtttagcctttcctgtcgattcaggcgaacggaaatggcacaatcgtcaacgatcagtttggaaatctgaaaagataattgagggaaatgaaatgaatggttgtgaatttgggaccgaaatgctcagcggggcgtgaccaatttggagaaagagacgcgaaacgaacaaatcggtgaacaaacggtcgcggaacggaagagagccctcaatggaggcgcaatggagcagagagtgctgagaaaaggggacacaaatcaatgtgggaaatgtcaaacatccaaacaaacgccggtacgtttccgttttgatggatgccacaccccattaaaaaaaaagagcaacaaagccgtaagaaatgcatattaaattcaaaacagaaagacggagagatatttgttctcccattcgaatttcgaacccaacccacaaaaataagtctagttataagcatcctgaacagctttattgcttttttgaagggtgtggcatcaaaatggaaaagtaccgaaaatagatcaaagtatggacaatttaacgaccccaaaaagaatggcgagggcattttcggaaagattttaatttaaaaatttaacagagaggaaattaagtgccaataatgagtgtagcaaatggcaataccaatgctttgatgcgcattttgctgaacatttcgttgtgcgcaccgcacaaaggatggccgacagagagaagccatgcgcagtttttaagggaggaccaaccaattcaaagaatgccaattcggaca

SEQ ID NO: 13316 - DNA, 1130 bp, Heterodera glycines
ccaaagagcagcaaagataattctaaaaaaattgaaattgccgactcattagggaacagcaaagagcattatccaacaggaatgaatatgaccacaatcgctcttaaaatcaatcgctaggcaacacccaaagagcagcacagatgaattctaaaaaaattgaaattgccgactcattagggaacagcaaagagcattatccaacaggaatgaatatgaccacaatcgctcttaaaatcaatcgctaggcaacacccaaagagcagcacagatgaattctaaaaaaattgaaattgccgactcattagggaacagcaaagagcattatccaacaggaatgaatatgaccacaatcgctcttaaaatcaatcgctaggcaacacccaaagagcagcacagatgaattctaaaaaaattgaaattgccgactcattagggaacagcaaggcgcattatccaacaggaatgaatttgaccacaatcgctcttaaaatcaatcgctaggcaacacccaaagagcagcacagatgaattctaaaaaaattgaaattgccgactcattagggaacagcaaagagcattatccaacaggaatgaatatgaccacaatcgctcttaaaatcaatcgctaggcaacacccaaagagcagcacagatgaattctaaaaaaatcgaaattgccgactcattagggaacagcaaggcgcattatccaacaggaatgaatttgaccacaatcgctcttaaaatcaatcgctaggcaacacccaaagagcagcacagatgaattctaaaaaaattgaaattgccgactcattagggaacagcaaagagcattatccaacaggaatgaatatgaccacaatcgctcttaaaatcaatcgctaggcaacacccaaagagcagcacagatgaattctaaaaaaattgaaattgccgactcattagggaacagcaaagagcattatccaacaggaatgaattgaccacaatcgctcttaaatcaatcgctaggcaacacccaaagagcagcacagatgaattctaaaaaaattgaaaattgccgactcattagggaacagcaaggcgcattatccaacaggaatgaatttgaccacatcgctcttaaa

SEQ ID NO: 13317 - DNA, 1245 bp, Heterodera glycines
  misc_feature (1187)..(1187): n is a, c, g, or t
aaaaaagtgaaatttcccgctcattagggaacagcaaggaccattatccaacaggaatgaatatgaccccaatcgctcttaaaatcaatcgttaggcaacccccaaagagcagcacagatgaattctaaaaaaattgaaattgccgactcattagggaacagcaaagagcattatccaacaggaatgaatttgaccacaatcgctcttaaaatcaatcgctaggcaacacccaaagagcagcacagatgaattctaaaaaaattgaaattgccgactcattagggaacagcaaagagcattatccaacaggaatgaatatgaccacaatcgctcttaaaatcaatcgctaggcaacacccaaagagcagcacagatgaattctaaaaaattgaaattgccgactcattagggaacagcaaagagcattatccaacaggaatgaatatgaccacaatcgctcttaaaatcaatcgctaggcaacacccaaagagcagcacagatgaattctaaaaaaattgaaattgccgactcattagggaacagcaaagagcattatccaacaggaatgaatttgaccacaatcgctcttaaaatcaatcgctaggcaacacccaaagagcagcacagatgaattctaaaaaaattgaaattgccgactcattagggaacagcaaagagcattatccaacaggaatgaatatgaccacaatcgctcttaaaatcaatcgctaggcaacacccaaagagcagcacagatgaattctaaaaaaaattgaaattgccgactcattagggaacagcaaagagcattatccaacaggaatgaatttgaccacaatcgctcttaaaatcaatcgctaggcaacacccaaagagcagcacagatgaattctaaaaaaattgaaattgccgactcattagggaacagcaaggcgcattatcgaacaggaatgaatatgaccacaatcgctcttaaaatcaatcgctagtcaacacccaaagagcagcacagatgaattctaaaaaatcgaaattgccgactcattagggaacagcaaggcgcattatccaacaggaatgaatatgaccacaatcgctcttaaaatcaatcgctaggcaacacccaaagagcagcacagatgaattctaaaaaaattgaaattgccgactcattagggaacagcnaagagcattatccaacaggaatgaatatgaccacaatcgctcttaaaatcaatcgcta

SEQ ID NO: 13318 - DNA, 2812 bp, Heterodera glycines
  misc_feature (2097)..(2097): n is a, c, g, or t
caacatccgctccctaaaaaaacacttacgttttaaagacttgcgaatctcgcacacaatggcgaggatgaacaaagaactaattgccgatgctgcacaataaatgataatggtccaagtggacattgtccgagttgccggtggcggggttgtcgtggtggttgttgttggtgtcgtcgtcgatgttgtggttttttgaatttctaagcttttcacttactttggtccttttttctgcccccatcgacaatgctgctgctgtcagcagaaagagaatgctcctggagggatgtgtggtaatgaattaattgcgaatattgaaatatttgttgcaaaattcaaaattttcagttttttcctttggcctatcggattcgttaattcagagaggcaattattactatgaaacgcagaatcatttacatataaccttaataattataataaataaaattttgacatttttcttaattctgttcactaatttcgtactccgattcaatttatgcttattcaaatgacaaatcaaagcaatgggttgccaaactcctgctgactaactaacttacataagaatgaacttgcccatgttgaacggcagagagaatggagttgattaattattgaaagaatggcggttaaattaaagaggaaaaatgaattcttaacattttaacaaatggaatgaattaaaaagagtcgaattatttaatatttgttgaagccataaacctcatcccaaattgaaaacagaaaattgaaaaaatacaattaaatcttttgaggttgctaaaattgtacaagaattgctcggttgacccgaccgaatggttgttatttcgaatgaattctttttaatcaaatttgaatatattttctcattcgatggtcgggggaagcgaacggcacaaaatgagcaaatttaactagcgaaacattaattcttctgattgctgaaaaggatatcagcccatccgttagattgaactggtggatgaatcactttagagcacagtccatcaatggtggtggtaatgggtggaaagtgaatgaattttaaatcgatgtaattaaaaaaagaaaaactattgttattgggtaaattgtaatgtcgggttaggccgaatggtgtcgataaggtgtcgccaagaaaaaaaacaaaaattctcagactagagtcaaacacattaaaatttggatattcgggtgaatataatcttacaaaaattcggcgattattacgttgttcaatttaaaaattttattgtttgtctccaataaattagcgaaaagatgattcaaattaaaattaacttcattcgactattattcatattatttaatgcttttgggttcgattttcattaaactcgacagacaaaaaacaaattaaaaaattcattgtaaaaaaatataaaaacaaatctcagaatataaaaaaaacaatttgcatagggaaaacctggtattttttactctttactcgcacattttatgtataatccatgtatggccacagaacaaaagacaaaaaaagttttcgacaattcgaaaataccctcaaaagatttagaaaaaattagaaaattgtcaaaagcttcttttgcaatcctagttaaaataaaatttttttttaaattttttttttctccaattaacaatttgagatatcaaatatgctttgtatatattttggtttttcttcaagtaaatcaagaattttctaacaatttctcgaaaatttgaactcaatttttgggaaattttttgctaatattttgtcatgactttttgctattttttatgactcttttgcatttttcgtgaatttttggcgtttttatgaactttttcgctactttttggcgatttttcatgactttttaagtcgacttttttgagtttttcgtgacttacctaaaattagcatccctatttataaggattttttcgaaaattcccgaaaaaataggcgccaaaaatggccgaaataggcacaaaaagagggcgcttaaacgatttaaattcgatatttaaccgaaatgttttgtgttgaatatatttttgaagacaaaaattttgtaaaacttcggcttncgattttgaaaacttcgggtttttttgggcttcgaattttggcttcaaataaaccaaactgcgtttaaaaattcatatagtatattgaaaattcaaaaaattaatatggaaacatttctaaatgtgtgtctgtccattttctgacgccaaattttgacgcttaatcattttatcaatgcatttttatagaaaggtttgggatttcattttttgttgtccgttaattaattgttcagcagcaattccgccgcctgctcatcgtaatattcgggctcctccgtccgtacgtttacactcagcaatttgccgttgtcaaaaaagtacaggcgattgtccaccgaattgtagctgagttgggccaaccctttgtaaggattgtaccatggcacgtcaatgaaaatgccttaacaattacgaattaatgaaagagcggaaaatttcataattgcattaattataattagagatcggatttttataattggacaaaaaaaaatcccaaaatatggttaaaaactttgaaataatgataaattcttccgaaaattatgcatttattgtaaaaaggttaaaattaatgaaatttaaatattaatttaagaaaaaaattcattgagaaaaaaaaatcatttataagttgaattttaacaaaaagacaattaattttattttatattaattagatttaatattttactttcatttctgtacatgt

SEQ ID NO: 13319 - DNA, 2817 bp, Heterodera glycines
aaaaagagtaaagctttaattaacagcaaaaattaattaatttaccgtgaatgtttggtcaggcttccatgggcctttaattcaaaattatggcaccattaatttggcattatttctcacagtccaatgatgcgataggtcccaaggcgtcgctctgaatctgatcattgctctccaaatcgtagcgcaccaaaatatttgaaccatgacgatggtaaaaataagaaccattgttcacggtactgcccgttcccgatgccaaaaagtcaacgtaataccttaatgaaagctaattaaacttcgtccttttgccaattaattaattaataattttatgaaatgcaacttagcttattaattagcctgcaacttactttatgttctgctttttgttcattagctcccgttcatttgcatattcataaagcaccggcgacgcgtcgccatcggtgacccaactaaagccattaaactaattggcaaaacaacttgcagcttaattgataaacaaatgataatgttacacccaaaaagtcgattgaaaaaggccataaatagacaaaaacaattatatatttttcattctatccctaattagtaccaacgattacggttcatttaatcataataacaatttatgatttgttaccgcttttctttccatttgcccgaacgaggcattgaatcgcgaaaccttggattagaataacaaaaatgcaaaacaaaataaaatcattaaggacataaatcttaattatttagcttattaattaaattgttcaactaatatgtatatatccaggcagattaagaattgaatattgacatcagagacaaagtttttaataaaaaaagacacacaagtccaatggtgccaaagtaatttcaatgaaaaacgaataataatcagggtttgggcactggacccggacccgattcccggattacacattttccgtactcatgcttctccctcaattttaccatgatcctgtcgtgccatactgtgactcggcatggagcacgggaatcccgactgcattcagacggcattctgtttttgtttgtaaaatttgaattaatattatatcttaaagtttttccatttttgatattatttttaaaaatacctctccgattctcggaaagtgttggtggcccggtgtacggcgttggcgtggtcggttgggaggctaaacagaaaataaactactaattgtaagcacgcgctttccattcttactattttaaatatttcaaatctattttgtttttaattataattatttataaaattaaattttacatttacatttgaatttttaattttttaatttgaatttatttgtttttcatctttgcctgttaaatgcgctggcggtggtgttagagtcgccgtcgtcgttgttgccgttgcgcttgtggtggagcgacgccgccacgggcgcgaccaccaatggcgatattggctcgaagcggttggacggacagtcgggggcacaagtcgcgtttgggacagatccggcatcggcatgcctggcacccaacccaaggggggctgagaaatcagtgaaattctcaaaaagaaattaatcatttactgcaaagcctggaggagttggctcaaaaggaacctaaaaattttatggaataataaaaattcgaaattttttttttgaaatttaaagaattcataaacgctaccagctttgtgacctccatctctttgagcacaattattgggaccggcacaagcttttcaatgggaattggaggccccggcacgggcactctctgaacatacaaatcgggcagagaacaattgcaacggcctgggcaataaaagataaatttaaaaataaataaattataattttttgtttaaattacttttgaatgcctttgctttctgataaatgatttaccatcgcttcccggcggtccttcggcgccaatgtctccgaccggcccaattggccccattcgaccggaggggccccgacgacccgaaataaaagaaattaaaattacctaataaaatctaaaatctttacctgggggtcccactggcccggggggccctttgccgcccgaggggccacggacaccgcgtaatttttggcccttatctgcgcaataccgatgcacacgttggcaagacgtttcaaatacttgccgctgaaaatggcaattctccatagaattgatgtttttctggcaaatctaccggaatgattgtgtcgtagccgagcagtacggtgctccatttgcccggactgtccaattggcgtgccgactttgctgctgcttttgttttctctgacgtcacttcgcgctttccccgcgccttatgctgctccacccgtttgacttccaattcgcgttccatcagctaaaatagtacaaatgattatgatgcaattattatttcgaatattaaatcatttttatttattttttaaaaataattttcaataaatatgtgacacccaaattcggtgataagcaaatgcgtagaaaagtatcagacaaagcaaatggacaatttgcaaagtaatgatcaaccgaacagagggaaaatttagtttctttgtcggactcatttataacctaaaaagttgctcatttattttaagtgaaccataaaaataaactacaatcatttatggattaggcatttctcaaagttttttcgtttgtaatttattaatgagtgttcaattagtatttatttgggtaatagttacgatggttgttgccccccttttttgaagtaatttttttttgttttaaaaagtcataaaaacatgcttccat

SEQ ID NO: 13320 - DNA, 1254 bp, Heterodera glycines
gtttttctgagaatggcggtgttgcgatggccatcgaatgggagagggaatttctgacgcgtgccgaagggcggggggcgtcggagcggcactcgccaagcggcgaaatgtctttttttgactacgaatcggcgtgggaagcgatgcattcgaaagagacgcaggaaaagtaccaattcagtcgggaagttcgttttgagcttcaaactcttaaaatgggaacatttgaaagaatccatttgttggagagcaaagggcgcgggaaaaggcggaagagacttttcgggagggacgcgtggccgactcgattttgcactacgaagcggcggtgcggagggagccccaaaatgtggaactttggtgggctgggggaaagtgacgcaaaaaagggggacggacgggggaaagggcgttaatttggcactttaactgtttcccaatggcatttcctcgtccacttgttttaggcatgcccttggcattgctcttgccgagaatgaagatggttggtacttccttcttctgcagttctcttttgtccttcgcttctctaactgttatccttttctcttagatccccgtgctatttcggccctccgaaatgctctaaaattggatccatcccataagccgtcacttttggccctctccgtttcattggccaatgaatcgttcgaccatttggccctgcatgaattgcacaaatgggtttgtgtccatgagaagaaggaaatgccgagggacagttcggagaacacttcgctgtttcgtcaatatactcagttggacgggactgagttttccaaggtttggtgctgaaatggccaatcctccattttcatgcttttccgcttcgtcttcgttagcttttcgcttatcccggatttgctttgcttcagattgaacagcaatttttgacctcggctggccgcgatcagtccgataaggcggagcttcagaatgccatgtaaaatgataactaattgagtgatcactgatcatagtgtttctttggctcaggggtgtgctctacaatttggccagaaatttcgaccgcgccgtcgactgcgtccgttccgcgttgtcctttcgtcctgaggtcgttttccattggttttagggccaatttttgagtcaaattttattaatctttcgcaaattccatttgtaaattgccatttgtgttctttcgccaggaccctgttctgtggaatcggctcggtgcgactttggccaacgctgacagagcggcgg

SEQ ID NO: 13321 - DNA, 1184 bp, Heterodera glycines
ccccattgggcaatccaattgaaagacattcagttggacattttgccaaaagaatcttcaaattgccccctcccccactctctcgtctcctccctccacacaatttggctcccttccaaatttgccaacgaccaattcatgccaatttattctaaatctcatccatcttcttattctccatcgatcactcgcctttttttccacgagtgcctttcttattttaattcacaaaattaggcaaatcgctccgtcgcaaaatgtttttgcatagattaagaaggtaaagcgaaacgaaagggttaattgatgtatcattgctgcaattagattcgacctttacacaaagcctgtggaggactgtcgggtgaaaacgccgttcggcggagtcagtgagtgccgtccgtcacttttgccatttcggcactttcactgctcgttcattcagtcaccttgatcagcttcgtcgtgattgttctgttgttcatctcagaaacatggtcatacctaagtgttgatgtcgttgaacagctttttgtggttattttttaccccaccccaaatggccaatttctgttccaaggattccaccagcgccgaaatgcgaattgaaattcattttgacattactctgcacaaactttcatgtcccttggttaccatagacgtgatgagtcaatctggagagagtcaagatggcattcagcacgacgtgttcaagcagaggctggacaagcaggggaacaacatggaaggggcacagcccgagaagcagggtcagcagttggtcaaacatgccatcaataggccaaattgacaataaaccacgagtttaagttgtgaacacaaatgcatccaaaagtgctaatgtgtcaaggaggacaagcagtgacgaggagtgcggcagctgctacggggccatcaaagggtcagtgggccaattgggacggtcttccgactcatcgtgaattgccttaggtgctgcaacacttgtgaggaggtacgcgaggcatatcgcctgagggggtgggtgctgcagaatatcgacaaggtcgagcagtgcaagaacgacgcggtgttgaggtctttgagtgaacaggcggacgaaggttgtcgagtgtggggcacagttgacgttgggaaggtaagagaggagggcatagcggggatccataagagggagagag

SEQ ID NO: 13322 - DNA, 2181 bp, Heterodera glycines
ttggccacgctgacagagcggcggaagcgataaagtcagtggaggggggggggggggaagggaatgttttggtggaaaatgttagggcgggtggacgacacgaagcaatttaggaaaagctaaaacaaaaacaaacgaataccaatgaaaatgaatatcaatgcttctcaatgacctcatttgatttattttatcgtccttttccgccattgttcgttcacaatatccttgatttttcgttctcaaataattaattattaattaataatttggcacttcattaaccgatgtttcgcttggacaattaattgttttcctaattaattaataattaattaattagtgcctttccctccgccccttaagtgcctacaaaagtgccctccatttgttccccgcttatgttcgcgctcggtacaacttgggcattgcgtgcacaaatttgaacagttacaagtcaatttactacagaagtggcctaattatccgccattgtttaagggacgccgccgcacattttgtgaccgccctccaactccaaaatgcacccgaaaattcccaaatttggtccaaactccgatcggcgatgatcagactgacgggggacgacgagccgagcaccgattgcttcgacgctttggagaggaggcaattggaccgaattgtgacattccttcgacataaaagcactttcgaacgaatggacgaacagtgacagagaaaaagcggggaaagaaagcgaaagaaattttaattattggcaaaattaataaaacaattttatggtgacaaattaagcaaacaaaaaacagccaaaaacaaatgacaattttattactcgcttaatttataacatatttgttactctgatttaaaatttaaaaatggtcaaagttttgtgggcggttggcttatcacttgcgcgccattcgcgggacagaccggcggaagggcgacggaaccgccgccgacgcagcgattgacagcgggaggaacgcgtcggaccattgccgtttggttggaagggcgggggacggcggttaaatgggcggaagaaacgggcgccgatttggaaagagcggagaaatgggaatgcatgtgttctgcaagtcgtaggaaattgggccaaaattcaaaattataagcatgagtatagggggaccgcttttttgtgtgccaatcatttcacaaaaaaaaatcgatgcattggcacttcccgtggctgttttggccgattcctccaaacggctccatttccattggccgtacccccgtcagttggtgccactcacctgaaattgtcagcacatcctgcgcatcgaaacgtctcgagggatttgtgcagatgcaattggcaattgtcagtcgcaactgaacgaatacgatttgagggtggtgtttctgttttggccgagggttttcctggcacccaatccccgtcccccctccccggctttctcctgccgctttgttctctattttatttattgcctgttgcgagtaaatgttggccgggatgggcgggtactcgcatttgctgattttgcggaccaacgccagcagattttgtttctcgccaaagaacggcgactgaagcgcggccatttcgtaaaggacacagccgagggaccaaatgtccgacttgaagctgtaccccatttcgttcattctttccggcgccccccccctccccccactcaatttgccattttagtccacgacttccattccgtctcccccgcccgttttgatgcttctcacaccataaaccatttgtccttcggaaagcctttccccggcaaaacgcatcctttggacgggaaacaattcataaccaacaaaggttggtgaagccatttaaaacgcaaaagcatttaaaccaacaaaaaggcggcataatgcaccaatatcaactgaaaattgtgcctactcggtacatttacggagtgacgcggaaggaagagactttggtcagccatcaatttgcgatcactcgcgtggagagggacattatgaccggggccagtggcattcccggactctttgtacaatgcgaactctcgcctttgatggtccaatacgaagagaggaaaaggtggagacaaaaagcatgccaaagcgagggggggggcaaagaatgacataaaaattggggaaggaatgtcataaaaattggcgaag

SEQ ID NO: 13323 - DNA, 1505 bp, Heterodera glycines
caaatgtgcaattgccaattacgcgttgtcgtgctgtctttcggtgcatcgcatcgccgaattgagcagactctcttttggggtgaagcacgccttcacctggcggaagttgccaccgagcgaagtgatatgagactgaaaagcagcgaattccgccgatttttttcttgaaaaatgcgcacttggcacgtgtccaagcatggctccatcgtcttctgatagcggtctttgcacggcttaatctccgcacatttgcactgcctttccatccccgcgggcggttgccgttgcgctgccaccgcttgtcgcgcggccggtcgcgcagatcgcacagcggcggggggtggcaccgcatcggcgaaaaatggaagcaaaacggcacaggaaagcggcaccagggcgaataagcagcgcatggtgatttatgtgatggaaactcaattaaatcctaaaaatttggggggggggtcattgatgatggtgataatgatgatgaagttttgcaaattaattggctaattgctttgctctctccgtccttccgtttaatctttgccgcatattcggctcgccctccggcgcgatgatttgctcctgatgatcgcagccccccttttataggcattgcgatgcccgcttgtgccactcgcggctgttcactgatattttgcggtcggccgtcgccgtcgccaccgcatgggacgaccttgagaaaatcgtaaaaaattattaatttttgaacagtttggaactgttgtgcgttttggtcttcagtcaaaaatagtgtacaaaataattttgaatttttcccactttttggctatgcgtttcctctttttttctccatcttgcgaaatcactgcaaaatgatttttatcgttacttattcattcaaatgctctaacaaataagtgaagttcaaaattataaatttaaaagcgttttcgacttattgttaaatttgatgaccttcactcaaaattcggtgggcactgctcagatcggtggatgattgatgagattttcgatgttttatttgtgtcccactttttgttatgtttgaatggcaaagatgtgagatcactcaactaatgaataattgataaattaataattttaaaaataattttctaaagcaatttcctcaaatacggtaattggtaaaatgatatgatcatcacattaaaatttaacattgggcgaagctaccgaaaagtacaattgatgaataattttgggaaagttttgacgaaaaatttgtaatgactttggcggtggagggagcagaagaagccaatcttattattattaaattaaataaaaatgaaaatgaaagtaaaaataaaaagacagccttttttattttggctattttggaaataaaacatttaatttccaagagaaggagaaccattgctgtttttgtgtattttcatttaaattgtcaaataaaaaattaataattgatgaggagctggaaccggaggggggtggggggggggaga

SEQ ID NO: 13324 - DNA, 2670 bp, Heterodera glycines
gggactgaatgggggggggggggagtgagtcggtgtctaaatttgcgaaggggttccagtcatgcaaaccttatgattttttttttttgcttttcaaaccgctttttttcgacgcgctcttctaaaaacctttggggaacaatgaattttttcgaaaattattcaattttccataaatctcttactttttcataaacaaaaacttttaaataattttatataaaacattcacttcaataaaagtttctttttaagaattttatccaaaattgccgcggagtcacaaatcccgcggatcgcggattcattaccgcggtcgcggatcgcgagaaaaaacgccgcgaatcgcggatttcggtcgcgctccacccctggcccattccagcatttttgggtccatatgataaaaagctgaaagtccctgctcaatttggggagggggttggtgggcttttagtccgcgagatttttgaaacgaaatatttcctaatttgtaagatttaagcaaagacgcgggcggatgggcgagcctttgtctgccgtcgcgccaaaaggcgttttgtccggacaatgcgtgggacgcactcaatgtttggcatccgtttaaaagctcacaatcagaaatcaaatcgctttttcgtttttctttacagtcccttggagagaacgatcgctttccgttctgttgatgggcgaattgaaaaggaattgaatttgttggaaaatgctaattttaatcattttttattgtatgttttttaatcaattctcgacaaattatcccaaaagcaaatacattttagccgtttcagtctctgagggggcggggggggggggggcaattgcgaattgcctaagcatggtttaggggtcctaattgtggattgctgttacgaattttttcgattttgcgcaattaatccgcaattttgaacattgtaagaatgaggaactgagaattttgaataaatttataagtatgcaattttcaatgcattaaaaattaaaaacaactaattcaaagtcgtttttagataacttttgttaaaaacccgacatgtccctgctcgccactatttcccttaaatctttcaaaaattaattaaattaacataattttctttaaaaatttttattaatttcctttacattaaaaaaatttttatccgatttttgttgcatatatttttacagcattacaattattgaatatgtggcttaattgattaaatttatatcattaagcttctcatgaaaatattcaaattaagaaaaaaaaattaacatacaaatttaggaaatggcattattatttgaaaatcatcaaaattttataatttaattattttatatttaaaaaatagataaatgaattcaaaaacaattcttcatgtttttctgctccttttccttttctcttcactttttgtcattatttccttggcaatgcaaatagaggaacaacaaacaaagagtattcataatggagatgatgatggtaatgagaatgagaagaatggcaatgacagtaattttatgctaagcgatgcgtcagcgttcaaaacgtaccaaaagcgcgaaaacccaaaaagcgcaaaaacgggcaaaaacgacgaattggacggtgccggcgccgaaaagtctaaccgacgagggaaggcaaatggggtggaaaaagcgccgcaaaagcaaaagaaaactgaccgcatcgcttctaagcagcgaccgatggataaaagtaaggcacggaatgccattaccaaacaaagacggctaaatgaagaagaagccgctgctgtagccgtcgatcaaatgagtgaacccgcggggattgacggggaagaagccgagccgagtcggcaccagtcgctgacaccgagcaaaaggcaacgctcggcacgaaagaagccaaacaaaagccaatgggatgttcaactgacgccgacgggcaccgtttcggatgcggaaatccccgcagatgacaacagcacgcgcaatttgtcacccgcggccgatggcccaagcgaagagccgtcgtcgtcaaaaggcgtgaacaattcgccgttggcacttgtggacaattggcaacggccgcaaattaaaaaccgaattagagaacaaacacggcgcattgatgaacttggccaagaagtggcggaattaaagcaatggaaggcgcaacaagaacaaaaacaactgaaccaatcgcaggaagaagcgttgcggcaacaatggcactgttttgtaagcatacagcaaatgatggcactacaggtacaagcacagcaaatggcacattttcaatcagcgaatatccaagacttggaacaacaatcggagactgatcagcaacaaacgctgtttcgtccaatcgcctcacatggaagcgtaacggagcgaacagtaacagcagaagagaaagaaaagcaacatgaaatgcaagaaaatggacaacatgagcaaggaggacaccaagatgaagaagtgcagcagcagcaacaatttgaagaaggaaagcaacaacaaacgacgaatgcactgatgagctcttaccatggcttaccacgggaagcacaacaagaggaagaagaacaacaccaaatgcatcaccaccaacaggtgcagggaattgcccagcagcaattgaaagcattggcacaaagcacaaca

SEQ ID NO: 13325 - DNA, 4052 bp, Heterodera glycines
  misc_feature (4023)..(4024): n is a, c, g, or t
atgattaaaaaagagaaccccaataagcattttttgtctcactgtgcttaacttcctatttcttggcctggtgtcttatcttatgctaatttctaaaaaaaataaaaatattaatttttaaaatccacaaaattacccattataattaaaatattatgaaatatgatttgttaaaaaacatcactataaaggtataaaaatattatatctattaataatttcttctcaagaacgccgttgcgcatgaaattcattattttccgtgttttgatcatttgtgagttttggaaatttgttaaaaaagggtaaatatccatcatatgtcccacactcaaaattgcataaaaacacttttataggctttattaggtgacggcgcgctgtcatttcgtccctgcgtcgtttcgtcccctaagccaaaatgagtcgtttcgtccccaatttttttttatttaaaaaattaattagtcttcaagcggtaactcctaaattttcacacattattactaaacattttttatttactaattttagacctattatgaaccgtaaaagattgaatttctcaaaaattgatcaccaaaatttattttatttttttcttgtaaaaaaattttaggtttaaaaattttccttattcgaaaacattataaagtcttttttcgtgccttttttcaattttttggtgcctattttagtgcctttttcgcgatttttggtgccttttttgcgagctctatttattatttaatgataagtttgctttatttggagtccgttgacattatgcgccgccgacaaaaaatttgagaatttttacccaattaattaacaaatttgcacaaaaattatttgaacaaattttgttatttgccaaataaccttttttggaaccgaagcatattgatctttgttccccgttttttagggatgaaattatttttcacacaaaatacgatttgatgaaaggtgaaagcggtgtaattatttttcatgcaaacattggcaccgcacaataatttctaattaatattaattattttttttattgaattacgtaattatacacatattatacaaaatccattagattggctgggtttaatagtcaaaaaagcgttgctcctctttctcgggaagtcaatagcagtgaagtgcgtgtgcccgttcgagctcgttgttgcgctggtggtggtgggggtgaaggatttgcgacacagagaggcattagggggacaaggaggaaactgaaaaaaatgcaaaagcaattaaatattaatgaaacattattatttttaacaatttttagtccaatggaatacatttttacataattggtttaaatatttttataaattccccgcttcttttttcctcaccaatttgcgtgcatttcctgaagtgctcgttcacgcgaaatgcaagtggggtcagccaacgtgcctcttctttaaggaaaataaattcaaaaaaagttaatttattatcagcagtaatgaatgttatttaaaataaaaatgacagtgattaatgcccgagaatcacaaagtagagaaaagtttggtgtttcttttgtcctgcctgagttcggctttttagtttcgttaatctcgagaccgagataaagaatttgagttctgtgaaaaaacaaacattggacttggtacggtgtgttttccaaagtgtctggtgggtaaatataaatgcatcaaggtagaataaagaatattctaaaaaaataaaccgagttcaaaaacccgattagtccgaacaaattcgggctctacttagaactgggacaaccagtgatgcgaattggtgcgattgaattgggagcgtctaataagttgaattaattgacgtttgatataccgtattccattcatttggttggcgcatttactgtacctttgctggttgtatttggctgccgcattcattagcaaatggcgctccaaattttttcggcacagcaatccgatggaaggacttggtgtgaatttgttcaacaaaccgccgacattctgctgttgctgcctgcgcatattggtgaaccaattgatgtcatcccggagggcacgacgatgccgctagaaaaagaacataaagtctaatcgcgggtttagaggaatgagaccgaaccaccagacaatgaatgaattaatgatcaatgcccgaatcccggcttttcatttgatcaattttttctgatcatttttggcgccggagccaaaaaagccgaaaattggaaatatcaaattgactatgctctctacacgataaaagtggtttaaaagtgattttaacacatacagttcggaatgttcccttgtaagtcgagaaatcaagggtcatgaatctatgcttagttctcaaatctcttcttgtgattttaagaaaaatcattgcccatatttgtactattagaagacttaaataaattttattttttaaaaactgttgtcatttattatttaaattaattttggaatcccttggctcagcgccaatccgacaaaacaaaacgaacagactttgctcatccaaaagtacagcaatggattggacacaattgaagtcatcgcaatggcgtggacatttaacagcttgaaatacatgttggtggcatcgcgcaagaaatccatgtctctaagctggacaaaaattacgataattggttactgtatcgcgtattcaataaaaaattcaaagaattaaaagtgcgacctaagatacttaagtttttgaaaatttttcaaaaaatacggagtccgcggtaaaggaattgtcaatattcgatggtgcccaaaaatttaacaaatcgcatgggttttaaattttgaaaaaacctaccaaattcacaatggtcaaaggcatccatgaacccatgaaaatgagcaccttatttaaaattggaaattgtgaagagatcattaatttgaaaattgaaattttgtaatatcaaaaaatgaattaataatccgtaccatcaagatgagcacgtacctaaaggaaaaagttaagttagagagtgcagctttcatcaggactaatcacaacttttaaaaaagattccatgcaaaaatttcttagcaataatttgatcttgaaaaaagagattttctattttagaatattttaattcttacatattagaaatttcttgattgaaaatatttgttgcttcattttggcactgatttacactagctaacaaataagaggcgttcttagcacgaacatcacacggcgtttgcgcattgcggtctgcgcctgttgttcaacggtcattgtggaactgaagctagctggcaccatccaatcctgacgaacctaaaaataaaaatttaaatggttaagaattggagggagaccttttgtagaattttccagtagcagtaagccatgattgaagttgggatcagaaattggatgacaagaagcgaaatcttgaacaaactgatctcaattcaaaatgaaaagtcaaaggtcaattttttaaaattatttatttgaggggatgccactcttcaacacatttttatcatcataaatccgcatacatggacaagctggcggggtggtcagaaaattgcctttacgaaaataccccccccccctcagaatttttacgaaattgaaaaaacgctcaaaaattttttgatgaccagcaccagtagagaaaatttttaaattttatgcattttgctaacagattttgtagaaaaatgcacaaatttactagccgatatcataaatttttattaacaaattttcatggctatataattctgaaaaattgacgtaattcattcaaaaaaatgtgacgaaattgaaaacgaaattcaatatcgtaaaaattttgaattttggcagaaaaattttgattttcttttaattcgtaaatttcttcatatgagattaagcccatattctacgaattaacatactaattctttttttttgcatctatttgaataaaacctaccccgtaagcaagcttcaactgcatatgtccctcanngccattgtattcaccgcaaaacttaaaa

SEQ ID NO: 13326 - DNA, 3930 bp, Heterodera glycines
ttgtttgggaaaaatttggaaaattggctatctctttttctgctcacagtaataggaattccaaccgcattctcagaataattacgccgatactaattgttctggaatttgtttctcggcgcgtttgtttgggaaaaatttggaaaattggctatctcattttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgtgaaaaatttggaaaattggctatctctttttctgctcaacagtaataggaattccaaccgcattctcagaataattacgccgttctggaattttgtcctgtgctcaaagctcatcaagagctatggaattataccatatttgttcggattaaatcctttaaaatcccccgtatttcaaaaatggaaaaaccgatctgtcggcacatgcaaatctgggcttttaggttcacccccttcaaaaaattcagctcttttaaattattttttttttctgtcagacatttgttaaaatattacaaaaaaatggacacggttgaccaactgtccgcttctggcaccgcagcacaaagtgttgttgacccacatgcagccgctcttcaagaaggcaagcgattttcaattaatttgcggcgcgctttaacaaaaacggggaattggggactgctgaacaggctggtggcttagctgccgccatgggatgggaaaatcggaatcttttggccatattttgaataaaatactaatttttggttagataattggtcttgaatgaagcgatgaaattaggccctatggggaaagatttggaaatttaccgaaatcgttaagataattagtacattttcaggaaatgttcaacaatttgttgccgcagcgccgccattgcctcttcctgatgcgccgtttacatttgaaaacatttttgaggtgagtctcacaaggaatatttgggatgccaagcaaaaatattcgaaaaagggtacttttctgttttcagacccccccctgaaattttcaaagaaagtcagtttctgaggttatttgtgacgctgatcacgaatatgacatttgttttgctgaattccgaaacttggacccgaactcgagcaaaaattcaaattcattaatacacaaggaaaatcatattttggtagaagttcagtttgtccctccatttttgaattttttatttttattttaagaccataaaaacatgttttaaggggttttagagaaagctgatcacgaatacaacaaaaattttgagcaattccgaactccgaacatgaactcgaacaaaagtcgaaattttaaactttcgagttacgcattttcggttcaaacaaaccagcttaatgcaaggaaacaaataaaaatcatttttcgaaaaaaaatttagtttttaaagtcattaaacatgtttccaagggttttcggggttgctgaccacgtatccggcaaacattcgactaatttcgaaaatctggtccggggttcggattggccgagatgggtgttcgaatcggattctctcatcccagaaaacccataaaatgcctttatttcaagattaaaaattgatttttcaaaaagagtgcaaccatcgttactattaccaatgtttttagaatttcagaaagatggagaattaaaatttttctagggccactccatctcttaagggctttttcggacattgcggtctagcatttgcggcttcaagtcaaaattctaggatttgtccctccatttttcgaaaaaattagttttcaaaagtcataaacatgtttccaagggtttagggtcgctctgatcacgtatgcggcaaacatttcgactaattccgaaccgcgaaccatgatttgaacaaaagtcgaaagttaaaattttcgagtttcgcttttttagtctaaaaaacattaaatgatcttttaacaaagcaatgatgattttcacttcggtttccgtgtaattaaaaaaaactttgaaccaatgaaattcgaacattttgattgaaatttttgactttgtgttcgaatcctggttcggggctcgaattaggccaaaatgaatgtcagaaaagcatttcccgccccttaaagaccctaaacaatttatctcatgaaaatttgggttttttaaatattcggcccgacatttacggcccccaaatatttgcagttgaaggatgtgacgcaactatgtcgcaaattccgcacatttctttgtgaaccgttttgccgcatttcaaacgcctgtagcccttcttctgttgggcgaacgtggcgtgggcaaacgccatgtggcgcgaactcttgcggacgaggcgaagtttgaactggttcgaatggtcgcgttggacgacaacacgtgccagcactcaatcacacgccaaaaaatgtcattgtccgccgcctttggtaaaatttggctgtgtttgtgattttggcacgaacaaataagtgggcaagggcagaatttttttatggacccggtccaaatcggacaaatcaatttttgtcataatgaaacaattactctcaaaataacttttaaattcagaaaaatagctattaattaatacgggtggtgcattcaaagaattaaaaaagtttttgcataatctttaattttccttttttgcgattgttgctcttcgctgtgttttttacagcgcttatcccattaaattaaaaaaacactgaaattaataattccattttggttttcatcatattctgccaaattgcctgtaatactgtagtttgtcccccatcttttttaaaaaaaaatttcaaaaattcttttgccctaaaaacaagtttccaggggtttttggggtcgctgaacacgaatccggcatccatttcggccaatttcaaatcccggacccgaattcgaataaaaggtcgaaaattcaaattttcgaatttctcatttttggtctaaacatgacttatatgatcttttattgcaaaattggcaacttttagaatgctttcgtgtatgtaaaccgatttcgaaccaatccttccgcgatccgaagatcgagctccgccccgatacgcccaaattgaacttttattagctccatccaagacgtatatgcgatgagaaatttacttgcgttcaactactgaaaacctagagaattcaaagtgatccaactgttttgagaatacaatacgttaaacagataacctttcggatcacattgacgtagattcactctttaatgacatgtacgtccactccaaaatcaaccgagctcgtttcgaggaagaatgcatgccgtatggcataaaaaagtgttaaaaacaaattaaatccaacaataattaagatccgcacaattctccaacccttgtagaaggtattgaagtttgtgactgactcacaaatggaagggtgctgaatcaacatgacttgcagtttatagtaatcttaaagggtcgaaaaatacgaaattaaaaaatactgctgcttatatagaaatgattgccgactgctgtagatttatggatgccaaggtagacaagcggtccatcctcgaaatagtgatcgtagatggatctactctcatcccaaaaagagcagaagccgctcaaagagttcttcaacaaccgaaagctgaacctgtcc

SEQ ID NO: 13327 - DNA, 822 bp, Heterodera glycines
agaaactgaagagcgaaagggagggagaaaagcgtttccccccgtttcactcacaaaatcacacaatctttcaaagtttcttattgggaaaaccagttttagagtgggggagagagtgtgtgggcgagagaaagagaggaaaagcggaaggaaagggaagagcgagggagcattagagagtgagggagtaggagagaaattagggaccgggaaacccgaagaaagacacagagagagagagagcgagagagagaacgagagaaagaaggagagagtggggggggggaacaaaagtaatacgaatgatgaatggcagcagatgaggaagaagcatgctggaagcgatcggaagaagcaattacttactcataaatgattagcatgcaaatgattaggcaggcgttttgccccggggcaatgatcagcagaagaaattatgtccaaaaaggtaatccgaagaaacgccaaacacttttttttattcgtcaaaagcgatgggacaattaataaaaaatttgttaattcttaccaaagggaaagcataaggtaattaattaattaattaatggaagggggggggggaagaaaaatatcagaaggcatatcccccgtcatgcgcaaagcaaaatgtgcacaaaaagaaatgaatgaaagggaatgaaaaacagttgataaatgaacaaataaaagggacccattcaaaaggcccggggcaaatgattatgtaatgaataaaaaacacgccaattaaactttaaagtggaagcacaaattgttgggtttttttttctaccggggggaaagaggaggggagagggggga

SEQ ID NO: 13328 - DNA, 2415 bp, Heterodera glycines
  misc_feature (12)..(12): n is a, c, g, or t
atgcgaatttanttggcaaaggtttaacggtaaacacaaaataaaaatggattaatttaatttgttggctctttttgttttggtggacgccgccttttaacttggcttcttcctgctgtagtaaatccttcaaaatgcttttcttccctctctccttttccacctttctcctctttttcttcctcctctttgtgttcttctttccttttttccctcctctcttttcccacttctctccttatgtgtttacatcatccattccccttctcctcttttcttcctctttacgttgttccatttcttctgttcttcctccctttctcttccttcccctcgtccttcacatttgctctttttcctctctctcttccctcctctcttccttttccggcattcttcgtctttctccgttttgcttcctgctcctactcctcctcctccctcccttccgctgttcttctaccgccgtcatcactcggtgataaaagcgaaaagcccccgcgggaacgcccaaaacgaacactgacgcaaccaaaatgaacagcaaatcgcgcgggtggcaaaggacaaaagactaaaaaaagaaaacaagaaaagatatgataagtgatagaagtgccgactttataatcccagggaggcaaacattgcgaaacatcgtccaatttggcgactttttcccgaaagaattccgtctcgagcatttcttcgggcaacaaatcgctgacctaaagccatcagctgccgatttattcgaattttaaatataattaattaattggtttgatataagcatgcttcttcaacatctgctatctccagcactgtctgatccgtccatagggcgcggcgacccgcgcgaaattgcgcatttttaatgtccaaaagatcggagtctgtcatttggccatttttcgccacctttctgttggcccatctgagcttcgtcagaaaagcaaattgaacaacgaaaaattgttcatccaaacattgctttctcagcaaaagcacttggtcctaaaagaatttgaatttgcattgtacgcaatttttggcgatttgtaaattctcacaaatttgattttgccgccaaaagtggtcgaaagccaatgggcgagaaaagagtccatcagttgggggaaaagcgattggaagccgaacagagcggggagggggaaaagcagggggacggtgagcactttggagggaacatttcgaatgagaaaagcggatgagcaacgccgaagagtcgcggaagcggaggaacgaaggaagggcgacacggaacatacgcaatgccaaaagggggcaaacgcggacaaatggccgttgcacagtgtgtgctgctcgctaaggcatactgtggacagacacggtgttgatgatacgttgccaacaaatgctttaccgtcccatgcgtccgtctgtaattcgtgccgcgtttcgctttgagtcaacgcctgttttttttgttcaaaagcatcatttccaattatttgaattgtcaatttaaatatgataatttttcttaaattgcttgatatttttaattactaatgtcaatttatttgctcgctaattaccttattaaggcgttggtgtcttctgatcactttctcgatttgttgcgtgaccaattgtccgccagaattggacattgcgtcaacaatttccatcgtttgcaatcgtttcagtgtttctctgtccattttagtcaaatttacctgtcaacccattaacaaattgagctcttaatcaattaattgtgttaatttgcctctcctggatcaaatgtgtgcacatatctcatgccaattgtttggttggcacttttacggtttcgattgtattgactacaaatgattttaagcttcgttatttgctcggcactgataaaattttcctgaaaaatcaaaattaatttcctctttttctgccattttagaaatgacccttgagagaatgtttccgaaaagatccaatttggagggcgttaaacgacggccacgaaagcgcttaagggcaattccatcggccaaggaattgccattgtacgattgatttggcattttgccatcgaattcaaccgattttaacagaaaacgttgacgaaaacaataaagcaaaaggagaaggaacagaatgaaaaaggacaaatgccatggagaaaaacactgacggcggcgtaggaaaatattcattttggagaaaaattggaaagggacaagaaaagactaataatgtaaaatgacgataatggacatattcggtcctaattaggtcctaattagttcctcttccgttttcttcctcggcccaatgcggtaaatcgtcgtgcgaattgctcttcttcccctccttcgccctcttctgtttatggtcgtcctctccttcggcgattaatttgtgacttct

SEQ ID NO: 13329 - DNA, 939 bp, Heterodera glycines
gctgttttgtctattctgctgatcaatgaccaatcaatcattcaattcattaattagttgtacttttcctctttacttgattgaatttatcagaaaagacaatcgcttcctcgcgcctttctttgcttcccctccctctgtttgtccctccaaaatttcaccttgaccccccccccccccgtttctccgatctctcccccctcccttccccatccattctttctttacccttttgatcattttcttcgcttattccctttttcttacatttttattattttttacattttttcgccattttgattcgaatattttagtttcattccgtccccaaatggcttcttctttttcgtcttcttcgccttccgtcctccgtttcgagcccaaaaatgtgttggtcactggcgcctgcggtttcattggctcaaattttgtgaattttgcctttgaaaagtggccgcagagcaattttgtgaacgtggacaagttgatactgaacagtgactgtaattacgtggcacggaaagtgcgcaattcggcgcggtacaaaagcgaattggcggacattcgcaacggaaaagtgctgaaaaaagtgttggagcaaaatgaggtgaaaaagggagaggaaactaagaaaattgaaatgaaataaaacattcatgattaatgaaattcatcattattaaattgattcaattaagaaacgacgaacaaaaattgaaattagtaaacgaataattttttttaattactgttaatacatcaaaaagaaacgatttaaacaaatttaatttaattgattttttggtaatgcgtgttaattttgatttgtcaatttaataattgctttaattgattgatcagattgatacgattgtgcacttcgcagccgattgcaccagcaagcgatgctatgaacaacccaatggaaagcgttgg

SEQ ID NO: 13330 - DNA, 4392 bp, Heterodera glycines
cgactgatcagtccgtatttggtcggctggaggagacttctaccacgtcggattccaattggtcgagctgctcaagcatcgaactcagatcccttaattggcataaaaagtgcgttggttaattagctaattgcccgttcttcttccgtttattggttttttccgctctcttctaaattggcactgtttcggctttctctccgtccgcctcacttttcttctttgcccggttcggtgcgcagttcgatgtaatatttcactttcggctccgttccgctcgcccgcagtgtcaccgcacttccgtcgaccaaagtgaacgtcaccatttcggaggaggtgctcagcggcagaatggccctgtcatccggttgagcgttgtcataacctgcaaaaatgccgttccgtggttttgttttggcaattccttctcctcaaatggcccacccgtcgtcaagtcgcgcacaaatttcacatcgaaattctgcccaatcgtttcgggataatcggagcgaaggtccgcaaataatttcttcgtcacttccgtcgatttgaccccccaatacgaattgcgttggaggtgaaagccgtagatggagaagaggcggaagagctgttcacgcagcgaaacgcccttttgggtgcgcagccaattggccatttcagcaaagaccgcggcggaagaaacgccgtcctatgggaagaaagcggacgaatggtcagcagtcaaaaacagacaattggccgctaacagacaaaataggattaaaactcaaattctttggcctttatggttcactgcctttcccagcgggtcattttcccttgaaattttaagttcaaaattccgaaatttttagtaaaaaatgcctggaaatctttagaatttttttggttgactaaattctgccgcccgtgcccactttgtccagcgttgtgccgggagtaaacccaatggactcctcccaggcggcaataacggtgttgccttccgaccgcaatttgtgtgccaaattgcctatgtatttgaagcccgtcaacgaatgcgccgctttgaagcctttaattggaacgaaaatagccaattcatttgtttaattaataattaattgagggacagaccctcctttttggccattgtggcgaccatttgggaagagacggccgaatggaggacgaacacccgcgaagagtccgccgttgggttggcggcacgccaattggtccacgcccaccacgtcagcagaatgcccatctcattgccactgaacacgcgccactctccgctgaaagcaaaatcgaaatcagtcaaatgccaattcaaatttggtcccgttttacggactttgcctctttctccgccaattggagtcggtcggcgtccgggtcattgacgaggagcaaagtcgagtcattggcatttgcagtctcaatgcacagtttgaggacccggtgcccttcctcggggttggggaatggaacagtgccaaagtcggcgtcgggctcgtcttgttcctgaaaatttgaatggaaatgagtcaacaggacacactgcgcaactgttataaaaaatacacacaaaataccttaacgtacgaaatgttctccgagggaaagccaaactcagcgaacattcggcggacgaatttggagccgacgccatggaaagcggaataagtgagacggagggacgaagtttggttgagcgaccgaaaatggaaagggaagggagaaccaaaagtgtgccgcatggaacttgtgatggcagcaaatggcactctccccggcaaaatatttctccaaaaccgagtcggccgagtggagaaaggcacttgtgccgagttggaccgtgtcccaataggcttcttcgggctttgactcctccgcgacaattcgacaaatttccgtgtcgtgtgggctcagaatttgagcaccgttggcccaataagccttgaagccgttgtcctccttcggattgtgagaagcggtgatcggaaaatggaaaatattaacaggggaaatacaaatggcaaacaaaccaaccatgatgcccgcagcacaacccaaagaaacgacggcaaacgaaacgacaggggtggggacgacggcggaaaagagaaaggcggacagtccgttcagcacgaaaacattggcagccaattcggcaaaactaagcgtggaatggaaatgccaacgcatactttacaggccttttaccgtttgctctgatgtcggccatcgaagccaatcacaacgcctttctttttgccatcttcgcccatttcacttgtcaaatgccgtgccattccatgggacagttggatgatggtcaattcgttcagtctggcaaagcccgcctccatgtgcgttcgaactcctacagaaaaactcgggatcataactcacaaccgagaaacccatcaaggcacctgccgtcccaaaagacaatttcccaaccatccgaagtcgcaattcgtgcacattattctcttttacgagtcgttcaatttctgttcgagtcgtttcattctgaaaattttacacaaattaaatacccacaatttgtgatgatttgattaattaattagatgacaataccttgtcccagcataaccatttgtttattaattcttgaaggtaggggtccattacagattggtaacaatttgtttgctaatgaaattatttagttggatttaaaaaattgtagtaatggatagtttgaaatatcatttttaattagcgttgtcttacaaaaactttaattattcatcaactttaattaaaacatttctccgtttttacaataatgattaggtatttagttgagtatcgatactgattgattatcaacataaaaccattgttaggtataagtacacacaacgaatgacgtcacatactgactgtgagagactgacaaagtgactttctgaaggaaacgagtgtttggaggccaaaacagacaaaattgatcatacatataatatgaaaagtgaaatagcagtgggagaggaatttctgctgaatacaaaaaataaatggacatcgaatggaggacttaaatttaaaacattaaaaccgaaacccaacgtcctccatttattaaagcttttgtttgaacaagcaaaagtgaatggaatttgaatgccttcgttcggttggtggtcgacattcctcttaaacttgcgtctgcagcgtcccatcctcaaaaacgatattgctgccgccggaagtggcgaatagtcgttcgacacgcttccttttccttcaaatatttgtataatattgtaatattatgttacatcgaaaatgctgataaaactcactccatttcggtgctgggcccaatgtgtgttgttttggaatagtacgaacgacgttcgctggtgccccgttgtgaaagcggaccgccaatttgttgttggtactgaagggtaaccgcgtccaccgccgcttcctccgccttatgttgctgctcttcgtgctccgatattcgcgacctttgctggtgttgtcgcatcggagtttgtttcatggctaaattaaatggaaaatttattgaagtttaattatttaagctgaaaacattaaacaaacaacaattaatttaaataaaagaatcgcgagggtttgagttttaaacgaacgtgtcaaaaatcaataagcacaaaacacaagcactgtaagcacacatttaaatgcaaagcccaaattgaaaacgactcaaaaattgctatattttaaaatttggaccgtttaattttctaaaaatggacgcggtatgaaacagtgcatgcctttgtacctaccgatgtaggaatggacaaaggagcgaaactttgaggatggatgcctaactgacggaatgttgtccactgaaatgcaattagaaagcaggtcattgaacaaagaatttgggaaaggcttttaagagtgcactgacccacgcaaaatgctctgagtttgttgttgaccaaaacttattcccggtctctcacacatagtttttgtaattcttttccttaataaattcctctctcttaaaatttgaaatggcttaaagccttaaacccggggacacaacaaagagcatgggacggggctaagtttgatgaaagggaaatggcagttctttgtcagttggacgccaaactgtccgatttgttaaaaatcacagacttgtcgattgtgaaattcgccggaacacaatggttgagacaaaagtttggaaacgcaacgcatagaagcccgggtttgtaacggaaatactttcctaaaattttggaaagataatctctggatttataataatattaaaaaacaaaccccgtcgtgcagtacgctcttccatgtagtgcaatctttttaaaaagcccggtagctctgcagaat

SEQ ID NO: 13331 - DNA, 643 bp, Heterodera glycines
caaataatcgagatggattgaattcaactgattgagatcagtgagaattgttggcgaagcatgacgcagcaaattgtccaactgagcaccaccgggaaagcacaagcggcgaatgtttggcgcaaaaattggccaaatttcacggacgaaaacatcccaaattggctggtcatctgtgccgtatggggaaagccacagacgcaaatcggtgcctcttccgtcaaaaatttgctgattggaacggaggaatgtgatgacggaatgatcgatacacctgaaaagcaaatgctttacataaatatcagtgaaaatcctttgatttactcaattcgaagacgattaaattgataaagtttccaattcacttaaaataggtaggttaaatcagacgttttttagatataataaaataagaaattaaactaataacatttacaaaagtttcaatgtcttatttttgttgtttagttttgatcacatttgatcagcaataactctcttcgttccccactaatcttaacaattttgtgatcattcgaaaaatatcgaaaagaagaacctttttctaagccaagactgatcttttattaaaaaattggtaacttttagacgtttgcgtgtatttaaatcgatattgaaccaa

SEQ ID NO: 13332 - DNA, 3139 bp, Heterodera glycines
gggggggggggaaagcataggggaacaaggcgatgcgttaatgtgcctcttctatacaaatatcctgtcacatttgagtccaaatttgtcccctcgggggttctggattttgaactttaaaaatgctctttggtgctaagtttttgtcgtgattcgagaacaaggcttttaaaaagttgaaagagttctcgaatgatgaggagcaagcgtttgcctgatccgatttgttgaaaaaccatgaatactgtaaaaaaatcacttaaaacattgaatttttgaacccaaggtccaaactcgtcaaatttgaaactcaagaggtttcttgagctcttgagcattggtcatgggagacctgggataatattcaattgaaaaattcttttaagattcggcagttaatgggttagcacttaacaaaaaccaagccaagactaaaaaactgaatatttatttcctctgataactctgatcagacttctttagagcattctcagtctaagaaccaaaacttagtaagctcgaaaataaaataaatttttgtgccctgaattttgttaatactcaaaagggtataccttgagaatagggcaattaaaatccgagatttaggtgagattctcggagccaaaagccttccagtcatctcgagaaaaaataaatgtcgagaaaaaggatggcgggtgaacaaagttcaccacgtcaggcgaactttgatgagttaatcgtttgatgctgctttttgggtgtcaggtgaacatatggggggggggggagaagccggtggcaacaaacaaagcgctttatactctcggggccaaaataataattggcacataaagcacacccatatccgtgccaccggttgttcagcaaagctgttaagccgcccgcccctctccgcccggggcatatcatatagcacatgcgtagcactgataatgagcaaagatataatgggataaagggagaagaagctgctttgagccagctaatcatcaattcaagcggaacacaacacttcttccctccccaacaaaaaaaattgtcacacttactctgtggcgtggaagaaggtagagaaaaaagtcgagagagagattgggaaaagccaggagattgagtgagaaagcataaagactaggctaggcaaaagccctgagagagagaccgagagaggagaggggacagaacgccaaagaaaatcgcctggggcataatgccaatggcacaaaaaatgctttccccagcgcgcattcgcccccccccccgaaaccaaaaattaaaaaattttcagtaaatttttttgaaattttaagcaattttcttaacaaaattgcattaaatactcaaaaattttcccggcggcgcctatcggcaccgccggagccccattttaccatatttttgaaaaatggaggccaaaatggcaaaaaatattaattttggcgaaaaatggctaaaaattttgtaaaatacacccaccccataattcgggatttcaaaaaaccaaaaatacaccccctaaaaatcgacttaaaaaggaaaaatacacccctaaaaatcgactttttgacttcagcccccccccccaaagccaagggtctggctacgcccttgccctcgacctcccgacatacagtgtttaaattttgtctaaacaccaagccaaagaaatttttatgtcttatatgatcataaaatatggcctaaaaagtccgaaatatggattaaaaagttaaaatagccaaataaggatcaaaatattgactaaaaactgcaaaatataagttttaaaccccaaaaaattggtatatatacaatatttgcttaaataaacttaaaaaattcacgaaaaactaccataaaatggatttaattttttttaatatgaattactccagggaattccccgaaaatttttaatttgcttattttcaagattgtacttaaaatgagcattttaaaaaacagccacaaaaagtgcatatgcagcgaaatgaaaaaaatagtcagcgaaaaccaaaaaaatatgggggaaaaaatccatccgggtgaaaaatttaacacaccgagtcaaaaaacgagacatgtgtcaataaagagagagtgcagagaaactttttttctctaacttttctctccttttggcgtactatctaatattttcattaaatcgcctcgagactccaaaagtcattgacggcgcgggatgaggggaatgactcgactttactggggtgggaggtcagcatggcaattgtcggggtgtgccgtggggcctcgggaaactcagcttctcctcccaccatcggaccaaaaccgtttggatgaggtggagcccggaatggagcattgaacagccggtgaagaattcccaaaattctcggatgccaatcagaatgtccggcgctttttcgacgagcttgaggacggcattaggagggaggggtccatcggtggtgtcccattgaagggccttgattttggtcgtgatttcgtcgattacgttaagctcgagggtctcccagcctacgtccaggcgctgcagttgaatggcgaattttgctgatcggacggttttggggcgtgagtctccgaaagtgtgaatccgaaggaggtgctcagagaggcggggggggggccgtggcacgactgaagttgtgagacgcatttccattccgctcccgattctcttgtcgattgttggttcgccctggagggtcaattgacgggcagaggaggaaatgatggtctttagcctggcattttgagcatcggtctttcgcgagtaacatggtcttggcggaggcaacgcaggcagcgcccctgttcctcaagtcgtcgtcggcgctgagtgacggtggtgtatcgctggcaagcgctcggacggtgtccctcctgctcacaaagtgagcaactgatgccgttggcagagatgggttgggctagagcaggaaaggtccgagtgttctccaaataacgtcgctccggcgctgctggtggtggtggtgggcgagaagaacggcaaacaggacgagggagtgcgggggctctctcgggggacgttcgcggggttggatatccatgtcctgggaagtacgcacacacaaatccacctgctccttgtcggtgacgattg

SEQ ID NO: 13333 - DNA, 1073 bp, Heterodera glycines
cctaaaaatttatttttcaaatttcaggtattttttctcctttggaaattttttgaaatttaattgaaatttttcgacttccagtcccgcagcgggatccgcaaatttgaaatttccagtctctatttgcaacaatcctgctttaattaatttaaaaaataatttttatatggcgaaatgttctaaaataatcagagaaattaaaattgcaaaaaacatggaagaaaagatttcgagaaagcagacactctgataaaatgacgtcacagaattgcatttattaattttgttggctcccaaatttttcatttataaaaactatcaatgaaaataccatatttaaaaacaattaaattttctttttcatattttaattttttcagcaattttttttagatagccattttctattgttgtatttattaatttcacacacacatacacaacctcaaatcccttacattcgcatacacatatttattttatacatatcacaattgtattcattccgcttggtcaaaatggcaagcccgcgaactctaaaagtgcttaaggagctgagaccaattgacgaaaacaatgtgcgttttcaaaaaaaaaaaaattaaattttatttttggtatttttgcagtttagtgaaccctatgaaaaactaaacaaggggacagaaacccttaaaaattccaacttacatttcatgatttcttttaattttaagtcctgttttgagtgccaagcggccaacccgcagtgggccagcgtttcctacggcatttggatttgtttggactgttccggcaaacatcggggcctcggtgtgcacataaggtttacacaaccaggggctttttgaggatttttgagcaagagtttggtaaatccatcaaacactaaagcttagcatttttgatatcattcgacattccctaatttttctgctagccttaaaaaatttaaaaaaattttgatgttaaatatgcatgtcttatagtaataattgtatacctacctaattgtagattacaaggaaaccattcgaactgtaagattccggggtacttatttgttatct

SEQ ID NO: 13334 - DNA, 2428 bp, Heterodera glycines
cttcgtcaccgctcgaaactgactcattcaataattcctgctgatgctcaaagaacacagtgcttgaaatgtcttcgggattttctttctttccgcttgaatccgatgtttcagtcggcaattgtgaggtgggagttgacaagcgaggttcttgaatcttgagaaaaaagagacgtgattcaatttcagcaataggctgagaaaaagctctagtgcactttaggcgttcaatcaatgaccaccttcacccccccctggcctttagatcttctagagccgaaaagagctaggaatataaaatgttcgctataagtgcctttaactcatctaaaagtgatcaatttttggataaacttatttcataaaactacctcagattcgttagatgttacagacatacaacgaaaatcttcgtcaccactcgaaactgtctcattcaataattcctgctgatgctcaaagaacacagtgctcgaaatgccttcgggattttctttcttttcgttggattccgttgtttcagtcgacatttgtgagtttggatccaataaaatggaccgcaattcctgtataaattcatagaataagtgcgtatatatatatacttgacatttaaaaaaataatcgattaattaactctgcgcattagcattttctgcacatgatgctgggtaatagtggagaattggtgtcccggcgaaaaataaatttaaaaattttcttttctagttttctatgtaaaaaaataggctgattacggatctgagtccagaattcgaaaaatcattgaattagtgtatgatttttcatcaagtacttgatttttcttaataaatgttcatgtcagaaaaacatgcattctgggattttcggagtcgctgatcacgaatatgaccttagttttggccaattccgagtcccggacccgaacttggacccaaaggcgaaaattaaaacagatttttatgtgtgtgttttgaacttcgacttttgttcatgttcggtccgggattcaaaattggtcaaaattaatgttttatttgaaaacacctctaagaaatttagaaaagttaaaagatttgttttttgttgtttttctggaagtggggcggtaattatcagctccagggtctgaacagcaaagagaagcagttttcaaccagtttttcggtattttagaattaaaaaaaaagattttgcggaaaagcattatctttgcttcattgttgagctgaactgcgcatgagcgaaaccacacgtatggatggcccaatctgttgtggtgcaatttttgatttacagcgaaaatccgtcgtttgaacacaaaagggaacaccgtttggaatgcctgctggcgatactccgaactaaaataaattaaattattttttacacattttagtggaagactccaattttagtcatattcccgaaaaaattttcaaaattaagaatttctcaattttatttttattataaaaattttggcaatcccgaagaatcgggggttcctaatttaggtaactttttggtacttttcggttttgtgaccccccctgaaattttcaaataaaaagtcatttctagggtaatttgggccgctgatcacgaatatgacatttgtttttcaaaattccgaaccttaattcgaacaaaaatttgaaattcataaattacaatgaaaacatatttttgggggttttagaggtcgctgaaaacggttatgacatccatttgaccaaattcgaaacccggactctaacaaaaaaaaaaggaaattaattctcgacaaaataaaatatgcaaaaccgacgcatgttatgggtcctcaaaatcgttaaaactatttttaagccatagtcagaaattggtaaaagaacgtcaaatataaaagattgaatttgcttattgcgctaaaaaaccgccgcacactcgactacgcccactacttgctccgtcttcgcgtgctcccttttgcgaaattttgcttttaaattgttatttcccgtttattatttttcggtactgaaatgtccattttcactgggacttagttgtcccagtgctcagatggcgtcggttcgaatctataccttgttttttaataacttaggtcatcaagagctttcgaatgataccaaatttgtgtgattttgaccgttttataagcttaggtgcctcccttttcactcaaattttcaagttttaaaccggttaaaaaaccggtttaaacgcttttccgcgcagttttttgatggtttaggcgttttcagcacctaagaaaccctataaaagcatttatatgcaattttgagtctgggacctatgatggatatttaccttttaaattttttagtaaatttcggttttttgttcaagtcagggttcgagtttcgaatttggtcaaaatgcatgtcataatcgtttt

SEQ ID NO: 13335 - DNA, 2791 bp, Heterodera glycines
tctttattctctttgttgatttaatttttattgttcccccccttaacattttgttttcttattgcttttaccattttatgaaaatttttttgaaagaaattgcaattcattttttgattgaaccaatcggcagcttaagcgcttaatgggccgtaaaaaacaaataagcactaatttgtaagcgcatttcaaacgcaattaaattggcacattaaaaatcaaaaatttcgacatacaatcttctcggcatcttcgaaatttttccagaattggctcgattaaatgcattgaaaaaattggcaagcaaaaaattcacacaaatcaccaaaaaaattgaactaaaaacagtttttctttgttttgctttgattgataactcataattctgtcctctcccaattatcatctcttttggtgttctttcgccttttttccatttgcttcgttgtcctttttgttgttgttttcattgtctgcgccgtcctcaacgcctgcggggccatttttgcgcacacttttcacaattttgtgcatccgtttgaagaagccggtggaggaggcgggcggttggtgttggaacgcttgaatacctacaaaaattagaattattaattataataaaaaaaaattttctttgcgacgaataaaggtactgccgggtctttttttcatattttttggggggaatttaatcccaaaatggcaaaaatcaatgtcttttttttggcgaaaaacggctaaaattataaaattagtgtttttctcctcggcaacgacactttaaaaaataacacgagaaaaattttttgaccaaagagcaaaaaaaaaaaaacaaaaaatgaaggattgcccgctccgatattttttccgaccacgggactgttctgtagtccccgccaataaaaacaaaataagtttagaaaaatgattaattgcgtgaaattaaaaaaaattccaatttttttttatccatttatgacttaccaatggaccacttctccagcgctggcttctccaccgcgtagtcgggcttgtcagcgcaaacgttgtgactcatcggcaccggcgtgccaagttgcatctgacaaatgatgagtgattagcaaatttttttttttgtgggaattaggggtccagcgcagcgacggtccttatcagattcaggcaatttttttttgtgtttttaaggaatttttatttccatgaggtgggtaatcagagccccctgtgctcctggggtgcactacgtttccccccgtccgtatcatttccctaggaaaatttaaaaaaaaagtcttcaaacttatagaattttattcatcgtcttagaattttgaaaaatgaagaaaaagttttaaaatatttttgcttgaaattttccaacaaaattttttttaagtaaaaaaagttcgaagtgaaacggcagtgttccgggggtgccgccgggggaaaattggaatttaaaaccaaaattccgtctccccgctccactcgtcccctttttgaccaccttcagcaacatcgcagtggcctcctccttctcctgatgctcgttgctgttgttggctgtggtggtggttgatttggcatttgccgtcgtcgttgacgggccttggccatttgcggttgccgaagggcacggcggcggtggcacatcagccgctgcggtggtggaggacggcagcacaacgccagtgaccggcggtgctgttactgcttcatcctacaatgcatttgcgtttcccaaggaaatttgggcggctaaaccaccaaaatcattggtcaatcgtccaaaatcccggccaaacccgcgaaatctagccaaatacccaaaatcccgacagctgcccctaagtcctgccaatccctcaaaatctcggtcaaatcccggctaatccccctaaagtcacgattaattccccaaaatcccgtccaatccacaaaactcctggccaatctctcaaaaatccctgtcaaacgcccaaaatccagaccaattcaccaaaatcccggacaatcccccaaatctcggcttatcccactaaaatacgtgctgattttcccgcacttttttgcgcacctttcgcctctttttgcccaactttttcgtcgtccttttgccgatgcttctcttttccctccgtttcgtcactttgtcatcattttcggcgatgtctgtggcttttgttttgccgttgtttctgtcgctgtgcgtcctcaagtccatgtcctgggaaaatgtttggcgatacatggaaattgcttctttttttgtttatttccaaaaattttattggcaacaactttgaattttcggagtttgatgaaagcaaattttgttttttggatgcagcaattaaacgcatttgcccaccctccgatgactgatgccccccggtccatttgtgccccggataaccgtatttttttaaaggtgctatgtcattacttaaaaaccatcataatgggcgttacttaaaaaaccatcataatgaaaatttttgcttataactttgctctaaaaagaccaaatttttaatccttgctatcattcgatagatctaaatgttctttatgagcttgtaaaatttcaaaaaattttattaagcttaaaaaaagttatggccaaaaatgtacgaaaatcaaggttttttgagttcctcgagctataacttttttgaaacttaacgaaattttttgaaattttgcagactgatagagaacgcttatggctatcaaatgatatctagaattaaaaatttggaagatttcgactcagtgatacataatt

SEQ ID NO: 13336 - DNA, 1907 bp, Heterodera glycines
  misc_feature (69)..(69): n is a, c, g, or t
ccgccgctttcctccacgacgccgccggcgccacctccttaaattttttgcgccgcccctcctccgcgnccatttcgcccttcaaaatttggacggacgaactgtccgagcggtcctcgtccgaaccactgaaagaatggggggaaggggaatccttactcgactgccaaagcaaaacacgtaatattaaatcacgaatctttttttttgaattttccttttacgtttgccatccacgccaaatgtgagaaaaattagagcgcggaaaaaaatgcccgaaaacgaaaacccagaataagcggaacgagactctcgccgttttcccgtaaaatctcttgcaaaaaaagacgggattcccgggttttccggagggaatcccgaagcccatcaggctccagtgaccaaaaccgccaactccacaaccacctgatctcgtccttcagcaccaactcgtccgcttcgccatccaacccgtccgagccggttgtgttcattgtcatcgctgccaatttgggttctccaaaacaacaaatgctttttttgcaatcaaaaaaataaagaaatttaaatagaggaaatagcgctaaaaacggcgtcatttgtcgttaaattttgacaatggaaaaacaaaaaaagtgctcatttattcaattattaaaaatgcaaaatttatcagcagataacagaaggaaaaaatgaatggatatgaaaaatagcaaataatgatcacataattgataaatccaagaaaaagcaaccagaaagccattttcaataaatgtaaaaaattgtttcatatttcgtaaatttttgagattttaaaggaacaaatttagttaggaaacataaaaaattcaaattatttaaacgctgtctatgccattcaaaaacgatgaaacatttttgaattttaaaatgattttttacaaaaataaaatgggcaagtccccccaccccggtgccctcttcttttgcaatgttttatttattttggtgtgagcacgccacgttcgatcaggtcgggaatctcgacagccatccatgggccaaggccaagtgagtaccaatattctggtttttttaattgatggtgccacgaaaaaatggcaatttttactgtacttcgactccctagacctccatttttccgagcaatttttttaaactcgtataaagttgtaatttaaataaaatgccggaaccggattagaaaatgttgcttgacaaaacaagaaacagcagcgggaaaaaggaagtgtcgatacaacggaatttgaaaacctaggatttttgcgaaaattttcaagtttatttttataattttttgaaatttgaactgtcatgacaccaaaatgccgtctcccctcccccgcacctttcccgtcgtcggctgccgaaactgttccgattctgtgaaatacggcgcgcatcgcgcggctccggacacttggacagctcatggccaaccttgccgcaattgaaacaggtctaaagatgaacataaataatgatggtgaagaaaaaggtgtgtgccattcgatgtgtttcaaggaatttgagccaaaatttcctaattccaattcaaacccaatttcaatggtgtattggggcgcactccaaatccgtacaaaaatctctcagcaataggtagaattaacatacggaaataaaattttaatgccaaaaaaatgccgctcatggacatttaccacccgacatttgctttctatgtttaaaattggattcaaaatttgtttttttaaatctttaaaaaaggataaacaggcgcataggtagataaaaatttgttcccggatttgaaaagcggccctaaatttgacaccatttttgggcatagacacaaatgtttagtcaagggaaagagtgccaacggacaaacggacgaa

SEQ ID NO: 13337 - DNA, 3546 bp, Heterodera glycines
  misc_feature (109)..(109): n is a, c, g, or t
  misc_feature (119)..(119): n is a, c, g, or t
  misc_feature (178)..(178): n is a, c, g, or t
  misc_feature (1376)..(1376): n is a, c, g, or t
  misc_feature (1408)..(1409): n is a, c, g, or t
  misc_feature (1436)..(1436): n is a, c, g, or t
atcagcgcttacacaggcgctaagaaaaacatctcggtcttgaattttcacactggacttgtgctcgggtcgtcgacgggtacagacttgattcattcagagggtctcncaacgcttanactgttcctagagaaattgttattttcagacacaataaaatgattattattgcaaaatntaaggcgttttcttgaaaagataccttccgctttgagctgacattgtgctgaatcagtcctttattttgcagcatcgctgcatgctcttccatgctcatattaataaaatcgtcgtcaaggaccatatttacttttcctaaaaaacacaatattatggatgaaagaaaaatgtgcgaaaattaattataaaataatgctttaaatgaactgtctcggttaacacttaaggaatgagcatcggtggggtggatataaagatattcaattaaaattatctttgtaaataatatttttaataatttaatttttgaattatttttttttattatctttataattactttttgactttttatcttgtatttttaaaatactatcttttatagatctatcttctatatttatcctttttaatgacaaaacttcataacatattgtgaaagcctatttttcaattgatcagcatttcattttccattcccttttcattttaaattcctccattacgaataaaaaaaacacttttcgtttgggcttcaatctctgctggtgaaaataatgagatgcaattattcttttatttatgaaatttgtttttaataatttaatttaggattgctccccgacccctcgggggggggggcaaaatgtcgagggtcggggacctcggggggcgacatgtcgggggtcggggcggggaataggcccaaaaatgtcagggatcggcgtcaagaaccgggaacgcgggaacaccctaaatgaaaaatatttttgaaggggggggacaatgaacgaattaaggttttttaaacattaacaaaaattggtcaaaattttcctttttttgccggggataaaaaaattttaaatttttaatccaaatttttaggaaaaaaaaaacctttaaaaaagcgatttttttttttataaaatttttaaaaaaggttttggcccccgaaaaaaaaaattttttaaaaggaaaaaataaaaatccgttaaaaaaaagagaaagtcccaaaattttttttttaaccccccccaagaaaaaaaaaaatggggttaaaaggggggggtgcctctttggggggtttatttttttttttggggggggggggggggggcccccccccccccccccccccccccccccccccctcttttctgcttatcaattattttatgtctgcaaagacgttnaaattctatgtcactctttcgtcagtcacgcnntaatcaggcgagtctagcagtatctcncaatccttccgtcctcctccccactctacggccatctcctctcaaacctgaccaatttttaattgttaattaattaattagtgcagcacttgctcccttttcggtagggtacgttagggacccaaagaaaaattgtttttcggcatcgtttttcatttattttcctctttcgtcccttcttcggcgggcagcattaatccgcggaaagaatgcttcttcattgttgctgttgtgcttcttcttcaaacttccattggcactgcaaaagtcggaaatgttcccgcgtccgttgcgccaccgttagttcctccgcgctttggcctctgctcctctttaggaagtacaaatacgtgctcagtgagatgatggcatgcaccgacagaatctaaggaaatgcgacatttaaaccacaaattaaacgacaaattctccgatgcttaaaaatgtccactgatttcgcagcgctgccccatcctaattagcaattaattaaacattcttaatctttggattccataacaaacctaatcttaaggatttctaaaatccagcaggggtttcgaggcaagaagccctaaggccgtgtgccgaaaaggtggcactttccttggttggaagcagaaaagtccaataatgtcaaaattgccaattttgagatgacaaaaatatgtcagcagaaatcgacacgaaattaccaattgaatgccttcgtatgctctgttgtacacgagtaagcccatttcgtccttataaaagcgcacaaaaacggaggaaatgatgaaaatggtgaagaaaagggtgtaggagaagtcgagcggaaagagcagacgaattgtcacaatattctcattggcctgataacttcggctcagattgtacgccatcactttgttccttcggtttttaaagtttccaatttaataaattttaatagaattctaataatttactaattgaaattttaaatgaattttcactcactttgccctttgtatcaccaatttgttcagcttaatgagtaaataatcggccaacgcaacacaaatgaccagaaaaaggaagaaatagtgaatgttgatgaacacatgcgcattgaacgaagtggtcatactgtaataacagaaggggtgaatacggtaggggcaaatgggtaaagcacaaaaaacacctcaaatagaccaaaggttttgagaaggttacggtgtccgcaaatgctgtgatgacaatataagtggagaaaaggacagctaagagccactgaaaggggatggaaatcgaaaattatatttttaaatattttatttaattaatttcggctaatatatatttaaatttattcaaaatttcttttatttgtgctaaccataaaaatagtgatgccaattccgcattttaagccttccctttcatatttgcccacaaaaatcgtagctcgaacgcgttcaaccttaaaaaataggtaaacggaattaaaattacaattttgaatattattttagttaatatttatcattttgaatattaatttaccataattccaaaatggaaaagcggcgaagcgaccaaataaacgtaagcgggcatacgaagcaaaaaggcgagccaaattggggtcaaacattggcacgggtcggaaaaagtggcaaaaatcaactgaaaagagcaccgaaggaaatggcataagttaaaacaaaatattaccaaatagcgaaccgaagtgatcagatagaataaaccaaaaatagcatacagaaaaagcacatttagcaaaagtaactaaaaaaagtcaatcgaaaatttaggggaaattaattattattttttaatattatttcacttttaaatttccatgcaatggcaaatcaggtttcttggcaataaacactgaaatgttgagaagcaacagaaggatcaccgacccggtgatcagatgggcccagcggacgaaaaaatagccaaaatcggtcacgtaatctttggcattggcacaatcagccagattgggcgtggacacatttggggggatggaggacgaattaacgaacataattagggatattacgaaagataaagttattcgtctgcaattggcctaattcaagattttaat

SEQ ID NO: 13338 - DNA, 955 bp, Heterodera glycines
aaggagcagaggagggagaaaagagggacaaaatatacacactcatccaaaaaaagttggaggaagaaagcattgacgagggacgggaaggaagccatcaaatttggaaaagtatagaattgggtccgttaaaaaaaagcaaattgcatcattaaatgtgactaaaaggattttattaatgaggaaatctgtgggaacatttagggacatcgcgtgaagtgagaagttagtcaaagcaaaagcattgggaaggaatctttggtagagagagacacgaaaaaacgtcagagagagagaggagaaagaatgagtcatcccaagttaaattcatttaattatgctaagtaagttagcaacttctgctcaagtttctaaagtagtcgtccgaatttgaatcttaaagattcaaataatgaaagtcaaataaaagcatttattcgaagaggaggcaaaagcattcattctccatataaaataagctttgaggagagagtccaatggcgaatatttgcagtcaaacggattaaatgagcaggaaaacttttgatcggcttttggacgggtcggatttccaaaagatagatcaaaggagcacaagtgcacccatctgggcaataagtcaaaactgatctgatggaccacatctgcaccgatggaccaacaaattgagggcatatgtttaagggggggggatcagcagtgagcttttgggtatcccatgccgtcgggttgaatttggcaaaggattagttgccagaaaacgattcaaaacgggatttcatgatacagatggcaagcagtttgctgtttgagtttaaccgaattagaaattgtataaattggcggcgttaaaccaaaataacgctttataaaggaaagccaaaaaaacaaaacaaaacaaaaattcaaagccctaaaaatttaaattgccttccaaaatgtgataaggtgggaa

SEQ ID NO: 13339 - DNA, 2083 bp, Heterodera glycines
aatggcgtacactgcaaacgtcaacactgctaatttccatggcacacttccgaagaacaacacgcaccattcattggccacaaaattggtgaaaaaacatttttatttaaatctaatttattcatatacttttaattcattattttgaaattaaataattaaaaatcaattttgacttctacttttactcttctttcaaatttcagaacatttctcattttttgactgatcatttaccccactaaaatctgataagcatgcctttcaaaatgattttctattaacttttctattaaacataaagtttaattaattaattgttaataagttttcactatcaataattggattaacttatatttcatacagaaatataaaaattttttaaactcaaattattcaaaaaattttgctttggacagccaacaattcgctcttcccaaccatttgaaaaaatttcaaaaaaaaaacacagaattttaagatgttttgctgcaaaaatgcactttaaaaaattttaaattttaaaattattttccattcggggaaaggaaacaatttcgtaaaagacaatatttgggaaaaataaaaaatgaattttttgtgccaattaaataaatataaaaaatatatatataataattcctttccacttgccatttcagctcaattgccttccatcggtcgctattcctttgccatcaccggatacgacctcaaccaaccaacgaaaacaacaaaagcaacaacaaccggggttagtttctcacaaaatttgttcccttgagctaaattaattgcaatttttcaatttcctcagcctcaatggcctgctgcgcactgcacaagttggacgcggcacaccagtgtctgagcatgatcaactacgttgttcgatggcactgaacgacggcacagaaaacgaaattggttggcaaaaaagcacttacacacaaacaaacacattgttaccctttttccatgctcataattaaacaaacatgcttttacataaattgctgcacccaaatcaacggcttttgataaattacattactgcaccaaatatacacttacacatttttaaattatgctgatttttaatttactctaaacaatgaaacatttctaaaatatggcattttcagacggttaaaaaagttataaataaaacaaatatacagtttagtccaccaactcttaaagcaacaaacaaatgcgaatttaaaagcaaaaaatactgttttttttctgacaaatactatatcataaacgcatttctattatttcaaaaaaaaatttatacattcacattgttttttgaactatgagcgaattttgatattaaaattttgaaaaaaataagaaaatgccatatacgaatactttttgggcaatactatagatggtggatggacaaccttttgaaaaaattgttttgttttagaaagtcaagaaaaaattgttatggagtttttttggcaaaggaacataaatcaaatattcattttgcacaatttcgaatgtcggacccgaattttgaaaaaaattcaaaaacgaaacttttaaatttattatttttgttagcaaaattgatcaaaatttgtgttcactgacccagaaaactcccaataacatattttcacgaacttttgagaacaaaaaaaagtttttaaaaaaaagattgcccatccaccatcaatagtattactcttttttgtttattaaggcacgtgttaagggcaacaaaaaggcattcgacttaaattcacagccctactacaaatataaaaaatattttttttttacaaataaatttagaaataaaaaataatatttaaaatgagttaattttaaattttagaaaatatttattaaaaaacacgagccttaaaaaataattccatatactcagttttgcttcttttttgttgcacaacacttttcacacaaaaaaaattttttatgcaaaataaaatttattttaaaattcccattgatttaagacaatcgaaaaacgcaatacttaagcaatatccattgacaaccaacttttgtaatagtacggatggtaccccccccc

SEQ ID NO: 13340 - DNA, 1903 bp, Heterodera glycines
ccccccccccttttagagaaacaaaattttttaaactttttatagaaatgtcatattaggggttttaagggttggagaatctgaatctgacagtaatttcgacctatgtcaaatcccgaacccgaattcgagcaaaaagtcgaaaattcaatttttttaattttttattttcggtataaaaatggttgaaatgaagtttttattagcgaattgtccaaattagtttgtttctcgatatgtaagcctttttaaactaaaaataaaaaattcataaatttgaattatcggcttattgttcaacttcgggttcagggtacgccatagatcaaaaaaaatgccagattcgaattctccgactcattaaaaacactaaattattttttttaaaaatttttacatttatccagaaaatgatagtgattccgaaacaacttttaaaaattcttattttagaaattaataaatgtttccgttcatttgcacttatgtacacttattaaaataaaaacagcttgcttttattccctttcctttgttttttattgcgcgcgcgaatttgtatttgtagtactttcacttttttttgtccacgtcaaaatcacacagattttgtcttaatgtctttttcgtttgtattgtccattggccccgcgacatgtgggtgctcgggcaccactggattacctaccaagctggggccgcgggtcaccaattggcttccgagctggttgaactcagctggacaacacttcccacgtccagcgctttgtggaacagcctggtagggatgtgccagtgtagcttgggcaaccacgggcccggtgtcccgttctgctacggtggtgccccccaccgtggaacaaccgtattgcacctgtggtttagtttctgccactacgcggcttacggtttcccaggccccaagcgctcgggtctggatttaccaggccccttgcgctcccgggtctgaacaattcacttaaaaagagacatgttgaattaatagaaaaaatagaaattttatggcaaaaagcgcatgcaagaaaaaaaattttagtttaacaaaagcaaacaaaaaagtgcagttttaaaaaaaacaattgcaaaaattagtaattagataatatgaattgttcagcgcccgggtttcctggcccgtgttccgactttcaattgagccgaaagtcggacatccaaacccttccccccttccccttctgtagagcaaatatttctttttcttcatttctcttccatatttcttttaaaaaaattctgttcccattcccttttcttcccctctccctctccctttccctttctctttcccttttccttttcctttcaatttcaatttcattttcattttccttttccttttccagtccattttcacttttcctttttctctaatccttttcaatttcattttcattttcagttttattttccttttcctctcattttcaattaccttttccttttccatttcattttctctttttctttttcttttcaaattcattttccttttcctttacaatatcaatttcaatttcattttccttttcctattcattttctttttccttttcctttcaatttcattttcaatttccttttccttttccttttcaatttcattttctctttttctttttcttttcaaattcattttccttttcctttacaatatcaatttcaattccattttccttttcctattcattttctttttccttttcctttcaatttcattttcaatttccttttccttttccttttcaatttcattttctctttttctttttcttttcaaattcattttccttttcctttacaatatcaatttcaatttcaaatcgttttcctattcattttctttttccttttcctttcaatt

SEQ ID NO: 13341 - DNA, 1177 bp, Heterodera glycines
ttccttttcttttcaatttcattttcaatttcctttccttttctttttcaatttcattttctctttccttttcttttcaattcattttcattttcatttcattttcatttgccttttcgtattcattttcttttttcatttccttttcaatttcattttcattttcattgtaaatttcattttccttttcctattcattttcttttttacatttcaatttcattttcattttcattttaaatttaatttcccttttcctttacaatatcaatttcaatttcattttccttttcctattcattttctttttccttttcctttcaatttcattttctcttttcctttttcttttcaatttcattttcattttcaatttcattttcattttccttttcctattcattttctttttcatttccttttcaatttcattttcattttcattttaaattacattttccttttcctttcaattccattttcattttccttttccttttccatttcattttctcttttccttttcctttcaatttcattttcattttccttttccttttccttttccatttcattttctcttttccttttccttttcaatttcattttcattttcattttccttttcctattcattttctttttacttttccttttcctttcaatttcatttcccttttccatttcattttctcttttcctttttcttttaaatttcatttacattttccttttccttttcctttcaatttcaatttcattttcattttccttttctttttccagttcattttcacttttcctttttctctaatccttttcaatttcattttcattttcagttttattttccttttcctctcattttcaattaccttttccttttccatttcattttctctttttctttttcttttcaaattcattttccttttcctttacaatatcaatttcaatttcattttccttttcctattcattttctttttccttttcctttcaatttcattttcaatttccttttccttttccttttcaatttcattttctcttttccttttcctttcaatttcattttcaatttccttttccttttcaatttcattttctcttttcctattcattttctttttccttttcctttcaatttcaatttcatttcccttttccttttcct

SEQ ID NO: 13342 - DNA, 2566 bp, Heterodera glycines
  misc_feature (1288)..(1288): n is a, c, g, or t
ttgattttttctttacgttcttttatttttgacttgaatctttccatttcttatagcaattcagggagtatggcatttgacctctaaaaaagtaaaaaaaactattttcttcaatatttcaattaacctgtaaagcatcgattgttgaattaaaaattggcaaaatatggctcaaaaaatgaagaactacttttgcaatttttgcgttgaaaaaatttcgcagaaccaatgggccatctccgctgaaaaaattctccaaaatttcccagaaatggacaattttgtcgacaattttagaaagagttgtccatcgagtcggaccatgcgcagtaagtgtgagataattagcctaaaacaaaaaaaagtaatgtcacaggcagataactttctaattattggttatgtacctcaaaatcatcgcaaatgtgctgcagttgttcaactctcttgttgaattcttgaaatgactcgtcagtttgaagacaatggactcaatgtcgatcggcaaattgtcggctcctcgcttctctgcgttatgtagcaaatgagccggacacccaacgggtatcagattatttttgtgtgtcttcaatttgtaaaaaacattgttttctccgcgatgctcagcagagccaaaatttgcagctgtattgtcggcacaaaaagcaacaattcgttcgaatttcaggccatgtttttgcagcatttttatgatccattggtaaaccttaaattggaaaacaagtcaaaaaatgatacaatcgctattcacctcttcagacgtttctcctgggagtgcttgcaggtcaagcaaacgaacttgtattccttttttggcacaaaaatagcgaatgacaataggaaaaagctttgttgttttgtgattggaactgtccagcgcaatgaaaaagaattgatcaccgagttcatttagcatattttggacagaataaggtgcgagaacgcctttaaaaagggatacaaaaaccacattgaatttactaaagttaccagttattattttcgatgcctttttttgtgcgcatccgaacttttttgcaactgctgaatctgaaaacatagtcctgaacaatccgtcagaggatacacaatccgatgacttgaatgattgtgcgtgcctacagagatgatacgccatacacctcaaacaattattccattacacacaatttttggaatcaataaaaccctcagccgcagcattatgtcggtcttcttcagatgctgtggacgcactcggcatgaaagattggattgcttggctggnttacatagctcgcaaattctgtttgtgtttttccgatctttggtgtaccggaattgctgcctttcccatcgattccaaattaatatcaaaactgcacggcacacaatacgcatattcatcgccctttttgctcctttttatggcctgaaattcgcgctcataatcagcgtgaaatttctgtttgcgctttggtggagccattaataataataatctaagctaaaaagttatatagtacataggtcttcggatgaaaattttcaataaattaaaataaaaacgcttcataaaattattttatttcaaaatagacattcaaaattgaattttctcttaaatctcaaaaataagacaaaaataagtacattgagctcaaatcagtacatttattaaaaataagtacattttatattcttaagattcgatccctccaaatcagtacatttcttaaaaataagtacaaatgcgacctctgctctaactttattgcatattattaggttgataaatctactgctattggaatatgtatattttcgaaattattatactctagcctcaatcagtattaggattaataaagtatatttttttttggttgaaatttttatattgatcattgtctgtaaataaaagccaatttggcttataagttacaaattttgtcagtttcttttaaattaatgatacatattccgtggaacaaatgactttaaaccacatttgaatttgctttgtcattataaacgtttttatttatttgcttttaatacatttacacatttctatgctttaacatctatttagaattttcacatgagactccatccattacaaggattacatcattattgaattggcaaaataatattattctttgtcgtttttctttaattataacttttttacttcttaaaaatgatgaatattggagtcaataataactcttgaccatcaatgtctcttttaatttagatgttaaataaaagagaattattgtttctaatttaaaagataaacccgataaaaacactgtggctaaaatttattttagaatttttgataaaattattagttagttatttttcaaataataatattttaaatcattaatgcaaatcaaattatgaatgttttcgtaatagtttaatttatttatgtatatttgccaaaaatttggattaccttacaaagtttattttatatttctattatattaaaatttaaaagttaacaaaaaaatactcattaaatgacaaattctaaaaattattttaa

SEQ ID NO: 13343 - DNA, 1208 bp, Heterodera glycines
  misc_feature (62)..(62): n is a, c, g, or t
gtcataatcattaattttatttctaataaatgtaatttttgatttatttaacacttaataanataggtatttataagttattcacgagtttcacctcatcttaacttgcttttaagtattcagaaattattagcatttgtaattgttttttagtaaaatatttattcgaaaatatgattggttataaatttaaatttattataacttttaattgaaaaaattaattttatttgtgacattttcatttttcctttgaattaataatttttgtctcttttattgagccaatttcaggatatttattgctcttaaataatatttgtgtaaaattagtttcatattcagttatatttttattacaattacaaataatattatgatctttcatttactttaattatcaattattatcgaacaaaaatttcttttaacggacatattatataaattgtttcaattaattcctgttgcctaattactgcgagataaagcatttttatttcttcacgctaatttgttgaattaattaattttataaatataattttgttgaaattagttaatgaatttcatcaacttttgctttcttagatatatttattgttatttaattgggttttatatggttcgagtattcattattttgtatatgttactttaataacggtaataatttgtaaaattgattattaataaaatatttattttaaaccagaaaaatattttttgaattgcacagtgatttaatatatattaattattaagaataagcattcaatttcttgtataggttaaagtttttcgttcctaaacaattagtttttttaatttattatttaatttatatttttctttgacttgtaattagaaacaaaatacattttttcctaatgttaaatctccatcccccctgctcagcagaactgctgattttaaaaatatttacaataaaagtaagctttcaaatttatagatcgttttaaatataagaaattttgttattttcaatatatttttgtttcattatattcgttagaatttacttaatacttttatttatatcattacttaaagctattaattagttttattttaattttttgattataacttacaattttatctgtatctctttatttttggcaaaattttttcattgttataaaatggaaattatttaatatcttaataaaaaataatttatacgt

SEQ ID NO: 13344 - DNA, 778 bp, Heterodera glycines
  misc_feature (686)..(686): n is a, c, g, or t
  misc_feature (734)..(734): n is a, c, g, or t
acaaaacttttcattagcaacaaaatttgcttaaggtgcgcatgtgggacggaacaatcattcggtcggtaattagtcggcattttgaatgttcgactgattatgtgcaattcgccgcattttttagggactgcgatccgttggcgttttgtccgcccgacggaagcaaagtgttcaaaaacgcggattatttttgctgtgcggggaatgtgtgcaacggaaagcggcgacacattcatcaaatgataattttacttatcttttccatcggacaaattatattctttttatttttatgatgaaaagggaaaataaaatggaaaagaaaggtaattagcacaaaatgagtcaaaacacaacaaaaattaattggtttaattagggaaaattgcaattaatacaaaaaagaggcaaattaataataaccttgtttatatatatttttttggaaatccacagaagaatgaatgaatgcataatgaatagggatgatgcaatttttaggtttttatcttttttctgagctaccagaaaaggacaaaaacaagttgtttttttggtggttgataagctccttttcgagttattggtgcctattttctgttttatttttagagcctaaacctaaaaaattgaaaaaacttattttaactttttgaagaaagttttcgattttacatccctanattagaaagtttttcaactattttcccatttttagcacttatttttgnggtttttagagtctaaaaactaactattttggcagtttttagca

SEQ ID NO: 13345 - DNA, 4037 bp, Heterodera glycines
agtgtcggcacttcggcggcgcacgccgcgcaattgcctgaccttttgttggatgccgacatcgtcggccattacaggtgaaagggagcgattagccgagcatctgctgatcaatgatcaaaacacttcgtcaattatactaaagatggcacttcccatttacagtcatggccttaaccgcctttgcatttacattgaggacgtcgcctcgggcgtaaaaggcgacggtcagagaataaaaagggaaaagccaaaaaagaaaaaagaaaagagttttcaggtgaaccgaaggtgctcaagcaggtccatttgaaacagaattgaaatgccaaaacaaaaagcaattacgctgaatttacagaagggtgccaccgcttgggtggacgggtgcgatttgcttggcgccgtcgtcggtaatttctgcacagaattggccataaagttggccaaagagcacggcatcggctgggtggtgtgcaagcggtcgaatcattacggcatttgccaacattatgccaaaaagatagcaaatgccggcttgttggtgagccttgccaattgaatggctgaatgacattgttttgctcttttctaacccttcccatggccacccttcctcccccagggactgtcgttcaccaacacttcgcccatcattttccccactcgctcttcccaaattggccttggcaccaacccaatcagttgttgtgccaattcacgcgaaaaaggcgacggattcattttggacatggcggcgtcgacagttgcgcttgggaaggtaagaatggtcaatcatcgctggggacggaagttgaacagctttttggcaggtcgaaatcgcaaaagtgaacggcaatcggccattccgtccgcttggggcgcagactccgcggggcgtccgtcgactgatccgctggcggtgctcgacggtggcggactgttgccattgggcggagtgtcggaggaggacggctcacacaaaggcaccggaattggtcggtggagattagcatcattgtgccaatcagcagaataaagggcattccaaatttagcgatgatgggcgaacttttttgcggtcttttgggaggcgcaagttttggcaaaaacgtgcgatcgtggcgagaagtgcaaaaggcagccaacctggtaaatgccgactttgcttgaacagtcgcttgtcggacaaattgccaaatccaatggcattattgtcaatattttgtcccccagggccaatgcttcgtggccattgaccccgaatgctttgctccaacatttgtggacaatttgcagttgttcctggaccaaacgcgtgggcttaagccggtgatcactgctcttcctccatggcattcgatcgcctcccttccctccttttagcgcgacccctccaaatcggtgttagtgcccggtgaccccgaaagaatgaacagcgaacggagcgcaaaggctggcggagttatttactcagaaggacaaattcgggatttggtcagtcggaggagcacttaacggcaaattatcacttttcaaattaaggagaaattggcaaaaaagcaaaacgttggcatgttcccttacaaggcaaatttgtagcagaacaaaaaaactgttttctttttgttccaaagcgatgactttcaattgaattggcattcatttccattattgaacaattaattcgttcccatttgctgctgctgataaagaaaaaagaatgacaaatatttgcattaaatgcagcaaaagtaacggagagaagagatgagaagactaatgggtgaacagaaaagggaaaatgggaaaaaagggaacggaccaccggcggcacttttaaacgcattcacaattaatttatgaaccgcggcaagggatcggcctattttttttgtttacagttttaacatttattaataatcattgaacagtcagtgtttaccaatcacagtcaatcattcctttcccctctctccgtccttttgccgatgagtgattgcccctctgctgtccctccccccgtctcttctctctgtcccccttttcctccgtctcttcccctcgtcctcgtcacagaaccgacctttgaagtgagcagaattgaacaacagtgagtcattctgctggagttcttttaaatttccattgtaaataaaaaaaataaaagtgcgcgtgtcctccaattccgtcccaaaaacgatgggtttttctcggaagatgaacagcaaaaatgggtcaaagaacatattggagaggctgaggtgagaaaaaaaagattttcgaaaaaggtttgtgaaaattaatttcggttgagataatttacacgatgggaccaataaaagtggacgcatcgcttttggtagttgccaaagcgttaaaagcagtggtgggcatttttggccactatttgttggcccttaattaagacaattagtcaaattttccgaaggtgaccatttctgcgggccatgaaaacatcgacaccgtggaatgtgccagaaggtggtcataatcacttacgctcaactccccacctctttacaaattaggggcatccgaatgggctttggcggtgccattctcactgaagcaactgccgaaacggcgatggcacttttacttacggtttcacgccgccttgtcgaagcagtacaaatagccaaagagttgggggagcggagttaaagtgcgggaaaccaccaaatgttaagaggaaaatggccgaacaattggtcaccaaagttttgtgttgggaaagcattggaagggtcgacggttggtatttttggaatggggcgcattggacgaagcattgccgataaactaagcgcatttcgcccgtttgaaatcatttatcacaaccgtaaagccaattctgaatatggtcggattgatggaagattaaacgattttgctaattaaatgaattatgttaattaatcagagggtcgcttccgttatgtgccatttgaagaactcatcgaaagaagcgactttttgattctgtcggcgagtgtcaatgatcagacgaagggactgttcgacaaagaaaagttcgaacgaatgaaatcggacgcaattttggtgaatattggcaggtggggaaagaaaaaggcggccaaaattggacggggaattcgactcgcccatttaagggggtgtttggtccgaacagacgacctttacgaggcactgaacgaccgcaagttgggcggcgccgcgttggacgtcactgagccggagccattgccagcggaacatccgctcttctcactgcccaactgcggtgccaagaatgaattagaaacgatgaattgcctgtctttcttcagtaataacccctcacattggttccgccaacggcgtggcccgaaaacggatgatggaaatgggacaggcgaatgtaatcgccgcgctgaagggcgaagaaatgccatcgccaattcgaattgaaaatgcataaaacgggaaggagtgaagacaattcttaaactcaatgatggacgaacacttttacattttcaatggcaattgttaaagttgtgcaaataaatgagcagttttgtaatgtcctatttttggcattcgtttggcgttttgctgtgcgtcattttcaattttttgctaatcctccaatcatttaaattgttttttttctttcgagattaactaaattcaatatcaatttgtataactcacttcaacagaacaaaaatgggaaaagttagcaaaacaaaatccgcaaagaaatccgccggaggcagcggaaataaaacggtgatttgggcggtggaagacattgtggacggaccgaaatacgaaacaattgggacgaagagacagaaactctacaaagtgcgatgggggtcagaagagcacaaattgtgtgaggaaatgcgaacactttgttaagagagacgtacgaattggccagcaacattcccccgggactcatcgatttgtacgaaaagcgggaaaaggtcattaccaacccataggcgctaattgccgtcccatgtcagaagcaaatcaaa

SEQ ID NO: 13346 - DNA, 895 bp, Heterodera glycines
aaaaaattcgttttgcaaaaaatattttgttttttttaaatttccaattactttaaaaagagcaaaatgtgttaaattttgggttggaattatttattggttacattggaaacaaaatttgtcttcaatttatgccaataaaacaggcgttttcagagtgcggcaattccgactttctgctcgacttggaaaataacaaaaattcatactttaccattaaaaattgctatttaaaaaaaatttatgcggtgtaaattttgaaaaataaaaaaaacataatttcgtgacacaataaacggaaattaaaaagagtgaagaaagaaaaattatgattatccaatgaatatttacgattttttatgttttttcaacatttttagggtggcagttccaattttcaaaatgccagcaatttctttgtcagttaaagtcggatttctttttttctatttataataatcatttaatttgctcattttttcttctttgggaatatcgatttccacctgtaaaataataaatttaatatttttgagaattttttaaggaaattttaattaaatggccccaaaaaatccaaaatttctcaatatttcatatatattatcatttttaaaaatattttaatgcattttttatacatattttatttacatatttcgggatttttcttacgtaaaaaaggaagtcttaataataaataaaaatttaaaatataaatttatttaaatacaaattttataaattttccattttgaaattcccaatttttctgcaatttttaattcaattttattccgaactttttccgaatatttccctcttttcttaattccttcttttattgcgtggaatttgtgaacaatttcgcgtctttgctgatcagttaattgct

SEQ ID NO: 13347 - DNA, 1828 bp, Heterodera glycines
aataatttattgtcggtttttttttttatagaatttgctcttcactcaaacatttgcagattttgattaaattgtcttgcgtatattcatgtattccagaacatttggcacatttctagttctgttttaaacttagatgattaacatcgtataataacatattatttgagtttttatagtctcgtaaattcaatatttataagcattcagttgtcctttgtaggcggagatatatttgtttcgcggtcatcatcatcttgttcgtcagtttcttcattcatctacgtgtatttttgttcatccatcgaggctcacggaatcaggagatccttccgagttatgatattccttggatagatcgttcataaaatatttagtatatataacaactaaaatatcgtaataataaatatttttgttatcatttgtccgaaatcgagtttagatttcataattctccagtcgtcctatagcacccccttcctacatcatttctgctctgtcgtgaagtgctacacttaatgcatttttcgcgaagtgcccaattagtgcactgtcgcgtagtgccctttttgcacttgtcgcgaaatgacgtagcaccattgctcattgttctgatcattgccaattgaatcagaccaaataaatcatttcgatcactttgaggaaaatttaaaattttgatcattttcatttttcattttcccattctttgccaaataattcttcaaaagttggtcaaagtttcccattcttttcaattgaattatttatgaataataatataaaaattataacataaaattccattctcttaaaaatatttggagtaatattttatgaaattttattaaaattttggttatttaaatttctggattaattttacaaattattataattgattttgttaagaaggtggaagaaaggcaaaatgttttacaatttttgtttgctattagaaaattataccgataaaaaaaatattttataattattaaagtatatatgaataaaattttaataaaaaaaattttaaaatataaatcttttgtcaaaataggaatttttgtttttagtaaattagtaaaaatttttttgaataattttgatcaatttcgattcaatttgttcatagaaaattagatggactttgcagcgtaattaggaaaagcgctaaaattcaaattaattttgtggcaaaaacggcacaattaattacttttgcttttgctgagaattaatcgagcactttcttcaattataatattgatggcatacaaaacaattttctggctgaactaagagaaacctgtgaatttttttttgatcaaaaatgaatttttagttgaaataataaatgatccaaactgtcaattgcgaccgatcagcggtcaattaaaaaattttttttcctttttttttgttttcatttttggcttttttcaacataaaacattaaatagacagcatcaaataatctatctataagttataaaaatttattattcattaaagcaaaaattatatgaaattttcaaatagaatagttatgtaaaaatttctatttgaacaaatgaataaaaaataaatgattgaatatgcaataatagtgtttaaatagttaataaattttaaaattgactaaacaaataaataattataataaaattggatataaaatgaataaacagataattgggatgtgttaattttgtaaaatgcataataaataaaattggataaaatgaataaaaattggtcattggggttagttttatttttgaatttttttttttgataattttttttttgtttgggtttttaa

SEQ ID NO: 13348 - DNA, 2351 bp, Heterodera glycines
  misc_feature (2318)..(2319): n is a, c, g, or t
  misc_feature (2335)..(2336): n is a, c, g, or t
aattgaaagggaaaagcaaaagccaaattagccttaggggttatagttctaattggattaatatgctgcgcatcaaaggacggataagcttaaaacaaagcacccaatttctgatcagtcggttgatcaaatcgatgcgaatgcattcgccgcggagattttgggggtggcgacgaaggaataatgaatgaatgaccccatcgcatccatcgaaggcagaagcaaatttagatttgtgctcggatagggcgagcattcgacggggagtgaatgaaatggaggaaaagtgggcactcatcgcccgaaggaaatcgccaaaataaatgcatttattacaacaacaaatattcacaaatagttccaggaatacatcagcaatgaaagttttcttcaggagggtcgtcggtgtttctgaaacgtttcggtgcgcatctccgccatccgcgacaccgtccgcgcgaaagcgaacatttcttcggaaccactgaacacattggcagtcgcggattccttaagaccgaatgcaatacggcagcattaaaatgtcattttgagaaatgttaagcgatggccaacagaaagtgccacctctccgtcgcacatgctcaagtcgtccattagcattcgctgcgtgtcgctcaattcggcctcttcctcaaattggaagagtttgtccggttcggcgtcggccgagcaaatcacacggaccttcgaacgacagaaattaaaacttttgtttcttctttcaccttttggtcgtaaaaagtgtcgattagagtgatgaaacgacgcgcttctgataattttgcacgggtgaaaaagggaattcgacggatgagaaccgtgtggaaaacgctcgaaatggccaagtaatcgttggcactcaatggctttttgcaaagctaaaaacattggcacttacaattagccgtacaattgctatagtaattgattaatcgttttgatggtacgtcgtcaaagtgaacatccgcgactcttccgcaacatcgctcaattttgagggtccgtcccaaaatgttgagcgtttttggaccgacaactgaacatttgttcaacaatccaatattattgttattatttgctctatttgttggcacattaattccccggcactcaccgtcgttctcatgcaaaatcaaaagtttaaaggaattgtccattttggcatcaatttcaggcccactgccaacaaaaaaagagtcttctgccattttgtcagaaatttgcttaaaaggcacttttattggcaaaatgctttcaacacgttcacttttctgtagtcaatgcccgaatcgaggcaaatcacacggcacttttgttccagcaaacgaatgaatggcacaaattgatgcctttggagcccatttttgtacagatcgacgggcggtcgattcgaagtccttcaaatattttgaattgtttttgagtgaaaaagggcattcgtacgccaccaaaaccaatcctcgggagaaaagttcggtgaacaatcgttttagaatcattgctgaaaaaagggaaaaatgttgaaattggacacaaaaaaaagataggaaaagtgtgaaagaacggacagacaaaagggcttattgttaaaatggaaaaggtggtcagtccaaccaattcatttttggctaccatcggcgatgtccaccacttggaactcgtcgaaacagaaaagcaccgcccgaccgattatcgcctcggcaatttttgggaccaaatcagccgaagggacagccgaagagattttcagacgatgcaaatctgaaaaagagagaaatattcgacggatttggccattaggaagaacggacctttgtgaaattgctgcataaactcgtgaaaatggattctctcccgcctttgtatttgaaccgactcaaagaacaaatccattagcattgttttaccgccaccggaaaaaacgaaaaattaaaaaacataaaatgaacaattaattataaatcagttcacttacccacggccccatgtaaataaatgcccatcggtgcgtccatttgctgttgccttttcaaatttttatccgcgaaaagtcgcgaaaaaaatccgccgatggttttcactgaaggaaaaactgtccctttttcactgtgagcaacaatttcaagaagtaatcggtcgaaatgttcgatcacttttagctaaaaaatgtactgaactgccaaaaaaaaattattgtattttattttacaataattgactcaaaaacacgaggcttaatatttgctctttctgatattcaaaatttgtgttgtttttttttgttcaagtaaaanntggacaaatgcgaccnntgcaggcccatgcaa

SEQ ID NO: 13349 - DNA, 1086 bp, Heterodera glycines
agccgaaaaatgggagaacgcaaagcaaatgctgacaatgagaaaaaagaatcaaaattcaatgaattaaaccttaaacgaacgaatgaacaaaacaacaaagtgacttagtcacctgccgctagtcgaagattcgaattttttatgtgcgaaaacagcggacgaaaaagacagaagcggaagttcggggagtttgccatcatagccaatggtgtgaaatgctgaaaatcgcttcctttatcgtaagaaacccatagattaaaattgagagaatggtctgtttgcatatttaaatttatacatttttacgaatggcaaaattagcaattaaaaactttattaagaaaattaaaaacaaaatcgataaaataataaacaaaaagataggatgatataaataatgcagaatgtctgcaagtcaattaggtatttgacccattggaggagcagcaaataatctcaacgacgggggaactaaaaggtgacggattgcgttttgttcgacctttaaggggggttcgtccggtcggacctgtccaattggagtccgttgaccatcgtcgccgaattcgccgtccgtcctctgttttggctgattatttcgctgactttcctcgcgaaacaattgtcttttaatacaatggcaagaatgtgctcacagagatgaaagccttgatctgtaaaaagtttattttaaacggacacattaacaaatgccaccgtttgaatggcattggcattggactgattttgattcattgcacacataaaaggcgcattgaccggcactgtcctcaacgacaaaccgctttttctgcacattgtcagtaagattcagaacgtcgagggcatttgcacgggacagcaaatccatcttttgtgatcgactcaaacctaaaatttaaaggaaattaatggacgaagaatttgaaaaagcaaacaattaattgcctgaaaatatcaatgggtcaaacgaattcgccgaaagagtgccggcagcactcagtgcagaaagacccaaattggacaaacattcgcgacgttctaaaaaagacaatgttctatacaacattatatgaaaatttt

SEQ ID NO: 13350 - DNA, 1551 bp, Heterodera glycines
tttctgcttggttaggggtgtctacgttgacttttataatgcctaattttgcctatttcgggtttttgtgcctaatgtgcctattttaggattttcgaaaatatccttaataaaaatgcaataaaaacgaaaaacacacccctaagaaatgcccgaaataatttctgaaaatattccccacgaatttgaaaaattttcccaaaaatggatccctaaatttaatatttttttcatcataaaaatttttgacgaaaatttttcattattcgaaaaactttttaaacaattgaaatgaaagcaaaatcccatccctactaatcacaataattttgcaaaaaaaatcattaaattaatttaatgccgattcagccaacctcattaagactgaaattataattacattccgttgccttggcattgaacgcacatttcattaattctctctcacgctctgcagacggaaacgaataaatttttcgaattcctgttgaacaagtgaaacgccattttgggtcttaacaaatgatggtatttttcaattagcattcaaaatgatcaatttatttcatgggtgctataacgttaatcaaaaaccatcaaaatgggcgctagctcaaaacaacattaaatgaaatttttttttagtaaaacttcgccaaaaataaaccaaattttaaaatcttgcagaatgatgtcaaggttttaaaatttgattcattttgggtgaagttatgaagattttctgtcaaaaattttccatttgatgggtttttgactaacgaccccagcaccatttcatgccggaattcttatacattttttggggggggggggggggtcaaattggttttaaaatcatcaaataagtttttgacagcggattttcaattttatggaccttttaaattttatttttctaagaaattaatgagaaaattttcatcccatcggtgccaagaggcgaagcgtggaaaaatttgtcataacttttgaaaaaattaagaaaattttttgaaatttagcaagctattaacacaattccagggctaccattgtatgatgataccatgattgtgcgatctcaccttggtttcccgcctgcggtaaacatctcaagtaaaaacgaagcttataattttcgtattttactatgcttttacattgaattccaataatatcaatggcattgttactgacagcgctaaagggtggtgccacaccttttttgaaatttttttccaaaaatttattaagtcgtaaaaaaattattaataggttttcgggattgctgaacacgaatatgacatccatttcacttaatttcgaacccctgacccgaattacaacaaaaagtcaaaaattctaatgatctattttgcacaatttatttaggcaaactggttaaagggacggcacctacgtcctccagaccacgacttcttcctctgcgcccattaagaggcaagacacattcggccatcaccgccgacgccagtctcaccccacaaagggagacacaagcggccagaagcagccgaatcttcaagtctt

SEQ ID NO: 13351 - DNA, 2140 bp, Heterodera glycines
ttgccaactcactttgacataggtcaaaaacaataaatatattaactattttatcatctaaggctttccggcaatactgggcgcaaaattttgattatgaaggccaatttggacgcacttttactggcaccaacgcatgaattagaatcagatgatgaaaatgaagaaaaagacgatttttgagttcttaaaattttatttacgtgcatttaaaaagaaaaattggatttttcgttaaaaattttagttgatcactacccgatcggggtccccgacccccgacaattgagctcctccccgccccgacacccgacatgtcgtcccccgaggtccccggcccctgacattttgccccgagggctcggggctgaaccctaatcggaactattaccctctaaagtaattataatctcttgtttccacgcttttccaaaattcacttaatttgtcatttgtaaaaatgattgtcccgctgcgtatccaacaacggccggataaattattattatttgtgttgccggatggagcggcagagaatggcattttgtaatgattttccggcaaatttatgtccttaattgagtgtaaaagaaacacactaatcacttccgcgttggtcagaacgccggtcgatactgttgttgtaaaaattttatttttttgagaggtaaaattttattgaaaatattttaattagataaacaaaccaataatggaaaaggcaaaacgacaaaaattggctgaaaattttttttaaatgctaaaaattctaattaccgtatagcctggcccccttgcatttactaattttctgtaaattttttttggacattattctttttaattaaattttataaaaagctttacaaaatttcaattaaaaaagtcaaatatatttgtttgttataccaatatttcttgtaaaaaacttatgcggaatgttctgaacatggattttgtacagtgccgtgccaagcatttcccgacgatttgctcccgtaatttctttgccatttttaaggcactgattgtccgcccaacggagtgccttttaaaattaaaaaaaaaataataaataaatgacaaaaaaggctcctaattatgcagagtctcggaattctaagaaattacccccattctttaatttttgaggggtcgatggacgaaaaagaaattgccgttgacgaactgaagtgtccatatgcattgggaccagcaggactggcgactggccgtgatcacggatcacggaaatcacgagatttttggggtgccgtgatcacggctcacggatttccgtgattgcgaattcaatcacggccagccctgattgggactctttttcccagtgctcttatggcgtcggtttcaaaaaatttttatttaaaatcttttatgggtaattttgggtgcaattttagtgatttaaatcggttaaaaacagattctttgaattttccgcttagaggtcattagagattgattacaactaattttaggcggttttttaacgggcccacttaatctaaagcctttaatttttacgataattttttttaaacttggaatttttataatttttgagaattgagttttagcattcatagtggaatatgaagctttttttaaggctccaatgagaaggtgggggggggggggtgaattttgtgaacttttgtgttcctaccgatatctttaaatatatgtatttgtattatgttattacagcatgccaaattgcaatttaatcatgagtttctaattgatcacgttgcaaaatttggcacaaaatctgttgatcaatttccaaaaattcatctgattgcagcaatgataacgcattttggtcaatgtaatcaaaacagcgatcagcgaacgccttaataaatataaaatttttgcgcgggggatatggtgttaaactctcgaataattctagatacacttggcattattccatagaaatataagttgtgtttgatcactactctgaaaccagaacatttatgataaatcaggaacatttctattttatcaaatttggacagggtttggatcggacagtgtcccttttccaaggacgggtatactgtcttccaaaggcatatggggaaaattccattaaattcaaggacactca

SEQ ID NO: 13352 - DNA, 1698 bp, Heterodera glycines
aatggtcgcgaaataggcgcctaggcataaaaaaagttctaaaaaggcattttaaaaaaaaagataaattactccatcaataaaacttctttttgctaaattcattgtttatgctatttcccacagattctacaaattcctgcgcggttttataaaaaattatttttataatcgtttacattttcatacaaaaaactaataattcctaaattaaattttttactgcaacataaagaaaatttaatttatcctaatattgtttattatttttgatttatccgaatgaatagccggcgtctatttgcatcaccaggagcctttcagaattacgaacgacaaacgacaaatttgtcgtttgtctcctaatatgtcgctacgacaaaaaaatatatcgtttgtcgtccaagtttatcgttttgccatttatcgtttgtctcagtcgtccgaattgtcgtccaatcagaattaccaaatttcacagtatatttgtcgtttgtcgtaaatttcttaaaagtaaccaaaatttcataaagtgcaaaatcataaaaaaatagtaaaagtgtctttctatggggtttttaggcgtagattccaattataacatttattttcttataattcgaatataaatgtgaattcaatagacctagataattttatgaaaaatcattgataaaagcatagatagtgaaaatctgagatcggattcatgatcagcgaactcttttacccctaggaacataatttaacatgaaataaaatcttttgggtgaaaattttgtggtggctttttgggacacttctcagacgacaaatttgaggggcggtgttgagcgccccccaaatatttggcgtttgtcgtaaaaacctatcagaataatagaagacaaacgcccaatttcagacgacaaacgacaaaatttttaattctgattgatgataaacgacaaacggcgtatactaacgacaaatttgtcgtttgtcgttcgtaattctgaaaggccccagaccctccccttcaattctgttaaaaaatgaaaaataataccataattacgaagcctggaatcaagagtcttgggactcacatttttaccactaataatttgaatatcaacaacattacagaatcaataagaaaattatctcatttttacgtcatcaaactttctttcacgtcacacgtaaacaaattatttttttatagtaatattttttcttattaaatctgaaaaagatagtttaattttctgactgttttttcttcttgtgattttttcattgtttatcaaatttaaattaaaaaatatattttttttaaaattttttataaaaaaaaaaagcatggttccccatttttccccattgtttttttccccacttttttccaattttttttggcttctcctttgaacccttgcatttccccccaaaaaaagggttaagaaataggttgtgtaaattaaaaaggctccaaaaaaatgaggggaaaaaattttaattttataaaaaaaaaaatttgtttttttgggtttttttccttttttttttttttgaaaaaaaaaaaaaaaaaacccgccccaaggggcccttttcccccgggggggcggggaaaaaaaaaataaaaatttttttttttttttttttttaaaaaaatttttttttttttttttaaaaaaaaaaaaaaaaaaaaaaaaa

SEQ ID NO: 13353 - DNA, 1604 bp, Heterodera glycines
  misc_feature (84)..(84): n is a, c, g, or t
  misc_feature (176)..(176): n is a, c, g, or t
  misc_feature (1266)..(1266): n is a, c, g, or t
tgacggaaaataaaaattaaatttctacatatttaaaattgaaaaactagttatatctcaattaaagaaaaacaaaaataaaanatgagtcgtccgtcctcagccgagttgtccttgtcctttgctgatttgtcctgactccatcaaaaataataaattttcaaaacatttaaatntaaagaaggtcactcggccgacggcgaaagtgcgaaaaatgggaacgaattgcaaaagaatgtgaaaaatttgagataaatgtatgctatctaaaaaaagctgaagaaattcaatttgatgatggacaaactctaaaatttggttgcaaatgggacattgaagcacagaaatgcgggccgaatgatgaaacggagaaagcattgaaaggggaagagaaggaaaagccgaggaatttgttggcatggcttatacaatgatttgatcgttgattgatttaatcattgatcatctgattagtgttggtgattaaaaagatttgttgctgattttgcattaattttcaaatgtattctttggggtagggatttgttaattagattctgacgaaaaatggcaaaaaaagagtgaaaattgtgattaatttttttttggtaaaattaattataaaacgtttttcaactttttttttgcaaagaaaaagcgattttttcctttgtttcatttttttcaacggaacttattgaatttaactttagaaacctgtaaaacaaatttggctttttggccaaatatttgaacatttttttgcaagttacattcttaggtgattattttttcctttttatattatcaaaaaatagtgatgtccaaataattattcctaatgatgcatagataatgacgttaaaatgaaaaagttatttatgaaaattagaaaatgtttaaaaatagttttttaaaaaaataattgtaaattttgaatgtttttttgaatgctcatttgcaaggacatccttggaaaaaaggactgtttcaaatttccaatagacgaggccctaatccaaggacgtccttggcatccaaggacgaatagcagccctgacctatcacaatttgcactataatatattcaataaataggcaaaagaaaagttttaaaggtattgaaattttgatggaaaatttaattttaatggtaattatatatttatgtattaatttttaaaattccgctattttggaatttagaatttatacttatttttaagactttaattaatatattttttttattataattacatcatntaaacacaaaatcactcataattaaaaattgcatactagtattgtataaatgtatttttttaagttttaaaaatattagagttaaaattatgaaacttttatgtaggctggtagcggaatttttatttttatttgagatttaagttgattgttaagcttgtaaccatgggtcgggcggggcatggttggcggcagggttgttccgggtcgagaaaaatatcgggtcgggtttcgggtcgggtcggccgaaaaatcatcgggtcgggtttcgggtcgagaaaaaggccgggtttcgggtttcgggtatcgggtttcgggtaacccggaacaaccctggt

SEQ ID NO: 13354 - DNA, 974 bp, Heterodera glycines
ataaagcatgttcaccaatttcccattgcttttctccctcaccttggtttttctgctctctttgaccctgcaattccctcttaaaatgttaggaatgtttgctaattacaatgctcagaaaaatgacggtaatactttaatttataataaaataattgcttttgtgtttttctcatttcttttttgagtaaaataacaaaaactcggccgaaaggccaattcagccaaggatgacggaaaataaaaattaaaattctacatatttaaattgaaaaactagttatatctcaattaaagaaaaacaaaaataaaaatgagtcgtccgtcctcagccgagttgtccttgcctttgctgatttgtcctgaccaggggtgggcgaagctcggcttaccactcgaagccgaaggcgaagcccaatttttattcgaaggcgaagtccgaagtcgaagcccaaaaaacccgaagttttcgaagccgaagttttttcaattttttttaattccaaaaagttttaattttggttcaatataaattataacggaattgttaaatttgcagtgaatttcctttcgaaaaagggaataattttgaaaaattagaagaaaacaaatacttggatgggaagtgatccaaagcaaaaataaggaatagaaccaagagcgtaaccgacaaccatatatttgaacaaataaaaagcaaaaagttaataaatataataaattttgtttgccaaaaaccattcattaggggcagagctgcacgctactggatttgcaattacggaactccgtaatccgtaattacggcgattttctcagttacggaaatccgtaatccgtaattacgggggtccaaaaaccccgtaatttcccgtaatccgcaatccgtaatccgtaatttttaaaaatcaatttttgtcagaattttagaaaaaaatttttagatagtgattaataaaaatcaaaaaactgat

SEQ ID NO: 13355 - DNA, 2530 bp, Heterodera glycines
ctgcgcattgttttgagccgtttgataagcatttcaacggtaagtccggcctgttttgcccgcgttctttcgtcaatgcatttgctgtggaacattagcattttgcgtgcgatttgacttctgtgaaaatccgaccctttgttgtgttcgtacgtctccaaaaatgctaaatttaaatttccacttttcaaaatttaaatccattttattttttatttttttttgattcgatttacttactgaacagttcgttgtcaatgtgtcggtttgacacgtcataaacactgatcgcattgtccgctcggcccgcgtaacttttgaagtgttgtcgcaatggcatttcgtggaccggcgcacaaacactcgcgtaaaaattgtcacagcgttcgcttttccgcgcgtcggtcgtcgcattgtcgcgcgtgcgcagcagcggccccaacggcgggatttcgtagagaccaatgcgcgaaagggaggcggaaagggcgggggaagaagctgaacaacaccaaattaagcaacattagcaatggtaaatgggtaattaggtaaataattggtcttattaatcattgaaattaaaaaaaggcttacattgtgctgctgaaaaataaaggtttgaaagaaaaattatgttggtaaataataataaattaatgtgagaaattctcattttccttaatttatgagagattaatattttatacttttaatttgctggaagctttaaagcataaaaatatttttgtatattgcattttaaaattattttttattataaataacaattattatgaatttcgaatttcttttaatgtccatccgatttcagcatgtttaaataaggtttcgatcccatacaaatgtataattaaatcaggaagaaaggcaacatttttgctgtgttattcgtatgatacccccagaggcaacccattccctaataatttattgttcattagtgtgtgtaatgatctaattaagccacaattattaagagcatcatgctaattgcattaccactcattcgccgatcagccgctcgaagtgtgaacgttttcgtcgcgatttgccttataaatattgctttttcggccgcttctccgcttctgatcgcccattaatcatcggtccgccgttcgcctcccccgctccgctttatcagaggcataaatcataaaaaactgtccacaaacattcgacgggcgtggatttgatccttttcgctgctgccgacgacggtcaaatggaaaaggcgcaatccatcggccgattaggcggggggggggagacggatgatcagagcaatcggcaggatcaatcagccccgttggtgtcaacctgtttactaatcagccattcttggtcaccgacagcaaacagtccgccaacgaaatgcaaaaagaaagtcccatctgtgaacaatgagtgagcaaaacgcatcatattaagcaggatttggacaccaccgaataaattaattaatgaaagcatttaaaataaaaagtcaaaatgttaagcaaaactgatcaatgaaaaagaaggtcacattgtacttacgcactgttaaccataatagcggatttacgaaaaaaacctacaattagcatcaccgatttgtcataatttgcttaatttctctacaaaacgcattacattaatttaattcttttttattataattattattaaatgaaaaaacaccttcccaactcacgtcattcgttagttggcacgtggcatgtgacttcaaaaaacaaaataaaaacaataataataataataattattattattattataatgttagtggtgtctcaatgctaaaaaacataatatttttaacggaaataagagctaaaaaataaaagggccctaaagaaaaaggagaaatcacacgacaacataataaatattttcgcacgagaaaatgcgaaaaattttgtataaaagtgaacgcatttcactcaatctcaataacttttgctggaaaagtgccattcccacgccctcccttccattgtcagattggcaagcccatacccttgtcatgccatttctgacaagcaacgagttttaatgattttaaaattctttccatggaatcattttgctggaaaagtgcattttcattgatcttaaaaaatattttttttatataacagaaagaaattgaaatgctttttaatgctgaatattttttcattctctattttgcctttttgttctgctccgccgatgccttgggcgataaccgctcaaatggacccgtcattttaaacccatccaaatttgtccataatcatcgggaaaatgaaatgtcggagcggaaccccttaaaagaccaaaattttggcaacaaatcggcaaaaattccgattgctgctgataaatactcccaacttgttgggccgtcaacgaatgtggcaaaagagtggttggagcggagcaacccaaaaaaggtaaaattaccgagcagaaaagaggggatgggaagattgggaagtcgagattgcaaaagtcatcg

SEQ ID NO: 13356 - DNA, 1297 bp, Heterodera glycines
gggagggggagggggagaagcattcccttcccttcccttcccccgggggaggggcgatcccggaagaaccccgagaacaaacttatccctctccagctgctcttgagtaccactttttttctcttaaagcatatcattatccaacggacagagcgcacaactgttgtcggaagcggacgaaaggcgggggggagaaaaagcatccgaaggatgggccgagagaaccatctgtgatgcgttagtggggcagtgattgttggttggtggccagccatttggccaacttaaaatgcgatgtgccaaaatcatttcccgcctatgacgaagaaaaaaagggggcgggaaggggcgggggatggtcgaaaagccaacaaataacgccattttacaacctccagatggccggacattttcgtaattttcctacaaatagcgacgattttacgtgttaaagcatacttaaaatttaacagcacttaaaaataactgacatttgttttattattcttctgctgctgcgtgatggtcgacttttcgattaattattgcgtcgatttgaaaagtgctgacggcacagtccgtggcggttcgttggaccgactgatgtcaatggcacagaacggtagctacaacggcacaacgatggaatttgttgacaaaaagctctcgggacaatccgatgtcacaatggtaccagacgaagaagaggcgaagaacgaggacacaatggatggtggtcagagagcgggctgttcaaattaccaaatcaaatttagaagtggccactaccaatttcgtttatcgtccgtcctgccctccggcgcttcgaccggttgaatttgacacactttcggaaggcgacaaagccgaatgttacgaggaggaggaagatggaaaccagcaggcggaagaggagggggaagaagaggaagaagaagaagaggaggaggaagaagaggatgatgatgagtatgaatatgtgtatgaggaggaagagcagcagcagcaagacgagaacggagacggacgacagccgggggcagtggcggcaacgatcaaagaggacgaagacggcgacatcaaagtggtcatggaactcccgcccaagaagcggaccagcattcgtcgcaagaagttttccgcgtcgcgttcgcctgcgcccgaacgcgtggacggagcacaagcggagttggacgcagaggtgcgaatttgacaattgatggtcagcaagcattttggatatgcaaaataaaatcaagtggagaatcagcgaaagtgatttgcgctgcattacttt

SEQ ID NO: 13357 - DNA, 3698 bp, Heterodera glycines
attggagaattaagaactaaaagccacctaccaaattgctttattaaagaatgttattaaagtcaataaagccaaaataatatttatttactttttggttatttttaatattgtccacgaaatttaaaataattttcattttaatttttaaatcttccaaagttttccacccttttcatatttattatcaaattacagtattgcaccatgaaaatttcaaaacaaaatggttattccgtttgcttaacaattaaatataaaataatgcaatcaaaatgttcaaacaatgcttgtttagcatattgcacactaagggggcggggcgatggactacaaataattcgtatgccaaaaagaggttaatcgggtgttatacagaaatcatcatcgtctgccaatcgtatcgtacacttctcacattccaccgtaatctctctccgtccaattgtcattgtttatgccaccacagcaaccgcttggcaccacactttctccttgaccatgttacagtagccgtcgccggacgagctgaagtgcacacggttgggcacggattggccctctttcgtctcattggcgtcagcgcatgtgaccaagaacttttggccaaagcgcgcgtacagtccgctttggatggcactcactgagccgatggcgtcgcccgccagaatgctctgaagattgttttaagttataatgaaatgatgggaaatgccagtgattgcccaaaaagtgccaatgacgaaaaatgcctcaccttttccaaggtttcttgccatgccgtttgggggcacggcgtttcgacggctttgtaatgaggctgaatggcagagacctggtggaaaaaatgcattaatttgttgaaatatttccttattaattgtttataacttttttgaaaccacaacaaaaattttcgaaatttgcagctaattaaaaaacaaaggactatctaatgttaataaattgtttgaactcggacaactatgtattatgaaaggtgttatactcaaaaaacgggttgtcgcccagttgtcgatttcagaaaattcatgcagaatttcaaaaaatcggtcacctgtccgagctccttggctccgcgacggcgacgtcggcgtccgagtccaccgaggccgccaagtccgccgccccctccgccttggcagcagcagcagccaccgccgccgcctccgcagcacccgctgctgcatccgccttggcaacactgctgctgctgacaacattggttctgttggggtaggccaatggcatcgatcagtgccaacagagcgatgacgccgaaaagagcgatcaggaagagtttttggttcattttatttgttgagctcttaaaaatgaaaattgattataaattatttttaaatgaatgagcattttttaaaaatataagagaatttagtgtaataataaatttcgaaagagggattccatgtgccaaaattttggattgattttggattaattgttaataatatttattattttgaaaatattacttatttgttaataaacacagtgaggagctttgctgctgtttgttgctgttgcgttgtgatgattttgctgtgtttgtcccctgcttttaaagcattgaagcgccaaacaaaacgccccaaggcatagaaaaatgccgccgacggagacgcggtaattaatggcaaaacgagatgggcgcgcggggcgacgacgcaccgacggcgtaccgtgttcacggcagtgtcgccggtcgccgtcatcgtttgtctgctgctatgtgatgatcatttctcaatcagcctcacctcataatcaaaaattaccggctttgaccaatccaatctccattaataaaaagcgattaagcctcattagcaacgcaaaaacgcgattacgccaaatgaaaatcgccgccgcagtcgtcgccgaatttgtgctttgaattttgtgcgttgcgatggaacacatcggccggcgaaagaagaacccgtcaaaagggggggtgagcagggaagaagcggatttgactaatgaactcgtcccccaaggtggcctttgtgagcgaagagaacacagcgaacaccgccgcgcagacagatgaaacgccgatggaccgatggacggacggactgcgcggacatcgcccaatgttccgggaccaatttgcgggagcatcggcgcccgaggggacgccgaaaagaaagaaaagaaataacacaaaacaaaaaagaaatacgcgcaaaagatttgctcacagcaaagacaaaattagttgcgacggacgaatgtccaaaatacacaatcagcagatcgaaatttatttacattatttatttattatttagttttatttgactacaattttgtaagaatttgataaaacaaaaatattaaaattattttatttaattaaaactttctttaaattatatcaatgaaatatataagaataaaaatattataatattgtacaaatcgatgggggtcactgcgtctgagcaaaattttagttgccataatttattttttgtttactaaattctataaatcattcaaaagctctgtcacatggtgattttggttgggcccagatatcatctaaaaagaaaataaagtatttatgtgatgcaatcgtcaatacatttctctatgctctcgttgctgcttggactcaattcttgatcagcaaatgtacggtcaattcctgattcaacctgaccaaagttgttcacatcaaaattatcgtccatttctatcgttgggcagaccaattctaaagggattcatattttaattaccaaatattctaataattcaaccaactctcttttgcaaattcgattaattgctgttcgacaaccctccaattttgctgagaaaacagttctgtgtaagcaaatcgaggatcaagtagcattgcgactcgcaacagtgggttgctgcaaagttcacgaactcgttcatttaaagaatccactatgaccctagcaacgcccaaaatgcgatttgagaaagttttttcttgcaaaaaatcacgcaatctttttatagtcgaaataacggttgatgctgacgatttttcattagaaaactgaaattgtttacaattgttttagttttaacatatttcacttgcttttaaagtctctcgatgaaaaatttccaataaagggcacagttcgcgcaaaaaatcaaagtcggtaatttccaaatttggtaaattttcagggacaatatctaggcgcgacttttttgatgagccaacaccaaatcctcgtcttttccttcaatagttaaaagaacgtttttttgttcacgaaatgtcatcatcatttcaaaggtcgagttccaccgggtcgggcaggccttaatttaaaagaataattgtgaaaacaataatttatgaaaccattgtgagttttttttgcttagaatttgtcttttcttgatagtcgcggagcaaggacaggcctttacttgtacgaaaaaaagtaaccaaagaccgaattttggaaatgagtcctgccaactcaggcagtcccaatacgtctcccataacaagatgaagaaaatggcacacacattgaaagcttaaaaaaataattataaaaaacaaaaattaggtaaaacctattcaagttcaaaatatttgtggcccttatcatgttttttgcgttgtcgcgaaccaaacaaataatttt

SEQ ID NO: 13358 - DNA, 2807 bp, Heterodera glycines
tccgcgtcttgtgggcactgcacgcgttcgatcactccttttgcgaagctgaattggcacggggtcagcagctgctgcttttccttctccgcaatgttcgtctgaatttacattttaacaatgtaagctatgccattgctgcatgttcacctcttcaaatgcttccatcggctgcacttcttgcggctgcgacattttgccgttctgttgtccaacccgacactgctccaatcgcagctgtgcatgccgttcggatgcgaagtgaatgttggccaagcattggatgcgcgtcaacgctttttgctgcgggttggccgcgctttgttctgccgattggagtccggaggcaatttgggcgttgtagatgaagctgtactcggtgtccttctgctggaacggctgcagcagctcggcggcgtcgttgtcgcccgacgttgggccaacccgtgccgtgccaaagttggcattcgccgaagacagaaagccgccaaaactcatccggttggaatggcgtattccgctggtgccaacactgaggaaggcggtgaccagcaccaaaagtgccgcggtacgcatttcgtttcttttttgattgctgtgttgcgatcactcactaatcagtcggaatggtcggttggggaaggaatgaatctgagggaggggagattcgaatgtgctctcttctgcctccgatgcgctatttatacggcccattttcggtccgttttgcccccggcggcgtcggacagtcgccgcaagggacagaaatttgggaattgttttgctgataacagtcaaatgtacaaaaaacagctagccaaattgacaggcgattgaccccaaattgacagctgctgctgctgctttggctgactgattgtttggtgctaatttaatttccccccggcgcattccgccatcaatcatttcgcatatgccattcaattttttttacttttttataaaaatattttttggtaattattttttaatattacattttgcttttattaaatatagacaacaaagtctattatgggagaccctgtcagaagttaacgaaattttcatcctgattttgtgcaaaatccaaggactaagaccccctagggcataatcacgaaaatccaatccattcacagactttaagctggattcttgaccgattttcggtattccctttttttatacttatttcaggttcgaatgtgatggtgtaaataattgtaacaccatcgctaccgtacaatgtttttttttttgctctttttgactgtaacaattggcaaaattttaaattgagaaacaacgcaaaagtttggcattttattcgttaaatttttttttaattattgcactttttccaattccttttcaattttccgcattttctcttttagcaaacgtccaaattcgtttagcatttttttatggaaactctgctggacaaaaccattttttcggtcatcgacccgcccaatttgcgcattaatttgccgcgatggtttacggttttgaaatgtttttttttaattgtcaaaatttgcctttttcagttcccctcgcccatgcaaacctttttcttcattcttctcacttatttcctcgtctccggtggcattgtttacgatgtgatcaacgaacctccgtccatcggtcggcacatttcactgatttctcccattttacaaatttgtaattttatactttactaatcggaaattccgacttttgtcaatgaataatgaacgttttagttttatgcaataaaaagtgccgttctgcattcataacacagacaaattggtccttcttatgccattattttaagtagagaccggattttccaaaagtgccgggcccggaaccggtttccggtttggtaaaaatttaaattttcacatgtatttcacccaaaattgaccataaatcgtgccagatgtaaaatttcggctctacttcacttcaggcgtcaataatgacctcttcaataataaaatttcaaaaaaataaaaaaattttaaagaattttttgaaaaattttttggtaaagtgcattagtacaggaaaacctagtaagtaattctccataaaaagaaaaaaaattctttcttagatatttgtggaaaattttttaaagaaaattaaggatttttagggtccggcggtgccgataggcgccgccgagaaattttttgaaaatttcgatgcaatttattaacagaaattgtataaaaatgaagaatttttggctatatcataaaccggtaaaaaccggtccaaaatgccggtttccggaccggtttggcattttcgaaatgaccggtttccgggcccggcctctcaaaaaccggtcaaactggaattttccctaaaatcgccggaccggtttccgggcccggtaaaaaccgggcccggtccggtccgttctctaattctaaggcattaaaatttgtcgattttggcatttgactattaaattgtcattagacgagtaatgtgcttcacttttggtaatttcttcttaattttgccaggttccacggtggatgaacgcggaaacagtcggccaggcaataaatctttgcggattttcttttgaaatttctgaaaattccccccgttttcagtggccataatgccctaccgcgtcaatggccaatacattatggagggcctcgtcgcttcgttgatgttttgtctcggaggttggctcccattccatactccccccccccctttttttctattttacgaaatctttaaaatataaattaaaatgcccccattttcggccttggcattat

SEQ ID NO: 13359 - DNA, 920 bp, Heterodera glycines
aaaaagagcgccgcaaaaaaatgatgtaaaaagtcattcacatgaaaaggaaacacggactatagcttaatcaaataaggaaaaagtttttaaaagtcgtgcaaacagttatgtggggttttcggggatgctgatcctgaaaatgacacccgttttggccaattccgaaccccgaacttggattcgaacaaaaacttgaaaattcaaaattttcaaaattcatttttatgttcgtatccttacaatgaccattctttgatgttgcaatgtttgcgaataaacttagattgtttttaatcgatttttgaatagaagtgagaatttctaaagttttgaatttcaactttttgttcgaattcgggttcggaattcgaatttgaccaaaatgaatgttagattcgttatcagcgaccctaaaaaccccataaaacgtgttttcacgacttttaaaaacttcaagaaaatttttgtcaaaaaggtgtggcaccatctaaactattaccgtctcgggttttttgggtctcgagtctcggggtcaagtctcggtctcgagtctcgggaaattttcggtctcgagcagcactaatggttggtacggtttctccgttcggtccaaccaaacaaattgagtcgttttttgtagacattacgaattttcgaatttgtcgtaacccccgaaaatggggggggggcgtaattcacattatgacgaattacctgtaacaaacatctaaatgtgtctctgcagagcaggattgttgacggaagtgcgtacgaggagggaatccaacagcacaaactccaccgactgaaggaatcgctcgaatgccatgagaaggcactcgaagagtaagggcacaaaatgcatactgcagggattgatgggtttccggggcatcaaaaattgcgaatttctaacc

SEQ ID NO: 13360 - DNA, 4005 bp, Heterodera glycines
  misc_feature (345)..(345): n is a, c, g, or t
  misc_feature (2044)..(2044): n is a, c, g, or t
tgcaagggggagacgacgaaggaggggaaggacggtgaagcaagcatggaaatgaagagagagagagagaggaagagagagcgatggcaccactcactcgcccattgatcattcatcccatttcgaatttgcaaattttgtccagttttgtaaaattttaaatttccattattacaaaaaatgcaaatttcgacacgattaagaagctttccaatatttgaagtgctcgcccaatctctcacgtccgcattattgttgtgcaactgaccaatatgggcaaaagcgaagcaaaagttgtcatggatacggacgcggagagggagaagagaatgcccgggggggggngggggggagtgaccaattgccaaagggcaacgaaatgtccgaacagcacgcactaattccatccgatgtatacacttaagtcacttattaacgccttggggaacgaccggcgactaacggcgatgagtgacgaatcaaaggaaaaccgacagcatcagcacatccccaaatggctttaaaaagtgacggacaaatgcccaaagagacacatcgccagaggaattcggcgcgaaagggaaactgcccgatgatgccgatgcttcttctattatcacttttggcaattactgtcattttgtcggagggaaggccaaatatgtggagaggggacggagaaaggaaacagacggaaataggcagagagaaaagggaacaggaaaagcagagagacaaagaggaaaagttaacggaaaggggagaaggcaggagaaggtacagaaggcaatcactgccaacggacaatgtgttggtcagttattggcttattggcatttaaatttgagagaaaaaagcggaaaaaatcatttaatcttataaatttatttgatcattctccgtcttttcaggtgtattcttccaattcgaatgtgtccatcgccgatcggatccaagttttgtccaaagaatcgcaaattcgaattttggagcgaaatttaaacaccaccgtttggtcaaatgcgtcgcttctgcaggcaaaaaatgcttacgatattatgtcaaaccttaattttgtgatcagatgtcacaaaatggtgagcaaatttcgatgagtgcgtcgcaagcgatcgctttggtaatgaaattgggcggaggagcgcaaatggaaggcacgggggacactttacaggtggagagactaattaagggataaatgggaagaaagggactaattaagaaataaatgggaagatagggtagggacaaattaagggattgaagataaacaggggagagagggaggggacaaaggagttggggtgcatttttgtgttcagctaaatgccagcagcgatgggccgtcgtcccttccgtccgttgactttgtcccttcccgccgcatggaggcccaactgacgggccaacgtgtgaatgtgtccctggctgacttggccacccgtgccattgccttcagtgcgtccggcgcgcgcgtggcggcggtggtcgccaccgattgggcacgacagaacgcgcgggaagaggtgcgaattttgtcaacaccggcgggggaaggcgagcagagagagctgagcgttgtggccaattcgcctgagtatcagtgagagagtgcaacataatgctaataaattgccgttcaaatgctttagggtccaaattcgactgatcggtgccgaggcacgtgccaattcatccaaatgatttctgaccaaattcgccccctccccgttcagtccgcccttctcttccgagattctcatcttcaaattcccgcagaccaccggtctcttttgctaaatgctctcgactggcgcgtcactgttcggtcggcactttcgccctttgaactccatgccaccgacagccgactccaattgaattgttttgaagagtcgctctccttggtgcttcttcccgacgcacttcaattgcacattggccaattatcgaggtaagcgacgcgcaaattaaatgtgctaattgatcagaagcgaatagatcactttaaccggaaataccattnttggctgctgatttttcaagttttcatttctgcttacatttggccattcctttttaattttcgttccgtcgattcttttttaatttttccctgaattcgttcgcctttttccgtcctctcttttagccttgccattgtccgttcttccgttttgcccggaaaaatgcgcattaatggggcgattgcgaatacttcggctgccaattcgctgctaatcaccgatcggatggaaatgatttcgcacgacttgagcctttttctgagtcggaacggatccgccgactccgaccaaagggcaaaggccgacgacgacgaccaatcagtgctgatcgatgccgttaattcacaccttcggctgttccattccaatcacacaatggtaaatatttgcataaacttcgaactttcagcttttaggcttcattgactgccgcaaaacatttcgtagaaattctcgggggacggccattgctgcaaattttgacgggaaatgtttctgtggagatcgaactggttaaagaaacgaaaacggtggccgaactgaacactgacattgtgccgaaagagctgatgaggactgaaaatgccggtgactcttttggcagcggtgggaatgcatttgaccattttggcatttttcgtgtctttggaaggtccctttgctattcggcctaatgtcacccatcccatcgtgctcaattggactcattctccgcccaatccgtcccaactcggctcttccgtttccgcttcgtccccccttccgtcgtccgttgcgcccgctttgaatttgtcttccctttctccggcatcgacgccctcccgcccattctctcccgccaccccccaaatggccgacccttccgagctgttcactttccgtcactctttcccccctccttccgtttcgccctcttccgctggtccctcctccaccgaatttgaatcgcttgtgacacataatgagtcggcgtccgcttttccttcccccgactctgaactgttcactttccccccgtctcttgtgcccgatgccgactttctcgtcggccaatttgaaactgtgccctctcagcggaccacccaaagtcttttcccattgtcagcgaccatttcggcactccaattccccgaagaaacggcagaagaacaacagcaacacattgccgaacaattcccgggcattcgacgggaaaatttgctaatttggagaccggaagaaaacgaaggaacggagggaaaggaggggggagagaaattggagacgtatttggtggatgaaaaggaggaagagggagaggaagggaagaggccgagaaggacactgaacgacgacgtcaatggaagaaagacggaagaacgaatgccgagggcggagatggaagtggacattgctgtggagggggaggaggacgtgagggcggagagactgaggagagagttgggggaaggcatcgagaggatgttggaagagtgtgaagagaagaggacgaaaacaatggaaagagaaacagatagagaagagacactacggaacgagacgaacagagaggacgaaaagataacagaaagcgacggagcgagtgcagtgagagtaacggaagtgaaattgaaatatttgggaaagatggactcaagcaagaaggaggtgatcagaatgcacttcacattggaaggggaacagaatgaattggagaagggcattcgaagaatcggacagatggacagagaaacggcggacaaaacactgaaacaccaagtgactaatgaggggagggagcaattagggggtacggataaacagtggcaaaaaataaatagcattcaaatttcggaaaaataaatgaaaatctgcgaattttttcacatacctattcaattgcaaacaattaaattaaacgacttttgctgctaatggggaacgtgtttattgcatttttgaagaaattctttaaaaaaca

SEQ ID NO: 13361 - DNA, 1586 bp, Heterodera glycines
aaaaaatcgatttttcaagtgtcgttgggggtactcaaacaattatggggagcaaaaatccaacgcagaattaaagtacaggctatagggaagctattcccgagggattcggtctccccataaatctgggcgcatcggtttggggggactgcccaaaaacaaaaaaatcgattttttcaagtgtccgtttggggtactcaaacaattatggggagcaaaaatccaacgcagaaattaaagtacaggctatagggaagctattcccgaaggattcggtctccccataaatctgagcgcatcggtagggggacggcccgaaaagcaaaaaaatcgattttttccgtttggggtactcaaacaattatggggagcaaaaatccaacgcagaattaaagtacaggctatggggaagctattcccgaaggattcggtctccccataaatctgggcgcatcggttcgggggacggcccgaaaagcaaaaaaaatcgattttttccgtttggggtactcaaacaattatggggagcaaaaatccaacgcagaattaaagtacaggctatggggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccggaggattcggtctccccataaatctgggcgcatcggtttggggggactgcccaaaaacaaaaaaatcgattttttcaagtgtccgtttggggtactcaaacaattatggggagcaaaaatccaacgcagaaattaaagtacaggctatagggaagctattcccgaaggattcggtctccccataaatctgagcgcatcggtagggggacggcccgaaaacaaaaaaatcgattttttccgtttggggtactcaaacaattatggggagcaaaaatccaacgcagaattaaagtacaggctatagggaagctattcccgaaggattcggtctccccataaatctgagcgcatcggtaggggggacggcccgaaaacaaaaaaatcgattttttccgtttggggtactcaaacaattatggggagcaaaaatccaacgcagaattaaagtacaggctatggggaagctattcccgaaggattcggtctccccataaatctgggcgcatcggtttggggggactgcccgaaaacaaaaaaatcgattttttcaagtgtccgtttggggtactcaaacaattatggggagcaaaaatccaacgcagaattaaagtacaggctatagggaagctattcccggaggattcggtctccccataaatctgggcgcatcggttagggggacggcccgaaaacaaaaaaatcgattttttcaagtgtccgtttggggtactcaaacaattatggggagcaaaaatccaacgcagaattaaagtacaggctatggggaagctattcctgaaggattcggtctcccccataaatctgagcgcatcggtagggggga

SEQ ID NO: 13362 - DNA, 2253 bp, Heterodera glycines
cttttcctgtattccttttaagtcaaatttatttttcatttgaaatgtcaaaaatttgaaaatgtctcaatgtggcaacatatcccaaaattaaatgttatggggcatattttgattcttttctacttttattaataaaaagcgaaaaatttgttcaattgaaataatacaattaaaaaattaaattgtttattgagaatcaaaaaaaaatccttcatcagtgatttttttgatttaaaagaatatttaacaatttatcgaaatgcaaataaacactaattctgaattattttagctagaaatcctaagatttccattcagtttaaagagtatggttggagcattttattttattttaattttagcaatttgtttcaatttatttcaacagcagctcacaagatgagcaaaatttccgtcctaatttcccatcaaattcactcaattttccttctcagttagtcctttttcgaggctgtcaatgtaagcacgccacgggtggacagatgagatttcaatgttgccgcgtcgacgtcatttggcagtcggtattgacggtgaatttcgcgcttaacacttccgtgctgatctgaaattttgacaaaacaaatcaaaaattgatttctttcagcggtagtggcggaggggaaaaaagcgtttctaaatttttgaatcgaaatagaaaaatttagttttaaaaaacagaccaaaaaaccaatgcattgctctatgaatggagaaaatggagacagaatgtggattttgatcgtcattctaatatgctttaaaagaaatgtggtgtaatgtttttatgctatttggcggtataaggaaacggaaaaccgatttaatttaaaaaactgccaaaacgaacgctttttcaaaatgccgatttctcaattgcctaaggaatattggcagaaattaccaacctttgcgaatttcgtggagacaatgaatgatcacatcttggcccgacactttgaccttgtttttttttttaattggataatttttctcttttcttttggcattctgacctcaatttcttgtggagcaaaaaattgcacgtctaatccaacctcaaatttatcttttgtgttgtgcactttgacaactccgtcagtgtgttgtagcggccctattaaattaaaaatattaatttttgaattaaaaatggtatcaagttttacttcataatggaagaaaatagattcaaaaaacaattaaaaaattacagtcccattgtgatgctgcatcatgttcaattggaattgctgacattgccattttgaaagtttttatacaatttatttaatttaggctttatttaaattgtatcattaataagaaattgtcacttttaatgatttttaacaatatcaaatgttatttgctcaaccgtttctaaatactttttttaactttaaagtaaatttaaattaaataaaaaggttttgcaaccttcctttttcaaattaatataatcaataaatacgctttatttttttcaaattttaatgaataaaattaaattaaaaaatacgcaaaccatttacaaccattaataagagaagcacaaaacgatggttaaatgcttatgaaaaccgtctcctgtgcatttcatcacaaaaatatgtttaaagttgaagcaaaaaggttctttctcaaatccgctgatcagatccgcttctttgtcttccacaaaacaaaaaaaacggcgctaatagacgaacgaaccgttaaattttgagaaatgagcaaacaaaaaggaaaatgggaggagaggcggtaaaaacggatttacgggggggggggacgaaagttaaaaacggaaactgttgctaattgattttaactcaaaaaagcagatattgaggaaaaggaagcaaatttagtgaaaattttgcttaatttttaattattttttaaggcagttacctcaaagtttttttcaattctttaaaaattttgttcattaatttaaatgagttttaattaagtgatcctgaaaaagttttgactgagaggacattttcattttaataatacaacaaaattaaattattgctacaaattttaattagttaaagcattctctctaaaatggaattaattaaattttatgtactcctaataaattcagttagcttttgcttcaaagaattttatttattctttttttttataaattaattctagaagtaccagcaaattttttgagatcgaatcatcgaaattgttttagtgatc

SEQ ID NO: 13363 - DNA, 2476 bp, Heterodera glycines
  misc_feature (1387)..(1387): n is a, c, g, or t
  misc_feature (1439)..(1439): n is a, c, g, or t
  misc_feature (1500)..(1500): n is a, c, g, or t
  misc_feature (2143)..(2143): n is a, c, g, or t
aattttttatgctaaaatatattttataaactttaatttttaataacaaaatataaatttttaaagaaaatcatatcttaaatttatacatattaacaaccttaaaaacgggtacacatgcaaaagcgactttttccgtgtgttcaacatagttgagacagctaataaaaaatttaaacaaaaatttttcaggattaaaatttaattttactcattctcgaacaacagaacccgcacatggtagtacaatggttcgcactcaaatcgtgttgatccaatagtaaacggacgagcgcaaatgcatttcacctcagagagagttgcgggaattctctaaagaattttaaaaataaataaattttattatttggtattaatcataaataattattttattttttgtaatttggccacttgcatttggcttgtagttcaaaatgtactcgtattggcacaaggcgcggtcaatgattggcatgtttgggtgaacaggctgaaaatgtttaatttaaaataacacattgatgaaacccagcgtattttttaccaattaggtgcttcagagagaaattaatttttgccaaaaatgacttattttgagggttttagtttaaacttaaaaaatcaaacaaacaaaagtattggtcagcaaatagttgcaatgaaagactctgaagatttaaattttcaaaattttagaaaatttttgtaattgaaatgcttaatttttcaaaaaattacctttttatttgggggtggggtggattttcggcgcccttcccaagcttaatgctggcctgccaccaatgggcccaaaaatttagttttatttttttacccttcttataaaataatgagtccctctcataacatttgaaaataaattcttaaaattatacaaaaaaattaattaatattctgaaccttcattctccgatgtctgatgtcacagcttggctgttgtcggtgctgtgttcccatggttatctgtagtccgttctttatgtcatcgggctgaaaagtgtgtgtgtgtaaaatcatctgcacaaaatctcattaatcgaaattgtcaagaggactattgacaagttaataaaaaaaatggtggcaaaaccactaatcaaattaaattgctgtacttgaactctgcgcaaaatttgctcatatgacggcgaaatgggtgtgtaatgggacacatttttgtggtgtaaccaacgcaagaatgcgtagtggtgatccgtttcggcataacgaaaatagcattcgttgtgtagcgtaatttcgccgtcctgcagctgctgttgatcaccaccatcttcttcgctgtgcccatgtttggtgaataccgtattgtggtgcttttgatgtccactaaatgggagaaggngatactgtaaccgaaacggcataagtggcaactgtgaatgccaataaatggngtttgtgcctatttttaaaaaacattatatgtaatcttatgcgatctttccgaaatgaaanacagagaagggtacacctaccccaaaaagaattttcgatttctcatggcctatgcggaataatacaaatttttttatcaacaatgaggaaaagtataataaaaaccaaaaaaatgctctcccttgactatgaagcaagctgcaaatgcttaaaaaaaaataaaatatgcttaaaaatttttaatttaaaaaaatttatttattaatttttgaaaaagtgaaaaagtcataaaaatccctaaaccattcttaaatttgtaaactgaataatttctagacttttttgaagtaatttgatttcttacgactatatttttgaaaaaagtctctattttgtttcttaattttataaaaaagttttttttattttcaaatatgtattagcaaaagttaaatttgttatcacaacatctctctcctattaaactaaacacaaatagtcttaaaatagccaataattattgtttattattgtgataccgatattttctgaaggaatttacgacttggcacagctgaaggacgagaaaaatatgaagaacaaacacaaatggtttttgttccattttggtttttggcgttttgttttcgtgttgtcttcaaaaattatttgtttttatttctacaaaaaaattgagcacgtntaaaataaggcaaaacaattaaggccggatttaggtattaaaaagttgaaaggagaatgaatttcatattaatgaaggcaaatcatgggttttaagttgtcaagtacataaactacacgaaagcttgaaaatgctttaatttaatcctaaaattattatttctcttgagaaaaaaaatataaaaaatgaacatattaattaataaaatttatttaatattaactaattcggattctataataaaactaacaaattgctttctttggttgcaaaaaccggtgaaattataagtatagaagccaaccaaccaattagtgtgtgtaatagcgagaa

SEQ ID NO: 13364 - DNA, 2577 bp, Heterodera glycines
  misc_feature (9)..(9): n is a, c, g, or t
  misc_feature (774)..(774): n is a, c, g, or t
  misc_feature (843)..(843): n is a, c, g, or t
  misc_feature (866)..(866): n is a, c, g, or t
ccccccccncccccctcgagggagtatcgaaaaatagccgtcccggggcagttattataggaaaaacggtagaaagaatttattggtccaaaagcgagcgagtacagtggaccatgcttgggtgtataaatctaatttccataagataaccgtttcgggataaaagtgcatgaaaaaatgtgccctgccactcgcttagcccattttggcattgatcactgccaacttttttggcattgccactacctattgaaattttatgcctgatgaaaatgtatagaaaaatgtgcccgccctgccactccctcacttaacccattttagcgtgatcgctacaaaattggatttttatgtttggcgaaaagtgcatagcaaattcattcaaaatattcattcatttttattcacaaattaaatcaaaactctctcattagaaaagactgcttctagtgaaaaagaattttttttcaaaatgattggacctattcctgctgctatggcattgctgctgctcgtcttatgctcgtttttaaatagtaaaattaaaatatttttaacatttcgtaacagcgttgcctcgggttgataaaaagtttgggtcgggtttagggtttcgggaagccaaaaataccggattttttggatcgggttggcagaaaaaatcccgggtcgggctttgggtcgccaaaaagagcgggtttcggttgggttggcccgaataaagttcgggttaggtttaggggttttgggtcgccaaaaagaacttgttttgangtcgggtcggtcgaaaaaagatccgggttataagggtttcgggtcgtccaaaaaaccgggttctcgggntcgatcgtaaaaaagctcggacngcttattggggggtttggggtaacctacggtaacccttgttttatatgtatttgataaataagaattaaatttttagtggagaaacgggaccgatttcaaatgtacccccacaggcctcaattcaccagcttcatcaattttgcaccaaatgggaaccgacaatctgttgaacaacaaccaacattaacaaacacaaaattgaaaaagagcgtagtagcaaaagtggtgatttaggtatacaataatttgtaaaaattaaattttgaaattattaattttaggcaaaaacagcaaacacccgcacaaaaaagagtaagtaaaattagattaagcaatcggcaaccgaatccattgaactgttcgaatgtgttgtatcatatagcaggaatggaatcgggttccagacctttttttcaaaaaatcccggacctgtctggagtttttttttgaaagtaccccaaaggtactattagaggaaataaaattttttaggtgagattttaagtgatttttgacggaaattgacccaaaaagctttagaacaattattgctaaaaatactataaaaattcactcgctcaataatacaattttttaaaaatctaattcaaacatagttaaaagagaagaaaaaaaaagaaaaaaagaatttttaaaaaaccgaacattttcccttttttaaggttagtttttatcctttttttgattaaagcaaatccattgaacttttcgaataagttaaatgcaaacattgatagattattttgaaaagaaataaaaactaaaaaagctttttgataataccttgttttttaaggaattttaattgaaaggcttgtgcttaggtatttgctagtcatattttaatcggaacacgttctttggtttatatcaattctgtcaaaattggtcgaaagcctacctatgcagtttttcgcattcagaccgaatcaattgttgcaattcgaattttcatggatttcaaaattagaattaataaaacaattttatagatcagcaaccaaaaagcctcatagaaaacttggagttgagagtaaggtgaaagtggaacaaaaacgcaaaagcaaaaatttaagtgaaaagaaagggcgatttgggaaaatcatgtaagtggggaagacaccaataattgagcaattatgatttatttccttgtcaaggttttacgtgttcatgttgatcactataattgtgccccatgtgccgcaaaatgtgacgctcagtatgtgtacaataataaatagggctgccaattttatgtaaatacatttttttcctggattctacgtagtctaattagtaggaaaaacatcttcttttttccatttgcttataaaagttgggacttttatttacatatttttatacatatttcggacttttagtacatattttcagatttttgggaaaactgcttaacaaaaatgcaataaaatcgaaaaatacacccctaagaagagatttttcaaattttttttaaatgcacccctaaaatttgagcttttcttactcttcaaaaattttcctaaaaaattaactttttggctttattaaaattcttaaaattatattttttaattaattcagtgtattttttggatttttgtttgtcaaatacctatttttcatttttttttctacatgtttcatacatatttcgcaaattttttttacctatttatgtatata

SEQ ID NO: 13365 - DNA, 1979 bp, Heterodera glycines
  misc_feature (1886)..(1886): n is a, c, g, or t
agttcccccttccatttgaaagcccccctttcattagaaggcctccctccatttgatggctcccctgctcatttttgagcggagttcgctccattagaaggcatagaggaaatacgataatgtctaacaaattaaataatttaatttaatctgtattttgttagtcggtcatcgatgacagctgtaaagttaaagatggtaaacaaatatgtgacacccaactggagatcaatgctgatcagatggggcaactacgaagaatgcttgttagcacaaaaatgattgatcagagcattggaaatgacaatcgtcgaaaaacattggagggacagacaagtacataaaaagccattaagaaataatataattgggttatatttcacgaatttttatacgtccaatcgacgtttaccggtccaatcaaattaatttagtaatttcataatctattgcggaaatccccccttttgaattgcaagggataatccccgtctcatttcctccaaaaagtcaaagcgcagcttgttacaaatataaacgatctagtaaacgcataaaagtcgatcgattgtgtgcataaaagtcgatcaattggacgcataaaattgatcgattgggcgcataaaagtcgatcgattggacgcataaaagaggatcggacgaataaagtgaaatagaaccgaataaatttatattcattaaaatgtataggtattcgaaaaaaaattcacaatgatttacctagttacactctctttggcaaaccaatgtgatcatcctgtttgggtgttcagcaacgcaattcctaatgtgcaaatgccggtgcttttggaatcaaaccacggccagcactttccaattgcatcaactcaggcagcggcacgtttatgggttgaacagcataactgcaacgatgtcagaattaaattaagaaacattatacacatacataagtgtataataagcatatattaccccataattcctatattaaaggccactggggctctattttttaacctcctcaaatgtggggctttatttctgagggggggggggggagtggctctatatttccaaccctctcaaaagggggactttatttcaagggtggctttattgcaggggagatttaatgtaggaattacagtatatataactagggctgctaaaacaggcaccagaaaatcgcgaaaggcaccaaagagggcattaaaaactttcaaatacgaatgttttcaagatgttataagcaaaattcttagaaaatcaaatatttttatttaaaaaaaactactctttcggagtgcattttttaaattttgatagcaaaaaatcgattttactgctgtatctttttgaatttttggacaagaaaaatcgatgataagtccatccttaggggtgcattttgctaattttcaaacaaatttaggaccaaaattcaaaaaaaaccccgccaaaaagggcatcaaaagggggcatcaaatgtaaaaaagggggcatggaagggcataagggcacgaaaattgcaatgctaataataaacaaagaagagtcacataatatttgttcataatatgtcaatgtataaaattttaaaaaaatgttttttttagctcaccgatgatgaaaaacaaaaaaatttaatatgcaaccctgctggggccgacaaactttcactctttgaatggacctttgatggtattagccagttcattgatgtcagttatgtggacggtgccaatgtgccgatgggtgttcatgtgcccgaattcccggacaaagacatcattatcaacacgcccacgggcactacccacacagtggaacaactgtttgaagatagcaacggtcaacttgttgtgccactggaaatgatcatncacgattatgccggtgtaagttaaataattttacacagaagagtgtgcaaatttgtggtttgtccagccaagtgtacaacgtttgtttgagga

SEQ ID NO: 13366 - DNA, 2532 bp, Heterodera glycines
aattgctcattaactaattagtgataatgcataatgcattggttggtgatgattggtcccttccctccgtccgttcgctttaatccgacccatcccaaagtgcgaacccttttccttcattttcactcacaaactccttttttactttgtgtacagtacatccaactctcgaggagagggcaactgcccgaatcggtcgtgccggattagtccaaagtctgtgccagtcgcccctcggctggactttgatcggctaacttttgccagccttttttctgccggctgagctgcgaccaaagtgccgacacgtgccaagtcggcctttgcttttgtttactgtttttgtatattttgtatttgagaggcataagctaacaacagcacggcagcagagcacaagcatttgcagaataataattgagcatttgaattaataaatggaaaataaattagacatataaacactttaaattgcgcgacctttgctctccaaaaatgaccgaattggcgacaaaacatggcaatgcatcattagcaggcttttcagttgctaatccgtcctttcccatataagccgcccccttttaacagtaattccccgtcccctttttttgcctcccctttgaatgtctgtccattttttgacccttttgctaattgccatttgcttccttgttttgtcactcatttgttgctttgttttgttgttgttccattatttggccaaacaatgctttgttttgttttgcttttctttccgttgctttgcttttgtctcgcattacaccaattgtctcgtcttccgatttatcgccacggctttttctgttgacttttgcgcgttaatctttccctgggttaattccgaagctttttcggtgtttgcggaaaatggaaggcggggaattcggagaggtcgcgagaagctcgagctttttccgtcatttcctcgaccaccgcccctcggcttttcttcttctccgaatgaccgtccaattcgccctttttgtttttggtcctttgcccctcccctcacactttggggcagtgactttttcacctttccccttttagctaattaatctcccgacacaaagtgggcagaatattgagaagggggggggcattaagcacctgagcataaatccgatttgggctctctctccgaccatttaatgaaattaaatgccgccacaataaattgcaatgaaaagggcgcatttgctcattggtcattttattttggcacttttgggcgcattgaccagcagcagacgggcgggagagaaaggctaagattaattagcaaattattcggatgggcacatttcgttgctccctataaattctctccactttttcagccctttccattgccccctccccttaattttgctccaaaatgctccaaatttggccctctctcgccatccttctcctccgccttctcatccgacttggaacagttcagagccagattgacgtacaatacgacgacgtcaacagtatttatgtggacgaaattgacgacgatcggtcgatggttttggacggggaaaacactgctgagtcatcggctggcaaattgccattctcgagaatgtttcggtctcgtccatcgtcggcaccgtcgtccactcggccgaacattcttgttctgatggtggatgaccttggctacggagaccttcaaagttacggcaatcctactcaggtgtgactgcttggcaatgacttaactgtcccatctctcaaggaatggacgccggtggaccaactgatggccgagggggtccgctttaccaatgcttacgctgccgattcgatgtgttcgccgagtcgtgccggcttcatgaccggtgccccctccctcccatcctccaattcacgcctcccctcctgtccttaggccgcttgccaatccgtctcggcgtcgtcggtggcagacgcgtgtttctgaacaccgacacgggcggtttgccgaaaaatgaatcgacaattgcggaaatgcttcgtgaaaacggtgagaacaaaaattgaatgaagaaagtggtcaatagcttggacaccggcgctcaattaaggctatacgacgggaatggtcggcaaatggcacttgggcatcaacgcattcaaccgctccgatggcactcatttgccgagtcggcgcggcttcgacttcgttgggctgaatttgccattcaccaacaattgggaatgcgatgagacaaaagtgttcctggccaagaatgggtgcttattcatcactttgcttttcaggatttcttttcctctgggccaaaccccgagaaatgttttttgtacagcggtgatcaggtgggccttttgggccttttctctttgtattgtatttctttctctcactctttttctttcttccttttctctcccttttcagtattttttctctcactctttttctttttcatccctttgtcgcttttcctctttccctttcccttttttccttttcgaagcttccccccccccatttctcttcggcttctgatc

SEQ ID NO: 13367 - DNA, 3280 bp, Heterodera glycines
  misc_feature (62)..(62): n is a, c, g, or t
  misc_feature (69)..(69): n is a, c, g, or t
  misc_feature (106)..(106): n is a, c, g, or t
  misc_feature (111)..(111): n is a, c, g, or t
  misc_feature (119)..(119): n is a, c, g, or t
  misc_feature (146)..(146): n is a, c, g, or t
  misc_feature (156)..(156): n is a, c, g, or t
  misc_feature (173)..(174): n is a, c, g, or t
  misc_feature (184)..(184): n is a, c, g, or t
  misc_feature (192)..(192): n is a, c, g, or t
  misc_feature (195)..(195): n is a, c, g, or t
  misc_feature (199)..(199): n is a, c, g, or t
  misc_feature (243)..(244): n is a, c, g, or t
  misc_feature (257)..(257): n is a, c, g, or t
  misc_feature (3273)..(3273): n is a, c, g, or t
gcaggtctcgtacaacgcacgttgagatatcactctgaacagtctgaatctaccatgggagngaaaggngggcattggtcttttactggaactttaaattaatggnaattngttggagnaattataagggaattctgggaattggnaattagaaanttaattgttggtgttannaggtaattanatgatatnggncatnttaaagaaatttaggaaagaatgaaatttagaggaattttgtgnnggtggaaagtcangggacgattggtagggatgggtagtagatagaaagaatgaatggtagaaaatgatcttcctttgccctaaaggtacgtcagccaaacttgcccggacagtcagctgatcacacactcccctccgctggtgtacgacctttacagggacccattcgaaatgtaccctttggtggacagcgcaggcgaatggacggtgtccgtcgtgctcgacaaagtcggcacaatcttggagaagcacattggcacaatgtttcccgtcccaccccaattgggacacttttcgccggaagtgaaacgggtgagttttgtgctcatagtgtgggaaaatacttcaatgcatttttaaaattggcagtgttgcgattggccaaaatgccgttgcgattatctgacgaaggagcgaccgaaaagtgaggaggaggcggacactttcaaggagagatggacaggcatttgaggcggaggagcgagggacagaaagaaaagagaatggcgatcactcggccgatcaatcgcctgcggcgttttgccgaacatccacattttagggcatcgacactgtcctccgctttgatcaatttcgattctccagattctccgctgttactgattgatcactcccctcccctcttccaatttaattcgcacaaaaacttttttgctatttttctaatgggccgatctttttttgcttttagacaatttagagactaattaaaaaattataatgaagaggaaaagccaaagcaaaaagtaacttaattttgtgcagatttccacaaaacaaaaagactttgttcagattaaatttattgtaaaaataggaaagttttaatagaaaatgttttattgtaatatttataaataattgaacaacaaataataattgttacacatattttgatgaataaatgaatattattttttaaaattttcgaatgaatgaaaatgtccaaaaaatgaaaaatcggattggttttgccaatttaccatcgatgcttttcaactttcgccccctcagcaaacattcagcaaagtccgcacgtccgaccacagaaaatgcgtttccaatcatacgaatagaggcgaccgcggcaaaaacggcgtttatacaaatgacatctgataatgaaattaaatgacattgaacttaaatgtcatcggcgagggatttttcccgtcgaagacattacagtaatgcgtgggttactgtaaagaaaacagagttggaccccttggcccaccaattggtcattccattgcccccccccccctttttcgctaggacctcgtgtctctgtccatacagacggtgctgttcccgcacaatccgcagctgtttgggcagtcttgggaaagtgatggaatagccttcgattgggaacaaaaaaatgagtggcatttggccaacttttgaaatgaatgccaattccgtcgtccgttccccccaattttcctcccattgccccgtcccacccgaactccggcagtccatcggtgcacatccggacacttggaatggcaaaatgattcgttagtgtcattcttttcggaacattggaagcggaaaagggccccgcgggcggagacaaaacgaccgcggggacgggggcggggacgaacgaagcgaaagcggaaacggggacgacgcgggcggggaggcgggggaacggtcgaaagcggggaaaaagggggccaagggcgaggcgaagaccaattgcggagcagcaacagctcatcccccgcaagggttttgtgctgcttttctgaaacgcaatttatgcacgaaaatggacaccgaccacctcactcattagtcactaattgtgcaattagttaaccacaagtaattaattacccaaacaattgacttgcccaacccaaaaagatgaatatggcacagtgaaaattgagcaattttttttaatttccaaaatgtttttcagaattaaaataaaggcctaccgtttcggctcactttttgttgataaatcatcggaacgaaaagaaaaagcagaaaaaaagaacaaaatggaatttggcacataatttttaaaattagcgaaatgaacaaacgagcgaaaaatggaaatttaaaaagggagggggggggggacaaagcgaatttgtgagttggggagaaacaaagagacgaccgaactaacggaaaacggagcatttccttttgtgtcagctcgttttaatgctttattttaatgaaaaagcacagctgttttgaagtgtgaataaatttattggaaaaggcagaaatagtccaaaattaaatttgatcaacgcaattgataaaattataaataaattaataaagtcacaataactaggaaagaggcaaggcaacaagaaaagaagcgatcgaataaataaacattatgggaaggaatgcaatggccaattatgataaaaaaaaacacccacccccaaaaaggaattgtccgcctttcattcgttccgatcacaaaatcaaattcgactgatcagtccgtatttggtcggctggaggagagtgtccaccacgtcggattccaattggtcgagctgctcaagcaccgaactcagatcccttaattggcataacaagtgcgttggttaattagctaattgccctttcttcttccgtttattgttttttccgctctcttctaaattggcactgtttcggctttctctccgtccgcctcacttttcttctttgcccggttcggtgcgcagttcgatgtaatatttcactttcggctccgttccgctcgcccgcagtgtcaccgcacttccgtcgaccaaagtgaacgtcaccatttcggaggaggtgctcagcggcagaatggccctgtcatccggttgagcgttgtcataacctgcaaaaatacccttccgtggttttgttttggcaattcgttctcctcaaatggcccacctgtcgtcaagtcgcgcacaaatttcacatcgaaattctgcccaatcaatgcgggataatcggagcgaaggtccgcaaataatnttcttcg

SEQ ID NO: 13368 - DNA, 1167 bp, Heterodera glycines
catgcactttttctattggcccgtgtcaatgctttgtgctgaatttcagactttgttcttcctgctcagcactttcatcttcagaattcccactccgattggctgttcccaacgatggcattcgccgctggcaaaatctcattgaaaatttccttttcgcaaacaaaaaaaagaaagaaagaaatgttcgtttggctataaaaataaaaatgaattttcagtgatttatgttcaaatttcattaatatttcacaaaaaataaataaaacaaaagaattaatggccattttgtactcctccgattgaaacagaaacattcttttgtccgtccgttcgttggacgatgcaaagcgacgaatggacgggggagaacaaagtcacggggacaaagtcagtcatcagagtcactcccattccttcctcactcaaagccaaagcagctaattccgtcgaaagcccccccccccttgcggcaaaagcaaaaccctctctcttattttctaagcccaaccaattcgctttctcccttcctttctctctctctctctctctctctctctctttctcattcactcatttttgcttttcttcactcttttccacttgttttcctctcaccacagaaacactcacaaatctctccggataaaatcatgcgaataaattgtgggtacttaggaagaattgagtgaggaacgagcagagtcttattattcactcatccaacggaaggtaagaaaagaaaagagagagcgggaagaagagaggagaagagaagaagatgatatagagtaaagagaggagaaagaggagtgaagagaccgacggaaggaaaagacaaacggacggacgaaggaacggaggaaagagtccaatcgatgagaaaagctgaccgatgaggagaaaaaaagggatggaagaacatatgacgcaatgtgaaaaggaagaagaagatcaaagagaaaagaaaaagaggaagagctgaggaggagagaaaaagaggaagagctgaggaggagatcacctgaggggagaggggggggcattgttttgcccggagaagcgggaggaaaaaggaagtgtaatgtggaggcgaacgcgaaggcgagcggcgacgacaaaagcagtgatcggcgagaaagagatggacggacgaaaatagcgcga

SEQ ID NO: 13369 - DNA, 1031 bp, Heterodera glycines
ctttttcgctgcgctgtgctaatgatgcgttcggtcagttgttgcgcctccgctggtcccccttttgcacttcccccccccattttcccaattttacatttttctctatttttcatccccccccccctcccgccggtgttgtaatttccattccattctttcatttcacacaaaatgctctcagaaaggccaaatttgtccccttcgtcccccaacggaaattggcaaaacgacacttttcaaaaaatgacaacgaatgacccaagtgtaagcggcgacggcaccgccacgaacagtgcgacgggggcacgcattggtgagggaaacatcgccacggaacagaagcgaatgttccgcttcctccactcggcattggccatcgtttccatcctttgggccaccgtttgtctgttcctttacttccacgcgccctcctcacaggtgaaatgcccaatcgatgctctttcgtcccaccgttttctccctttggcaccactctctcctctcttttcgccagagtcaacagcttttcgactgtcgatggcatttgtccgttctgctggtccaagcttcgtttggccatgtgttcgtcttctgctcgcgcagtgccctccttttctgtgccgctttcgtgtccactcaatatgccattgtctactcactgctcactttggtcatttactcgttggacaccgttttgcttatgctctttccccgcccatcggctggtgagcagcagaatttaatgaacaaataaatgccaaattctttcattttgtccattcgtttttttcgttaggcgtcggaatggattttggcccatatctgaaattgaccgccattttcatcgtcctctctacttttgggttcggcttatcattggcccacatgaaaaaaatgctgcaaatcggcaaagaattggccaaacaaaacgaaacgacaaaaacagcgtcggccacttttgttggacaggacaatttgcgaacacttcgggtaactaatttactgctgcccttttgctcaactattaa

SEQ ID NO: 13370 - DNA, 2399 bp, Heterodera glycines
atgactttcagttcttcactggtccggagagtgcgcatgttcgcttcgcattgtcccgagtacaacacgccccctcaattcgaattctgccaattcaaatcccccgctaatggccattccctcgcctttcagacctttctcttcctcagtttgttgttccatgttggccggatgctgttcaatgccttcgtgttgtggtgtttggcaccgcgtgcattcggcacggcactttcactccgtgtcaaattcaaaatggactcggaaatggcccaggcggaccaacaatggactgagacgcgaaagcgggagaccaaatggcgagtccggcagaatgagtgtcaatgccaacatttgcttgtatgtccaggctttactccgtggccgcctgtgttttggccgtggcggttggccatttgctgctcaatttcggctacgttttgcagtcgatgattttcgagtcgttgtccgtcgccactggcctttccttcgtcttttccatgtgtcttctcggcgctgtcggcttttacgctgtccggcttctccgtttctgcttggtattacagttcttccctcgatgtttttttctctcttttcttttcctctcccttctctcttcatccctccttttttttaattttccattccattcagattctttccgcgtacatctctttgaacttgtttgtaactgcttccctgcttctgttcgctttcatccaagacttcttcttcttggccacaacactcgatgacgaagtaaaaaaaaaagcgaggagagggggagcaaattcaccatcaatgcttgctctgatcagtgatcattgctctgactgatcgtttgctctgatcagtggtcatttctctgactgatcatttgctctgatcagtggacatttctctgatcattgatcactttgccctaatcctctgatcattgtggttgtgggtattaaatctgatcatattacttcctttgcgtttctcatttcgtcctctttagaaggatactatcgccactgcccttaatacttcgtccgcttcctttcctttttcttccgcccttaaaaatggctctttttctgctccgccggatgagtccgattcgtctgacggcggtggctccactctgaagattttgctatatttatccgattttgccctttccgtcggcacttttttcatcgccggtgaataacggcacagattaattaattgcatttgtctttcatctttccattgctttttctttagcttttgccctccgttatgccatttccaccctcgtcaggacaaaaatactccaaactcagccctcaaatgtgcaaagggccgtccgattgctccgcgcactttccctcgttggcattgtttccgctgccattgaatttgtccttttggcagaagtgcgactttaattttcttttttttaaattttatatttttgtttttaaatttaatttagcttcgtcttggcaaaacttcttcaatggtccgtcctttgtcattttttcacttccttttccattttcagtctcatctttccgtcaactccgagcttttatgattggtcttccaaattttattaattaattagtttttattacccaactaattaattgtctcttctctcaggcttctcacttctgctcaatttgttttccttttttatgtgactcgctttgaacgcttccaagcactgcttcccgtccaaatactgcaggtaatcagcgaactgatgaatgcttttcgttcaattgctgcatctccccaacaactcattaagcttgcctcggttgggatcactacgcttgatctgatcggacaacagacggacattgtccaaatttacgtgaacagcgttttgcaggtcgtttttacgccactaacaataagctgaaaatgatgccaattttaatcgcaaattcagttttaccgcgtcactgaagcgcttttccgtcgtccgcttctttcctccgccgatggctccgcctccaccgttttcgtcacccattcgtcctctttggccattcccctgcacctttttgtcgatattttggttatttactgtccaaataatcggtaatactgccgatggttgcccgccccccttttttgatgaaaattttttttgttttcaaaagtcatgaaaactgcttccagggctttccagggtcgctgatcatgaatccggcatcaatgtcgacctattttgaacaccgtacccgaattcgaacaaaaagtcgaaatttcaaaattaaattttatgttcgaatctgtgtagaatgattattttctggtgtttcaatggtttctagttaattttgcttgttttaatctattttagaaacaaaaagcgaattctgggaggttttattttcgactttctgttcgaattcgag

SEQ ID NO: 13371 - DNA, 2206 bp, Heterodera glycines
  misc_feature (22)..(22): n is a, c, g, or t
  misc_feature (72)..(72): n is a, c, g, or t
ttatgcgcagtgagcctcctanaaggcacccgaagcacacacaatttgcgtctgtccgtcgacgtccatcanaatcaaatcccttaaaggtgggcaaatacaaaaagaaaaaagggacaaaagtgcctaatcggtcccaaactgggataagtgtcgatgacattgacaaacgaattcaattccgtatctacgggttcggttgagagacggatgagctgagagtcgccaagacgagagccaacaaatgccacggaattatcctaaaaattggaaaaatggacgggggaaaaaggggaaaagaatggcaaaaccaaataaacaatgcattcggggatggagatttcaccgagaagttcaatctgaggaacgaatcggttggttttaacaaatttagcgataaatacgcttttacttttatgtcccgaatttcgtcctctttggccgggtcgcggatcagcaacaacatgaacagtctaatttttacaaggatatttaacaattgttcattttcagatcaccttccagccatatcgcccagcaaaaagcgttcccccgtccggtcgatgcgcccgcaacaattaaaacgcgccatgtgaatgagaggcggggcaattgctgtgtaatggcttggtctctaaattaaaatatcatttttctatagcaatattcgtcgttccctctgcccttttctttttttaatatattttcccatttctccccgttttgaccgtcctctgttcggctcaccttctggtaaatgatcgattcttggcccaccacaattaatccgccgtaaggcgacggcaccggcaccaaaagagtggtcgctgcttcgatattacctgcccaattagttgtgttttttttgtttagaaaagtgtaagttcgcagactttgttgccagagcggagagtgcaattctttgttttccaaatccaattcgcagactttcaaatggcgaccattcaaatcctggtagagataagcgatggtcggttcatctgaaaacttggcattctttataatccaaatttttgtttttaaaagattatttagcaatgtcatgtaattgttcgctatgctaatttatgctatgagaatggtacaaaaagtatcccttcagccaggggcgtatctataaacatttttcgggggggggggggttgctctttacccaataaacaaaaaaccctttttccgctgctgggtaagcactttttcactaaaaaggacccaattttggccgttttaaggcaaaaaacttagtaaaaatagtggaaaattgaggtccggcggtgccgataggcgccgccgggaaaaatttttggaaattagagtgctttttgttacgaaaatcgcctataaaatttttaaattttcgtttgggaggaaattcgaaaaatttttccattatttgctggaaaatttttaaaaattttcatttcggggggggggggaattaaaattttgaggtgtaggcacaaaacggaaaagtacctaaaaattttcgggaatagcaaaacttgcccgtgttttccaaaaatgccacgtccgtgatgtcgtagtcttcaaaacgaacgttgaaattcttcaaatcccgcccgtcctgccattggatcagctttaagtgggcctcgtaaagtcgcagtgcgatcagtcccgactcgtgcacacatgtaatgatccccgtctcggccggccttcccactttgtccgccacgtgtccaaatgcgcgggtccgcggctgtccgtcctccgcgaaactgagaatggccaagtgatatttggcggtcaaaatcagcaaactgttcagttcctgcagaaacatttggttttggattatcaaccgggacaaaactgcctaagatttaatttaaaaaatccctattattttttataattatattttcaattaacattttaatactgtcaattcgcagtacggacctcgccgggaagtttaaaagaattgatggaggcgattcggccaaatattggaatttcgcggtgcggtttaaggccctcagcggtgaccagcaaatgctccacccgactcactcgcgcgaccatcatgtcaagttcgttcgtattgcgaaaattgccaacgacggcgccggtcactacacaaaattaagcatttctattttaagtgtccctttcttcacaacctgccgtcggtttttgcaatgatgcgcaataacttagt

SEQ ID NO: 13372 - DNA, 1480 bp, Heterodera glycines
  misc_feature (1460)..(1460): n is a, c, g, or t
ttttttttttctgttattcaccgaatatcgctaaagaatgaaacatttggctgttcgctttttgcgtcaaattaatctcgctcgatttcatcagacacatatccattgtccggtctgaataaccacattcacgttgtgatccacagcttgattttcgggatcgttttcagggagaaaaaggtatttctttatcaatgctttatttcttcattaaacaattaaaaatattcagcgattgaactctgtcgtagcattttggcacggaaactttcgcttgatctgttaaaaatacgcaatgaatacgaaatctggtgtactgcatttaaaaatcatttgaatgcggaggtgtttgtttctctctctgaaatattcttggaattacttgttaaattaagcacagccctcccctcgaaaagcggcacatccgtgggaaattattggacagctccgctggccttttgtccgttttggaattgcccaacgatttggaccgttacgtcccctcaaccaacagcaaaagtgaaggatcctccgtttgcgatacgacaaacaacaatcagtcactgatcgatgctatcgtctctcaaattaacaaaaatgctcatcgatggaattccgtccaatttcgccgtttcattctcagtgcactccaacgactaatttttactgcgctacaaccaaagccacaaatggtcacttttccgcatttggtcagagccgcggttatcgaagcgtgcaatttgcggtttgactcgtttccgctggtcgtcgaaaatgactcctatttgagccttgcaggtgctttctgattagactacgattatttggcttcaatttcaggcgtcgatttgccctcgctcatttcccctctgatcaaatgccgattttccaacaaatccaaccattggccgctggttttgctctcttcaggaaacgtttatccgtctcttttttctcctcggaccaacgaatccgcaccattcggccaaaatgcccaactttctcttcttttaatggatgaacactcccacaaatgttccgaaactgtccaacaattggccttgttgttgcgggcctttctctccgaaattggcctttcgtttgacattggtttttctttttttcaaaaaatgttgagtaattaaatgcattatttagctgatgtcaatccgccgaatttgtttctttacgaacggtcggccttttccttttgccactcgacgatggaattggcccgtttctctaacatcggttagtttttatatttccttttaattcattaaccaaatagaaatttaggcgattatgtgagcaggcgcgctcagataaagaaaataaacgaaggcggtgacatttacttgaaaatggcttttgtacgggtgaatttggatgccatcgtcaattgttacaaattgaccatttaatttagttttctaataaattcttttgactttttcaantgtgttaatatccgtattct

SEQ ID NO: 13373 - DNA, 1453 bp, Heterodera glycines
ggtacaaactgcagatttatttgaattttggcttctcttctcaaaaatcgcttcttttaattaatcttaaattatgcacttggtgtggcaaaaaatcacagactttgacaaaaacaaaagggggcagaaattttttgaccaaagtaaatagctattcatgatcagagtaactttaaaattgggctctgttgcagtttaaacgaccataaaagacaactttaatgcactattactttttctagaaccaccaaaatttaacatccttgatatcactcgatagccccaagaatattctattagcctgcaaatttcaaaaattttgttatgtttcaaaaagttatgcccagaaaactttaaaaaacttgttttccaaacaattttatcaaatcttttttaaaacaataaaaattatgaaattcaaaagggtgccttttcgtttttgtcgacctctactctatacaagtgccctaaattactattgttaattcagagagttaaagtaaaactttctcattttggcctctattacatctccaatgacagcgatgacattaaagaagcaatttgccctccaatgtatcatttccaatatttgttcaacagttatttagaattttaatttaggtattttgcaccagaatgtgtgttgaatcgaagggagaaattgtccttttgcactgacatttggtccttcgggattttgcttgttgaactttttacgggatggcaatttgccaaaatttggagtcggaagcaagttgtgtctgtgcttcggtcaatcattttcaaaagttattttatcttaatttaattacttttccacgcttcgttttctttgaacatttttgctaattttagccaaaatgggctcgtgccttgaaaatctgctcgattctgtcgaagtttcccggcccaccttcaaagagtcgcgtcactttctcaaaaatgtcctttattctgtgccctttgattgtctccaaattgctcccgtggacagacccgactcggcgactttactcaaaattttagaggacgaaaatcgacgaggagaaaacgaaatgactaaagatattgcgactaatcagcccattgatgaaacaattgattcgattaaaggtaatttggcgaatgtttgtctctcaattgacttaaaatgaagcccctgctcattgtcagaacaaattcgcaatgagtcggaattggccaaattcggattcaatggccaaacgatcaacgaaatgtttttcctgtggaaattgtgcgggagcagcgtggagagcattctcatccgaaacggagtcatcaaaaaccggccgccggtgctgacacttcccaggtgaaacactgcgagtttgataatatgttagtccaaatcaaatgaaacagaaatattgaaaaacaagttctatggcaatcctgtggggtttctgatttaaatttattgcatctcgag

SEQ ID NO: 13374 - DNA, 3550 bp, Heterodera glycines
ataatagattaaaatttgaaactcccattctgcaggatttacgattaaatacgagtccctaaatttgtcttatgaaattgcttattgtcagattagtcatcgatgatttgcaactttacgggaatgaaactgctcggaaagtcaatttgtctctgaatgtcgccgaacttccgttgagcaacctttttgaagtgccatgccattttcccatttgcctacccaattgtttagagactcaatgccattcctcgcgacgatttgcatctgagcatggaatttatgagcatttgtggccgggagggaaagtggaaagaaccctctccgaccgtagaagactcagtccaatctttggttgtcagggaaagggacattgcttaccaggtgatcagtgattggttggtttcggatggaatatttctctttaaacagatttcccccttgtttaaacgctctccttttgtttaagtttgaacggatgcgtttgtttcgtcgtctgttgtccgcctttcctttcaaatccgatttgttccgtttcgaatgtcaaaaggatattccgccggtgtatcgtggtgccatctgggccactttgttgggtgttttgcccacgtcttctgctgacgatgggtcaaatccccaggatgagttttacaacattgacacattttcggagcattccgctgatcgccaacttcaagtggacatcccacgttgtcaccaatacgacgaattggttgggaaaactcccatccgttttaacaaactttgtcttcctccacttaagatggcttctccgatggcccatcatcggatgaagttgctgatcaaggctttgctcgtctctcgccaggacgatgactttgtttattggcagggactcgactctttgtcggcgccctttctcattttgcacttcaatgatttatgtgccgtcaaaatgcccttttcccccgttgaatttgctttttccagcgaccgcttttcgttgtctcaacgctttcattgagcgttaccttcgcggctttttccttcgcgacaattcgactgtgattcgcaattatttggctgagtttatgcgcatgctcgagttcgtcgactcggagctgttcacccatctcatttcgttggactttcttcccgaactctttgcaattccgtacgttttccatgccgtttaattttcatttgctgtttttgaggtggtttttgacttgttttgcccatgttttgccacttcataaattggttggtttgctctttctccctttttttctgatttattaaatcgctcattttcagtttcatttatgggattctctgcttcttgccgattcgtattttcccctgtgtctttttttatttttaaattatttttaatttattttttagttttattggcgttgctattctcatccaactcaggtctcgtctcatttctgtcagttttaacgaggcaattttgttgttttctgacttgccaggtcaacccaatattaaaaaaaaaattatttgcttaataatttgttcatgtttagatttacccattgatgaaattgttcaaatcgctaaaattcattatgccaaatggttatcaacaagtgatgggcaaaacacgtgaaaaattataattagggctgagattatgtattttaaatcgcaaatagtgcctaaataagtgaaaaatcccttaatccccccccccccccaaataaatgctaaaatagaatcacaaacatttcaagcttttcagaataggtgcaaaagtaggtgaaaagaaagtcaaattttaaaaatctcccccagccctgagagacttcttaaaaataggtaaaacctaaaaatcttgccctaattataatcaaaatattttatagtgcataatttatatattgtattttaaatatttatgtgtatgatatttttaaaataaatgcataaatatttatacgcattgcattctccatccaatcactgacaatgattcgttgtcttttgcctcataataaatttctgattttaatatccataaaaaaaattttatcgttttttctgaaatggcaacgattctttctcatttcggcacgccatcagctgacggcgtcagcgcaaaaaaggtgacagagcggcagccaaagcaaaaaggagacggcacaaaagaaaatgggacgccgaatcactcgacaaagccatgggtggagaaatagtgggcaattagttattattgtgggacggcctggtaaatgtgctgtttaagtaggccgaaaaaagtggaggaggtggcctaccaggaggaagtggttgccgtgctgaagagatgtgtgcagggcgcggatgtggggttttggcatttgcaattttactttttaatttataataatgccgactgattattctcattcagttgccgaatttgttgttttatgggccacccggaaccgggaagacttcggcagccgtcgctttgtgtcgtcaacttttcaaaacagcacaactttacaaggacagggtgttggaattgaacgcttcggacgagcggggcattgacattgttcggcacagagtgcgtttaatttttgccaaaaggattcattttcatcgtttaatgattggcggactttcagataaaagaattttccaaagtggccatttcctctgtccgcgttggcaaagactcggtcgtcccgttgaaagtggtcattttggacgaggcggacgcgatgaccagcgctgcgcagtccgcgctccgacggacaatggaaagcgaaacgcagtcgactcgcttctttctgatctgcaattacgtcacgcgcatcatcgagccgctcacgtcgcgttgcgcgaagttccgcttcaaaccgctttcaatggccgcgcaaaaggaaaggtgtcattttgagacgggcggggggggggcgacaaatgccgactaataaatagtgacgcggacaaatattgacttgatcagaatgttggacatttgcaatgctgaaagcgtccaagctgatcaggaaacgattgaagaattggttaatttctgttgcggtgacctgagaaagtccatcactttgctacaatcgttggcctcccttggccgccaaatttctgtgagcgatgtccgagaggtggcgggcaaaatccccgacgaagaagtggctttgcttataaagacgtccgaatccaaaaataccgaaaaagtagtcccaatgccatgtttaatttcattagatcatttacaaaaacagatcctcgacaccgttcgacagattatgagaaagggttacagtgtcacgcaaatgcttatacaattggcggacgttctgttggaggagagcactttggaaccgatcaatcagtgcagagtattcgagaaaatggcggtttgttttaaattatcagggttaccataacctacagtaaggagacaaaatgttttacggttaaggaagccgagaaatgtttaacggacggggcagacgaatacctccaactgttggacgtagcactgacaattaagaaatgttttatgaagccaaaccatcccaatgaaaatgat

SEQ ID NO: 13375 - DNA, 2993 bp, Heterodera glycines
tgataaaaatgagattttttttagaaattaacttgttttttgagcagttttttcaatttttggcacatattttggccttttttggggtttttagcacatattttgagagttttttgcacatatatatgtacatattttgcgttttttagcatatataaatccgttccctgtttataaagatataatccggaatagtcaagattcagttagtccggttacactatatagtatcagcataagatttacttgtagccgcattcagaaaattattcagataccagaatacaaaaacccagaaaacatattctttggttccgggcattcttgactattttaggattcgtgaagccttttgtttttgctaaatcacggttaaccggataccggaacttcctgatttttttgggtccggaagccctgaaggatttaagtacgggtatttgacataaattttttggagaaattggcatgttttcaaacgcaaaaaaggccacatttaatacataaattctactttctaccggtggcaattaccgtaaaacttgcctaatccaatctcatgtacaatgttccaccaatttttataacgttcatgaagcagtttggtgtcagaaagttcgtagtttctttcatgcagatacttggtcgttattttgttaaattgttgtacaaattgctcgtaaaatgtgtttaatttggacacataatcctgctcttcaccattgtccagtgtctctttgatagacgccacagtaagcggcggtgctacagtatcttagaaagaatgatcaaaatgaattgcgagcgtgttggaaaattgcaaattcctacaccctgcatttttcgtaaatcagcaacttagatactgtaaggaagaagctggctgggcgattaaaacgcggaaagcgggggttgttaagatccataaaagaaagggcggatgtgcctcggtagcggtagagctgcccacggaaagggtgcatgagtgggttcgattcccacccgaggtttaacattttgcccatttcttattatactttacccaccaaaaattggcgtagtttttcagaaaaattgagtagcaaatagatatcattcattctagccctatgtattctttattaggaatttcaaaaattacattaaaaatcaaattaaaaaacaacaaattaaagacactctcattcggtttgaaatgcaacagacgacttcaaaacaatggttagcatcaattttggcatttttgaactattgacctttttccagaaatttcatagcaaaagtgccataaaacgaaaagtacaccccctaagaatcgatcacaacaatttcagaaaataactcctaaaaattgaccaaaaggtcaaaaaataaaccctaaacatgaaaaaattttcccaaaaattcgccttcaaaatttattttttattttcttgacaagttggcattgttcaggcgaaagacttttggaattattgtgcctaaaaacattgaatttttccaaattttaacatattttcgcacctattgcgtattttgggcgtttttatccgtggtgcgacttttggggatttgcaacttggggacccgacatttggggacccgacttttggggatcccgacatttggggacccgacatttggggatcgacatttgagcaaaaggcacttaaggaaaccacggatatttggcaacccgacatttagggacccgacatttggggattttaataaaacaaaaaaaatattagaaaatttaattttaagcccaaaattagacaaattgtgccagctttttacttgcttcgacaacgagcgaatgagctcggaatacaagttgttccaattgcaggacaaccaatcgcaatattcgattactttgggcggtattgataaaataaattgaattgtttattcattatatccaagaaactatgtgcgtggtcacgatggaagacctccactgtttcctgttcatacctggaatcaccatgatagtgttcttcaggacttggggcgcacaaataacgcccaagaagggttccatttggctttaagaatgcaatttaacagtgtgcatccgccattatcgaagtgaaaatcgcgtttaatcagcttaatattttaattatcagagttatcactgttctgaagaaagaagagcgaatcgcagccgataagctgcggcagtatgagttggacccaactcaagggataagaattcgagaacggaagaaaacataccgtgaaaatgatttggctatcagaaatttggttgaaggctttgatgccattgagaacccaaacgaagatgagattcttgctcatctcagatcgttgcaatacagacttatgcgcaatgattttgagaattgggacgacccaaatggtgattaattctgttttcacatcccgttggcacttgggaaaggcactttaaataaaattggaaaaaggtctactgtagttaaaaaatgtattgtggtttgtctattgtgttgtggttagtatgggctcaaaattctgcgcctcctcgcggtgagtccggaaacagagttaatttttaaaatattaattaatttttttgcaatggaattaactctggctaaagcagacgtaattttgtctaattttgtggcttagaattaaattttttaatttttttttgttttattgaaatccccaaatgtcgggtccctaaatgtcgggttgccaaatgtccgtggttttcttaagtgtcttttgctcaaatgtcgttcggtccccaaatgtcgggtccccaaatgtcgggatccccaaatgtcgggatccccaaatgtcggatccccaaaagtcgggtccccaaatgtcgggatccccaaatgtcggaatccctaagtgtcggatccccaaaagtcgggaaagtcgggtccccaaatgtcgggatccccaaaagtcgggtccccaaatgtcgggtccccaagttacaaatccccaaaagtcgcaccacgaat

SEQ ID NO: 13376 - DNA, 4273 bp, Heterodera glycines
  misc_feature (75)..(75): n is a, c, g, or t
agaaaaaagcgattaaatacaatatttaatttaaatttttattctcacataatggcaccggcacatccaaaggcnggtatgtcgatgtagagcgagaacgggcaactaatgaaatttaaattaattaggcaattaaaatgcaaaagtcaaaatatatgatgaattttttacgaggaacagatttttaagttttagactttttttttttgcggatagttcttgatgagagaagtacgaaatcaatctaacattttttttcaaaaatacaatcgattttttaaaaagcaaaaatcctggcgccatgatttggcggacaaccgaaataaaatcttaaaatgtgtttgatttacaattgtgtaaccgaaatggacaaataatgaggcaattttggaaaattcacacatttcttgacaggtttttccaattttttagcaactattttggcatttttcagttttttagcaactatttatgtacttatttcgctatttttagcaactaaaaatccgttccctgactattactatgtatttatggaatttaacacatttaaaaacgaataacaaatgatacggaagcgctacgtgcagccgcaaattcagtcccgcgcgattcgcttggcattcgcgcagtggacgccgaacggtaaatgccatacacgcgacgtggcattatttgatctaaaaataatcttagaagggaagaattggttgttaaataaccaaaataagatttaattattaatttaaatgattgctggcgaatgtttaaaaaagaaattaaaattaagcaaaaaattttcaacaaaaaatagaccattcaattttttcagactataaaaagaattatttaaaaaaaaaatttaaattaatataaaaatgggtaaaaatccattcaaaggaaataaaaccgtggacggaaaattttgtttaatgctctaaactggcaaatatatcagttgttttcttcactgacgagaaaaattgaattcgtgagcttattgccgtgggtaattaagccaaaagggaaaagcaatcgatttgtttgtgattgctttcaacttcaaaaaatgggctaacataggcgagaaattggaaaagttaaagaacaataattgtcaaaaataatttaaaaattacaaaataataaaacgaaattatttcatctgccatattaagctgattttaacaatatttagtgataatggccataattgtcattttctcgatcagatttttctccctcacttcaccttttcctcctcctcccgatttgcttcgtccacaaataattcggtgaccaaaatcaccgagtccttttcctcgtcgtaccacccattggccgggtccataaatttctaaaatatgatttaaaattaattcatttagtaaacatttcgttcctccctcccaaaaaaaacagattcaccccttttattccatccattttgcagaattaaaaatatttgatgttttaaaatattctttaataaatggtgctcgctaaatgggtcttacttataatggtaacggtgaaaccactaattaccgttgtcgccgacaaaaataggtaaatgtgagttttggaatttttcttttttaattaaaaaagaaaacaaagtaattatttttcaacataatttgactaaatcatgggaccgtccctggggtactggtgttttggggttcgtcggtgtcgatagacacagacggagaaaattttgaattggcaaaattgcttttatcaatttgaattaaataaaaatccaaactgctgctttctgtgccgttcccaattcatttacctttaacggcatataaaccagacattccgggatacatttcgtgatctcatcattcaccactaaatcctttttccccttcttttgtgaactgatgagaaacgaagccgaacacaaaggggtccaatcatctgaaaagtttttaaatcgaagaaacattctaaggaaaattagaggcgcgccggtggcggtgcaaataggcgtcaccgggagacttatgtaattcatttaaattattttttacagaaaaaatttcggagcggtgaatccggatcttttttttttttgctattcgggccaaaaaaattttctccggtcttcttttaaaaaattcagcgactaagagccaaaagcaggaattttagcagcttttcgccaaaaatggcctaatttttgccattttggggtcaaaatttaaaaccaaaagaagtaaaataggggtctggcggtgccaataggcgccaacgggaaaattttttaaaatattaatacagtgattagaaaatagattacaaatttttaaattgttaattttttctggaaaaatttttaattttggaggggcggaattcacacccccgccccctctggctatgggcctgccagcagaggagggcattcccccgttttcgtccccccccccacaattttatttatttttccgctgactttgttcaccaattttttgttgtcgcattcaagataaacggaaaattccgcattcagatcatttctttttggcggcatttcagctagactcatgacaatgcttcttctgttgatgatgccaccatgcactgattacagaaaacagtgacacctgatgagcatatattcaagacattttggcccataaaacaataactgttgaagtgaatggcatggacacagtgaaagatttgaagcaattggtagtattcatgttgcaacttttttataagttgttcaatcgcttagaaaaaccttaccaaaagcttctaaacatgtagagctttcgaatgatgccaaatttataaaattttaacaacaatgaaaaaagttatgatgttttatgcttggctcagacgcatcggcaccaccggaccccaaaaatcccaattttttcttaaaaaattggctcaaaatcgcaaaaattggccattttttggtgaaaatctgttgacaaatcacacccaaagctcaaaaaattttcccggcggcgcctatcgtcaccgccggccccaagttctcgaaaagttttttggaaaaagcgcgccgaaaaaaacggtgtttgaaaagcaaaaaaaaggtcatcggcggccgacctcccacacccccctttttaatgtatgcccccaaataacgtttttttgcattttctcggcaactctgttagaaaaaatcttctctaaattttcaaaaaatttctgccgtctgcttggcaccgccgttggcgatgcttttttctcttttgcattttttagccattacttttttttcattttttaccctttacatttttccctctcttttttagcgtcaaaattttccgctttctggaagattttcccgtggctttcttccccccaaacagagtcaaaggcggtggccgcgttggacttgggcggtggctccacccaagtgacttttttgccgaacgatttcaacgccgcgctcaaaggcctctccaagcagaaatatgcgcacaaactgaagattttcgaccacgagctgaggctgtacacgcacaggtcctttctccgtttccttagcaccgtaaaagaaaaaaaaattcccaagagaaatctgaaattgtcccctcttataatactttttccatagatacggcccaaagacaaaaaagggcaaaattcgtaagaaaaatgaaaaaaaaccccaactagactaatttgtaagccaaaataatgggactgctactgcttaaaacaacgaaaatttcttttttttaaaacccaaaaatttttataaattccaaaagatttttttcaagaaaaaagttttcttttattttatttccttattttttgtctccggttcagttatttgggcaacggtttggtggcctcgcggctcggcatcgccaagttgagctcgcccaactggaaacccggcgcgatgccgtcactgcacacgcactgtttgcccaagggctttgtgctggacgactgggactacgcgggcaatgtgtggctgatcaggtgggggaaaggaataagcaaaagcgaactgatcaaacgaaaaaaaatgaaatgaaaaatttgtgccaaaattttgactcaaaaaagtgccatttttatgagtcaatttttatctgatcgacaaaaaaaggtagcggaaataagggagaaaaagagggacacaccccaaaatctcgccgcagaaatttcaaaaaaaaaattttaaacagaaatttttcaagaaaaaaaatcagaaaattttttataagaaaatattaaaagaaaaaatttaaaa

SEQ ID NO: 13377 - DNA, 701 bp, Heterodera glycines
aatttttttcagtgtaattggcttaaattttcgttcccgtagaaaaaaacgaaatctttggcatttgagacctaattttgggacccggcggtgccggtaggcgccgtcgagaacgtttttgtaggtttttaatgcgatttgttaccagattttgatcaaaaagtgctaattttgtgaatttccggaaaaatttagcgaaatttttaggaaaatttgggtgaggtatgtctcagagagggtaccagcaaggaaattcgaaaattttcagcaaaaataatccctaaaattttcgggtacgtacttcgcgaacccccccccccccccaacttactattgtccaccgccgcgcgtcaccgaataatccacacgaactttcatcccatcaatcactgcatcgaccaaattttccttggccttaatgtttacttttgtttaatccaaatttggagaatggaaaaatatgccataattttgcaacgattttttttgttcaaattcaggtccggaaagacaatgacaattgggcaatgtcatcatcgttttttatcagtgactctgttttaaatgacttaaaaatttaaaaaaaaattttcagcgattttttcaatttatgaaaagttactaagtttttctcaaaagttttcttaaaaatcgctgaaaaaattttcaaaattttttttctttcttagaattttcttata

SEQ ID NO: 13378 - DNA, 4157 bp, Heterodera glycines
tatattctagagttgagcgggaccgggacctgaacacggacaactgagtaccgaagtcccggttttgaccgggaccgggactagccccggtttttcccggttttcccaaccaaattcccggtttttcaacccgaaaaggtcccggtcccgggtttgcccaaaattcccggtcccgctcaactctagtatattccataatttatctatttatttttaaggaaatgttttttctgaattttattttcttctttttcgtgttcaatgttgaacaacatttcaccctcggcgacggatcaaatggaacacggtaattaattatgtaattaggagaatgtgacgaaaaacttgaaaaaaatcggaaattttaccaaattggatttaattaatctgaatagaaaatttattttacttgaaaaataatagaattactttttgccaaataaaatattttaagagattaattcttttaccaaatacggaaatttagcaaaaaccttcccaaaaatcaaaagtttgacaacagaaaattgtttatagcatatgagcaataaaaagttaaaaaaaataattattataaaataattatgcaaaattaaagcactgtgtcaatggaagcgactgaaaatggccccaaaacaatcaaatttaaattgttgtatagaaattgttcaaggttttcttggacctatttttttaataattatgtaattgaacaatagacacttaccaattaatgttaattaagcttttggttgtgctacaaaagtgcattgaatgccacaaatttgtcgtggaaattggcgaaacgtttccgattcgacaaaatgttgagcagcaacccaatgatcaatgacagtgatgatgatggtgatcagttttgtggacaaaatgacagaaaaatccaatttttgattaaaaatgaatcaatcactatcggaggccaacagttgttcagcaggtcaatcaattaatggcggattaaggaattgatttgaatttcttcatattccaattcaatttttaaaataatttttatgaatttttttctttaaattattttctcaaggaaaaagttccagtcccgatcgaaaatcaaggtccccccggtcccggtttttccaaaaatccccggtcccgctctactctattacaaaaaactattagtttttttaaatttttttaaatttaaaattaaaatactttaaaaaaagttttccctttcttttggccaaaacacaatttttgagaatacaattcattaatttttttttttcttttctgtggatggaggtcatttcttatgctttttatacaattttgttgtgaattttttgaaaaatttattaaatatttaaaaaaatttggatttgcaaataattgtttccttttaatttaattgaaaatttaaaaaattatcccaaaaataaattttacagatcgaaaccggacggagaattggcttttgcgctgcaattggaccaaattttgggcaaagttttcgctttcaatttaggcaggcatttttttagaaaaaaaatatctgccaaaaaccaaaaatttggcatttttttagttgaacaggaaccaatgaatatcagcaacgaattttttgaccattcaaattttggatcatttttaactgattatgccggactttggctgttgccagcggacattgcgccaaaattgggtcaaaaatccaccaaattaacttttgttgtgccggatgaatgcatattcatgccgaacagaaccattgtgccgccactaaagtgccgcacttttaactttgaagcggttacacggcatggccgtgccaagagacgaatcaatccactcgtaagatttgtgttgagggaaatattttatttattttttggcatttcattatttggcactcgctattgcgttttcattgttggcatatttctttcttgcgcttcttagactctttattttttgtaaatattttttatttctcgaaaatgattttttgggtgtttttcttaggcatttttcaatggttggcactttgatttttatttgtctatttctttggcacttttttctgccttttttcccttgggtgcatttgctattcaattttttcttcttttacatttctccatatttggcactttttgggtctttttctttggcatttgctattaattttttttcttttacatttctcggcactttttatacatttttccctcccatcatttttcagatttacaatggcactaacacggagataaagcatttgccatggactgtgtattttgagggcattaaaccttttaatgccacagcaaatattctcgagtcgtgtactgcttcgttgatttcttcacaatttgtcctgttggcagcacattgtttaaaaggcgttaacaaaattaaattgggtaaaaattgaaaaaaaaaaataaaaatggaagatttaaaatttaaataccctaaattctagtgatgctcgagagtctcggtctcgactcgagaaaagtctcgggtttttttttggtctcggtctcgagtctcagtctcgggttttcaagtctcgattttcgagactcgagaccgagacttttttacacccctaatgattgttggcctttggtaaacttctatttttataaattttaggttttttttgttaaaatttgttaatatatgcgtggtccagcgggttgtgttcttggttttggtccttacttttgcgttggatcagttcccctccaagtatcattttttcttctcatttttcaaaattaatgtttttttcgatgggagttcaaacacaattttaacaattaaaatcgtaaaaatgtcatttttggactaaatctattaacaaagtgcactaaaaatttcaaaattttctccggcgaaaagttttgtcagcgctaacaatgaatcggatgcaacaacaacaaatgctggagcagcagcctcgggcaatgccaacaacaaaaagcatgcggttggcacagtgccaacaacaacatcaccaccaaatgccatcacaatgattgacattgaggaggaagaaccactgctagaaaagatggacaaagacggtgtaagaaaggtgccagaaaaaacgggtgcatcccaaaatctggccaccgaaatctcgccgatacaagatcaataaaaaacttcaaaaatagaaatgcaaaattctagcgattttcgaaaattatgatgaattactaattttttcaaaactttttcagaaaaatcgctagagaaatctttacaaaaaatttttcttgaaattttcttataaaaaattatcgaagattttttcttaaaattatcttacaaaaatgtttataaaattttaaatttaaaattcggcggcacggttttgttgcggcaatatttcggtcggaaaaatttcgtcccatctccgaaaaactctcttggcattttgtggaattttgaaaaattgaattttagatagaaagtcaaaagaccagccgcggcagagccaaattgccaaaagcaggacagaatggaccggtcagtatttttttttttggcattttgtaattaatttccattaaaaaatatcagtttgcaagcccacgaccaagagcaaaatcgagcgggccaaatgggccggtcagtgattgtttggcattatgaaaaatgattttttaaataggagactggtactctggtccgtaaaataactgctcctccaacacattctgatcaaacacaattatcatcacctcatcagtccaaacctcagcagctaaacaaccaatacagtaatccgaggaatgcggacagtacagtaatgcctaatgaggtaatgagcaaaaacatttttcattgaaaattcaaaaatggctaatttctgagttagtacttggctcttaatgttaaaggaatatcgttttcttcctgaacttgcctatctattattgttttgtatacatacaaaaataaattaaaattaaaagaatacatcgccaaaattgcttgggttttcaaaattatgtctcacgccgggctcggatcgaaaattttccaacaatacgagcatccaagccaaaacataagattttagggtcaaaaataagaacatttcgcaaaattgcttcaattcagaatgatttttcaatctattcgatcgaaaa

SEQ ID NO: 13379 - DNA, 1292 bp, Heterodera glycines
ataaatgacaagaaattgatgaattcgattgtttcaaacgaaaaatatgatagttaactgatttgttcgcaattttatgatgtttaaaaaagtgaggatttttcattccaattgaggatttttttgagatattttagtggcaaatgaggattttttatggctgaaatgagtattttcaaattttgagatcgaaaccctgttttaaatcaatattttattagaaccaggggctcgcaagtttttttcaaaataaggactaaaaaataagatttttttaagggctcggatcgaaaaattttcaaaatcagaacatcgggccaaaaaatcagattttggagtcgaaaatcagaacattttgcaaacttgctttaaatcagcttgcgtaacaattaatcaattaaaatagcatcaaatttgtagttttcagccaggaccgggacctcgatttttttcgggacctggaccggcaaccgggaccaaccgggaatttttaaaaattcaaaaaaattcaaattttaatttttttcaactgaaaataatacaaaattaaatttttattttgttttttatttaatacaatccaaaagttaaagttaaagctaaattaaattaataaaaattttcaaacaaatttctttaattatttcaaacaattaatcattttttgggctaaatgattgaatataattataaattaatatttgcttttcatatagcatttttcggcttgctttttcaaaaaatttttgggaaagaaggggtccggcggtgccgataggcgccgccgggggaaattttgaaatttgggtgtaatttgttaacagattttcaacaaaaaaggtggtttttgggattattaagctcaattggtaggattttcattttaaaaaaatgataaaatgtgtcaattaaaataaaactatgaggaatcatattttgtcgataggaaacccatgagtatacaaaaaaaaattcaaaatatgtcagtttctgtagagggattgaaccagaggaaagaagaagtgaaagtcaatgagactagccagtaggccatccgcacaatcataagcgttacttttaaagaatatattaatatatttttaaaagcttttccttttaactccaattttatcactaatttttcactcagacccccattcttaccagtgcttgttttccccggttcccggttgcgttaccgggaccgggacctgagcttttcaaaatccgtgaccgggacctcggatgaccgggaattcccggcccggtcccggtcctgtggcactccagtt

SEQ ID NO: 13380 - DNA, 1310 bp, Heterodera glycines
tagggttcggaccccgtgggcgggggcggaggatggcgggggtcagagtcgcggggacgggggcacgataatttcgccgccgcggggacgggggcgggggtttgatttgaattaactcctaaaaatttcacaaaaaattaattttttatgaatgatgtgatggctccacattcctttagtcaatgtatcgcctcaattcaattccttttggcataaattacacagattttgcctaaagaattaccaaattttagagatttttggctaattttttaagaaaaaataggtttttggggggcggcggtccgataggccgcctggcgaattttgaaatttaagctcgatttctaacagatgtttacaaaaaaatagatttttacgataaatttttgttttttttaatataataaattatcatgatttattcaagcaaaattggaactcagatttttaacatattttcttgtggcacattttccaaaaaaaaaaaacttggtgaatgtacgagcgtagagagaggtccggcggtgccaataggcgccgccgggaaatttttttgaaaactatggatctgttaatagattttgtccaaaaaatgataggtttttgctatttttagagaattatgccctgcgatgccgataggcagcgccaggcgaattttaaatgcagggggccgttttaatagaggttttttggaaaaatgccaaaatacggaaatactcgcgaaatatggataaatatgaatatagaaatccatccaagaagcttcaaactaagctaaaaacatgtttttcgtgcgtttcaggcctccaatagttcaggaaaaaatattgatttccatataattaccagccctattattcataagtggtatttttccaatcttctgattttctcaaacaatttgtgagtccattgcttggccgacaaaaatcagcatttggagtcaaaatcagcattttgaaaaaatcaaaaagttaacagattttcagtaaaaaaatgataaattttagcgattttgagcgtttttgggtcctgtgatgccgataggcaccgccgggaaaatttttttggaaattttaaagaattttattacatcatatcgccttattttgaaaatcttgggagtttcaaataccatttaatttgacttttatcagagaccccaaaattcaggacaatctgaaaatttaggacatttttgatttttctctccaattcaggacaaatctgaaaaaccaggacacttgggagccctgattaagaatgaatgcatcggaatgaccttttgataaaaatattagtga

SEQ ID NO: 13381 - DNA, 970 bp, Heterodera glycines
  misc_feature (142)..(142): n is a, c, g, or t
gtaatgatacaaataatacatacatatgtaagcattttatagaatgaatggtaatcagttagcaaaataaagcatgcttaatcgagtgaatattcattaaaaaaactttctattcgtaacttgatcaaatttactatgcttntaaattagatggttgcaatttatagacaattaaaaataattttattttttaaatccttaatttagtgccaaacttcccggtgcccaaacttccgcccccattgaaacaatgcagcataacaatattaaattacaataacccatcactatatattcttctctttaaccgagcgagatgcagttaatgtgcgctttatccaaggagtgatttcataggacttacactcttttaaggtaattttgctgcacgcgaggatggtcagacatttgtgatcagcagaagaggcaaaagttaaattggaatatttcttgaattaaatttaaattacgggagggggcgagcggcggcagaataatttaaaacaccttttttcgactgaggctttttgactcataaaatgggtgctaagtctttatataaaaaccttcaaaaagggcgtcgttatataaaaagctatcaaatgaaaaatttcaacctaaaactgtccataacttttgtcaaagtcaacaaaattaaacattcttggtatcaagcgatagcccaacatttctctattaatttatctaatttccaaaaaatttggtcaaggttcagcaaaggtatggccaaaagtacacaagcaaccaggttttcaaaaatttttggccataacttttttaaaacctaacgaaattttttttaattttgcaggctaatagaggacacatagggttatcgactaatgcaaaaaaattaaaaactaaaataatttctaacagaaatttttaattaaaaataaaattattttgatcatcaaaaattctgatcaaaacattcttagaacgaaca

SEQ ID NO: 13382 - DNA, 5098 bp, Heterodera glycines
gttggcaaagaaaaaagttatagccaaaaacttgtgcccgtacgaaaacgaccccgaccctgaaagttatacttggttgaataattgatcaccataaaaatgatcaatttttgatcagtgccatgactttttgtagaagcatccaaattaacaatcttggtatgctttgatagctctaagtgtcctctacttacctgtaaaatttcaaaaaatttcattgtgtttcaaaaaagttgtggcttgtaattttcataaatttatttggtaaatttttttgatcacaacttttttgaaacttaacgaaattttttgaaattttaaaggcaaataatggaacactttaggctatcaaatggtaccaagaatgtttaatttggatgcttcttgaaaaagttacggtgccttaaatttgtaaaattattatattgtcatgtcaatttttcgtggtcttgtaaactgaaatagagccaaatatattttttattattattagcttatcattcaattataaatttaaataataattaatcattagaataaatcttcggtactgaaatgacccgccccttctgatcaccactcattcggactttttgcacttcgacacagcaccgattttttgtatttcctataaaaaataaaattttctccctttaaacacaccgcaaaaagcgtggcattgaagcagacggtgccatctgtgaaagggacattttcgcttttatctttaaaaaatgctaaaaataattaacccaccgctgttcaacggcatattcatggacacaagacgctgcaaatggcaaaaattattatttaattaattcactaattaatgagagcaaaacaaatttgattgttttggcctaattaatcaatgagggcaaaatttaatttaattgtttttttggcccactttgcatgccaatcggtgcgggcacagtttgccgaagccgagcggtggcgaaattttgcgcagcaatgtgaccacgtccaggtgcttgatgcgccccttggcgtccgggtcgtactcggaccacaagcggacaaactcctcgagatggtggggcccgaggatggaccaatcgcgggtctgccggggggagggggtaattaaattttaaaaaatagaaatggcgccaacactgcgccagaaaaccccaattttttggggggaggggtaattagagtggggtcgattgggcccaggccgatttttggggtataactcctttcatagtttaccgaattgaatgaattaaatcccattcaatagccctgagtgttctctatttgtctgccaaattatgaaaatttcgataagtttcaaaaaagttacaaccactaaacttaaaaattgttcccaaataccgcgctgggcctaatcggcggggcccaatcgacccagtccggtaattatgggtaaaagtctaatggttcaggctttttaaaaattttgagtttttccatttaaaatttcgaatttcgcagtaaattgtttggtatggtcgccctattcttgaaattttttctcaagtattcgatggctaatttgtaagcgaatcgaagcaccaaatagtcaaagttgtccatgatgaccgcaacaaacaggttgatgatgaggaaggagcacagcatgaagaaggagatgaagtaggggtaggcgaaattgacacctgcgcaagaaaatttggaatttttttttgaaaatttaaatttaaaatttaattttccactcaccgcaacccgcgttcgggtcccgcttgtagtcatcactggccgggtcgcacttcacctcctcccggtccgagcaggacaacatgatttcttgccaagcttcaccggtagcggaactgtgtaaaaaatactgcttttaatgggctaattaattaattaattaatacattaattaaaccaaaatgaatcgaattagcacctgccgactgaaagagttcagaatcaaaaaatgggaatttccaagaaatttatagtcccttcgggaatgaaggcactcgggaatttgggccgagaaaattggaaccaaaaatcatcaaatttcccgtcgggaatcatgcgtggtgagaaaaaatttaccaattttggctcgagaatcatgactaattaatcgtataataattattattccccatcagataattagttggatttgggataaaaaaagccagggaatttcccagttttagctcgggaatctcgactaacttaatcgtataattaattattaaatcctctaccggaacagcacaagcaccgcagcggggaatgtgtggaaattgttgttccgatggatttccgtgtcgtcgtccaatgccactttgccgaacacttgcatgccaatcacagcgtaaatgaagaacagcagcacaatgagcagggccacgtagggaagggcctggggcaattttgaaattcaaaatttaaatttaaaatgccaaaatggacaaattccaatggacacacctgaaaggatttcataaatgtccacaacaatgtgcgaatgccttcccctctgctcaacagtttgaccaaacgcatcacacggaacagacggactgaaaaaaatgtaattgaaactctttaattggtaaaaaaatgccaaaaatgtcacggggggattctgatcacattccgatcagagacttattgtattatgaaattacaattttccgatcaattccattaaaattaaatggaaatttaaatcagattagtcacgcttaaattttaattagaaacccaaaatgccaccaccgcggggacattgatcattttcgatcagaattattggaaatgaaaattttcgtcagttcccactgattccgcttatcctttagactctcgctgacctgaagctcaactctctatcaaatagaattgtttttgatcagaatcacaattttcctttttggaatgttcgtttaaatttgatcgcagccaaaattcgatcggataaattaatcatcgatttttgccaatttgattttaagataatatgcgactgatcagtcggctcaactctgtcccttctcccctcccccatttttcaattttccaaaattaaaactgacaaaaattgatggaaataatgtttgagccggtgccgccaattttgccgtaaatgatgtcgatgaatgagccgagcacaatgacaaaatcgaaggaattccatcggtcgccgaaataatttttcggatttagcgcaatgattttgaacagcgcttcgaaggcgaacacgccggtgaagatcaagttgagcacgtccagcaccacgtccatttcggggtctgaacaacacaaaatataatttgacggatttttaatttaaacaaaaaatgagcgattggaattttgtggggactcaaacgggacgggacttggtcagcaggggtcaaatgaacatttaaaaataaaaatttccgttctagatttaattttaacaaaaaaattttttggagatgcagggagttgaaccccggacttctcgcatgcgaagcgagcactctaccactgagttacatccccaattaataaatctgtctttattgcataattttaatttgaaaatttattaaaacgatagagtaattagttttaattgctttccaaaaaatgcaaaaaaaattttggagatgcagggagttgaaccccggacttctcgcatgcgaagcgagcactctaccactgagttacatccccagacaataagaccccacttaatatttcttataagaggaaatttaattgaataattgatgaattaaatttaataatttcaatattcctttgctcaccaggcggataatgcttcagtgccaaagtggtggtgttcagcacttaaacggcaaaaaataaaattgtcaaaaatgagaaaaataaaactcactgataatgatgaaaatggcgtactcaaagaattgtgaggtgacaaaccaccaaaccctggcaaaggaagcaatttcatttaaatatttaatttaaaattagccaaaattggtgccaatgcatcaaaaaatgcggcacaaaagctccacctgtattggaaacggttgcgcggaatgtaacggcggtggggctttgctttgagcgcaaattctgtgatggaaaaatgggtatagaaattccgaattattgatcagagattatcaaagtttaatcagagtgactaacttgatcacaattcattgatcagatagattttgtgaccaaaaggtttggtcagagtgatttttcacatttcattgatcagagagatatactcgatcaaaatggttcgatcaggctaatctgagcaagactaattgaccaaaaagtttgatcagaatgcttttatcataatttaatgatcagaatagttatgattaattctgatcaaaatggtgaacaatgtgtttgtgattattcgacaacttttttgttgttttgttcctttgctccctaccgatgcatttccgctggtttttgtccaactcgcagttttcatattcacgttcgccctcattttggaaggtgacaatgacaaaaccgacgaaaatgttcatcatgaagaaggcaatcaccacaatgaaggcaatgaagaagatggccacctttaattggtgctaatcattgcctaattacccaattaattaactaataattgaccacccacaattaactaattaattaattgtccactcaccggctgtcgcgcgttgtgcaccgggccacggttctcctcgttggagttgatggccacatacagcaggtcgggccagccctcgaaggtggacacaacaaacagcgaaatcattgcgtccatcacattgtcctgtgattatgggcgaaaaatttttttggcaaaaataacattgccgtattgcctaattaattgctcataccgtcaagagtctcgaaccaagaaaatgtcggcactttggtatcgggataaacactatgctaataattaaacttttgttacccatggaagacgaagcgaaccatcgccaaatgacgggggatacttagcgcaaattagcaactatagagaggtaattagggccaataaggcgccccctttggacagaggggtccttattaattt

SEQ ID NO: 13383 - DNA, 4139 bp, Heterodera glycines
  misc_feature (4057)..(4057): n is a, c, g, or t
tttcttagataatattgacattttaaattaaaaatttcgtttattgaaaaaaataaataaattttgggataaatttttgagaaatttttccaattcttagggtgcatttttgaaaatttttctggtcgattcttatgggtatattttttgattttattgcatttttgttaagaattttttgaaaatccttaaaatagataacaaaaatgccgaaataggtataaaaataggtattataaaagtgggtgtagaagctccaaaccaagctaaaaactcgttttttatgcttatctcaacgttacaagtgcgcaaaaattttaggtacttaactaaaaatcgcatccctattaatgacccaagcacaaatggaaggaaatgaggaatggttgtgtcctccagcagcagaagatggtccttcgtttatcgacattttttggcatcatttgctgggaaagacacaaaaaatgaacggaaaagaaaggggaaaatgagaaagagtaaagggagggaagacaagaaattaaagagaagagatgacggggattttttaagagagtgggaagagagggagaggaaaaagaaagaggacgaaaaaggcagtggacaatccgtcagttaggacagacaatccgtcaataatggacaattcgtgattttttaaaatcttgctattgcgatccattcatcgtagtaagtttttataaaatcttgaatttaaaaaaaatttacggaaagattgtccatcactgacggattgtccattcacggattgcccagggagcctatcaccgccacatatcatggctttttacaaataaattaacacatcgaagcaatgccatatgataattaattctaaattacatgaagttccacacgaacgatcaatgatttaattacaattattgtaaaaatacaataataaactgttttattttttgattttgtccttttgtctctttttccttatctccgctcaattctgatccaaaagccgtcacttggcttcagcacaagctcaggaaggccgcgactttcaagctcgtgttggacagaaatcactcgaaagcgacgaaaaattttcgccaaggaaattttctgctcagtgccagcaaatttttgtcctaaaaattttcattttttgttaaaaatttcctagtattttgtacctatgcaatttcgaggcccggcagaaaatggtaaatatgcgaatggctctttgtttcgccaaaggacattttcctcggaaaagtgttcaggatcgtagtcatccggtgcatggtaatactgtaaattgaatactgtaattgctattcgaatttaaatatgtagggaatttgaaactcgcaaaaaattactcttttgtccctgtgaatggagaagggggcgaccatcgctgtgcaaccggccggaattttgaagccacaaatttctgttgtttcagtaatatttcttaaatattaaaaaaataaaaggaaaataaattaaaatttttcaaaattattttaaaatattcaatttttgggttaaattattttttaaaatgcaactcaaaaacattatttaaaaatagacttaaatatacagaaatgaacctgccaattaagggaacggaaggaagaagacgcattgtttcacgaacgcacttaatgatgaacaatttttgagaaaaagggcgaaaattttagaatttaaattgatttcttaataattagttaaactttaaaaaaaaattcagaaatacctataaattttccaaacagatttatattcgtaagtttaattttatgctagcctgttaaatgtcttcaaatttcaaatttttcgtttgccttcactggctcaaagtacacttattgtcaattacgtcaattttctcattgtaatatttgcctgttccgtgtatcgcatccgtggcaaatcgtcataagttatgtccctttcggcacattccccaaacaaattatccatttctgtatgcagtcgttcctgtagttgcggacggtgtccaagcgaaaatacggtaaaaccaacacttaaattaatgtgagtacggtaaatgttgatttaatcgaagaaattgacatttttgaagcaaactttttgagatataaagcttacttttgtatggatttacattcaagaaaatttctttgaatatgaagtcccggtgcaaaaaaaggccgtttttgcagttatttttttaaccatttttggaattttgattcatattgtttttgggtaaatttataaattaaactgcggatatttgaaattccacctgcttgcaacagtgtcatgaccttcgaacataaatgtctccacctcttcgcggatgtcctcgtcactgaagttgttgtgttcctaaatacgctatagccctgttgcatatcataaactttgttaacaaacaatatgtaataaattgcgttaagccaattttaaacggtagaatcttagcaaatattctcatgtattacgataatatttgcctgtaagtccaacagtatgtccaagaagcaggcggccgccgactttgttccggtttttacatcgacatcaataccgtttccattttgactgattacggtggtgtcattttgctgatggctttgaacgccgttttgctgcattttaatatcattttcctgttgttttcgctgtttttgttgttgttgcacagctcgttcacgcttacggctggcaatgacctaataattagtgactagttttatgccggcatttctttatttattttttgttattaattatatgataaaattctttttcaaatttcagttaaaatagacaatttatgcaatccgatttaattcacataattaaaagaaatatgaggcactgaccccttgggtgaactcggtaattgccttcaaattgcgcttaaattcgcctccttttccggacaaccaccaaacaggggcaggccaaagccacggggaacgcattctgaaattaatcaaaagattaggtaatagcttaaattagagggttatttaaaaaaaatacaatacctcagaaatgaaagttcgcacatttttttgaccgcctccacatattttgggttgccgcctcgttgcgcgtccaattgcgtgcccattgccgcctctgaaaaatgatttaaaaaaattaaattaaataataaaaaatgtgtgctttatatctttatagagttattattatttaattaaaaaatgatctatttaatttttaccgccaattatgataaaaaaaaatatatttaaaaaaaaatgtcaccacatataatgtccaatgcataaagtttgatcatccggtaaaagtcaaatgggtatccatttttggcacattcatccaacaattcaaccaacacattggaatgtctgttgaacacctaattttgttaaatattttttaatttaaattaattagacagcgaaagcattgaaaatgaaataaaattaatttaatttttacctgaatgaaatttgcaagaattttaaagtgaaatgccggcgtcaacaatttccgtcttcgctgccatttttcgcccgtactgttaatggaaaaagaataatttattttaattttaattaatattgtaattgtgtgccttgtcaacagcccagtgccaagccaatctcgcaataggctgtattcaaatggtttggagatgagagcattgcctgagaaaatcgagaaaaaatattttaataaaatatttttgaacttttttaaaaaccaaaattaaaaaaaaataaatttaaagtgggcaaatgaatttaaatttccatttttattttgtcggcactcactttccaaaatggcctttgcggattcgggcttccagaaaatgacgattggctttggccctaaaaattattaatgtataaatttgcctcttaattgtaatgcttgtttttattgcattagttaattaccaaatactcaccgatccaaagtcgcataatccccggattgttcgcattgtttctggcactttgccgaattcaaaagtgtatttgcgaaaataatactccatttgataagtgctttctgncattttatagaccaatttacttttttattaagtatttattttataattgctaaaagcgcgagtatcagtgatgtaaattttt

SEQ ID NO: 13384 - DNA, 1437 bp, Heterodera glycines
  misc_feature (60)..(60): n is a, c, g, or t
  misc_feature (1405)..(1405): n is a, c, g, or t
tgaaatcaaaaaataaaaagtcccacttctctcgcccttcataggaacccacggtggggngcgggatttctgatcgccattaaatttttgctcattccgcacgaatgcttagtaactcccgaggcgggcggtaaaatgtggacaatagagacgcaattaaaatttgacgcgggcagaggattaattcagatgtacaatcattcacaattatttagtggggtaaagctatcgctattataatgactttattttctatttccgctcactcaaacgacgcccatttattgccattgtattaatgagtatgacggcaatggtgcactaattgcttctgggacatttctttctctaaatttaacgagcaattttatattgatttatttggccaaaagactatctgaattatggaaataaatcgccttggagggagatcattcgtttagccatctatccgtagtaaatgttcggatgaacaaaaatgtgcaatgtcttcccaaatggacatgagcacaggcaatttgtagttgggtgggtggatttacaaaaggaaaagcgcaagattaatcatggactaggttaatgaaaatgaaatttgactttctaaacatatatgtttaatgaacaaatgagtggctggcatctttttaattgcctttttaattaaccaactacaaattgccagttcaaatggcgaaggcgtcaatgtgtctttgttttaaatattgtacgggagtgggtaattgtacatctttatcatcaacatttctactccctccacattcgtttgtccgcatgatccactgttgtagcgatgtggaagcagtagccgtggtaatttagcatcggcctttaagaaggaatatgatttttaagacaatgaaaagcgtgaaataatttacgaaaattgaaaatgtgctgaaaacattttaaattggaagaaatggacattttggggccaagcaaaaaaaaaaaaaaaagccaaaaaatttaaaaaatgatctcgtccatttgccagaattttgatgagaaatcaaaaccctcgtggtgccaacccccgttttttttttgaggagggtttatttacgtataaactcaaaatgtccataccattaaaagttcgccgagaaagaagccaggcgtgccgaacagtgtgtattgccttccgctcttaacctgcgtataataaacagtttcgtcttcgctgcaccgtttgccctgcccctccatttggccacctgttgttgctgctccccctcctctgatgttggttcgctcctcactaccatttcctcctcctcccgtttaagcaacacaatttcttgtgacgagtcgacttcatccttcagcttcgagtcctcttccgctttcactctctgttgttgttgtttctcaaaaggctgacgtntgtgtttttttgggcagcagcagccaagccgt

SEQ ID NO: 13385 - DNA, 1970 bp, Heterodera glycines
ttttaagacaatgaaaagcgtgaaataatttacgaaaattgaaaatgtgctgaaaacattttaaattggaagaaatggacattttggggccaagcaaaaaaaaaaaggcaaaaaaattaaaaaatgatctcgtccattgccagaattttgatgagaaatcaaaaccctcgtgtgccaacccccgtttttttttgaggagggtttatttacgtataaactcaaaatgtccataccattaaaagttcgccgagaaagaagccaggcgtgccgaacagtgtgtattgccttccgctcttaacctgcgtataataaacagtttcgtcttcgctgcaccgtttgccctgcccctccatttggccacctgttgttgctgctccccctcctctgatgttggttcgctcctcactaccatttcctcctcctcccgtttaagcaacacaatttcttgtgacgagtcgacttcatccttcagcttcgcctcctcttccgctttcactctctgttgttgttgcttctccttcgctgacgctgcgttcttttgggcagcagcagcagccgtttctctcgacagtttcgactgtgatttgcgctgtttgggtgcaaccattggctgaagcccaggaatctttgtttttgaatttggccggtcgtccgataactaaagcacttttgtcaccaccgtaagcaatcggaagtgcggactggcttaggcttttccacaattaatttcgatttgcacggagccggcgtcgaagtccttctcagatcgtacgcaaagtccgactcgctttcacttaacaacgcttgcccatagaacagcggggccgacgaagaatgcgagcactgtccgtagctcattcttcttccgttgaagcgttgtgtcagtcatttattttcggtttgtttacccaccgactgatccctccgctgaatccgttctgaagcaaatcggccgaaactggcacattgctgttgaagttgagcagcggcaacttgttcttcttcttcttccgttgtctgttgtcgatttggagttgctgacttttcttggctatttccaattcgtgtttctgcaagaaatgccattttataatgccttcacaagtgaaattaccttgtaaaactcgacatcacgactcataagccctttcccgcaacgacaagggatttcgtttttgataagtgtaagcccttttcgctcccaaagattgcatctgagctgcgaggaagtccaaccacgggcggagcctaaaggcagcggaagcgatgggtaagggaacccgagacaaataaatgaacgaatgaatggcagaattggtgacctcgactgctgagaatcttcagaagattctgttccaattgttcgaagcatgcttcgtgcagcagaaatttgaccaagttacaattgtcatttgtacaacgcatgcgaacgccgcactcttcgccgtctacgttcgtcggcaaagggacttctgaaaagagaagtggaaacatggaaaatcaaaaccaaatcagtgggttaattaattacctttacacatgcaagagacttttggcacgggacagtccgtcttttcattgtacatgcgagattcagattcagtgagattgctgaagggtaaaacgtgtaaacaaccacaaaacaacactgcaaaagtgagtgaataactccgattttcccgcatttagttgctaattgtgcacccattaaaattaatgggggctctaatgcagtttatgagtccaatcgacttttatgagtccaatggacctttatgagtccaatcaattgacaatcccgggtttttatacaataactttgttcatgttcgaacaaaccctatctttttggtatcattcgaaagcgcaaagtctgaataatgtaataatacgagaaaacacgagaattctaacatttcaagaaagttacaaacgaaaataatcagcaattacttaattaatcaaatctt

SEQ ID NO: 13386 - DNA, 2126 bp, Heterodera glycines
cgaatacccctgtaaacatgtttttatcattaaaaaatgtggtctaaactgtacaagtaccaattaatgttcagtgctgattaaaatttctcacctactcgaacatccagaaacttttttccgcttagacatctgaaagaacaaataatcaatgtaattgaattctcaagtatgtaaacatttcacaaactttttctcggataattgagacagctgttctggaaattaccatacaagtgaaacaattgaatggctgtggaataagagacgattggactttaataggtattgcaattaacttaattaagttagatttgtacgagaaaatttaatgaactcttgtttttaatttgattctcaagaattaaaatgcatggaatgattgcttcctcaaaaaaaaaaaaaaaatttgaaagcaaaaattccgctgaatcttgaattttctcgtcctaaaagtttagtaaattaaaaagtgatagctaatttacaatttttattaaattttgaagagctgaaagtgaccgaaccaatgaaaaaactacccaaaaaaagggagcacaatcaccgaattgcttaacatcaattggttctttcaattaattttccttcatacataaatgtataaatttctaccaaattattatttttttgcatgggattaacagaaatatgagaacggaaaaacgggacaggagataaaaagataggtagtttgaatatggaacgaacttttctctgaagtgatctgtaagtgatctctctcaaaaatggcagttatttaaaatcgtcaaaattgaccaaatccaaataagtaattgtatttttaaatgtggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcaagatttggacattttgtgggtcagcggttacatttcgtccaacctgaccctatttcaccactcatttttctcatatatttatttgtttactgcttttgacttacctacacttactctttttagcttcaaatttttgtggaatgacctgattttttttgttttgtgtttcgaaattcactaccactttcattcaccagaaaatggcgactctttcacgacaacaaaaatatggcgtgagtcattttgtttctcttaattggcttctttctttaaatgtcttggttgatttacattgttttgttgacagattttgtgagccactcaaaactatgtaaaacagccggcaaatgcttctaccctaccaaaaacattttttgttttttcaaaaaacagcggaggcagttgccccccatttttgaaaaaaaataatttttattttattttatttctaaaagtcatgaaaacatgtttccaagagtgttatgggtcgctgctcacaaatccgacacccatttcgaccaattccgaaccccgggcccgaattcgaacaaaatgttgaaaattcaaattttaaaaacgcaaaattacgccctccattttcattcactcttttgcagctgattttcctggtcggttggcttgccaacctgttcctgtgctgtttggttgcttttgtgcttgtccgtgcactgttcgctgttgctgaacctgaccattgggtgctcgtctccttttggacacacatttgcctcttcctcggcttcagcattgctttcctacttttcctgctgttcaacaattacacggacgtcatttttgccactgtttttacggagtgagttgtttcaaaattttatagttttttagttgctaaaaataaaaaaatataaaatagttgctaataactcgaaaagtagcttaacaaccccactaaaaacatgtttttcatgaatttcaggctacggggagctcaggaaaaaaatactgaaaaaacaataaatcccatccctacttattattacggaccggatttgtatggatttccatgtttttttttgcaccctttatttcgacctaaaaaccatgtaaa

SEQ ID NO: 13387 - DNA, 2740 bp, Heterodera glycines
  misc_feature (48)..(48): n is a, c, g, or t
  misc_feature (58)..(58): n is a, c, g, or t
  misc_feature (102)..(102): n is a, c, g, or t
tccgctttgttttcggtgcattttcctcgtctcctcggctggggcgtnggtcggcatntggtcgaaatttggggcttcattttgctgtttgggttcgttttntaaattattgcttttatacaaccaaaatattccattctttttgtgcgtttaacattttttagattttttttgggttaatgcacaaaacagaaaagtacccaaattgtgcgtcattcgaaatttattttaaaatgtttaaaatatttcgaatgctgcatatttatatttaatttttaagctgccaaataataatgttggctcccctgaagaaagttttgaatcgttttacaaaagttagcaaatgcaataaggaaaaagaaattagtgcaactatttccaattattagacgttcaaattgaccattttcttcccctttcatttgcagcggttttcttccgtcggctgtccattttcttagacaaatgccagtggtcggcacaattctgaatttacccggaattcggcaggtacaaaaaaatatttttaactcgaatctttcttccttttaaaatgtcttttctcaaatttagtgccttgacagatttgcaactgtacataaataccccgtctgatgaatgactgattggatgaatctgaactcagtgatcgctcactctttcgtcgtttcgctgtttccgtcgcggggttttgcacattttaagtgaccaaaaaatcgaataaaattttaattatttttaaaccaattaatgagcgatttaaaattaccatttgattttttctgtcaaaaagggaaatgaatggtcactttcatcccacatttagtggcctctcttccgccacctttccacgcattatttattattcctttgtttttaattggttgtctgatccctttgagctctcagatcactccgatcccatcgttttatttaaatcactcattttcgttttattatcaaatgattgtttgtttttacgttaaatgttttttcttttttttgtctgaaaacggaatcgaaataatcaaaattcaaaaatgttcgtttccttctccaaattggttatccgtccacaatttctcttctggcgtttggactgaaattgaaaatttgttttgtttttatgcttacggtaaatggtaaatacagtaccccggtgccaacattttacaatgccaattttgcctttgttgggaatttccaccaaattcactcacttcaattcggacattcgtctcaaatagcgcgtctcttcgctgcttctgatttcaacttcggacattcgcttcccattgcgatggcttctgaataaacttgctctttctttttggcattttccgctgattttttacctccgccaccgccgggggcgccattcgatggccaaccaaatgattaggacgagaagcgcaaacgcaaaaatggccaaggagaagagaagcatcagaaaccgctggtggtaggaggcacagcaggcggagtgacggcattcgaaagcgaagggatgggacggacacggcgaagaagcggacgaatagtctaaatgattttgttgggtggcactgctggcggagccgaacagtgccatcggcacaattgcaaaagcggcgacaattggcggaggacggcgtgggatggacattcggcggggaaaggaaaacaaaaactgaaagattaaaagttaaaaggaatgggataatcttgagtttcggggtggaagagatgagatggagagagcaaatttcggcatttccaattgaaaatgggtgggctaggcggagaaggaggggggggggggggtgagagaacggatcttcaagaacgatgcgagtgccgttgatcagtccttccttatcgcttttgttaataaggaggacaacgacgcttccgaccttgagtcgcagacggtggggaggcatcccagagtctgtgcgtcggttcaacgctgccacttctaactcgatttcatcgatgtccagtggccgctcgtcaagcggtttgtccgaggacaaatattcgcgcacttgaccaggcacgttcgccatcataatttcgttgatctcatcgcacgtgtcaatgtgaggtgcgaggatcagacgattgagcagttccttgtcatttccaaggagtctttggaagtcgggatagacaaagtctatcaactcttccctgctcagtacgaggaactgcggaggaatccagaagtgttctccggtctctccgaggccgatttggcggcacatttgcaagtacgcttgctgtccttggcccaacctctggtttattgtcaatttcatagtcgtgaattgacaaaacagtggagaggtttgaaagcaggccgtaacttgtgcagttaggccttcgtgaggcacgaccggcagtgactgtttaaagtcaccgctgaatatgacagtttttcctccgaagaggaggtccttgtgctggggaattgccatttctttgcacactcggtcgatgacctctatcaccgtgttgtgaagcatggtgatctcatcaatgatgatgagctgggcctcacgtatccgtcgagcaaagaagctttcaagcggaatgcttggaagcttgtctagcgagacttctctgccgagacggaacgtggaatgggctgttttcccatatggcagcaagatagccgcacacccagtggatgccgtagccagcactttaaaggtgtatgggggctttcgcaagcgtttgataattgaccaaacaggaa

SEQ ID NO: 13388 - DNA, 1714 bp, Heterodera glycines
ccgaaataaagagtcaaaatcctccaaaatggcgtaaatgcgggccaaaaagcacgaaaaaagggcgatgaattgacaatgagatccttacaattaagaggccaattaagtatgtaaaatgtcaattggaatgtaccgtctctttggcggattgtctcctccaaatactgtttgacaaactctaatggaatctccggaaaagtaccatcgatcggaacttgactttgaccattttgtgtgacggggtccatgccaagttgtggccgctggttgacaaccaatgaaagaaatgtgagggcacagtcagtgccatcaatggacgacaaaagggcaatgccatcggagaaattggcattttggaggaggagaaaggccaacttcttgcgcagatgatttaattccttaaaaaagtgaaatttaaaaaagaaatacgacaaaataaataacggacaacaatttccacgtcattcaaacaaaaagccgcacttttgccaagcatagaaagggcactgtccaaatttccgagttgaatttgttcttcaatctgttatgaatttattgttagcgaagcattcgtcattttccatcggcaataaattcacttgcacaacgacagagacggggacgagttcgtacagtgccgagtcgccgggtgatgcgatcagaataacgccgtcaatgttctccaattggcaagtgatcggcgcaggtgatcggccgcaaatgttttgccgcacctcttgaacttcatcggttggaaaagcgagcgattggaccaaatgggcatcgacggtactgaaagaggggggaattgggaagaaatcatagaaaataatcttaaaacttctgttattataataatatttccacctgaaaatatacacggagccatcttcgcttaacacatgcagaaacggctccttcagagaaagcccgacaattcgactccgaccactcacggaaatgggcggccgggaggaaacgccgtgcatattgacgaacaccaccaactcatggacaccgctaagagcgaattcttcctgaaaagaataatgttttatgtggatggttcatttattcatagcctcccatttcctcaattctttaccattccaaaggtacaaattgcgtgtccgtcggtcgccccatcgaacagtttgagtgctccgccactctttgcctgcagattttgcacataaaatgctccggagtccgttgaataacacaaacaatgcccactgaaagacattttgacgacacgtccgatagtcgagacctttcgaattgaaaaggatttatataatttgataaattgtcgttctgtatacctttcgatcaccgacaaattcggcgtctgcgaccgttccaatgtgtacaaaaggcttttgcgaatgggcgacggctaattggacggcgaaagggtcgtccaacgacggatgagaattgatggcacaacgggagacggaggaacagaaattgagcacctaaaaagggaaatgctaaaaaaacacggagactaatcttggtaacattcggtagctataagggttctctcttattattagtcacaatgtttgaaaaaactggccccaaccaaaaacttatggcaaacaaaaaaaaatgtgaagcgaattttaaaatttttagttttactagtatttctgaaaccaaatgaacctttttaatttttaaaggttaatagatacaaaacttt

SEQ ID NO: 13389 - DNA, 1139 bp, Heterodera glycines
ctggagcaattaattaacttatttgaaatcgaaaaaagcagaaaattgtaaaaagaaatcatttgtgtgtattaataattgtttcgttaaaaaggaccgaaacgaacaacacaaataaaatgagcacaattaatgataaaatgacaacaacagcagaaaagacattggtccacaaatcaactactgttaagttgaaatgagagaatctaacaaaaacaaaaagacgagaagaaacaggttttacagtgtttcaatatcgtaagaaacgggggaaatgtttacagaatgccgatgatggggtaatacatacttgaaaaaaatgtttttcaatttttttcggaataaagtagggttttcggggtccgataatcagattttctgttcgaattcgattacgaattagaaatttatgcatcatccggcgttaagaaacattatgcaaatggaagtggcaatgggattcgtccactcgagatttggccaattagaggccgaatttaaaaagaaaacgccataaaaataaattcaaatatatcacggtaaaacttttaaaagaacggtttggaaccgctgataaaaatgcagaattaatgtgtaatttaggattttataaaggtattctaggtaaccttaagcttcttcgctaattttgccaaatcaattctttctcttcgcactactttctctcttctctctgtctctccatctctctctctttatctctcttttctctctctctctctctatctctctctttcttttgcttttctctcacttttacacaaactctctctctttatctctcttttctctctatctctctctctctcttttcctcttttgccccgcggcttttcctcaaattgccgcagcttgcaaaagcacaacaaacagcatgacttgggaaaaaaggagtttatttatagtagatatatgcagacagtggaagcggagagaaaagccccagcggacaacttttcgatggcaccgcttcgaattgacgcaaagtgtgccggccgggacggtaaaatggcattggccagtaattgtagtgccacaacgaattcattcctcttcacctcttctcgcaaatgtttgggaccatcccttagtacacgactccagtcagcaatgcttaa

SEQ ID NO: 13390 - DNA, 2064 bp, Heterodera glycines
  misc_feature (65)..(66): n is a, c, g, or t
tttgatttgatcacttcaattagcactggtcatatctcttcttggctgatcaccacttgatcacnnatccctctttttgatcgtgctttgatcatcttacatttcttgctccgatcagccatttctatgtgcttttctcctatggaccagggctggccgtgatcacggatcacggctcacggatcacggaaatcacggggtttttggggtgccgtgatctcggattacgggtcacggattttttcaaattttccgtgattttgatccgtgattggcattttatatagggaatttttattgagacgaaaataggaaagtggtgtgaagaattttttgagaaaaataaataaattctttcctgcttacaaattagaaagtaaacatatatatgtagtctggtggttaagccttctgtctttctttgtctgtcccttgggttcaattccccattgggataggacaatttatatattttgttttgataattttaattgaaatttaattaacaagagatttcataacattgaaaattatttttctttattttttaaaacgtccatagaccaataaattaaccaatgattggacatattttggacaaaatctgtcaacaaattcactcaaaatttcaaaatttttcccggcggcgcctgtcggcaccaccggcagacggacccccattttaccgtatttttgaaattttgaccctaaaatggcagaaaaattaccatttttggcatataaactgctaaaaaccctattttttctctccgtcgtttaaatttaaaacgacaggcctaatcaaaattttcagaaaattttcccaaccctctaagaattttttctaaaattttcccgactttcagaatcttttgtggtgttcagatcgtcatgaaggactgagcatgttggtccaaaagattttttcagcatcaaaagttagcttacaaattagaggaaatttttttctctacataaatagatttttggttaaatttaagaaaaatttgaaaaattttcttaataaattagttaaaaataaaaaattttccttggagatttctacaaaaagctctaattttcctcaaaaaattgccaaaaatcgtaaacttagtcattttttggaaaaggtcgccgcaaaaaaagcggtttatatgttttggtttctttaaaacattttttgggaatttttcccgcgattaaattccgttttttaaataaatttaaataaaaaatcattagaaaatttttttttataatcacggatcacggctcacggatcacggaaatcacggggattttggggtgccgtgatcacggttcacgggtcacggattttttttaaagccccgtgatcacggctcacggatttccgtgattggaaattcaatcacggccagccctgctatggacccatcatcacttctcgcgatttgagcaaaagttttatcaaaacggaattttcaccagaaatttttaactcagcgaattggccttttatttaaaagtttcagggccccggccaatcaccgaaagtgcacttttctctcgttttttccttctgatcacctttttctccccttagttttagtcatcgtttcactctgttgtgtgtttgtgtcccttcgcttcatttaatgatttggcaacatttacgcctcatttgcctcacaataattatttaacaaatgaattgaaaaatagcgacgcatttttattttattttatttttaattaattttttgatggcggcggcaaaaaatattcgtacataaaaaaaggcttaagcaattgcgccattaagctgcagcagcagaagcatcaggttaaaatctgtattatgcagtcagtcaatcactcacttttctgtaataattaggattagccaacgacgcaattaacggcgcttaaaaaacactctcggggatttacagattatttttcctcctttttattgccgtcaaatgctcccattaattagcacattgattattagccccgacttagaagtgcttctgtgcggatgaagaagcgttgtcaagggccggtacaaagtttttttgc

SEQ ID NO: 13391 - DNA, 4103 bp, Heterodera glycines
  misc_feature (3868)..(3868): n is a, c, g, or t
attttggggtcggaattccgatttccgtaaaaattttgggcctcggataccactcctggtgccgatttttacaattcaaagtatttacatatgtagcgtgttcacgaaaatttttctacttcatagctcgctccaaaaaattaagcaaatgcctctgaattggggcaaaatatttaatttttaatagaataattcacccttatccatctcaattaataatcaatctaataaaattagaacggaatgaactcaaccgaatttcggcattacgggcgcaaaatggtcgattatgttgcggattatttggagaccattgaaaagcgaagggtgagaagcattttgtgtgttgcaaatgcttttttctccagttattgcatttttacaaatttaattaatttaacaggttttccccgccatcgaaccgggctatttgcgcaaattgcttcccatggatccgcccattcaaccggagaattttgaccaaattctgcaagacaccgaatcgtacattatgcccggagtaagaaaaattcataatcacgagaccgcaattgttgagagactgtaatttcgtagaataaaattttttcaaaatatatgaaaattttgggaaaacccaaaaaaatatatagtttttgaaaaataactcaataaaaatggctgcttcttttcaaattaaaagaattatttttggtctttattaaaaaaaaatctatttttgaaaaaaattcatttttttatggaaaaacattgcgctaattaatcgatgctttacttcctttaaggtgacgcattggcagcatccccgcttccacgcttatttcccagccggcaattccttcccatcaattatggctgacatgctctctgacggcatcggatgcatgggcttttcatgggtaagatccagtatggaatttcggcgtatggattgggtaatagggattggctttatcgggctcaaaaggtcggtgggtgttgaagttggccaaatcggtcggagtttggagggtttcaatttttgccttatgccatacggtaacatgaagtttggggctataatattaatttttaaaattgaaaaattaaaaaataagtaaataccctgtgatttttacatccttaaataacccaagctgtgcttaaaaatcttaaacagactgagccttgaaatgtacaaaaaattacataagtatgacattgaaacataaattgtaatgcatccagcaaaataagcatgtttaattaagtggctaattcgttaaaaaatttaagattacgaaaatttcgacacagcgaaaatatttcaagcagaatttttgatggataaaaatatatttaagaaaattactattcgccttacatttgggaggcaaaaaagatgaaaaaaaattttaaattaaaaattttgcgattttgtccaattttctgtgccccttttaaggctgcttgcccggcgctgactgaattggaaactcatatgctccaatggtttggccaaatgcttggacttcccgccttctttttgccgtattccaaaaattccatcggtggcggtgtgattcaggtgtttttggtcccgtttctcagatgccaaaattattaaaatctggcaataattaattaattatccacagacctcagcgtccgaggccattttggacgcattgttggcggcacgctttgacaaattgaagcagctcaaggaagaatcaaataaaacagagggagagctgctagacaaactgattgcctactgttctaaagaggtgtgttgtgccaaggggtgcactaattatcacgccgtcccgccccccccccccgccctgaaaatctatttgatccgaccagtccgacaaatgttttttttagagttgtacgggaccagaaattttggcaaaaacatgggacccgaactagaaaaggcttgatcaggatagagacctggatttttgaccggtaccaatgggtagtttttccaaaaaccgggaaaaaaattcaaaatattttttttccatgtttaaaaacaaaatatacccgtttgtcttaatttaaaaaaaaacaacaaaaaacaatgacaaaaatgcctaataaagtcatataaaacgacttttctgccgcattattatttttttaattttgcactaaaaatacttctttttttatatgctggatttaaaatattaaacctaaaaatacataatttaaaattaaaaaaaaatatatgtattaacaaagagaaaaataattaaaatagttttgtttatgaagcgaatttaaccaaggcgaaagcattattaaagcattttgtcatggaaacggtgtgcggagggacaagcttttacgtgtattggatttttcaaaattttgccaaaaaaatctcaaaagcggattagctttaggaaataatttttatttttccattaaggcccattcatcggtggaaaaggctgcaaagatttcgatggtcagagtgcgcctattggaaaccgactcacgccttcgcttgaggggcgaaactttgcaaaaggcactggacgtgagttggatgttaattcgggaaacgttaaggctttcacttgagttcgtatgggtttttggcgttgccatttaagcgacgccattttggtgttcaatttggacgttatctttaaaattgaagaattattttatataaatcttagaaaagctttcattttgaggaaaatgctaattttattaccctttttcaattttttttgtttgttgtcattttatgacttttatttgaataattgcatgtcccaaaatcctttctctaacggttagagtctaaccgtataaaattgtgtgataaataaattataatattttaataatttctaatgaggcaattaacgttaaaacatttgtcaacgaccatttctgctctttagaaagatcgcaaaaaaggtttaatcccgttcttcgtctcaataacacttggcacgacttcctgctgctcatttgatgtgctctcggaaattggaccggtcgccacaaaaaacaacatttggctccatgttgacgctgcatacggtaggtggtggggggaatatggtaacggagaatatgattttcaaaaattttattttaagctggttctgcgatgatatgccccgaatttcggtaggtttttttgttgttttactttgtaccatttgcagtgggcaacgatagctcattacctcaaagcaaaaaaaaaaatttatggaaaaatctgaaaggctgtattgaaaatttctgcaaatcttccaacggtgtcaaaaaggccttgcaaaattttcccaaaattcatgttttaaattagaaattaacatagcctatcggaattcccttactttatttttttcataaatcttttttttaaataaaatttttctgtctcaatttctagccccattccggtcccccatggatacggtggtggacggcacatcaccttgaatcacggcacttaatacattaattaatttagctatttaatggaaggcattgaacatgcgatgtcgttcaacacgaatccaaacaagtggggcattaaataaaaactgaatttaatagcaaaaacttatatttttttcatcatttcctcagatggatgcttatcgcctttgattgttcggccatgtggttggtattgggttaatttttaagttagaccagcaggaatttcaatcgaaaagcctaaaatacaataggagcaaaatgcaaatttaaaaagtgaaaaaaatgtaaaagaaaaatatttaaaaagtgatttaaaaaataacgacaataaaaggctgggccgcccggagataggaggccgggttcctgttggcgcaagtccgccagccaggagcagctnttttcaagtttttccattttcttgaaatttaagatctttttgattaaaaaaactttttgcgggaaaccgatacgggcgatggacatagtgcaacccgccagccggccggggccggaaaaaaccattgaaaaaaagtttaataaagatgatgaatcattgtaccatgacagcatgtggaatcagatcacgatcagcacctcgatacccctactatctatgaattgcataaaaattt

SEQ ID NO: 13392 - DNA, 2992 bp, Heterodera glycines
cgtccaatgcttctccgaatggtataaatagcaatctttgactttgccgcggggggataaaaactcattaaaaatacattggataaatttggcgggcggttccaaatgaatgtttatcaaaagacagacgattcattcagccaatgctatttttattagcaccgaatgatccgttaatttgtccgccgattcgctttttaattttaatctccgcttccaatctgttgagttttgtccgccgatgtgttcgcagttgaaaggctttcatggttcttaaagatttctaaaaagcattgtttttgaaaaagattatctttttttgaggctgcgcaattttctgaaaattttaaaaataaatatttatagcctttaattaaattcagtatccaactgatgcattcggtgtggggtacgttcacggatcaaaaagtcttttttcgtaatagtcaatcatttaaaataatctttgtgccaatttagaaaattttaaattttggtctgatcatttaaatttttggtccgcaagtgtccgtgcccagatcaattagggcactaaacatattccggaaatgttacaaaacaattaagcttcaggcgattgatttgcatatggtctattaaataaaagaagttggggacattttgtccatttgcactctttgttcacttcattaatttactacttttggaacgccgccagacaattaattttagtgaataattagaacgaatcatttgaccattagcattaattatgtataaagaacaaaccgctgatgatcaccgtgccagaagaagctccatagtcggagaaggcgaatggcaacgaaaagaaacacccgtcgcaaaagccaaaccaacggcatcggaaaaatggctggacaataaaattttaaaactccgaaatttggttaggcgaaatttttgtaacggaaggatgaggggggacagaaaaatgccgaagaaatgtcgaaaatgatggcatttgggggcaaactaaggaattaagtgatcgaagacgactttctaaaaggggagagaatgggagaaatttcaagaaatttatgtttttgggggcttttttgatttaaaatttttattatctatacattttactacttagctaacacttcaatagcatatgtcaacaattacagaaaatacggcttttttgcaaatccgtcatgacggattatgcattttttcagctttgttccccaaatagttttccggtctcgatcagaaaggaatacgcccaaaaatggttgggtgggtggttgtttccaaaagttgaaaggtttcctggatacgttttacataaattacaggcagaacaggcaccaacgaaaaaaacggaaatttatcgccggcatcgcccaatcattagtgctgtttaagactctcggtcacgagtctcgactcgaggtctcggtctctagtctcggggccaaatctcggtctctagtctccgggaattttcgatctgaaacagcactaccaatcatatgaattttaaaatttgcaaaaaattatttgaaatttaggctaattaacaagccaaaaagcataggtatattgtccgtctcatcctgccagcccatactgaaacgtagcaataatcattaaattttattgccgtttttccgttttctgaaaaattgccgtggatgcgttgtcgatctgaggaagctctctctgcggatatgcttattcgggacgtgcttcattcactaggatgggcgagatgaagcatcaccggacatgatcatcatcataaaaatcatcatcatcctctttctgcttcattgggaatatgttcttgaatgggtggaaaggggataaatgggctaaaaatgtgccgtcctccgctgctgatccgtatctccgcaacgccgagccgaacgggtcgaacgccgtaggcgcaaaagtgtggcggcgaatgggacggaacaaaaccaagtgcaaaacgggcagcagtagatgatgctgagcgagatggtgatgaggggcaggcagcatggtggacattattcattaacacaaaacaaagtgcgctaatttagggtcaatttgttaattaccgttaattaccgcgaaacattttgtgttttgtcgagcggaaagtgtttttgtttatgaataagtcaaaaaaaatgaaggggattctttggtcctaaagtatttatagcagggatggcagggtattccgacttcctatttccgaaaaatttttggacctcttaatgccattcctttttcatagggttatttctcgcaatcttattctcagttaacatataaaaaaaaggaattctctcttactgtctcccaaaataactataatgtcacgagatccactttgacatgtgattatcatctctcactagattcaataaattaaatggttttctgcacttattctaataaataggcgaataaagaatatttatttaaaaattaaaataaattttaaaaatattgaaaaaaagtttactaattcgcccgaaacaataataaataaataatttaacaaaaatggacatccaatttaaatttcagcagctttaaccggttgtgccgcagaaaatttcagcggtgcccttctctgcggatttgccaatgcggacgacagagaggaggacgacgacatcgtcggcatattattcatcagccagcctcgggttggcaacggaatgcgcgggattgtcgaagtgtgtgccggtgccgtgttcgtcaatgtcgtcgccggcacgatcgctcgtcgccacgggtggtcaagcgattgccacgcttcgttggcctgctgatagcattgacggcacttcggtttgtgccgtccacagcagcaacaacagcagcagcacaacaatgccaaagtgaagaggatggagcaaagtgcaaccaacagcattgccagcaagtacagctccaaaccggtgggtgggtccaaaatgccagctgaaagggcaaaggtggtaaggaatttgggcgg

SEQ ID NO: 13393 - DNA, 923 bp, Heterodera glycines
ttgtgtaaatataaatatctgattttcaagttattcacgtaaatttttcatttgttgaggtgagacacattattatgttaaattaacgtaaaattcgtattcaatgtccatttttaccctaagaaaaattcaaaaaaaaaattttagcggtggagtcacaaaacagaaaaaaccgaaatttgagagattgaagatcaatctcacgttggcttatcactcattaatgatcagaataaatgaaaaggaattgatccctctatgcattggatttaaaaacataattttgaaaattaggatttttctgaaaatctcgggtgacggcactcggaattccagagttcgaaaaaatacggaaattttatgagcctgccaagacaaacaatattgggaaagagaatccgggatcggctgaaatcgtacgattttgacaatttaatgatgaaaaaaaaatgtacaaattgctggtgtattaaatgagagagttgtgatctttgatcagtggattttgatcaaagtgtgagtgcagtgaccagacaacgatgcagaaaagctaattaaatctttcctaaaaacatatggaaacagctggcatttaaagaccagtttaattgggatttaataaggaggaggctgcaaaaaacatggagagaaacaagaattgctaacatcaattagcagcgatcactccgatcagactgaggctcgaagccagactgatcaggcttacacatatggactcacccttacgcagtttgatcagcgaaaaatctaacggcggtggctttacgctgtttttgtttgccgatgcaacggcatttgacgaaaggatgcgtgccgaagtgccattctcgacaaccgcaggtggtgaagcggcgaaactgatcagaaaaaagagccagccaagcgcaggattggcaacttcg

SEQ ID NO: 13394 - DNA, 3286 bp, Heterodera glycines
cggatgagaagggaagctaaacattgaatacctctcagtgccaggaaccaatgagtgccgatggggactctttcattttcggcgaatagtatttgccaagagagagagcaacgacctttcgcttccatataataggtgaatgttgattggctgaaggacagggattaggacgatgatgatgattggttgaatgaccattcctctaggtttaattgttggaaaaaatagagttcgggagcaaataaaataattctcctttggaaaatgtttaaaaatgaagaaaactcttaaattttattcataatttggaaaattatttttttaaattaaagaaaatgtcaaaatctcctccgtctaaacgcgctcgtcgttttttcattgaagagctacttcgtgagccatacaatgagctgtcaccaccacataaatcgcctaaggaatttgttaaaaacttgctccgaagttgaacacgttccaaaatttcaatggatgaaaaccaaatcaatctaagacgtgcctgctgaaccagaagggcttctaatcggcattttccaacagtgcatttatgaaacgattagtgacagccggttgaggggagttgagccgacccacctcggctgcattgtttccagtgcgctacttacatcagatatttggatcccacttcgacaaatgacaactgatacaattaacaccattctcaaccgtttcaacgacgtggcacaaagcaagaaacaggatggagtgacgctttggggcgaaccgtttaccgtgaccatgaccacagtcaaccgaaacggactgcccgagaaacgacaactgaaaggaggagcagcgcgcaaattaacacacgtccaccaccaaattcattcaattaaaaataattttatttttaaaaaacatagatacaaaactttgatggagataactactgtctattcttggcaatgcaagcaacaatgattcgtactctcggtggtctggcacgtcaacgattttatgactacatgaatggaaaccattgtttccatggaaagctgaaaactgaagctcgggaaatgatgaatgccgtcaatgcaccgccaaatctgccaaattatgatgccgaaactctatttcatttatactatttaattaaatatgtacattaggcattagtctgaatatttattgaattaaatcacaataattaatcaacaaaaacaagatttaaatatcatatgtttcactgatttaaaaaaataatacattggcaaattgtataaatcgttaaggagcttaaaaagcgaccaattgtaaagaaagtttagaaacgcaatgatttatattagggtatcgataatttgtgaaaatgggcgtcgaaaaagcaattgtttcatgataaacagaaaacatcaaataaacttttttatattttaattatttcgtatggtaattaataattattctatggataccttattcaaagaaaaacttattgttaaaaatcaaatcaattctactcatcttccataagatatatgatgattataaaatactaaaaaatttaaaaaaacattattattcctttttttatttttaataataaagcatttagctgaatttatcaaaataactttattatttatttagacaaccctaaaatataattcccttcaggagatgagacgaaaaataagattctaatcgcgagatatggtttttattaaatcttgaaacaaaatattaaatattaaatcaaaaattttgaaaagttgtttaaaattttgcgatagtatggaaaaagtattaataaattaatttaaaaaaaatactattataaaaacaaataatacataaaaacatttattattaaaataaaaacgcttacaacataattatatctcctctttatctccatttctcttcctgtctttttctttttgtctctgtgtctctctcttcctttctccccctctgttaatctcccctttctctccaactccctatctttctctccctcggactttgctttaactctctctctttctttttctctacaatttccctctctctattttttcatttctctcctctcagtcagtctttctctttccattccttcctctctattacgctttatttcaatcatttgcactctttctcgctctctctcttctttctctctctctctcttgtttctctttctctcgctctttcttctctctctctctccttccttttcctctcttcttattctctttttgtttaactcactcacacttccccttctttcttttaatttcataataattttctcattttcaattcattaatttttcaaagtttttcgcttcgataaataatctttttaaaatgtgacatacctacacatcaaattagtatagttattaattaaatttttgtaataaataaaagttgaaaattatatttattaaaatattatattttatggaacaacctaataaaatcttactttcaattaccagaacttaacctagaaataaataaattttaaattttctcgcagacaaaaaaaattaaaaaataccagtatatttgtaattttagctacatccagaatttcattccaaattcttgggggatatttgacagttttaaaaaattttaaaagataaaagattacaaataaagtaactaaaagatgcattcttataaattatttcactaaaaaagcaaaaaaggaatttgtaaagaaaatagctgagcacttaatcagctcaagtagaaatatatttataattttttttcttaaataaacaatatacttcaacatgaaaattaattttttatctaatatcagaataataataataataaaatacctattataataatcaattttaagaaaatttataaattcataaacttgataaataatttaaaatattaaataaaacttcacaaaaatacaaaaaatatatttaataataataatatcatttcaattaaaagcagggtttgtccaagatttaaaaatattaatttcaagcaacagatgaattacctaataattttaatcatatttgagatttgagaatattcaaactcttagtttgatctgatgagaataatttaaattaatttttcttcgacactttgccattctcagcattaaacctaaatttttgtataattaataattaatgaagaattatattttctattggtaaattcgtaaaggttaaataataaaagatacctgtacattatgacaatagaaaaataaataaataaagggcccccgaggtgcgccgtgattaac

SEQ ID NO: 13395 - DNA, 1036 bp, Heterodera glycines
  misc_feature (27)..(27): n is a, c, g, or t
aaaagttggtaccggtaccggttttgncagtaccggtcagtaccggtaccggtttttttgaaattaccgattaccgctcactctaattacaactttgaaaatattttttcgaatgaatttaatgatcttattattgtaaattatttatttgctcatttattcctaatccaaaataatcaatttaaatgtgcttgtttttacaatttgtcttggcaaaaaatttttccattttttatttcaattaattaatgaataatataaaaaaatgtcaaataaacaaaaatttacaattcgattaaaatatctgttaggaaacaaataattttttaaatttattgagaaattttgtcatgagcaaaaacaaaaaaaaaagttatggcatgtggcggcaaaagccagaaaaaatcaatttttagggttttttgggtttttcttacctaaagaaattgcagtaattttgcatgcttattgagttgtcatgagtttttgtagatgcaccaactttattaagtttgattgtagaagaaaatttattaccaagtcttggtcttgattttcgagactcaagaattaggcagcatgccgttgtggaccaaattttgaatgcaatgacgtcgaccaggcactagaggtgcgccgtgactgaaaaaacccgtgaaaacacggatttgatttcgaatgaattttttaaagaaaattagttggcagtgggcttatcgctcatttctggtctgtctttgcatggccaaattccaaaagcaccaaaactgcgaattttctcttccattcacaaaatgctctcaatttaatctttcaattttttgttgtgtatgaataaaaataagaacacaaaattatcactaaattaattttcagcatttttttgttcaagttaaaatagttccaaaatcaaattatttttgagtttctgatttcaattaatatttcctaatatttatttatcttagcttgttaattatatttatctacaccataattgatgtaaataaatagaaaattttaaaatctattgcat

SEQ ID NO: 13396 - DNA, 4192 bp, Heterodera glycines
ttattttggtggttttttgggaaaatttaacaaaaaaccacaaaaagcctcaaaatttctagaaaaaaccacaaaaagcctcattttgaaaatttagcctcattggcctatcaaaaaaccacaaaatgaggctaaagcctcagatctgcgaaccctgtatttacctaactttaattgtaagatacggtttaacataacttcttaactcattgtcagccagaattaaactcctttcacgaacatttgattttcagaaattgttgcactaattgctaattattatggccacaaaagcttttcagcatccaaaggatcaactccttgatgagcaatgcaaatatcttttcaggttacttttttgttaatttctcaacaaattgttagccaatttcgtttagaatgtccaacgaaatgaaagatgatgagcagcgattcaattttgtccacgggtagggtgttgcattggagggacatttaaagaaatttaaaacaggcacatttccgccgtcgaggatgggcatgaaggaaggcgagcacaagaagaaaattgtcaagtccatgggcatcctgggctctcaaagtattcaatggcaaaggaaagattcaaaacggacttgcgaatggttggacttttggaaattggtggtgagttgggtagtcgggttttcgaacaaattttaattatctcataacgccggggtttttttggagggcaaatacagcaaagacctgaagatggaaggagtgatggaaaatctccaccggggtcggccacttcaacgcacagcccgccttttatctgatgtgggccgaacatggggccgcactgtacaaccgagccaactttgacaagatcttggccatgtgtgaaagcaattgcaatgtcaatgcttttgaatgcgtggaattgttcaggttgcaatttcgaacatttacatttattacttgctcctaattttgtttagaccgctgagcagcaagtactttggcgaatcttccgacgagactgacacagtggcactgatcaaagtgatcgcggatcgtccggaggatgtgcgcaggactctgacaatgttcccggctaaactacaggagcagcaacaacaccaccatttgcatgtcagtcctcgggacgaattgccccaagagcagcagcagccaaaccctttgcccacctgccgcgaagagtttcctcaggagcagcagcagcctttgcccgtctgtcgggaggagttttccatcttccgcgacccggccaaatccatggtccatctcctcataatgctgccctttcatcggctccccaatgttcagatttgttgcgaccttgacgacgtcactctcgctggtgcgcatggaaaatttgctcccacagttttcacttcgacgcctcgtcgttcagtggctttttgcgccttcgaaccgccaatgatggaaatggacaacgatgggctgatggggcctgcaccgtccgaagacagagaggaacgggttggcggattgtttgcaccggtacccgagacgggcgtgtccaaattgcagcgtcggcttagtctggttgggtggatgttccaattgtttaatgcgtttttccctttcgtccaggtgggcgattttccgacacacgcagaaaagggctcacaatcggcgaagaaaaataccggagtcagttcaatggggttactgtaaatccgatggtcgttggctgtttttctgatttgaatagagcataaataaatatatagcgtatcactttttctgcctatttatcccttaattatggggtgggcggtggtccgtcagcataggcttatttccgtattaattatttcctatgccatttcaggggaagaaaatgactacgaatgacattgtgaaggcgttgccgaatttgaagatcggctcgaccattatggaggagacggaagaagacgaaaaggaaaattctttcgcttcgccccaccggaaaaaggcgcgccagggaacgaatgcttcgcatccgccttcacttgttcactcatcaaaacagacatcgcaactgaatgacgtttctcacaaccagccaaaggccgtttcggcagaaacgccgacagaagagggacagcccgaccccgacaccacccatttgggcattgtgtgagacataccttttcatactattgtttgatttttggaattggaaaagataaatttgaaccaattgtgtaaattaccatttagcgaacaaatcaaaactgggactgagaacccatgggacgaagaaaagcgcaatcagattctccaaaccgcacatgtgatggtcgaaagtcacgcatttatggtaactcaaatggtccccatttaaagctttatttttcttcgattttattagacggaaaagtgtcctcgtttcgagttgaaccgaacaatccatttgggaggtgaatcattctcgattgaagacctgttgggccaaggcggatttgcgcgtgtttacagggccaattcacgtgaagatggttgcacttatgccatcaaggtgaattggatttttagtgtatataggatggacataaggacaaatataattttaaatccgtacggaaataccggtcttaaaaaaaattcaaattcgttttaatttctcatgcaaattactcctccatttcagtacgaatccccggcttgcccatgggaagtgtacatttgtagcgcactcaaaagacgcattccatcccaattcgctgcttatctaatggaagtgagagacgcgtacattttcaaaaatgccagtgccattgtttacgaatatttcccaaaagggacacttttggtagggtgaaaggcattcggatgacctgatgagaattttcaggatcttaccaatgtctacaaaaagaacggaacggtggtgggcggtcttcttgctacttttttcggcattcatttggcacgtgcgctgcgccaagtccacgagacggccaacataattcacgcggatgtcaagccggacaacgtcatgctgttgacggcgtatgtttcggattgaaaattgtgattcatttctctcttggccccattaaatgtcccattttggcacatttattcgattttagtcaaatacagtgcacctatttttacagtgccttgaatgcacatgattcgctggacaatttgctcaaaacccccgtgctgaagctaatcgactgggggcgatccatcgacatgaaccatttccaaggagtcgaatttcacggaaaagcgggcaccgaaaatttcgattgtgtcgaaatgaaggtggttaacatcatgaatttaaaaaaccgccttacttatagacgggcatgccatggactttccagactgatttctacggtttctgtgccacaatgtacgtgatgatgaatggcgaatatctggtgaccttcaaatactcacaaacggacaaagttgttcccgtgaagcagctgaagaggtgaggttgccattttacaacttgattttcggtgcttttctttaatcaattgttccttccgattctttttccccctaatttttccactttgaggcgcatggctctgtacgacgtgtggacgcagttgttcgatcagttcctgaacattcccaactgcaaacagctgccaaaatggttaaatacattggaccaaatggaaagccgactggccgaggctgtgaaaacggagcctttggagtggaaaagagcgatcgaacggttcaacgaattcgtcaaacaacgggggtgaaagaaaagggacaagacattggatcggacttttgtgcaaatgatataacctatcccaaaatgcttttctgcttcatttataaaaataactgtccaccccacatcaataaatgaaatcctgtatagccatcaaatggataaaacaatgactcctggaacgtgtatcactatttaaaataattacactaactatgttttaaagaagagatttattgctctttaagtatgtgtacaacaattcaaatgactaattaagttgggcaattcaacggacgatcgaatggaattgactagacaataaatgaaaatgcttaagtaggaaaaataataatgctatggcctataataaaagatggacaaatgaaaaggaatatctgtgcgaaaatgttgatcattctgttgttttttcaattttgacctaactcaatcggccgagccagtgaaatgggt

SEQ ID NO: 13397 - DNA, 1934 bp, Heterodera glycines
cttggcccatattatgtttttgcgaattgcgtcctcaacctcgtcccgaggtcattctcactgaaaatggaaattttttaaaataaaacataatgccaactattctaagaaagtcgttgcgaaagtttttgcggacattcgtcacactgtttttttgggtccttaaaaggggagaaatctggttgagttcatcacttttctccttctatttcacgtcaagtcagcacccctcgtcatcaacatcagctctcttcatcactgctatgcggggagctccttcctcacctctcatttttgttatagtatcccgttattgtcaattgtccagatcatacaactggcgtcgactcataaaagtgcattagaaccctttttttccgtcgggagtcgggacaccaattccaaaggattacccaaaatgcggcgatgccctccaaaacaaaatttggtcaacaacttactgagtgaatttatacaaccatgcatacaatatatacatctctactaatacaatggaatacaaacagtttatgtatacctaaataggttatctgatttatcatatatatatatatatatatcatccatcacatcgtcgtttcatcgcattgtttatgttttgttggcatcagcatcgttctacccgtttctgcgtaattgtaagttgattcgatggatccacgcgggttttcggagaaaaaactctttcgcgtacaaacacatcaggacaatgctgaacacctaaaagaaggaaaatgctgcgcaaaaccaaatgacaaaaaacaaaattcaccaaaatggtcaacggcaccattgtgtgatccgcttggaagttgacgcaagtccataagtccgtccaatagaacagcaaattgaatgagagcacagcatacaaacaccagtagaaggcataaaagaaggcattgaaaaaggccaagcgcttaaaaacaaaaacaattaagcgacacaatggttggtaaatgcgttttgatactacgcgaacacaaaaactcaaccacgacaaaaacttaatttcaactcgatcaaaaaatccatcggattttcgactaaaaagcaaatttggacgcgattttgttggggctacgcgttgcggcgatcactcacttcatatgcttccacagaacgtcgcatttttgtgatgccctgccacagaagcccgacaagcgaccataatgcgctcatcagtaggaaggaaaaattggacaaagcgccatagttgagggggtttctgtttttgccaatccagccaaaaaatgaaatctgaaaaagcaaacacaattttatttcatcgttattattcgttttgctgctggttgaccgttatcggaatgcaatggcgtccagcgggaggcattttcgcggccaattcgtccatgaattggtggtgttgctgttcatcgattggtcgaccattggtgctgctgctcatcgacagttggttgtgccatttgtgctcgtcgaacaaagcgcggaattcgccagtttttgagtcctttccgatgagtgtaaagcttttgcaatggccaattgagatgtcatggaggaatgcctgaaaatccacacacatcatcattttgatcatttatgaaattcaaatgaattggcaacaaaatcaaatgaaatttgtcaacaaaaacaccaacagcacacctttgggtcggcaaaagtgccgcagaattcgcgcagtgaacgaagttgccaaatgaaggccaaagtgagtacaatttgcaacagctttaggtagacgatcttccccatgatgccgccacctgtgacgacttcttccgtttgctgtgatagattaagaagcagaacgatgttttgacgcaacgggcaaatagaaaacaatgatgaatataatactgagggacgcaaaatgagagcattttgttgaaagcgtccctttatatagg

SEQ ID NO: 13398 - DNA, 809 bp, Heterodera glycines
  misc_feature (753)..(753): n is a, c, g, or t
  misc_feature (784)..(784): n is a, c, g, or t
  misc_feature (790)..(790): n is a, c, g, or t
aaagtcaagttctagatgaataatcatagataaaatcaattattttgcaaaatccgagctcagattcgtgatcagcgtattttttagcctagaaaatgcccttccgaattttttaattttatttttcgaagaaaccacaaaactttaccattgccgaattgtttaaccatctttgacaaattttatgaaataaagtaaacagtgctttaaatcttctaataggttagtgcttcaacaatactcgattcacaattatttaattaggacgtaacaaaatattttcaataaaattatttccagttgtaaaaattaattttttgcttttaatatttattaggtgggaatgtcatttttaggcgaatgcctaaaatttctttgcatagataagcacaaaaaatgacgtttttcacttggtagaggaccagattcgtgctaagcgcctcggattatccaggaaaatatctttttagcaatttatttaaaaaaaattcgggaccaatgatctttatcattgccctttttgctttgcagccaattttcagtattttggaaaattccatatacaataaaaatgaaaaaaaaattgttttttttcatccgaatcagacatagcccaggggaaaaacggcggtgattttctcgggccaatcgaacagtccgtagctgcgctggatgttgtagaagaaaagccaacctgtggaaaaagcaaaacataaatttgggatggtatgcaacagggacggtcccagattnggggttttgtggggggggcacctccccccgngcgcgnacccttttttttttttttt

SEQ ID NO: 13399 - DNA, 4583 bp, Heterodera glycines
  misc_feature (11)..(11): n is a, c, g, or t
ctaaattatanttttatgtttttgggaaattaattccccctcactatttcaaaaaatttcattggagtttcaaaaagcttattgttttaaaaattcgcactttttttgaaatttataaccatatctttttaaatattattatttaatccaattaaaaatactttcggaaaatgcgcatttttcgttatttcattacaattgtctacaaaatttttcccggcggcgcctatcggcacccccccccccggttccccaaatttttttttttaaagcgtgccgtaaaatagtgttttaaaataaaacaaaaaaagccgttgcgtgcttgacctatttcccaagctaaaatagaagactaccaatttttattagtcaacttatatcaatttttattaatcaactttccacaaattaaaaaaatccctgtccctggcggggcaccggctcaaaattgggacgggagtcccggaaaagtgggagtccccgtcacggggtcccgcctcggtctattttcgaagtcccggccccggtcccggctatttcacaattccagtctctactaaaaatacataagcgcgatttttgtttgcgggatcctacgcgggactcataatttaatttaggttaagaattttaaaaaatcatacggagtctggtactatttgggataaagaataagccttgcattacggattgggatcacgcaaaaatccgacgcggaacgatcccgcgccaatctctagattagtaaccacaaattttttgcgtctaatcaaataaagcaatttcaacggcgccaaaacaacgtgtcccgttctaataatgccctttctgtttaacttttcctaggaattggcactttctaccaatccatatttaccacaattaacattgacttcaaagcacatctctagcattcaaagcaatccttgtcatgtttaagccatattcattttacgctattttatcaacccaaaaaatttttttcacaatttttaataatatttaaaaaatatattagtgattattggttaatttttataaaacataatattgactatgcaatgatttttttttaataaagactaatgcatagcaaaaatgaataataatatgaaatctcagaaatatgaataagtaatgacatatacattttacttaaatttcatttatttttaagcaaatattttaaatgaaaatatatttgctccttttactttatgcctcttcacaatttgttatttcaaactctaaaaagaatgaaatggccaaaaaaattggtcctctcaaaatggacaattcgaattccattaaaaaggttgtaaccaaaaattaaagtaaaaatggaccaattaaaaaatttattaaattataggcatttgaaggaaaggaaaagccgaatggtgtcgaagagtgtaaattgatcaaaagtttggaagatattgtgattacggaactgatcagcgaagaattggaccaatttgctgcgggaaacgagaacgacacaatttagcgacaaaaagtgcaaatttaaataaaattccatcgttgggcaaattttagattttcgaaatttttcatttttttaatcaacaagcatcaaataattgattgggggaggtgtgaaaatactcggcttgagaaattccaagggttttccggtctcaatttgggagtgaataatttttaaataacttctttaatgactatttttgtttcgtcctatattaattttggccaattcccccgtcatccatttcagtacattcccaatggattggtccaacggacggtggcaagcagtatggctggttgtctccgaggagggcaaagagctaaggtgatcaatttaaaaaatttattattttaaataatcatatattaaaaaatatttcaatttcgttaaaattttctattgcacgaatacattcttaccaaaagtatagtaccgttttttacttattttttataaattttaagtaagaaattcgcaaagaaacattttaaaaaactaatctacaaattaaaatgaatatttgaattaaaaagtcttattaagattaacaaatgatttatttagcactaatggcataacaaaagaggttagggaacattaatttgcctgtgcaaattttaatgtttaaaaaatgactcatagtggtcagtttttagacgaaatgccgtcagcaaatgtcaatcatttctttaaataacacaaaattggattaagaataaacagaaattttcttaacattgcaatttttgaccattttcgaagtttattcaatgtaccataaaataataaaaagaaaatccaatgggttatttttcgaatttaatttgttattattttcagattcctgttcccaacaaattcacttatttactactactcttaccttcaaattattgtatgttaaattcaaataattaaaattaaacaaccaaaaagtgaattgaattttaaacattttttgttcatttaaagattacaacatgacttgggaatggtcttccaagtgcttcatcaaaatagagcctgaaccgatcacgcttaacccggttgttgttaatgcttgccaaggagaaaagaaatttgattttgaaaacattcctttgcctgtgccagaaggaatcagagaattttcgcgaattcaagtcaggttaaaaatcagataatatgatttggtcaaatttcacattgcttacagttgtcttgacgaaaatgttatacgtttccttggccaaatcaaataccttttcaaagaggggataattcttgagttggaaaatgttcatcaaattatgcctagcattttcgctgcaatttggccaatcattaaagaagacctttacgcgcttagcgttgactatcatgggcttaattttatgcgacagtgcatctccaatacagtactcacttcatgcccaaaacttcgttggattgaagcaagcaatgtttttccccagttgccggacgacgacgacagtgccgaaacagctgaaaatgcccttcgggattggcttcatctgccattatctgatcctgctaagccgaaaattcttcaatgccgtacaaacgaccaagaagagttaaaaattgaggaaacagcggacatacaaacggtcctttaatgatttttaattaatattcgtttgttcggctttaaattaaaatttaaaattcaagaaaaagttgtaaaatcaaataaatgatatttgctttttatgtacatatttttttagaaattcaacaatgccgatactcgatcttcatacattttgggccttgcaaatccattaattgagcaaaacgaacacgaaaatcttactgagattcgcaatggcattagcgaatgcatgcaatttgaactcaaggtgaatggagacgacgaccgagataattggtttttgttgtcaggccgtacacttgacaccgacaacgattggagttcgttttacgatgaagcaactagcgagctgacgaaaaaaagaaatgttgtctgcattaagattgtcaacgaacaggcatgataatggtaataattagggcttccctttttaggcaaatttgctgattttggaccttttgtgcttaatccctcattttatacctttttcaccatttttggtgactatttcatgattttcggaaaacttttaaaatacaataaaaacaaaaaaatacataaaagaattgaaaaaaattatcaaaattgatcacttaaaatatttcattataattggaattttaaaaaaaagtttgttgattaagtttttttttgttttgttatctaaaaagcgttaataaattctatttgaatattaattaatttataaccaacaaataaacatttattttaccattttcagatcgttgttgtaagctgatggcgcggaaattacgttacttcgtatactgtatcttcctattctgttctgtttgtgatatatgtatcgcaaatatttatcttaaaattatacaaaaaataaaatttatttggtagtactttttgaaaagtggcggagagtgatggagaagacggaaaatgactgtttaatgggtgccatttaatgggacaatagacaaatgggtaggatcaataaaaaaagagtgaaattaagcgaaaaatcaaagttcaaatagatgacataactgacgggcgatttggcatttaaaaatgcctaaaaacccaataatatacggtaaattttggaaatttcaataccatttttaagtcttccaattgcctttcgatattgtaaagataataacatttgagcattttggggcgctcatcgtcgcgcggggtgtgaagccacttggacaatgcctggttttgtgatgccccgggaccatcgtaggacggactctcgggaaaagtattgtcacacccgacgattctgagattggcacactcccgaagaatggacggagaagtcatttgcatcaattcgtataattcatttaacttcagaccagtcattacagcaattcccttagcaacaagaggccaaatatgctttaaaggttgccaagcataagctccagataagcgcaatttcaaaagttaatttttcgtcta

SEQ ID NO: 13400 - DNA, 2686 bp, Heterodera glycines
ccacacgacagagaccgggatctcgaaccgataatacttcctatctcgtgtcgagatctcggcattatcgggaccgagctgcctattcgtgtcgaggcgggaccgagcagcccataggtacgggtctgctggcgagagaagttagacggtgcactctctcgtcgctggagaggttagacggtgcactctctcgccccaaaagaagccaataggtttggggtggaaatcaatcgataattgaagtattctgttattgtagtaaggagagtgttcaggtgatggtggaatttccaaatgaactttgtacgtgggtagaccacccttgagttgagaaaatttcaaaaaatgcaaatttggaatcaaattttgaatattttatatggttttgggatattttcacagtttaatttccaaaaatcccttgagttgtgtcttcaatctttgaactaaagacattttgccaaaataattattaaatttttcaaatttggggcagtttcactggtcaaatttagtcccgttagtcccggtccaaatggccgggaccgggaccgtgacttggaaaatggaccgggctgggatcccggtaccgggagtcccgttttcccggtcccggtgagttgtccaaaaaaccgggaccgggagtcccggcaaaatcccggcggggtcccggtcccgtccgggctctaataattattcttttatgatattagtaaaatatttttttttatttggctaaaataaattattaacttctcagcagcatattaatgagtaaaagaataagccatgaaaatcaattaaaaagggatttggtttgagaaggaatggcaaatgcttacgcctaaaagcctatgtgaataacaaattaatgccgagagtgaaataaaaaacctacgaataaaaagcatttttacatttaattttcaacaaatagcctcgctttataaaaaaatttattttgaaaaattaataagaattcgatttttggaggttcgttggcgcaaaagttcaaaaaatacaatcaatttatatgtacaaactcatggtcagggaaaatattagaaagcttagaaattttcaatttaatgtttctaacatctcaatgtatgggatggaaagaaagaattaatctgatgagagagtaaagggacataaagcacattattgccctttcataaaaagtcagtggcgtccaaagtacagaattgaggcaactggtgcattaattggcatgccttcaaatttggggcagtttcactggtcaaatttagtcccggtccaaatggccgggaccgggacttggaaaatggaccgggctgggatcccggtaccgggagtcccgttttcccggactcccggtgggttgtccaaaaaaccgggaccgggagtcccggcaaaatcccggcggggtcccggtcccgtccggtctctaataattattcttttatgatattagtaaaatatttttttatttggctaaaataaattattaacttctcagcagcatattaatgagtaaaagaataagccatgaaaatcaattaaaaagggatttggtttgagaaggaatggcaaatgcttacgcctaaaagcctatgtgaataacaaattaatgccgagagtgaaataaaaaacctacgaataaaaagcatttttacatttaattttcaacaaatagcctcgctttataaaaaaatttattttgaaaaattaataagaattcgatttttggaggttcgttggcgcaaaagttcaaaaaatacaatcaatttatatgtacaaactcatggtcagggaaaatattagaaagcttagaaattttcaatttaatgtttctaacatctcaatgtatgggatggaaagaaagaattaatctgatgagagagtaaagggacataaagcacattattgccctttcataaaaagtcagtggcgtccaaagtacagaattgaggcaactggtgcattaattggcatgccttcaaatttggggcagtttcactggtcaaatttagtcccgttagtcccggtccaaatggccgggaccgggacttggaaaatggaccgggctgggatcccggtaccgggagtcccgttttcccggactcccggtgggttgtccaaaaaaccgggaccgggagtcccggcaaaatcccggcggggtcccggtcccgtccggtctctaataattattcttttatgatattagtaaaatatttttttatttggctaaaataaattattaacttctcagcagcatattaatgagtaaaagaataagccatgaaaatcaattaaaaagggatttggtttgagaaggaatggcaaatgcttacgcctaaaagcctatgtgaataacaaattaatgccgagagtgaaataaaaaacctacgaataaaaagcatttttacatttaattttcaacaaatagcctcgctttataaaaaaatttattttgaaaaattaataagaattcgatttttggaggttcgttggcgcaaaagttcaaaaaatacaatcaatttatatgtacaaactcatggtcagggaaaatattagaaagcttagaaattttcaatttaatgtttctaacatctcaatgtatgggatggaaagaaagaattaatctgatgagagagtaaagagacataaagcacattattgccctttcataaaaagtcag

SEQ ID NO: 13401 - DNA, 1222 bp, Heterodera glycines
cctgcaggtcctggcttcctaaattgagataggctaaataacattcaaaatatgtgaagatgttgccgaagtgacaaaataacagtggacaattcggcattttctaattcaatttttcgacttttgattcatcgtcaaaaaaaccgtaaataaaaaatgattaatgtcaaaaagtccaacaccaaaatcattcattatgataagacaaatatgtgtgttaattctcttgtttactcttcttcttcttcctcctcttcgtctccttcttccacgtcctaaattaaattcttatcacttttttttcaacaaatcttctgtttttctttttagctcatttattatattatttaaataatgattaatttattattacaaagaccggttccatctgaaaactttcgctaaactaagcgatcgattgtacaatctaataaaatattatggaattttggacttggaaaagacggagtgtccagatggaactggcacatttaactccaattcattaccgcgcatggtctcggacttgtgggctcatcgttcatcagtcggaactcgagaatggttggcggtggtggcacgtgcgggaagcatggaaaggcatttttctgtgcaaaaaattgctgattgtgtttggatgccgggaaaatgtatcattgacacagtatttttaaaaaattaggatttgcagcaacatattataattataaaggattaaaatggactgaattaagctggttccaaatacattaattcagttttttaactcgaaaaattacacaaactcttaaaaagaaaagcatgctgtaagggaaaagctgtagttttcttcctatactaattaaagcatgaacttttagatgatctatcccatttcttcaaatgctgcatcactactaaaatatttttcaaattggtcgagtatttaccagaaaaaaggaagcaaaaattttggtaaataaaaattgcacaatatttggcataaactttgtgccagctcaccttgtcataaattgctcgacgctcagtgaaatttcgtcgatcaatctgtcgatcatatttggatgaaatggcaacttttggctacaagaaatttctgatcatttttgccaaaatgatcgactcccaaaactaaccggaaagcgcgaatttgcatcgtttggatccagccccttcttttgtattttggcacgattgatctgtcgttgacgctcgttcaact

SEQ ID NO: 13402 - DNA, 1399 bp, Heterodera glycines
agataaactccaggaagaaacttattgctgagaattagaagtataaattttgatttaaataactatgcaatttgttaatttaaatttactcgggtggtgccttcactgttgggctcatttggctcacttcctctacatcctcctcaacttcaacctcctcttcactgctgaatgcaaatcaaagtttagattacatattgaataaaataaattaagaattgacaatggaaataaaatcttcaaattaaattagatttcttccattttaggctgtaaaataatttttttaaaaataattctgacttactattcttcttcagacattttgtttcaagagaagttacgaatgccgaacagcacaggaaaaagacaatttgtcgagatgatgaacaacttttgtgctatcgattttaaatttatctataataatgagaaaacgctttaaaatgtttccttcgggaaagttcaaagcatatttaaataaacaaagccattgaattaaaaaagaaatgggaacctaaaaatacgttaaaatttttttcgtgaaaaatgaataaatcggaaaaaaagatataaaacaaaatcacacacattaatctgtcggaggtttgtgggtacagagcatctcacaaatcagcggaatttgtgtgacaaacttttggaggcggaaaatgaaaggaatcgcccgcacaaaagcgacgaaaacatcttccgctgctgctttctctttgtgcgcattgtgctgaggagtaaatgaagaagcttctcccaccccggcggaagaaggggcccattcatcggcaaaatcggaaaaatgaatccattttcccggccgaccgactcacattttctcgacttttcgtaactgcttaaccctccctgcgcttcagttccttgccctccctcccccgacgcccctcttttctgcccactctcattgatcagaagcggaatgggcccactgatcggccttccccctcccccaccccaactttagtcccattttgttgttgagtactgccgcttttgctgcttctgcttgctcctcctccgctttatcttctcggcttcttcttttgtttgtgtacccttcctaagtcgtcggtccctccctccctgtgttatcccactgttttagctgaatggggcgggggattttgacttgtgacagctgccgattttgtaatgcggcattaagttgaagagcacaagttcaacaagcacaaaattttgtgtatttaaatttggaattacggtctgtattttaaacagaatttttgatattgtatgtagagcttaaatgatctttttgactgttataatattaaatagggactcttaaatttgtcataaaaatttgcctatacatattcaggggtggcatctcaaatgactctag

SEQ ID NO: 13403 - DNA, 425 bp, Heterodera glycines
tccgttttgcctttctcagcttcggtccgccgccgcctcactaggttccaaacattagttaaatttgtgatgtgatcgttcgcattttgcagtgcttcgaattttgacagtttttgaccgtttcccttcggtggcaaaacggcacgaagctaaaaaggaaaagagaaataaataaataaagtggcaaatttagaaagggacaattattttaaaaattgaagcggaaactcgccttttcgtaagccttgttcagcaaacgcatccttttcctttcgcgggcatttgcattctgaagaagatttaatttggaatttaaagttattatttattttttaaaccaaattctctcttctccccccccccctctcatttctccactttctctttcccaccctctctctccctctcccctctctccccccctc

SEQ ID NO: 13404 - DNA, 1599 bp, Heterodera glycines
ctctctctctctcatttctccactttctctttcgcaccctctctctctcactctccccctctttatctccccctccatctaccctctcctctttctctctctatttcttccctcctttccccttatctctgtctctccctctctgttttccccttcttctctctctctctctctcactctctctctcccctcactcccttttttcttttttttctctcacctctcttcgtaccctcagcagttgtggacttggtgttttgtagcgtcggtgttccccgcttttttgcctctttttggctgttttttcagttgaatttgtgtggcaatatttcgctgatgcaaatgcacaaattttgatcggtggagaaagagaagaagttgaagagaacggcgaatttgggctgaaactttggcattttgagaggaaaaaatttaaaaagcgtaccgaaaggatttccccaaagtttcgacttattttattgcctgtcttaccattggtgttgtccttctgccaaatttggtattgaatttgtcgggatttggtgtggcacaatttggcaaaagtcccagcagaaaaatgacggatcaaacgccggcgagggatggcacgggggccacggagcaaaatggggcgacggcaagcacgagacggatgaggaagaaacggaagaggatgaagatgaagaggaagatgaagaggaagacgggcaaagggacggggaagaaaccgaagcgaaggcggaagagcaagttaacggcagcataattaggcaattaggcaaaagggaaatggaaacaatgcttagatcggaatgatgtcttaataaaatgagcaaatcaaaatgaattggccatttattttaaggaaaattttgaaattctacgaattcgcgcgaggacaaattatgatcacttagaaacagtgagcattgagtgataggtgatcactccgatcacttcgtcgctctgttcggttcggtttggttctatgccgtggcatttgtgagtgtcgtccttcgtccttccgtcgctgtttctgttccgtgggggcgtgtccccctgggggcggggggtgttgcgacttgcacaaccccagtgccactgacaatgagtgggtgaatgatgtgttgggttggtcgtgatgagtggtgctgtgtggtccccgtgtaattgccctttggctgaacggtctggcgcaacagatgtgccaacggaggagcaatttgatggggacggaggggggggggggcggagggtccctcccggaggatggcccgacttatgacaatttcaaatcttagagtgaatgggggagggggcgattaaagcagtgattgtcgagtgagtgccatggaattacagtatgacagcagaaaaaaaaagtagcaaaatggaaagaacaaataagacgaatgctgcattcatttggtaatctcaatcatttcttgtggctattctcgctgaaagttcctacagatcccttcccgagaaagcaacactctctcgtcacgtaccatcccctgtataatcttaatgtcaaatcccttccggagaaaagtcctaagagcttgatcgataaaatcgttgtctttccattaa

SEQ ID NO: 13405 - DNA, 1170 bp, Heterodera glycines
attttcatttttatggactttcttctgaaccctatgtcaatttgcggtcttttaaaagaaaaaaattcaaaaaaaaaactggaaatctttcagggacggcttccgaccggtcccactgcttttgtttgtcgattatcattaattaaaatagctgattgtctgtgggtgcttcgttgtgtatataaaggaagagcataagcgttgtatgatcaaaaaagagcgatccttctgattttgtctcttggctaatgaatgaatggcgaatgaatccgtcgcccttcccgccaattttacgcacttttcaaaatgcccgcaaagaaagtgcctttggacggtcataaaatgattcactctttcccttccatcaaagtgtgtaaaaatcggatgaagtttatggggcgattaatggcaaagggatgaaaaaagggggggggggggaggaaatgacggggagggcataaaagggcgaaagggaaagaagacaaacgcattgggggcaagaacagaagaagcgggagaagaggcgggacaaacagtagaagagaaaggaggaaatggaagagggaggagaaaggacgagggagggggaggaggaggaaaaggaaatggaggagactaagcaatgaaccaaaaaaacggggctgaaatattttttctccccgctggtcaccctgcaagccccaaaatgcccaatcccggggcactctctgtcaacgggtgcaattgttgcggactgaccgaccaccaatgttcaggttctgttactcatccgtccgaagtccatttatcatttgaccatctcccaaaatgccccgggcaatgaatgccctcctctctctctgctggtgataatctctcgttaattgcatttcttcgctattgtctgtccctttcgctgggtggggggggggggcgtgaatggattcattttgaggatggatgagagattgaccaggaaagataagggggagggatttgaaagaaatgaatgaactgccaaaaacaaacaaaaaaaatgaggggggggggaggggacggatggccaacaccgacgaaacgcactcatttggttaagcaatggcgagaattttggacaatggccaccggcgaacgacacgcaatgattggaagagaaggaaagcaaaagcaaaaaacgatggcattggcact

SEQ ID NO: 13406 - DNA, 3697 bp, Heterodera glycines
  misc_feature (1571)..(1571): n is a, c, g, or t
  misc_feature (3618)..(3618): n is a, c, g, or t
ctcaataaatactataatatttgaaatggtaatttaattttgatttgaaatgaggtcatcaatcgttcccaagttgtcattctccgccctcctcttcttgcggctgttggccatcgtcgagcagtccggcaattcgcttcaattcaaacacttggagttgcagttcatcatcttaagtaataaaaaaaaataaatgaatggtaaaaataaaattctaaaattaataaccgtaaaaacagtaaatttttgtaaaaacaaaacccacttttcatttccataatgccctgtggagtaaagaaaaagaattggatatgtctgttctctttggccaattcggcaagcatttccatagcaaacccttaaacaaattaatggattattgtcaaaaataaatggttgctcacttcggttcaccgggtccatgaacacgtcaaattcgtccgaacagcgaaatggcgactccatgcaactgttccacaatgccatcacaaaggaaacggttgtgaatgaccgctcaccgccgctcaaacctaaaaatggaacggaatcggtagagaatgattcggggagcgaactgctctccccccccccctccattctgacctctcaaatcttgcagaattcgtttgctggtcgtgcccgccctcgttgttgctgccccggtccgttttctgctggtgctgggcctctgcatgtcgtcatgtccgtcctccccctcctcgtcgtccgttttttcgcctcccgtgccgggccgttcaacgcgtatttcgaccagctgtcgctcgtcgttgatgttcaggctggcgtagaagttgcgcatgctcatgttgttgcggaaatcgctggcaattttctggggcagcgatgccttcagcagcagaaaccgccgcttgcgacagtctttcatttcctccaatttctgaaaaatgggggaaaatggttattaatggacagaactattaattgcctgtttcctgcgagaccaaacttcgtagtccttcttgaacttcttgtactcgttcgctttctttaagaggtcgtcaactgtgggcacggggtcatgactaggggagagaaaaataagccaagaaaaataaggcaaaggcatgggacacattctcagatttttatcatattattgtacttgttctcctccgttttgatgaagcgctcaatttccctcagatttctctttaattcatccgtcggtggtatcttggtaagatcgggcggaaactcctcttggtcaggcgccaattccatcgatgcgatgtgttgttggagttcagtgttttcatttctgagtgaatgtttacgggttttgttgattttgatgaatttgtccccttactcccaattggttatttccttctgcaatttgtcaattttcttttgctgctgatccgaaccaatttcacagttttcaattttttcatcaattttcctctgctgcaaatcgaaactgtcaatgtcattctaaaaaaattggagaattttagaaataatattattatttaaatatggtatttaatttccgaaaattataacttgaaacaagggggtgcgccggncacccccccccccccccctcgttcgtcgtaaggggggcggctgtaaaggaggggggtgggggggtcgccatggtggggggtcgtaacgaaaggggagaaaagttaaaatttgaacaagttagaaaattcaaaaaaatttccccggcggcgcctatcgacaccgctccaacacctcccacatgttttctggaaaaaaacgcgccgcaaaaaaagtggtttgaatagaaaaaaaaagtcgtcgccggggaaaattgggggccttcgtatgaaaaattggtcctggcgcaccccttgttcatgtatgctccagagagaccaatcttcataataatcaaatcggatgacctcaatttggttgacgttgttcttcagataagcaacttttttgtccgcttcgtcaatttgtcgtttcgtttccttttgttcctccgttttttgtgcatattttgtgttcaattcgttcaattggccagtacattgtgcaagttgtttggaaatttcacggatagtcccttgctaaaaaggaaaattaattaaagagtttacacaaacaaatatcattagcaataaaaagctagagaattctatacatgaaaaaaataaaaaatcatataaaatttcaataaatggtaaaaattgtaggaaaaatgttagtttaaaatgcacaccaaattgtcgatcatttccccgctgaagcagagttggtccaacttctgcagctcatcctccactttgaatcgctgctccgtcaattggttcaattggcgatcaaattcgctgatcgtcgagttcacttcgctcaacgcgtgccctgctccgcgaactttttgctcgtgctgaaaattcaacaattttttaaaaaattcatcgagtttatttttcatgcgattaaaacaataaattcgataagttttactatctccaactgactttgttcttcacaatttcctcgtccacaatttgatgctcaatttgccgcagttgtgccgttatgactgctgggtcttgtgccaaaaagcgctgtgccaatgcgcgcgagcgaaattggccattgttggcgaagaaacggtagggctgcctgccccgggccggatacacctgactgcataacatggtgatggccatcgagacgtttggcgggggctgaaatgtcaaacattaaaaaatgaagatacactttcttgaaggcagcaaaaatccttagtattttctgaaagaatttggcctggaattttgttgaaatttgtttaaaaaataaacaaaaattaaaaaaactactaattgcttataaacatctaaaaaaacatactattttaatcaatttggtcaattgaaataaaatacaattttgtccaggaagtctttgtttttcgtgcccaacgacatgggcataaattccaggaaaattccggagatgaaaactgtcgggaactttccctcctcacttgtgggtacataatgttccgcgcttcctcgtccttctctaccaacaatgtgctttcaatgtatttcaagtccactaaaatgttgtaaacggtcggctcaatgtcatcagttaacacgcgttcaatcgtcaaatattcggaaggtggctcctggtcacggatgtcgaatttggtgtccgaaaacctgccgtaatttgtttagaattcataaaattttaaaaaatttgtataaaaaaaagagagcatacgctgctgtaatgatctctggcgggtcaaggccattccgtttgaaaatgtcgtcgagtgccgcgcggtcttcggacgagtcgcaaatgaaggcggacagcgtcttcttcatgtgaaattccacggcatttgcccatttttggtctctgagtttgatgaaactgcctaaaatggggaaacaattagactttggcacgcatgactttatcaatttttgctcaccaattggtccaattggcagccttcgaaatgattcccggttcatttcgatcagtttgaccaacttcggcatgttcgccccgaacagtgccagtcgattgaccttggagctggccaacgtgttcttctcctctctncactggtctcggcgccgctccaattggtgcaattcggaagtgtgttcctaaaaaataaacgcatttaactgcaaaaatg

SEQ ID NO: 13407 - DNA, 1790 bp, Heterodera glycines
  misc_feature (1784)..(1785): n is a, c, g, or t
aagtatgtgtgccaaaacgtactcgccaataatggctgccaatttcgcgttcgcctccccaatgtccttgtcaaatgccatcttttggtgtgttctcttatgaaggtcgcgtttcaaatcggtgatttcaaactccaattcacgcactttcctcttcatttccatgattttctcatgttgttgtttgcacttcttcacttcctcctccttttgtggcaaaaggctctgttgcttttggatcagtttgtccttttgggccttaatttcaacgaattttttttttgcagtttttggtgacttttattaaggttgaaaaaaacttgtaaatgttttaccatgtgttgctgaatctgttccaaaaggtcgaccttttccgttgaaagtgttccaacttcggcacgattcccattcactctctgaaaatttgaaaagggcgtttaatgggtttttaattttgtaagtctctgctcacggtgatattgtcccgaattggggcccaaaagttgtaccacaaaaggcgttgtcgctccacttttttgtctttgatctctcgcgacgctttgtgccggtttttcatttgaatataatttctggcaaatttcaatttttaaagtgatcatgaattgttaatttgatcagtccgtcactcactcctcacgcgcttttttttctgcagcgagcgaatcaaaaactctgcaaaattcgtcaaaatgcgcttcaatgctttggaacatcaaatcggtgctgtccatctcggcggttttcctgtacagctaaaatgatcaaaggaaaaagaatggtgtttttgtataaacttgattacaattttaggagaaattcgaatattgcattgcttttagagtccgggatttgactaatccgaaggaccgacttttgacaaaatgctgagcatttttatggtaagatatttgaaaagtacctggtacaacttttccggtttcatttgttgcagaaattgtctggatctgtcctgggaaagccaggccaacggattgtccaactcaatgccgaactgttcgagcaatgcgtccaactcggcccttttcctgctgacaacgcgttcccgaccgccgaatttggcactcgtcttcagcgtaaaattagtcgccttctcggtgatgtggcgttcgaccacgaccacttcgtcaaagttggcacaggcaaaaggcccctcattagacagataaatacgtatatgagcatcgctaaaaacagctcaaattaaataaactaaatgccggtgaaacaaaataataatttaaaaccacaaaattgttggaattcaaataataaccgacctcttcccgtctttgatgtaactgtgcaacgttttaccccgttcattggagcgcccggtgccgccaaggccaatgttaagtccggcaaacaacgcacttttgccacttccatttgggccaataatgtagaaacagttgttgctgtccacgtcaaaattcagctgaatgggggaaaagcgtgctgattttgttttatcttttcttttgctaattcttcttaccctgagtttgttatggcacataaaattctccaattcaatgcacattacttttccagcaactaaattttatatgaaaccaactttaaagccaaaaaagacaaagccacaaaccagctggcatcaattccttgggtcttttcagaatgttaccaattggctggtcatcctcatccaaacacctttttttacccgttgtagatggaaattggagatctttcattttgatagtttgaacaaacgaccnntgcag

SEQ ID NO: 13408 - DNA, 4229 bp, Heterodera glycines
ccattcctttttcttgtccattctctaccagtgccttcctctgtttgtccttcacttgcgcgtccctttccatcgattgcattcccttttctgtttggtttgttgttgttctcaaagacaaataaactatttttctcctcctgtttcttcaagtgaaatcccaaaaaaaagtttgcttctcatttgccataattcaaaaagttggccaaaatgtcaccaacggcaacccaacgacggcattcacttttggcattgggttccttttcgtgtggtggcctaagacgaagcgcacggctttcaatgaaagcgcgaaaatgttcacgaaaaatgtgtggtgaaattaatatgtatttaaaatggaatttaattttaaaatatctttttttgatgaaaatttatcaattttaatttttactctgaaaacattttatctgattgggccaattatcaaaaagtgaggacaaaatcatgtgattacttggcttttagctacgtgtgcaacgacatttggctgcacatttttccatggcttacccccgcaaaagtcgggctgaacatggcaatgctttctgtccgattcgattgtcttgtggcaacgcatttaaaaacgcggaaatgggcatttaagagaatgggtatcttttatagcaaagagaacggcggcggtgctggcgaaaggtaaattaacaattttatgaataattctgcacacacaaataaaaatggtctgtcaccaaatattgctctaattttcataaattttctccgcggcaggcccctcaatgttctaataagtcatataaattattcatttttggactattaacaaggttcattcaacttttacaaactgcgcctatttgcactgccgatttctcaataaattgggttttttcaagacctggttcgaactggaccctgatcttccggatccagcaccacccggacctgactttttcaaaatacccggactatcctattttgtagtttttaaatttcattaattttaaaggaaattcagtcacttagaattggtaactccctccctccctcccacttcggcaaaaatgtttgataatttataaataaagaaaactcatttatgaaatatctttttttgaaaggttattcggcaatttgccagtcgaccagttgccaccaccaagcaatttaattggttttaaagagatttacatcaggtagataaatacttttattttgtatataaaaaattcttatcccccatgctgcccctataaaaaatgtaagaaaaattaaaaacaaaataccttattatgtatatagcacatgtttcggaacctaaatgaattcgactcaatccaatttgaaatttttaaaataatttttgctagattttttaaaaaggaggacacgtagagctctagctgcctgcttcttacaataccaagattgattatttgattaaatttagctaaattatgatttattattttgcaaacaaataaaataataatgaaatttaaaatattactatcattgatacttttgtagtttcttctctccacggacaccacaccggtggtccgggggtttggagatttagtaaataaataaactaaattaaaaacatttaaccggcacgttcagttactttgacaactctgtgctctcattgctccattgcttaacgccgcttttcaaaatgggcatcacattgaaacatatgggagatgggatggataaacagaggagttggggactgttcatccacaaaattcttcctctgatcggcatccccaacatccacaagttgtacgttacttgcgggtatgttttggccaacaatgactctttgggcatctcactgatcatgattaaatagatcagtagggtggggaattagacaaaaaaaatcaagaaaatactaaaaattttttctttttctctcattttggcgtattatttcaatagtacttgaagcacaaaactcaatcgccatattttaaatacctaaaatttgcatccctagcaacaattattcccaatttttagtggcgctaaacgactgcgtggactgctcgcaagcacttcaacaacatttctgatcgattgtcccaatctccgatcaatttactatgatgggaataccactggccttgatcgtcccgttgacgccaacgcaaaagtgcgggaataatggcttctgtggccacgggcagatggccgtccgaaagtgttgtacttttggtacgatataagtgacgaatacaagcaggcaagcggcggaaaagcaaatccataaaaatgataattaatcgaaaagtaagagagggagaaagataacagagagagagagagaatgggagagcaaaagagggaggaacggggagggatataaaaagatgagagagtgggagaaaagagtgagtttgagagggagagaaaagacatgaaatagagaaaaaaaagaaggagaagagggcagataaatgagactgtgagggtgaataagtttcaaaaaatagaatttcaaattattcagttggcagaatcatttaggcattcatttccatttccaggaatttctgagtgccacaagcgcagtcaatttcatcatttgtttcacatcgttttgcattgacgaacaaccggctgaaccggacgacgtcgaactgtttcagttggacaacaaacgcaccaatgaacgactggcactagaacgaatggtgttggatcagcagagcaaagtttgcatgacgagggcgccgatcggaagagacgagcgaaagtgggcggaatggatgcgaaaagcgtgggaggaggaggaaccgagcaatttgctcatattttggataacggaagcgaacatggggccggacatttgattagacccaaattctgttccatttttgcgagtcgtttcaattcgccgcgtcaaattttggaatgtcataacgtttcttattcagttagcttaagcaagagaggcttcatttcaaagttatggagctgcacatttatatgctaattgtaagatcaaaaacgatcattcattctaaaaaagggattttggcgaaatgactcgtccgttttgctaacctctgtattctcaacttagttttacgcttcttggcattctttttcatttttaatattggcctaatttaattttgtacttaatttaacatttgtttggaaaattcattaataaaaatgcaataaactgaaaaaaatgcacgcctaaaaattcatctttcaaattataaacagataaacctgtaaaaaaagaattgtcaaaatttcaacgttttgactaaacttttctactcattgttttcttttcgtgaggtgtcaatgttagatttttaataaaacccaagggggaggggacccttttgatttgcaattttttttttaaatgataagtcaagtcggaaactgtttccggtgtttctggattgttggtcacgaatttaatatcgatttcggctaattccgaatttaaaacccgaacaaaagccaaaagttcgaaaaatttaaaatcggaaaaaagtttgggtcaaggatccgaaatttgttaaaatgaatctcagattcatgatttatgatcaaagaccaagacctccagacatttttctgtttgcaaaccaaaattgttcagcagttcccccctttagtttttataaattccaaaataaccacggcgagttttttaaattttgtacgcgaacacattcatttgcaaaatgatagactcggaattcggaattcataggctcgctcaaaaaggtcgaaaattggaaatcggaatccatacctccaaaaatgtttgtggccccaattaaaatttttttccatattggcttggctgggggattttgctaaacaattatttttatgttttttttaatttgttatattatttaaaaattgaaatgtgcaaaaatataaaatgtttttcgctaaaatccttcggaatttgactttgtcttcgtcattcacctttcttttatttaaaatctgtctgttggtgtagcaaatatttgatggccacaaagagggcatttgttgtatccaaaaaaaatcctaaaatgaatttattaatctgtttgaggcagcaaccgcacatttaaataaatgcaattgatgctaattgaggaaaatactcaaaatgaataaaaaatattttcattaaaagaaatgaatttcaaattatgaaattaattactagggaaaaagcccacaat

SEQ ID NO: 13409 - DNA, 3302 bp, Heterodera glycines
atataaaattctttcgccaaaatctgcccaattttatccatgaaaaagtggtggattttcttttgttttgtgcttttttgttgcagcaaacgccacaaattttgcacaattccaaaaacatcgcttcgggcgacgacccctcgccctttcatttcatttattcatttgctgcccctttgacgagttttgggttccatccgtccgtcgatgggttgccgaaaaacaaaaatttcgtcgtcgtcgtcttcgttttggtgtgtgtttccaaaaatagcccaccaatttgtcatagtcagccgccccctacggctgccataacgcggcactgaaaagtgtgcacagtgcacgacgacgacaacaaatataaactccaacccaaaccaaagcaccaaatcaacgccaatgcgtggacactcatttcattatcatcaattaattaactaattaattaattatcggctgtttattgtttgatcggtccgccaattggcggaagaaagccccgaggggcgccccgcggtgaattcgtcgtccatccgccgtttcccccaattttcggcgtccattcgttcgtttgtccgtctgttgtgttgcagcagcagtgcatttgtgcagatggatgaatggaaggaatgtgctgctgcggttggtgacggaataaacgacggcgttttggggttcgttctgtttttggttcagcaacggcgggcgaaggaaaagcatcgcgcgaactgacaaggatgaactcaaattttaatttataatttttttaaattcttaacagtgagacggagcggcgccgaagggtggggagagtccctattaaatttgggaatggcgacgatgaaaagccgagaaatttctcggctcgaaaaccgagatctcgaacaatcctagacaaaacaattgcgtgtaattactttcgtttaaaataatttcaattatttttatatatttttttaaatttccctccctttttccccatttttcttttggggtgcgctttgagtgcattacagcgaaaaatgtgaaaagcatttttacacggtgtactgcgaatggcgaccacaaaaaagcggcgatttttgcgcgcgcattccgcgaaaagcgccccgggcgacgcaaagcgaaggacggacacacccaaagcgaaaagggactaaagcgaaggacaaataaaaaaaagttgggggaagagtaggggaaaagccgggggcaaattccaacggcacaaagtgcaaaaaaagggtggaaatggaattttccgactgatttttaaagcattttttgaatattttgtcagaattaccaattttgattgatgtatctttacatattttatttaattaggtaaaaatacatattttaattgaattttaatttaaaatgaatggccaatcgaccgattttattcttcaaatttctttttaaaaattaaacaaaaaccttttaccattaatgagttaattttttttgtcaccttaattacaaaaaaatggtttttgtgacgtcattttgtgcgactgttcgcgtgactcactgcgccccttttgtgcaattcgccgccaattcgtccgctaattaataaatgataatgggaaacgtcgcgcgggttggccttggcaatttcaaaaccaaaataaaacagtgaatgatttggtggcattttacaaaagtaaaagtgaaatgccaaggtcaaagtgatcaatcaactgatttgctaagtcaaaaattccaaaattagctcatttgccaaaataaagcgactaattaaagtgccaaaaaaagaaaaagtaccaaaagcaccaaattatcggacagattttgcgatgccaaaatcactgaatgtataaacacagttggcacaagtgaaaagccttcgaattccctcaacaggcgttcatttagtctttgagcacaatttttggaacattcaatacgactgtctgtatacagtaccccacccaaagaaaaagactgaagttggtattacagtatccaattgaaagcgacaaatttccatcagccaagaagaagctgaatgaatgcggcggattatttaaataaatgcctcaattaattgagcctaatttggcacttttatttccttttcctttttttgtccttttatttttccatttccatttaactttttaagttgttgacgcaatacaacaatttttgaatcattcgaaagctcttcacagtctctattagcctactaataattccagagaaagtcgaactaaaaaaagatagagatgaaaaacttacgaaaattctttcaagcgacaactttttttctgagctccttaatcacttcgagatagcagaaatatcttctaaaatttaaaattttcgaatgttaccaatgtttgttaagtttggtcgacaaagaaaaaagttatagccttttgaactttgctgagatggagttgacccctaaccgtttccttcttcccctgtacaaaatgtttttgtttttgtctttaattgttttgccaattttcgcggaaattcaaaatatttttaatttttccaccgtttcgtttcgcgtgggtgtttcttctctctgtcccacgccttttttctctcttcctttttggcctcatccatccgtaaaagggcgtaacaaattcaacaaaatttccccccgggggttgcggcgcgcgaaaggcaaacggacggacaaagcgaacgcacttaacgcaaagggcacccgcaaatcggagaagttgtgtttgtgcctccaaacatttgttggtggcaattgaacaaaagggtcgagaattgacacccgccaagaggcgagcaaatgggtaaatgagtcggccaaaagcgcaggatttagaaacccgacaggccatggacgagggcatcgatggacatgccgaatagtccgaaattatgagaatttgtaattatggatctaagagaggcactaaattcgctaattgaggaggaccaaaccaattaaaatgcaattaattgatgatgcaataatcatacaacaatcatttttaaatatagtgagaaagcgaataaagtatggttggttcgacctggttttgcaattatatttgtcacatgcctaattagtctgtaatattattataattatccctccaaaagtgtcctttttctttggttcggattatcactcaccgttttgtgtgccaatttcgaatttcgtccattgtttcgacttttgttttgcctcccatttcgtcgtcattcttccaaattccaaaatcgtcgtttgtcccccgcccccacaaattaatttcgcgtcttttcttttt

SEQ ID NO: 13410 - DNA, 2692 bp, Heterodera glycines
  misc_feature (2590)..(2590): n is a, c, g, or t
  misc_feature (2657)..(2658): n is a, c, g, or t
atgttacaccatacatctgaaaatgtgcagcataaaaagcttcgcttaaatcaaaatttgagaaatttctccaaaactgcatgcaatataggtatatgtattcattcttgcgttggtgttcagcagaagcatttataacacagtatttcttttttatccaattaaaattgtttaacgttaattttaagaaaaaagatgatcttaaaaaatagattttcaaaattttttgatcttttttgccaactaattttgacaatcacaaaagctcttgaagaggaggaaacctttttcaaagcatttgctaatctgtaagcgatttgacgcaccataaaaaattttgggcgttactattttttgcacggtttttttgcattcattttttgtctccggtttcatcttgttcttcttatgccatccaaatcagcctcgagtgttttaaattccttctcctgtccttccttcctcaactggttcctccattcagttcattcgtccaacttttatttgcctcactttgtctgatttcccaactcactcgcacgtccacacaaaaacggggcaactaatttgcttgccatttttaattttcatcctccaccaaatgaataaatgaatgtgtagggtatggccatagaatgggtgggtaaaataaaaggacgacggatccttggccacactttcatccctttccctctttttgctgggatttcacagagaatgcagaagggcggggagagaaaggtggttccaataccgcagcgactgcaccacgccatagagttgcccttcgcgtatctcctccactcactcacactttatctcttttctctctctctctttttactttcccactctctttctctctctctctctctctctctcgcatttatcctctctctcttcgcccgctgtctcttttctcttctgactttagtagctgccttttctcgcttgtttcactttttcctttctgtttcccgagaagaatttcgctccattcccgcgccataacttttcctcttttcaccacctccggtgaattctttctttgcctttctttctctcttccctctcatctgtgttttctttttttctctcgttttctccgcttttccctccaaaaatcgatttccgctcccgtcgtcattgttcagtgagcctcaggcgaggaaacgactgaagggggagcagcacagtcggggatttcgtattcatcgtcgttgtcatcgtcccttgtatttcttcctcgaatgctccttatttttgttttgttcattacaataaaaataaaattgtcgcactctaattgcattaaggtcatttcctcacctttgcatcaattaaaccccattttttggttcattttccatttcccccttatatcatatttcggcataattttaattttgcattttatttttagattatattccaattttgtatattcatttcgtatatagcagcagcaacacatcccagcgtttttatggaattccctgcgtcaacttctgtcaggcgactgttttggacgtagtccgttacctttagtgttccttcaacttttcgccattttcttatgcgccagtagaaacatcatcgccgtcgcactccatttggcccgtaaagccagcacaaatagcggaataccaaatttttcgtctgatcatcgccgactcccttttccccgaaatattggaccctttaattgacaacagtcgagcatcccaaaacaaaggagcaacagttgccaataggtttatactttcaagattgattattcaaatttaattaaaatccaataattaattttccattcttattgaaatatgcatatgaaaaggaaacaaaacgaaaaaattattcgttcaaagccaaaagctgccattcagaaatcgacaacttcattgacttgagagtgcggtgggcctttggcgtgtttgctgctgtttcttctcaggcggctgcacaacaacagtccattcattcattcactgatccgtgcgcggggcagaacccaaaattgttggccaatagtgcgtcgcactaatcggcaaaacgggccgactaacgggcgtttctgtcgggccaatggcctgctgtctaagcgaggaggcacgagaacagaagcgcattaaccaggagattgagaggcaactccaacgcgacaagcggaatgcacgaagagagctcaaactgcttttgcttggttagcattttgtttttccatttctgaaaagccacacaaaatgtcgtcgtagtgaattacaattgttgttttttaggtactggagaatccgggaaatccaccttcatcaagcagatgcgcatcatccacggcagtggttactccctggaggacaagcggcagcacatccgacttgtctaccaaaacgtgttcatggcaatgtgaggcgcttcaattataatgagcgttgactcgaaaggatttaacaaatagtttttttataatggaaattgcatgaatcccttcaaataccaaattgtaaataaaaaagctatccgttgattgaatatatttaaacgtgtttcgactttagtgcgtaaagcgataaaaggaaaaaattgccanatttttattttgcccattcgcaatttctctcctcctttccccatcctttcttatttcctttatttanncatgtattttattttaaacatccggctgtgaatc

SEQ ID NO: 13411 - DNA, 2266 bp, Heterodera glycines
  misc_feature (22)..(22): n is a, c, g, or t
  misc_feature (2247)..(2247): n is a, c, g, or t
ccaaatagtaatttttgaagtntagcaaatgtactataatggtttcactattttataaaacaaaagattacttaattaatgtattaattaaattcctttacctttaaaacattataatttctgttctttgtcagttatttgaacgatgtccggcgtttggctgaacccaattatttgccaactgaacaggacattttgcgcgtccgtgtgccaacaacaggaatcattgaatacccattcgacttggaacaaattgtgttcaggatggtcgacgtgggtggacaggtcctttttctttatccgttcttttacctcatacttttttgaattatattcctcaaaaacttattttcaatttcgtgtcttaaaatgaaaactcgtctcatttgccagcggtccgaacgtcgaaaatggatacactgttttgaaaatgtgacgtccattatgttcctggtcgccttgtccgagtatgaccaagtgttggtggagtgtgataatgaggttggtggttcttcgtgcctagcattatacatttttattttataaaaagcgtattttcagaaccggatggaagagtccaaagcgttattccgcaccatcatcacctacccatggttccaaaactcttcggtgattcttttcctcaacaaaaaggacctgttggcggaaaagattctctactcgcatttggccgattacttccccgaatatgacggttcgttgtgccgtgtgccttgttttcacattgcattttcccacttcttcttaggcccgcctcgagacgagatcaccgcgcgagagttcatcctcaaaatgttcgtggacttgaacccggacgcggaaaagataatttattcgcatttcacttgtgccacaggtgggcttttacatcagtaattctccaccggcttcccctgatcgactcgtgaatgaattgtgcccttttgttcagacacggagaacattcgcttcgtattcgcagcagtcaaggacacaattctgcagcacaatctgagagagtataatctcgtgtgatcatggcctccccccccccccctcctccgccacgccaccatttttcacattttctcaacaccccgccccttccttccctccacgaatcgtctcatcttcaactcttcaccagtgcacaacgttctacataatgtttttatcaccatgtttttaatatatatgctattggtgtaaacaagaaactgggaatgagtgttccaattgttgtttttttatgtcgtgtgatccgttggctggacaatgcccattcccgtgtctctcatgaaagacttgttttgccataattaacgaatgcccaaggctttcttcctcaatgatgacctatcaaaaatataggctaaatctatttttggaatattaattttctaaaagtttcaatggagttgaagccaaaaaaattcacgtgagcttcccatctaatcaaagcccaaactcagtggaaaggtgatttagtttgttaggaattgaaacccctcccctccccccacttttgctgctctgttttgtttatacgtgcgttttttctaaaaaaaatacctattcaggacggttcataatttacaatactatttcacattttcttttttgcgttcaaatgcttctctaaactcctcaaatgttctcccattgtttgatgttcacctttctaactgattgatacctattcatcctttattcctcaaaatttctaagttcaccacacaaaacaattgtttttattttatttgctgccactcatgctaatataataacgcataaattaaatttaaaactaaaaaaatgtgaaaatatgattgcctgttaataagccttttcttaataattgggaaaatgtcggtattcgaacggaaagtcgaaaatttaaacttcacccgcaaaaaaatgttaaaaatctgattttttgtacgaatgcattgaaattaatgatttgcttatttcctccccaaaatcgttaaattcaaaaataggaggcgaaaaatataatacatttttgatcgaataattttaaaaataactgatttgaaggcagtttcgcaaaatgttctgattttcgaccccaaaatctgttcaaattttgaaaaactttcgatccaagccctgataattcaggggatgacaaaaaggagaagtaccgtatgtccaacgggtttctgtgatgacacgctgataggggacgtgcttaaacaccaaaaaacttcatgccatccaaantgtctacgtcaaacagaga

SEQ ID NO: 13412 - DNA, 1043 bp, Heterodera glycines
  misc_feature (956)..(958): n is a, c, g, or t
agagtcactcttttattacaaatatataaacatttacaaatgaacaatatatttatgaacaaatataaaattcaaaaaaaaaagaatgagatcaaagggatttgttaaagttgaaccgcgccatgccatttggacacctgagtcgtttaagcattttcgacaaaaattatgagaatcaaaatattaatttttctaaattttcaatatccaatttctggcgcttaaataattcagctcataaaagaagtctgaactcggttctttcagcaaaagatcattttagtacgtcctgttttaatgtgcaatttggctttattgcactttagggtgttcaaatatataaaagccgtactaaaacaactccgggatcataaatacattataattgaaaataaaataatatttgagatgattatcaaatgattagttgataatagcaagctgaataaaggattcattatggaattggatatcttttgtagtttatttgcatgtgaacacttgtgtgacattcctgtggtaaaaaatgaaagcctagagtaagttttattttttatggattttagtattcttaaaaaaattattaatatagatatattaaaaaatgaattgattaattcagatcaattggccttttataccaggaatataacgaaatgcccaatttccgagttttgattttggctcggaattccgcttttctattggcgaaattttctagcgcccgtcaaaattccgattgccgaaatttttgagggcatcggcatacaaccctgttttatactacaaaatttcggtccttcctaccgggtgcaccccaaaaatctcgccgccggaatctcgccgccggaatctcgccggccggaatctcgccgagacaaaatatcgccgccgaaatctcgccgggcgaaatctcgccgcagaaatttcagaaaaaaaatttcaaacctcagccnnnccccaaggaaaaaaatccttagaaaaatttgtttaaaaaaaattgtaataaagaacttggtgaaaaatcttttcagtaaattttt

SEQ ID NO: 13413 - DNA, 2647 bp, Heterodera glycines
agctcatcccactcgcactcattttacgctgcagaaattgtttttcaaactgagacattaaacattttaaaatcttctttcaaaattccttgttcttatttaaaattttcaaattaaaaatttattaaattcaaattaaactgatgccccccccccaaaaaaagttttccatctgaccaggaaaaactaagtcagtcagtgctctgtttttcctccgttgttgttgctgctgccttcggcctctgctgtcctccactcgcattggctcatcaaattgcatatttccgcggctgttgatctgaatacgccgtgcctgcttgtactttgtctgaaggatgttgccaatttgacggattggaggctaaatgcattttttaaagataatgaatgtattaaattgaataaaattctgtcttaaatttgggtgctcggtcgaacttgaaaaagtgtcaatgataaataatatttaaatttaattttgatttggaatcattattttattttataatatttaaatttaattatttttcaattataattttaacaatcgattataactttaacaataattgtaatatttaaattattattatctgaatacaccgaaatttgtaatttcggtgtctaaagaaatcaaaattccaagccgaaaatgtttccagatcattaggtattattatgatgagaatgaagatattttagctgggttttgtaactcttttcaacattttcagaattagtttaaattttggcatgaaatttctttggcataaaggctgattttatgttaaattcaatctctattgatcaatgattgatcgcttttaggatcaactcgggatataaattaattaaaactggcatgcccaattatttacacaccaattgcatccaacatgtctttaaattgcatgagccgctgaaaaaagcatgcatttatgatggcattcaaatttttttgtagttgacctcactccatggcatttgcactttggctttgcatgtcgctttactatctgaaagttaaaaaaatatatttcgattttttatttacataaatatttttcgcatttttcgttcatcacaaaaatgctaaaaatcaaaaatcacatcccgactaagaatggaaagatttttaaaaattttctactaaatttatttttttcttgaccaaaatttttgatttatgaatttttaaaatctggaaaatgtgaattatttacaactttaaccaagtgcataaattctttgaaattttttcatcattctcattgcattattaccttcctgccaacttcgttgttccatcggttcatcaacgatcgtccatgccattccgcggatcgcttattgctctcctccttttcacgtacatcaatgaaatcgcttaaattgctcttcattaaatttaatttgtcattgtattgtctcttgagcccggaatcgagatttcggtattgagtaggaatttcgaaaaaaaactcaaaaaattcaggaaaaaataaaaatatcaaaaacagggcgaaattttttccactcccagccgtacaaattattttgaaggaaaacggcggcgggcaacaaacagcacggcaaaaaatcccagttttgacaattgctgattgtgagcgccaacccgggatttttgggattttcaaaagcagaattttcagttatacttttctctaaaatccccggtttttgctaatattcgacaagtcctaatgataataaggaagatattttccagaatttcattgagagctttctgagtttgggcgaaaatcccgactcagtaattgtctcacaatcagctgctcaccgcgagaatcggtagccataatcgatgttatcgccacagccactccaagtccaatcctcattaacaccacggctttgttgctgaatgtggaaaaacatagaatatccatcttcatcatcatcatgagtgccaaatcacattttcccaatgataaaattcattatttgctcattaaaattacactcacagagaaatatattaaattaattaaaataattggataaaattaaaattcaaaaaaaaaaattttttttttttgcaaattctttgaaatttttcgattgcgtttatagtcaaacacttttggacacacccaatttcaagagtacccaaattttctgtcccacaagagtttattagatatttgccagtttttcgattaaatctgccaaaatataaatttaaaaccagaataataattatcaaatgcaatgattttgattaggtgcaatttttgttaaaagcccacgcgatttggcgcattatcactttctgaacagccacaacttcgcagaaagccaagacgacaacggcgtccaatttcatgtgtgacaccggcagaaagaattgcatatgtgaaagccgcttcacgagttcctttaagtgggcataataagttcattaattttataaaattttgaaattaaaattaaatttattgaaattatgaacgcggacattttattttaattattaaattttaacaaattcacctttcttatgtattggaccaatgtgttccttcagctcttgtggtgttgagcagttccatcgatgataacggaattgccattcgcactcctcaaaattccatttattaagaag

SEQ ID NO: 13414 - DNA, 3653 bp, Heterodera glycines
tccgaatcgtccgccgaattagtcccagttgataaaacagctgctgaccctatcactgttcctttggaaagactcataaaagtgccaaaggcagtccccgacatcgcaacattaccacggggaaaaaacccgtataaaaatgtgctaaatgcaatgattttcatgatttcggcccaactgaattttgaaaatatgccaaaacgtgcgaccgaaaattggcaattggggacaattgctaaagaatgtatgggggcggataaatatggaatggaaaaaagtagtgcaaaaattctcagaattaattgcctaaacctgaaattgaaggtaaaaagggaaagaaaggcgaatttttcaggacaaacgcaaacggacgccgggatttgttggacttcggtttgcagtcaaaaagatgccgagcatgaactctgcacggctttgaaattgggcgaattggaccctgttcttggacagtctggcccaggcgccatgatcgtacagtcgccgcttcaagctcttttggccgtttttctgcttcgctccggcacagtcacttcaaacaccgcagcccgaacattcgtcgaaatgatcattaaaagtggaccacaaatggaaatggccacttattcagagaagcgaggggattatgttggcaccgggaaattcccacaggaaaatgaccaagtcaaagcgctcgaaaaatgcttcgaaatgtgcttcgttgcacgtgccgctttaagcgcaactggctacaaaccgcttgcgatggcaccaccaattggtttagagttgctggcgggggctgatcaggaagggtggaaagaagtcttcgatcagagcgcatggtttttggaacgtgcccgtgccaaaatcatccacaaaaccgagtcatttgtgtcccacgaacgtgtttttgttggggactcatctgcacgccacctccagggcttcttcgaccgatcactttacattggacccaacgaaggcccagttgctgatgtgatcaggactttcaaacctgttgtgatctccagtcgcgtgaaggtcatggttgtgtttgtggggagagattctttagctgcaggcgaaaccccggaggccatcattgaacaatgcaaacttttggccgaattgtgcaaacgtttcccggttcaagtgctgtggagctgcccgccctacattcacaaaaaacagcgagaattcgaaacgctggtggcacaaatgcaggggctcataaatgatccccctcagattctgccgatctgcacgacaccgaatggccgctcggcattggaaatttttcgattcggcgatcatttcaatacgcacatggtggaagaagacggaaaattgaaaaaatgcgggctgtcgggcacttaaggcttggataatgactcagaccccattcccaggcgataacgaaatgcacattcgctcgctgccttcggccgtcattattccatcgggagatcgggccgatcaccgatcggaacagctggaattagggcattcttcgagagatcgggccgattctcgtagaattgttcctaatcgttcggctgatcgtccggccatccgttaccgtccttatgagactaatcgccagggacagtacggtaacgaacgccgtcgggaattccgtcccaatcgccgctgagacacctgttggaccccacctttcggtttctgacttctaaaggcagggacgccttttctgattgttgagggatgttgtagaattttaattataatgactcattagtgttaattaaatttggcataatgtcttgtttcgcgttttttctcatttaaaatggtattctttgtttttttttttcttccatctttcattccaattttattatctggtaatttttatttttttgtgccgtccaatctcttttgactttaaaattgatattcgtcaaattgtttctcatcggtatttgtcttttggaattaaagtgtttggatttgacagtggcctactctgtgtttggtataattgcgtccctgtcttaagtcagtagcaaaagtacaatttggcgctcccgaggaaacaggtacaaaagcggcgatttttaaagagtttgagggtgagatcgggaataaaaaattttttggacgggttttaatttggagtgtattaagtatcagtccggaccggacgatatttaagttttgaagtggaaattgactattccggatcggaaagttaaaaaaagcgacaaaaaactccagtgcaccgaaaaatttattgtttatcagaaaatttgagttcgggccgaacctttttttctgtctacatcgccgtataaactattgacaccgggtcggtgcttagtttttctccgtcttctcgccgaatttttacatttgactttgttggatggtcatcacacgcagtccaattttgacacggcaacgagcgttgaatttggagattgccgttgacagaagtggacatcagattaatgtcggtggaaatcttcagaactctccgcaacgccaaaaccacagtgctggagaaagttttccccaaaatcagcaaattgaaaactcgccaatctcacccactgaactcgcgggctttaatggggaaaatgaggacgacaattctcttgttttagaaccaaatatgaccgaagaggaattgcgcaggcgcttgttggtggtcagcattgaacgaagccagccgccatccaacggaaatgccggaaatggagaaaacgccgaaggtttgcgaaacgcaatcagggaaaatgatggacgaccgaattttggagtaaatggtcaaacatttgcccaccaaaggaggccgcatgacactttcttatcaaatttgatgaataatggaataggaaactttcctcaaaatttggtccatgtaccgcgtacttcaaccccaactcgaaatgttgaatttgaacagcaaataggaccattcccgtttgttgttgaccgcaacaacagagcaccaaccccacctttaaacatacggcaacaaattttccaccccatcccactgaatgcacaccgcattaaccaagtgtcggttaacgcgcaacgcaacattgacgttcagtacgtaccaaataattgcgttaatgccccgccaaacgtacagcgtcattgcgacattcagtacaccgctcctaaccctgtcgccgcaccatcaaacgcgcaacaaattcaagcaagaagtagacttattcaaaacattccaatgcaggctcagctttggcagggccctgatggaaaaatgactttggtttacccccaagaccaacagcaacaagtgctgatcgagcaacctaatttggctcaaaatcaacaaaaattcactcgccaggcctttcagattccggaaacgaatcaagagcctagacatttccctacctatccccaaccgaatgttgcgccaagcaacctcgaattcaacttgattttggaaagaattccggttctaaatggaatgagggtacagattctgtgcgccgatttttcaaaaaatttgatgcatacaccgacggatggccaaacgcgaaacgaatttcggcgttagaaagcaaagtttacaacaaagcagaaagagcttttgaggcagcaaagtcaacgcagccctaccgatacgagcatatctgcaaagatatgat

SEQ ID NO: 13415 - DNA, 528 bp, Heterodera glycines
ccaaaatgaggcttttttgcttgccaaatgaggcttttgaaaattttcatctgcgaaccctggtgatgctcgactcgagaaaagtttcgggttttttgggtctcggggtcgagtctcgggaaatttttgggtctcgagcatcactagtgtgtaagtcagtggattaggtcgttttggcgccagcctttttttttgcactgtaactctttttttttctttgtcaaccaaatctaacaattttgggtcggggtcggtttagtacgggccgttttagtacgagcgcaagtttttggctataacttttttctttgccaacaaaatccaacatttttagtatcgttcgatagccctaagtgtcctatattaatctgaaaaattgcgaaaaattttgttaagcttcaaaaaagttatggccagaaaaactcaaaaaaccagattttcaaacttttttagctcatactttttttaaacttaataaaattttttgaaagtttgccggctaatatagcatccgaggggctctcgaat

SEQ ID NO: 13416 - DNA, 1474 bp, Heterodera glycines
ccccttaccatgtgatataatgttgtttttactttcaaattacaaatgtttccccaaccctttggatatgccaatttgtggtgaaaattttcctatatttagatgggtaatattctatactattgtttcatataaaaattggcctaaggaaatacagtagggacacagataaataatccaatctacagtattccatttgatttcattttgttagtggcataattttttaaaattatttacacttgtctgatttttagtggcaaaaaatcccaaaataattttaactaaatagtgacaaaaaaaactgccaaaatagtggcgaaaaagttccaaatttaggggaaaaacaaaataaagaataattttttgtgattcacgtcaaaatatgatcatttgggccgggaatttagtcgagaagcgaagcctaaaaaaaagaaacgcaattaaatttttgaatcttttaattatttattggctgacccgtcgccgatttcacgctcattattaattcgaatgttaatttgattgcactgatcacgaattcgccaatcgtccgcttcatcctcccattttgtccatttgctttcatctcgcacaattgggcaacggatcagcagaaaacgattgcttttcttaatccttttcaatgcaaattgttcacgagtaaattcgttggtcagatcaaatggcacaatggaatcagcaaaagacggcggaaagggaatgacaacaatgaaattggcaggagatgaagccgaggaaaaagcctaaaatattaaaaaattgattaaaaaaaagtactaataagtcaattcgaagcaccgcttttaaggcttcaatattcgaagccaaatttccatcatcaatgtgcaaccaacatctcaacacctttggcacattgttttgaagcggagtaaaaagccattttgccaccgcttgtccattcgatgccatggcactgtcatcgcatggaaaatcggtgaagaattcgtcaaaataggaggagacaacgcgaagcgatggacaatcgttgagaattgacgggaccaattttcgcaaacgatagaaaatattcgtgaacaatcctatcccacaaatgttattcccgatcattggccaaatgttgcgcaaaatgaacaacaaaatacgaacattgttcgtatggatggccaaattaattggacaatttgaggcgaaaagttggcgaaaacggtggagaaaagcgatggcattttggtcgataaaactaaaaatacataaatgggaaaatgctgccaaattttttgcttttacaggatctggatgcatttgaatccggtgactttgcgtggcatttgaatttgcggaattggcaatggttttccatcggaattgacaatttccatttccttggtgccattttctccaattttgctttgaatttgaatatttcctaatgtccatttgcgcgtcttgaagtgttcgtccacgtaaa

SEQ ID NO: 13417 - DNA, 1177 bp, Heterodera glycines
ttccgtcgaccaatgcgttttcaaatttctataaaataaaagacgaggccattataccttttttttctaaatgccctttaaattttgtgagtccattaattaaccaccctcgtaacatctcaccccatattttatgttttttaaaaatggaattagaataacataccgcgaggagctcttcgatgtcgactttggcagccattttcaaaattatgtacaaaatgaaattcaattaaaaaagaggagtaaaaagaaaaatattcggctctaatgttaaaagaaagataaaatttgggaaataagtgggatattagtctccagacataaaacatgaataaaagattaataaactgaaaagttaaacaaaaattgctctcgggacttaggcatcacgggacccacgaaacagcaaaatcttggaacggaagaaaaatcatatggccaaaaccaaaaaaaatataaaatcactttcgtaggttttcataagcgctgatttctaagattttgtattgcttttttaagggtccgaaattttagaaattaaaatttaatactgtaattttaaaaaggcttttttttacatgcagtaaaatccttatgcacaatgctagtgctacctatctgcagctgaagattttttggtaatactgtagatgatcccctcatttttcaaaaaaaaatcgaaagaacagggggttttcggggtagctgatcatgaatccgacatctatttcaccaaattccgaaccccggaccccaactctaacaaaatcgaaaatcaaaaattttcgaattttacttttatgttcgaatctgcataggatgattcatttttgatgttgctatgggttatgactaaatttagcttgttttaatcaattctagaacacaaattagaccggcgggtcgggattcgaaatttgtcgaaatgagtgtcaattcgtgatcagcgacccccccccccccaacgaaaagccaagaaaaggtgtttgtacggctattttttaaatttttaattgctacttgagaaaattttaagatagttaacaaataaaaagatttaatcaaatagtattccccataatgtaatgataaaaatggtaaatgtttatctgagctcccaaactaaaaaacacccaaaactacttttataggttttatgcgctgaaaacggtag

SEQ ID NO: 13418 - DNA, 1131 bp, Heterodera glycines
tcctgaccttttaaaagggtcaaatccagccttttttggtatcattcgacagctcttgatgagttaaaacgactaaaccatcaaaaaaaaattgcgcggcaaagcaaataaacaggtttttgaaccgatttaaatcacgaaaaaatggacaaaatttacgcaaaagtgaacacgcgaagacggagcaagtagtgaggcgagactccagaaggaatccgcgcgtgacgtactcgagtgtgcacttgtttttagcgtaacaatttttaaatacatatttaaagtattttagaattttcttcgggtttcgtactgttcagaaaccaaaacacccctagaaacatgttataagaattttcagaaaaaaatatgatcgcctttttgttggtttagtcgtattcagcacctaagataacctaaaaaagcttttatgcagttttgagtctgagacctatgatcagggctcccagatctgaggctttagcctcattttgtggttttttgataggtcaatgaggctaaattttcaaaatgaggctttaaggttttttgtggttttttgagaaattttgaggatttttgatgttttgggggaaaattcgtcagattttttaaattttgattaattttgataagttggcataatgtttggcaattaaaaaaattttttaaatgaaaatatgctaaaaatatggtcaaaattcttaatttttcccccggcggcgcctatcggcaccgccggactgtaaaaatccttaatttacaaacaaaaatttgctcaacatcgcaaaatttggtcatttttcggacaaaatctgttaacaaatcgcattgaaaattacaaaatttttcccggcggcgcctatcggcaccgccggccctccttgcgcccaaaagttttttgggaaaagcgccgcaaaaaaatcaacttcgtttttcatgttcagaatcccaaaaaatgcttatttctaacaaaaaattgctcaaattgatcatggaaaatcaaaaatataaaatttgaacattttaaacgtgttttgaataaattttgtaaaaatgaggctttttgacccaaaagcaggcttttttgcctgccaaatgaggctcttgaaaattttgatctgggagccctgc

SEQ ID NO: 13419 - DNA, 1413 bp, Heterodera glycines
gccggcatttcggaaaatgatcgacacctgctggatggaagttgctgaagaatacgccgaattggggcactttcgattaaaggacaaaacagtgaagcaattgagaggggatatttggcaaaaaaagaaggaagcggcattaaaaaatatgatttttcacaaaagacaggcacgggagcaacaaaatttgaagaggtcttgaccgaagcaaactaatttaaactaggcatttaagtgggagctcgtaattttgtgttgcaagaaataacagataatgcatggtttgtggtagaaattgattgtaatttgattccaattttaagaataagtaattcaatttggcggggagttagacgaaatcgttgttgaaattcatttgtcgttagatttgaatattcaacggggtcattaaatgagtaatgccggcgatgattgaattcgtcggcggaagaattctcttcgggatcagattcaagatttacgaactcatattccatattttataatttgaggaaggaaattcggaagatttaatgaaatatttggtacttatacagtttgacccacataaaattttttgcttttaatgataaaaagtgtttccaggggttttcggggccgctgatcatgaatatgaactctatttgacgaatttccggacccctaacccggaattcaaacattcttgaaaagaccaagcattaatgccaattttatttgtttttttgatgaattacgtggcatcagtgcttggtctgaatcaatatattatgagcatcacaccggagaatcatggagcacatattttggtacatttaacaccactttggaaaaaaaaatttcaaaaaaatgttcgagtttagggttaggggttcgggaattcgacgagtacagttcatattcattatcagcggccccgaaaacccttggaaacacgtttttattattaaaaacaaataaaaaatttatgtgggtcaaactgtattagtacccccggccgggctctagcattcactatactatatccaaaaatagactcaaaacagagaaattttgcaggagccacaaattctaaattccgctttttcttttttattttcacatgtctttgctacccaaatcagtgtttggatgacgcgattatagaagaggcggaacgggcttttaggtaattaatccattgcaaattgaggaaaaaaaaattatatttttgtttttcccgtttatgcatttggcggaggattttgccacgcggaacattcccgagtttgacatcagccaatcctacgggtaccaacccgatgataatatttttgcaaataaatggggtttggtggctttaacgaaatttatccatttacaaagatgatttaatagagatttcaatgaattatgaactttgttgcactcaaa

SEQ ID NO: 13420 - DNA, 4143 bp, Heterodera glycines
  misc_feature (20)..(20): n is a, c, g, or t
ttttaaaaattaatattttntgggcttttcaaggtcactgatcatcatcaatatggcgtttgttttgacatctgctgatacctggtcatagactggacaaaatatctgtgattttttaaaatattttggggagggaggggtagcaaaacaacgaagtacccccagtgttaagcattttgttaagcgaatgtttaaagatttggtcgctggcagcacattttatccgattactataatgtaacggtcacgggattatgtgaaaaggccttaagaaagtccatttatctgcaacacaacaatttgtaacaactctttgctggattcaaaaacctgcgggacaagacccattgaaaatttattcaaaaaactaattttcgaacgcccatatcttttttctaactcatccaatcggttagcatttgcttagaaaaagcttcttctcatcaattgctttcgaatgataccaaaattttcaaattgctgccaatttccaaaaactcttacaagagctcattttcgggatggtgtgttatgtgaaatatcacaccacttaacacaaatttaatgctttttggttcaaaaattttattaagtatatggcatagtgtttatttttattttttttatttcagtgacgaaacatcagggagccttacgagttggcatagcacgagttatgtatgattttccattttaatcgtttagatagtttgactttttcataactagggatggtaaaaatatggatataaaatcgcgaaatatggacataaaatggtaaaaatctcaaaatatggacataaaatggcaaaaatatggacataaatttttctaaattgaggggtaaattttcaaaaaaacccgaccaaaaaaacgaaattttccattttttgcttatctttcacataaattaaccaatttttaagaaaatttaaatttaatcaatttttttgacaaaattttgctaaaaaatgtctttttcggaaaattttccggtctttggggttaaaacggcaaatttagctgatgggggccgttctaataggggtttttttgggaaaatgccaaaatatggacataaatcgcaaaatatggaaaatatggatatagaaatccatcttaaaagcttcaaaccaagctaaaaacatgtttttcgtgcgtttcaggcctcccacattccaggaaaaaaatatggatttccatataattaccatccctaatcataacgtttgccaattttcaaaatttgaaaagggcggatttaacctttacaaatgaaaaattccatccctagtcatcattttgcaaaatattctcctctttggtggtcctcttatgtgcgttccctttttcttcctcttccaatcggtcattttatgccaaaatgtttccgccccttccgtttttgtcaatgggttttcgcctcccattggcacattgtccaaccccatttaaggcaaaaaaattcaaaaattgttttaataaaatgtgattttcgtgtttctttcatcaagtactatccgtaaaaaataggaaaaatctaaaaaaatcagggctctctctattcatatacaaaaaatattcaccaattcccttttcatgactataaaaatcttttgttttccgctttgactgtttccaacgcaattaattattctgctcttttgtttgacatcattcggaactcgtccaaaattgtgctaattgcaaaaaaatgaaacgacggtaatgaattttaaaagtcacaaattcgtcgtttatttgactaaactgttttcccatttcagttggatttgcaacgacgtttggatggacattttcccatcctttgaccgtcctcaacttggcctcaaattggcacttctttcgccacgtttcgatgcgttggtggacaaacatttcgatggcaaaagcgaattgacaatttggagaactatcgaaattcgtcgcaaggacaaaggaccagaaccgaaactgtctgtacagatggatgacaaatttgtgccatttccattgcccgaccgtccgttgcccagcaaaatccgttttaaatggcttcggattgggtaaatcaaaatcagagagctatgacaataaaagcatttatcccatttttaggtacatcgatcactccgtcatcgcttttcttcgttcaaatcaccaaattttcgacaaaagaggcaccaatttatatttgtggctttcatcaccacacaacacggatggccagcagctgatttgggacatttttgttcgtgaaatttggccaattttttctgaaaacattcgccacttgcgcttttacgatggtgatcatttggaccatttgcttcgtcaaatttcgccgacaattctcatcgatctcaaccaattgaattcaatccattcatatggtctgtcgccctctgcgtttggtgatggttttgatgggccaaattcaacaatttctgctggccaagcattgtccaaatggttgcactctccgagaaaagatggccaacccaagcgattgcgttgcggtaattacaacgaacaaacggacttagattggatcaacaatttcaaggaggtgtggccataatctcgacaaatcactgttttttgttttcaaattgtttagcattttctccgtgccaatgccatttcttccgtcagttaccaaattcatttttatgttcatgtgccgtcaatacaaatggtgccatttgaattggtgaacgaatgcacaaaggaaaagctgacattggccaaagcaaatgaaaatgaattggacaattggataatgaaacgatgcaaaattattggggagaccgcgacggtttattggaaagacggaaattgggacaacagttgtaacaatgtgtacttttggctttttagtgccaataattgcattgggtgagcaataaaaaggggatttgtttttatacatatccaaatttgcgatttgcgcctaattaaggccattgtctccgccaccagcagaagaagtggaagaggaagccggacaatgcatcacaaaagggccaaatgagtgacggacaaaacaacaaaaacagtgatcagccgcagaagaagaagaaatgaattaattaagaatgaccgatcgatcataattcaaatcagtgatcaaatgcaattttatgaagaagaacctctcaaatcctatataaataaatcggatatataaaaatggcaaaaacgtggactctgttgcagttaacgttttttctttgcacccaaatccaacaatcttggtgtcattcgaaagctcgtaacatgctttattagccttacaaaaagcaacaaaattttcaagcctggaaaaaatgtattaagaaaaaacttcaaaatttttgttaagctttcgaatgatatcaacaatgttggatttagatgactcagaaaaaacgtttagtggaaaaacgagctggcgccgaaacgaagtggaccccatttcacggtcctaataagtttcaaaaatgggtttaagtgcaaaaaaaactccaacattgtataaaaatggcttgctatctatcgaatgtatgaatttctccttgaaaattgtggcaattaattttcgggattttgacgcgggatttacgacacacaaaattagcaattagcaccggcaacattaagtgccgatttgctgctgttcttttctcttttcagcttcattctctcctcctttttgcgccgaatttttccttttcctctctttctcttccgtctctcctccttccccaatgctatttccctcctcttcccttgtttctccatttttgctgttgtccatcttcatctcgtttcccatcaaaatttgctgttcttgttgtactgcttgaacttcttggttttgctgctgttgttgggtaatcatcggttttactggtcccataaaaaaagaggtaaaaaagagattttgagcgattttgaggtgctcttgggggtttagggggtgatgaacacgaatatcacatccatatcgaacccgaaccctaattcgaacaaaagtcgaaaattcatttttcaccctaattcaccttgatgcccaaaaacgattcaaatgcatagaatggccatgaatcccctattttctattcatttcagtctaatagaatcgctttttgggcaataaag

SEQ ID NO: 13421 - DNA, 1170 bp, Heterodera glycines
gggggggggggccgaaggcccccctcgaggccgcgaagcggccgagtgagtaccatgggcgcaggaaaattattaaggaggagggttcattatttattgatttttgcaaaattaattcataaattttttttcagaaactgctctgaacgcgatccaaaatttatttacaagttgaataaggcactctgactcttatattatcaaaaaaggagatgaataaatattttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagttgttataaaaatttcaaaatgctgagtcttctatttttatttttgcaaaattaattcatattaattttttcagaaagtgttctgaaacgcaccaatttttttttacatgttaacaaggtcctcttaggtttatattatgaataagggtgaagaataaaaatttttctaaatgttttccttatatgttggttatttcgttcaactttcggtggggtgcttggaaaagtggaatcatgcgtacccgtccgatctgacaagttaagcaacgctggctgactattcaaaaggatgggcgccgtgatgaaacgaaaccagcactgcttaccccgcggcacccggcacggacccctgaaggaatggatttaattaaattctctccttcggggaattttttccattaggtcgtctgttagcgtttgattgctctagtcaatttttcaaattttttgtgaaatatttgtcgtgctctgaagggcggggggggggcagggccgaaggccccgcgggggtgggccgaaggacccctcgaggccgcgaagcggccgagtgagtaccatgggcgcaggaaaattattaaggaggagggttcattatttattgatttttgcaaaattaattttttattattttttgtgaaacttatcagaagcgccccaaactatgcagggatactgaaaggaaaagaattaacctgttttatcacattatcttgacatcactttttataaaagattttcaaatttctgagacttctattatattattttttttttcaaaattttgaagggcggcggggggg

SEQ ID NO: 13422 - DNA, 2865 bp, Heterodera glycines
ataccagagtcaaatgaatcagggcctgccccaattcttgaatatggaaacaatgttaatcgggtggaaggcacaaggtcatcaaattttgaaaatgtaaagccgacaatatcaaataattctggcctaggcacccgaaatcagcctcaatcaaaaaactttctaaaacaaaattgtttggtgatccaagaagaggatgtgtaccgagaaaatgcgttttttggaaaaattgactcggatcttgagatagaaaattttgttgagcatttaaagaaaaacgtggacgaaaacctaaaagtggaaattcccaaagtgggaaaagttatggtaatcaaagttgaagtccttggcgaaaggacgaaagcaatgcttgacggaggtgcccaaatttcggtaatcgatgcagcatttttgtataagctgatgaaaaacaaaaatttgaacccaaatgatttgcgagttgccaaatcggagacacgaatttctgatgctaatgggaatccattagcctgtctaggtgttgtatgccttccgattttgagaaatgattgcactaaggaagtgcaagttgctttgcatatcgctcaggcaccaattgggtttgatctgttgtttggaacgaatgctttgagttctttgggttttaaactttttgatgacacaacgaacacaaaaatcaattttgaggaagtccagctacgcaagtcggactctctgactgtcatataccagacaattttggccccaaaatcaactcaaatagttgaattgggcattaaggaagagtttgaaggcaaagacctttttctctggtctgaaggccaccaaaattttcgaattgagccaacagttggaattggaaaggacgggaaagtcattgttctgatgacaaattttacgagtctgtcaatcaaattggaaccagggaattccatcgggaaaaatgaagtcgtgaatcatgtcgaagaatgcgaaaatttcctttcagcttcgaacgaatgcttcagaattaattgtgttgcaactgatgaccagaatgtgtcaatcgacaaaattttgattgaaattctggaaaaagggacatttccagattcggaaaaacaaaatctgttggaattgctttcgcaattcaagaatattttcgctgtttccgattcgcagttaacccaaacaacccttgttcagcatgaaattgagacaggaattgcagcaccagtgagatcgaaaatgagaccagtgccttacgcatatagagaaaaattggccgaaatgttgaaagattatttggaacgggatttaattcgtccttcatattccccatgggccagcccaatcgttatcgtaccaaagcgcgatgggtcactccgtttttgtgttgattaccgtgccgtaaattcggtgacacgaaaagatagtttcccatttccaaacatagacaatactcttttgttactgggaggcaaaaaattttttacaacgcttgattttatgtcaggctattggcaaattcggatgaaacctgaatcaattgaaaaaacggcgttcgtaactgaatttgggctccacgagtttgtggtaatgccattcggtttatcgaacgcagtggccacttttcagcgctttatgaatcgactttttgaaggaatgatcaataaatttctatttgtttatatcgatgatgtgttaattgcttccgaatcacttgagaaccatctcgaacacttgaaatgcgtttttgaacgtatacaaaaagcaggcttaaaactgaaactctcgaagtgccgtttttgtgtcgaagaattgccgtttttaggtcatacattgactagaaatggaattaaaatgaacgaagaaaaaatacaacctgtaaaaaatttaccagttccgaaaactaaaaaggaattgcagtcattattaggcttcttcacttattatcggaagtttatttactcatttgggaccattgcagcaccactttttcgtttgctcaagaaggagacaaatttgaaattggcgaattagaaaagagtgcaattgataaattgaaagaaaaaattttaagtgatgttgtactgtattttccaaattttgaggcagcgaaaaatgacccaatgaggaatttcattataatgacggacgcaagtaaaatcggtatttcggcaattctcagtcagcaggatgaaaaaggaagaatccgtccaatctattttgcctccaggcaatgtaacaaatttgagagccgttatgcaccaactgagctggaagcattggcaattcgatttggcgtcaaaaaatttgctcaatttgtaacaatgattcctacaagagtcataacagaccataaatcactgatcggaatgtttaagagtaaaaaggaaaccggaaatgctcgagttgacaaatggatccttgaattaaactcaaaattcattttgaaagttgaataccaaccagggaaaaagaatgtgattgcggatgttttgtcaagaacatttgagacaaaagagcgtgaaatgttaaaatttgctgctccagaagatgttgcattgattggaatgttgaaaattgcaggacaagaaacggagttaactgttgatgagaaaacggaatggactcgcgaaacaaaagaaagcgaaatgaaatttgtttatgattttttgagtcagagaattattcctgaagaccctcggcaacaaaaaagtctaattggacttgggatgagcgactttcatatgctgtgtttgcatacaatataacaccatcaaacgtcacaggattttcgccattctcgttaatgtttgggaaacatgccaactttccgttggatgaagccattcggttttccgttaacccggtctatacaat

SEQ ID NO: 13423 - DNA, 1787 bp, Heterodera glycines
tgccaacttttaagtgcataattatcattgccaaaaatggccaaattacgcactgaatccactcattaacttcgcctatgtccccccttaagctgctcaccatcgttgtgctcgttctattggacccctcctacgtcactgcgtacatttccatcaactatgaggtgcaagccagggatgggccgaggtttcgcttttcgcatttcgcctttcgcattattcgcattttttggcgtttcgcatttcgcttttcgcatttcgctttttggcgcgaaaagcgacttttacacccctaagaattggattaaattcccataaaatttttcaaaattttacctataaattggctaattttcagtgaaaaactgtttataaatgatcaaaatttccaatttttttccccagcggcgcctatcggcaccgccgcgcccccaaaactcctatttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcggcgcctgccggcgccgcctgccggcgccgcctgccccctcttcccaaaaagtttttttggaaaaagcgcgcctcaaaaaagcgttttattgatttttaaatttttataaaattttaaaaaatgatttttgctttatgattttaactattaaaaatttgtagaaaaaatttcgcttttcgcatttcgcttttcgcattttcgcatattttggcttttcgcatttcgctttttttttcatttcgcatttttcagtttcgcaaatttcgcttttcgcatttcgctttttatttttcaatttggcccatccctggtgcaagcattctctgatctaaaccattcattcattctacatacaaagcaaaattccatggcaacaattattggttcagatcgtgctcatctacatcatttgtgcacttaccctcctctattgcattgtttcggtacgtttgctaattttagacggcactcaaaaaaacactcgttttgatgcactttttgagctactttaaaaagatgatcaaaatttggcaaaaaggtgcaaattttcaaaaacccaaactaaggggggaggcaatgggaaaatgccttttgaaatatggcattgtctttttcacagatcatcatgtacgccattatgcagaaaagcgtgcgggaaggcgaagagcttcacctgaccaactgtgccctctccgtgcgcttttttccgcccctttaaaaatgaaaaatttccatgccatttaattccgtattttttttttcaggagattgtcttcgctggcgccggaatgatttgctgggttggtatttggcattagtcggggggggggggtggcaaagctcatgaaatgaagtctggttatctggcacattacacctagtaagtttgaaactttgaattttgctcccattttccgatgctcgtctgtggcatcggtggcactgtcgcgcaacggacaatcattgaggcaagttgacgaacggctcacacagaataaaaccagcgctggtttaacctgctgctgatgttgtttggcactaaattcccccaaagttcgagagggtcggcttcacacataaaaagggggcggggcgtcaaccgaaatttttgcgaaagggtcggccaaacaaatcgacgaccgttttatttattttttgcttt

SEQ ID NO: 13424 - DNA, 1879 bp, Heterodera glycines
cccatcccctcgcttcaaaagggtcccccattttgggcactttgcgagaggggggggggggcggggtcgacccgtctactcttttcatgtattctcggcacttgcatttcatgatatttggttccatttccattgctctttaatttcagaccggtcaatacttcggctggctcggggtcagttcagttctgtgtggtggtcactgatcagtgatgcttcccgttttgttgatctctcattgcctttcaaggcgtgtgccggcatcatcgtctgcctcttcatgggcgtggtgagtagtaaaatggtgcccagatttggtgtttaactgatctgatctggttcattcggaccgcaccaaaataataagtgatcggaatgggaaagcgagcagtcaatgctaatcagaaaatcgatttaaatgtgctttttcaatcaataaattcaatttttaagttggccgtttttgcgctggacattctcacgaacaaaattttgtcgccaacccgaaagtatcgctacagtacgccgcaaatgtgagagggggaatacgatgcaacgcgaacaaccatctccagctacagtacacacacataccaaataccaatacaaatttctcatttaccatttgctttttgtctcctgccaacttttgagtgtaagcaaaataaagagaatcaaaaaaaacatatgctcgtcccacaacaaattcaactgttcattttggcgcgtgtttttttttgttcaaaatgggaatgattggcattttgtttctacgtgtttctctgattgtctcttctgccctctgcgttcccttcactctctctcactctatccatgttctgcttctgtgacgatcattccactctctttcattgatcactttctgccgaacctcagatactcgtgtttccgctttccaaaacggagatactgaaatgtggattggtatgatcgatctgccatgatcagacaagctcctgtggatcttagttgcatggcccaatcaatcaccgatcaggactcgactagttaggtaagcaagtctaatcagtttcggtcactatattccctcctttttaaacatttatcatcatccttgattgcttgaactattctgtttttttgtaatcattggacccactttttctaagcaattattgatcagttgcaatcactttagctaatctggcaatttccgatcactctatccaacatggcattttcttgtcactgaatcccccaattctgatcacttatcagctcatcatcactcacctcgtgtttcctcttctctcggcctgcttccgctacaacaaatttgcccattcctgtaaatttgccaaattagatccccaaaaaacaaatcattgaacgactcgccttggctgacggccaatcggccaatgccttcgttgaccagaatgcccagttgggcgagcagtgccgaactctcgtacagctggcacaacaacatcctttcttcgtcccctgcggccaactgaaatgccaaaaaatatatttagccattaaattttcgattttaatcaattgctttttcatacgattttctcaactaggccgagaagcaaggacaaatatcgaaaaagctcatcatcgttttcttattccaagccgcttttccgtttttatctccgggatatgaaacagttaattccggaactcggggacatttaaagataaaatggcattttctccgataacatatggcaaaaccagctcgaccgaatcgggataaatccgagagtccaaattttctttgcccgttaacccctcccccctcgatcccacctgtgcacaatcggattggccaaattgctgctgctggtcagcgggatggccactttctgcaaaaggacag

SEQ ID NO: 13425 - DNA, 2143 bp, Heterodera glycines
  misc_feature (1337)..(1337): n is a, c, g, or t
  misc_feature (1348)..(1348): n is a, c, g, or t
  misc_feature (2118)..(2118): n is a, c, g, or t
  misc_feature (2128)..(2128): n is a, c, g, or t
tgcacaaagaccgaccgacgaccgactttttgctgcatttctgacacatttcccccccccccccccaaatttcacgcgatggaagcgaaaggggggggggaggaaaagccattttcataagctaaaataggggagggaggtgaccaaatagaaaagggagggagcagcagagggaaatttgagttacacacatatttttgaaaagcaattttgccaataaccttttaggaaaaggaaaacctcgggagcaatgcacaaagcccctccccccccaaatttaaggggaaacaatttttaataatttaaatttaaaaaattaattagaagttccaattgtttttattttttgtttgtttttgctcgttttaatcgttcttttttcgtttaattatcacttcatatttcacttctctttctctccatatttcattcattttgattagaaaaatgtgtacaaagttttatcaaagttaaagtccatttccatttttgataaaagtttttgattgacggggaaaaacaattaattccccttttgtccgcaattgaaattcattttctaatcgcacacagaattaaatgatgatgatatgataataataataatacggcatccatttaattttcttctccaatatattttattattctttcaatttaaattatgcataattttcaattattattttttgcttttctttctttaattttccataaatttaaattaatattttttattttgttattttttattttgcagcaaatttatgtaaaataatctcagctatttcctattattttccaaaatttttcataattattgccataaatattttgtctaaaaagtgtccaattatttattaatcattatttttttctgttatttgtttaaaattaaagatttcaaaaaacatttggcccatttcccaatatttttctgatcagttttttgtcgacccaaatggaatcagcgggcgaaacaattctgtccgtgccaccgttactccatctgttggctatccaacagcagcaaaaacagaagcagcagcagaacaacgggtgggtgattgatcagtgatcagtgaatgtttaaaaataattatttaaaaatatgatataaattgcagaaataatgccgacacgaacaatgccacgaacgaaatgactttgtcttcatcggatggcaatgtaaattaatcagaaaagtgtcaacaaatctgtaacagccatttttggacactaaattccttttttaattgccctaatttttatttgattttttcgttaaaattatttctatagattgacttcaaaaatgattgtaaaagcacttttgnggtctgaaatntaatcgaaacgtgacccattgaaatataaaatgtagtaataaatcaaatattttcaactttgttagttctgtattgctgaacagcaaatgcaaatcggcaccaatggcagcgaaagtgccgaagagagcggcgcatcggacggggaaaacggaagtggagaaaagcggagggaagaggaggatgaaaagcagcaggggaaggtgagcatgggaagaagcatcaccaaataattccactcttttttgcaactatttttatttaattttgccaaatattttaaaagactcggcatcgcccctattttggcatttgcgaaactaaaaatacgtgctaacatttgatagtctaatgcagccaaactaaactaataactctgcccgcctgaaaggataagatttgaacatggaccgaagtttatcctctagcctaataagtcaaaaatcatcccttcagttttaagtggtttttgccattttaatttgctatttttaacaaacaaattttttgtatttgtcctttttatgttcaaaaatcagttatttttatgtttaaaattgttttatttacatctatttgtataatgtttatgaattttgcacgaaaatagaatttttgcaaaaaaaaattatcaaattatatataattatgcttaaatttgcatccggcttaagcattttgcacatgcaaatgaagcccatccaaataatgcattaaatttataaaaataacaataatagcaatggaaaaaacatacgtaagcagcccaaantgttacaaantataatgtatattgc

SEQ ID NO: 13426 - DNA, 3588 bp, Heterodera glycines
  misc_feature (28)..(28): n is a, c, g, or t
gggaaaacggaagcgggagaaaagcgangggaagaggaggatgaaaagcagcaggggaaggtgagcatgggagaagcatcaccaaataattccactctttctgcaactatttttatttattttgccaaatattttaaaagactcggcatcgcccctattttggcatttgcgaaactaaaaatacgtgctaacatttgatagtctaattcagccaaactaaactaataactctgcccgcctgaaaggataagatttgaacatggaccgatgtttatcctctagcctaataagtcaaaaatcatcccttcggttttaagtgttttttgccattttaaatttgctatttttaacaaacaaattttttgtatttgtcctttttatgttcaaaaatcagtatttttatgtttaaaattgttttatttacatctatttgtataatgtttatgaattttgcacgaaaatagaatttttgcaaaaaaaaaattacttccaaattatatataattatgcttaaatttgcatccgggttaagcattttgcacatgcaaatgaagcccatccaaataatgcattaaatttataaaaataacaataataacaatggaaaaaatatacgtaagcagcccaaatgttacaaatataatgtatattgcagcccatcaattttttaacttattttttagcatttttatcaaaataaaataaaaaaatttacaaattttattttagcttgaaattgtcgaagagtccgctactcctcctccgctgtttcgacaacaaacactgcaattcgctgaagagatgatggacgtgaaaatcgaatcgccgcgaggtaaaatttgaaaaaaaaaaattcaaaattacggtttttaatttaattttagatttgcacattcaaatccctccgttaaatgcattcaatgggtacggcactccgtcgatggctcagagtgccgcatccactcctaccgaacaacagtgtgagggacagggagatggggggggggcggaggtattagtggttaattaatggtccgtcagttttgggaccactggttcgatccttaattttaaatgatcataaatttcagctaacaaaccgttgccggtgatcaagcccccgggggatgagaaggaggaacggccctcactgagctacaaggacctgatcatcgaggccatcgaaagcagtcccgaacgacgcctcaaactcagcgaaatttatcaggtcgagtaaattaataaaattattatatttcaataactttttggatttcctttgcaggtgatcaaatatctccacccgtactaccaacgtcggtccgatcaatggggctggcagaactcaatccggcataatctgagccttcacgactgtttcgtgaagcttccgctgaagcagaccagcgcaaacggagttgtcggtaataattaagcatttcaactaatttcgtgatttttaaagcgggaaaaatatttacaggacacttttggacggtggtcactcgtgggccggacgagaagccattgggtccaactcggcgtcgaacccgcggcagcggaaaggccaaaaagggaacgatggcctcgatgccattcaatgggtcacaaaatggtgaaaaaacaaataaatttaacacaataaataatattttcaaacaattttcaggcggaactgcttcaaatacgctttctggcatcaaacacggcacaatcaaagggctgaagggccgccaaagtgttaggtgaggaggcctcatattcattgtcagccacaaaatgcttaaaatacgaatataaatacagctccgacagtggcatcatgagcgacgagggcggcgcgtgcagtcactccaactcgccaaccgaaatgggcacgcgcagtgtgccattgctgcacgcgaacgccgaggcggtggcaccggcacgcgctgcacagttttcggcaaatgttaatcaccaacaaattatgccaaataatcaatccttttaatctttgcagcttttccaattccctcgacccaccgctcaaatgccgacacttgcgcagcaccaccaccaggtccaagcagttcattcgcccgccccaacccccgcgggccatggccacgcgcagagtcagctgagtccgctcgaattggtcctccaaatgcagcaccaacacaaccagcaacaacaactccagcaacagcaacaacaactccagcaacagcaacaacaaaaccttcatccgttcgcttctctccagcaattttccccaattcccaaatcggattctgttgccgcaggcgttgctgacgaagtgaacagcgcaccggctgctgcttcaacaccgacactgatcatggtgagggagggatgaaaagggaagggaaggtaattttatttaatgtttagccgaacgatgccatcggtggtgccgccgccaataacaacgcttttttaccttgcgaattgcaacaactattggcaattgcggcacttactcagcaacatcaccaaccgcaacagcaacaacccatggttccggtgtctgcggccaacggcaccaacaccaacaacaacagcaacaacaatttgccatcatttcactcactgccaccgccagcggcgccggatcataatacgatgacggtataaattaatatagaaaatgagttaaaaattattaaatcaatttttaatatataaaatgaataaaattattaaaatgattcagttgcttcaactgctcaacacggctggcacaagcagtggcacgccaccatcggatggaggacttggccttctgagcaatttggccacccaattggcaccagcggtcagtccggcgccaccacaggtgatcagcaaagacatgatttttagcaaaaaactacaaaaaccttaaattaaaatcaaattaattgaaagaaaatgtttagcatccgaacaacgtcgccgtcggcaacaatttgttggcatcggccgccgctgccgcaacggcggaattgcaacgtttgcacatgatacaattgtacgcacaacagcaacaacaacaggtggaaagcttagaaaaagcatttaaaggagtgaaactgattatgaaaaataaatcaaaataataataataataataataaaaatttcagcttcagcaacaattggccgctttgttggagcagcaacagcagcagcagcagttgcattttcagcaacgggtgagaaagcaacatttaaagcacgataattaaaacaaatccatacaaatataaattgttttaaaaattaaaaattccgggattaactttttttttctctttttttctaacaaataaatgatatcggaacaaaaaaacattaaattggttgacaatgacaaaaggctttatccggaaatatttcgattttttctgacttcatttttttaaatcagcctaaaatccacaaattaaccatttttgtgaaattgttaagaaaatatgtcaaaactttcatgccactaaaaagaacacataaactttttttttgaatgaaaatgattgcttttttcaggaaacggtaaaccccgcggccacggcactgtccgacgtgttgtccggtgctgcc

SEQ ID NO: 13427 - DNA, 3780 bp, Heterodera glycines
ccctcttcgcttttccctcctccgtttccccctttcctttcctcgccattcgttttgctgtgcttcttcttctctgcccccgctgtttcccccgtcttttgccacttttgtccgtccttcgcttcactaaattatgattatattattggtttggtctaacagtggcttttgtcttgccggcttcgaccacgggtattcgcacattcgacccgcaaatctgtcgcacgcattgccattgtttggctgtcatgtcggcaaatagcaccgtgtccgccatcagaactcctcggctgatcagtttgccgttgctgttgctcttcttcctgatcagcaacagtcggtcccttcccccacattcttccctcgggcatttgtaacttaaagcatcgcttttccgtgccgttctcccctccctctcctctcacatgtcgtactgctgttgctcttcctgttggtgttccccattcttattatggttggtctgcagttgagcatggcattggctgccctttgacgctctgttcgtcctgatttgcatctgaattcgatcactgtccgtgtgcagccttccgttcgtctctgtgcttttccttttccatgcttttcgtaatgttagctttgctctgtcgccactctccgtcgatgccttatgacagcccagcaaagtcgacctcatcgccgtcactttgcttctcgtgaacagtttgtcctcctcgcattcgcctgacaaaatgctttcgcccgcgtacaaattgccgcccattccctaaaattcaaatggtcgccaattcctttctccgtcactttcggcaaactgacgaagaaaagcacgagtttgtccatcttcacatgtgccaccagtgtttcgatgcgtgcctttcctcccatcgcttttccgtctttgccaatccttcgccgcttcactgcgcattccttgaacaccttgaacttgtccttgccctgcgcgagctctttgcgctcgtcttttgccttcctccgccatcggatcgcttcctccaccacggggactgactcttccgcgcactctctcctcacacattccaattgttccgcgctcacttccgccaccgtcacttcgttcactaacattttgcccacataaacaaatgagtaagactttgcttttggttcgtgctttttgttgaccaaaagcagcgcacttttgccatcgcaagcatcttcagggcattcgaaactgacaaattaattaattcattgaaaaggcaaaagaaaaagcaaaatcagaaacgcacagttcgtaattcccggcgaagcactgctcgtaatccatttgctttttgcttgttaaatccacttaaattaactaattattttctcctcccaccaaaaatgcttttcttccaatgctttaaactgatgggaatatttattttattttcgaaacacttccctttttcatttagaaaataataattaaatggtccctcttaaatatataaattttcaaattgtttactcatttttacataattacccccccccccccctcttttcgtacaatctttgccattcactgtcaatttgccgtttttgcattgctccacgggtgccccttctctgatttggggtgtcattctcgacgtcgctgcgaattccttgtcctctttgcacaattcgctcagttcgctgtctcccgtgtacaaattccctcccaatccctcaaaatttggaatttaaaagactcaaagccaacaattaacaaacaaaaagaatcatccgattgttctccattttggcatgcgaaacgactgtctccggcccatggcgaccttttggcgcgcggacggcacattcgatgaacaatttattttctcgacttgggccgggagcaaaaacggtgggcagaaaaagtagcagaaaagagggaaaaagcatagaaaaggtaaaaatgggatgaaaagcaaatggaaatggcacgaggaaaacgaaagggacggtatttgaaggggaaagtgagtggcgagcagctgagcaagcaaaggcacactttgcattggagggtaaaataaaattttaaatagcgacgcatttggggggggggggggtaattaacgggggaattagcaattagcgaaagggcgaccatttattggacgaaatgaagaacaattcgctatcgaaacattcatcttcgtggtgagattgatcaattgggaataaataggcgaatgtttgggccaatcgcgatgcgcttttggctttgtgccattctttgccgctaatagcccggcgccgttctcggattcggacagtgcgcacacccgcccggcattccgtgctccccctgcattccctgcttcccggctgaacaagcgattcttttccttgcggcacaacccttggccaacttacgtgttccaactttgcctggcggcccgacttgtccgggttcgcccggcggtcctttcggcccgggcactccgttctttccggctattcccggcgctcctttctcgcccgataggccctttggccccggctttcccggcggcccaggcggacccggctggtctgacaaagtgccttgtgctcccggcactccctttgggccaggcattcccggccttccctgcaaatgacagtgcatttggatctaaattatatatcagaccgggggtccttgaggtccaggtgggcctggtgctcctcgtatgcccccatccgcgtccaaccccggcgtgcccggctctcctggctttccttttgggcctggcgctcctcggggtccaatggggccttaattgtacaattgggtgatcaattggacaaggtttgttcttgacttgcctggtgggcattcgaagcagaattcccttggcctcgcctcgcctttcgcatcttcccccggtgggccattgtctcccggaatcccatcgatgccgtcctgaaaatgttccgtgttcgctttccctttaacaaagtgccatccatcttcatcttcttgcctttccgtctttgccatcttccccgggtgatccgggtgctccgtatgcgcaaccacctgccaaatgcaaaaacgccacttcgtaggcccgtctttttccttttctcacatttctgtccgacagcacttgtcgactgcgtttcgtaattggcttctctgcccgttctgtgcttaatggtcgccgtgatggaattgctgtgctgagacgtcctggacaattcgcgccacagataagtcgaccgatgctaaaattggggagagaggggggagaggggtattgttccaagtatcacggacggaatgtggaaataggagctggacatgatcaagaatgtgatcatcctccgttttatgatctccccctaatcacccccccccccatggcactggcatttaccttacaatagtcggcctcgttttgaacgacggaatgggcttgttggatgtaattgtacacaaatggcacactgagtacacaaagcattgccgccaacacagaagcacttgaaatgggagatttgtttagagaaggctaatggcaagtgttacgcgatgccgaggatggtaattttgcgaagggattcgcactgcgctaacaatttctgccgcctttcctccacttccttttccctctcgagagggcacaaatcgcgcatttccggcggaaagtttaaaaaatatctaaaaattggaatataaaattaattaatggatatgggaatttatgcaaatgacataattaatgatgatcagaagtgaattgaagcagggggaataaaagtgtaaatttggag

SEQ ID NO: 13428 - DNA, 3082 bp, Heterodera glycines
cccaacattgtttcattggttgtgccaactctgggccgaaatgccgttgtcgctgcagtcgccgtctgcgaccggtcgccacaatcgccgccagtcgtggcgacggcgtcgatcaccgatgtgccattgtcgacgctgtgcgacgacagacgaatcgccgatgccgctgaacagtcaaacagcagcgatcggcgagcggtcgccgatggctgctgttgttgccgctgccgcggagatccgtcgatcagtgccgggaaagcggtgcgcggggagtccaatggcacagccgtgccgacgtacgcttcgtacatggacacaccggcgctgctggggacgtttgctgcaatagcagggaaatgagtggagttgtggaaggagttgtttgtaccgtatgttaccgtatcgcattaaaattgcgctaccgtgtgataccggtttctcgccctaacagcaatttttgtcctatcgtattctaccgtgtttcattagttacttattaaggaaaaagtaaccgtaacccaccaatttatacggtaactatcatgttgcaaatgagaaattgcaaaaatattaccaaatgaacaccgtacctgttaaatcaattcgcaaagctttaggctaccaatgaggttgttcaattcgttacagtaccaccatgaccacccacagtttcggtcccaaattgctaccgtactgctctaccgtaaccatctcaacttaccgttcgtgttgtttggcattgttctaccattttcatgaccatcaatacaattattgttgttgttttggttgttgttattattgggtccaatttgcccatttccaccgtaactgttgctgctgttgtccaaaccaccgtaatcgtaataatactgtttctgctgaccccgaccatcggacgatggcacattggcaattccttgaatagcaaattaaaaaaaataaatttcgtataagaattaattgctgtaaccgaataaaaatttggtacttttccgttttggggccacagattcaaatcggtgcaaattcctttggcctgaggactgaaaaaatcgtcatatggacccattcaatgatcttttggcccaaatggttgcctttatgactctcaaatagctaaagggctgtatttgaatattcatcccgctctttatttatgttatttttttaaaatttaaatgtgtggccccaaaacggaaaagtaccaaaaattttacgaaattgcaaaaaaaaaaaaaaaattaattttactatcataaactaaaaatgaaaagcataaaaactaatttttatattttttaaaaattcaaccaaaataaaatttttggaaattttccattgaaatccggcacttttccggggactgatttgttcgcgcgtaccaacaacaagcagctgtactcacttgtcggtggtgccgagtttgagtacatgccattgttgacaagcggcggcgcatgaactcgccctttcatatggtcatttccagcagcagaaacgggctgctggagcagctcaaaacggccaacagtaggacagctgctgggcgacaactcggtggcgggcgacgacggcacggactcgctacagtcgccagtcgcagcgctggtcgctgccggttgcgtcggtgggtaacggtcgccggtcgcctcctctaacgacgaggaggaggaggacggtcgccgatgctcgcgcacacggatcagcgtgttcgactttgggtcaaagctgatcagcgatgtgatgtggtgatgatgattattgttttggacgattgggccaaaattgatcagcgacgccatctgctggcgactgttgctgttgccgctggggtcgccggcggcgaccgctgggccagccgagcggcgaccgtccgtgccccgcagcagcgcaagtgcgttttggtgatgctgcgagatggacgacggcgagcaattcgagaggacagaggcggcgggtggagaaaaggagacctgttgatgtggaatttttttcgttttttttgcgctaccgtatccctcgaaatttgagacagtaatgcaattttttactattgcgtgaactactgtaaccataaaatagtacgatgcgataccgtaccagcacactactgctgatatgaacagcttctcagttttctaccgtaatgcccaattggctaccgtactacctaacaagcccacaaaaatgcgccgtactcgctgtcgacgctgaacagcatagtcaccggcgactccagcagaagcatcgcctggctcacaacaatcagcgcccggcgcaacagcacaaaatgttcgcattgaaccgcccctcctgtaattgttgttggtgtacggtaggcgatgctgcggtagttgctgcatgacaataccactacggtcgcctccgccgccaccgaacgagcggggcgaccgtggtgcggcggcggcgccgccagcagcagcgagaccggcgagcggtgtgtaaaaggacggagacggtcgccgccgactaccgtatgcgtattgtagcggcgcttgctggttgcgattatggtaattgttgatggcgccgctgccgttgctcgccatagttttattactgttgctggtgttgctaccttgataaaaaaaatacgttccgtctaccgtatccatcgaaataaggcgttttgaaaaattgaagaatttttaggatttataaaaattttaaattttttacattttttttgcgagggcgacaaaagaatggtggcacaattgaccaactgaagaagaacggcacgtcaattggaaaaaaataattgggaaatgaatgaatggaagggaaaggaaaagcatcaaagtgaggaatccaaatgtgaaattttagcttttttaaactcttttttgaatccgattaagctaagctttcaaaattagttttgaaatttttatctcctaattctgatggtcaaaaattgagcaaaagaaatgcaaaaagtcagaaaaaagaaacaataaacgtaccgaattgctgaaggcatttgcaggaacagaatgaccagggaaacatcggaaaaaggaatgatagaattgactaacaataaggagtagggctg

SEQ ID NO: 13429 - DNA, 2900 bp, Heterodera glycines
cagctgatcagcatgggctaatttccaatcagcaaaattttatgtttttttttaaatgtttaagggtgtccgagttttgagtccctctctattccattttagataataaatattttccttttgcaacgtacaatgtattaaacatgtactaaaaccttcaaatatgtactaaaaaatgtaaataagatttttaatggctatttttttggaaaaaaattcctcgtaatggtgaaacaggcacaaaatgccataaaatgacaactaaaaaggcttaaaaatcacattttagtatttgaaaaattaatttttgatatctcactttaaaaaaaaaccgatttttggggttattttcgtaaataaatttttttttttcacagaaaatttccataaattctcaaaactaccctctaatatgtaaaaaaaatgaaaatatgtacaaaaaaatccaaaatatatataaaaataaaaaaacacctcttaatatgtaaaaatatgtaaagaaaagtcccaacttttgttcgcaaaaacacaaaaaagaaagtgttttctactaattaggctatggagaagccaggaaaaaatatgtaattacataaaaaagaagccctgcaaatcaactaaaactggaaaatacggatatagaaatccatcctagaagcctaaaaccaagctaaaaatatgtttttcgtgcgtttcaggcccaccctaataaatatctgcaatagttccctgatttatttgataattaatgatttaatgcatttgttatggaaagctaggacaaagtccgaatagggattaaatgtcctaatcacataacaatgcttttgcttagaatttaaaaatttattgaaaaatttagataataaatatcgtgctgagtcgaagcacgaaaagtgcaaagtgatcaaattaaagcaaaataatgcatcaaaaaaattaataaaatcaattaaaattttggtcattaatgcttgtggagatgttcttgttttattgttcatcttttcatttatttttttgaataatatccaattgtatttgtacatattttttaataataaaacaacatattttattcatttaattatttatttaatattttattctttaaaatccggaccagaaaattaaattttaaccaataagcattaaaatttgatgatcttttctgatcactactcgaaacagttttttgattgtttaggcgttttcagcacctaagaaaacctataaaagtatttttatgcaattttgagtctgggacctatgatggatattttaccttttaaattttttagtaaattaaatctcggttttttgttcaagtcagggttcgagtttcgaatttggccaaaatgcatgtcataatcgttttcagcgacctctaaaacccctagaaatatgttttccttgtaatttatgaatttagaatttttgttcgaattcgggttcgggattcggaattttgaaaaataaatgtcatattcgtgatcagcgccccaaattaccctagaaatgactttttatttgaaaatttcaggggggtcacaaaaccgaaaagaaccgtctcttctcacccgtctcgaggccattcatcagcatgaccaactgaaatgattggcatttgtgctttggttgttatgccaatgatgggactgaccatatcagtgacaccgatgtaaaacaacattttgtagcatggattggacaaattgtgataaatggacaccatgcaggggacgtacaacaactgaagggagggggagaaagggaaaaatcagaagggggagggacacctcgaaaatgaaaaacagaacgatcaaaagagtgccatggagagaatggacgcggcgatcaatcggcaccaagccgatatcgaagcccgagcagttgtacagacggtcgaactcatcgcgacggaagagcagcaaatccatgcaaaattagcagaagagagagaatttggacggagattttaggaatttgaaaatgggaaaaaatttggaaaatgggaaaattgggggagagaaaatgggagggaatttaattaattttttgccaatgacattaataaattatgggacaaatggcttaatcgaaaacgaaactttaagattaaaaatgaaagaaaaatgatcaactaaaaagtggaaaaattggcaaaatgaaagcccataggaatgaacgaaacagaaaatggctgattaatggcaacaaataccaacaaaaaaaagtgccgtccgattgtccttctcttttgtccgtcatttcctattattttttgtgacaattaaacggaactgcgaaatgagcagctttgagagaggagagaagagagagagagagggagagaagagagagagatagaggagagagagagagggaggagagagagagagggagagaagagagagagagagagagaaagagggagaaaaagagagagagaggagagagagaaagagagagagggagaggagagagagagagagaaagagagagagagaggagagagagaggagagagagaaagagaagagagagagaaagaatttgagagaggagagagagaaagagaagagagagagaaagaatttgagagaggagagaagagagagagagagagggagaaagagggagaaaaagagagagagaaagagggagaaaaagagagagagaggagagagagaaagagagagagggagaggagagagagagagggagagaagagagagagagagagagagagggagaaaaagagagagagaggagagagagagagagagagagaggagagagagagggagagaagagagagagagagagaaagagagagagaaagagagagagggagaggagagagagagagagaaagagagagagagaggagagagagag

SEQ ID NO: 13430 - DNA, 1106 bp, Heterodera glycines
aaaattgggggaggggaaaatgggagggaatttaaattatttttttcccaatgacatttataaaattatgggacaaatggcttaatcggaaaacgaaactttaagattaaaaatgaaagaaaaatgatcaactaaaaagtggaaaaattggcaaaatgaaagcccataggaatgaacgaaacagaaaatggctgattaatggcaacaaataccaacaaaaaaagtgccgtccgattgtccttctcgtttgtccgtcatgtcctattattttttgtgacaattaaacggaactgcgaaatgagcagctttgagagaggagagagagagagaggagagagagaaagagagagagaaagagggagaaaaagagagagagaggagagagagaggggggagggacaaaagtaggaggaaatgatggagagaaaagaggaaaaggaaatgggaaaagagagaaaaatggaaaagaggaaaaaagaaaaaaaaggaaaaatgggaagacttttcggttttggggcctagatttgatttgaatttaaaaatacaacaacaaaagacgcgcagaattttttctgtgcttccccccaattgaggtcgtccgtcactttgccattctcgccccccccccccccaatggcgcgcacttccgtccgttcaatcgcttttcttttttctcactttttttcgtcattttttccattttccattgccaaggtcaacaaagtccatcttcggcttcatttccttcgccgtccgctttaatgaagtgtgagaaatccaattcagcggacagagtttatttgcgacgttttggggatggaacttcggcagcagtggcaatgccatcatccgattacttatgatgccaatggcattatgccctaattgttgatgccaaagatggccagggattgccattggcaagcgaaaacaatgccaaagacagacaaaacaaagccaatggaaagcgaaactcaaacgaaaataaaaataaaaattcacttttttaaattttgcttgtcctttcttatcataaaaggaaatggcaataaataaataaataaaactttcaaatccccaaaatgaaattcacaccaatccccccc

SEQ ID NO: 13431 - DNA, 2017 bp, Heterodera glycines
gtgagctgtctttagtgtccacataatgtgtaactaaatcagtctgagtcaaatctttgtcatcaatagcaaaaatttgagagtggtcgatgatgagttttcctaactgatcagttacggtcgtacagtttgcgtttgcttgcttacgccaacagattcaatttgttggacatgatttgcttcaagctcatttaaaaactgaatggagataacagcaactgaatgattcaaacaatcccaatttaaggaatgtttctcctgtgatttgcttctccaatataactcccgttccaatttgatcattctcggcaagaacaattggaagcggtgaaaaatttgtgaccggtatggttgcttttccaaatttaggcgttattaatgtcggttcaattttatgttccgacacttctgatgccactttaatcaatatcgcttgttcgtcaatctcgtcgtttactgcaacttcaattaacgccgatgaacgcggttgaattttcacattatacaccactctaaccagtttccttttagttttcagtatctgctgcttcaaatgtcaccaatttttgattcacttcatcaaaaaactttatccccaactgattcaaagcattggtctcgatgatcaaatcaaatcaaaatcagacgaagcaacttgaagtgttatcagaacaggacgcattccatctcgcattattggaagtacaatctctccaaccatatcgattgtttttccattgaagtcccttactttcaaatttgaatgaccaaaactaaactccctaatatgtattaaaatatataaataaaatttttgaaatgattattttttgaaaaaatccaaaatatgttaaaatatgtaaattcaaagtttcaacttttgttcgtaaacataaaaaagaattgttttccccactaattctaagatttcatacttcgtttgttttattgacattttaataaagattaaatattttgttaaatttaaaaaattatttttgtaaattaataatattgctcaagattaatcgatgttctaccttcattataagagtccaattttaaagttcttttttccattttgaattttatcttatttatgaaacggtaaattataaattgcattctttttaatatagtattacatctctttcatatttaacttttaattattctatattcatgacaagattggcgcttgaatctgaatggtttgcgcatattttggtgatgctttagagattttattttactatttttttaatatttttagattatagtaatttttaataattgtctgagtaaagtttttaaaatcaatagcactattagtatgtcggatagataattctatttataagataaggacgcacctctgttttaagaataaatccaatacctatcatggttgccacccgaatcccgaaacacgacatttttctcgttccgaaacccgaatcccgaccctaaataatttatttcttttaaagcattttttcgtttatgtagtctagtggctataccttctccctttcaatatttgtcgcttgcaatgagttgtttatttttttgacaaaatctattaacaaatcgtattataattacaaaatttttcccggcggcgcctatcggcaccgccggccccaggttccccaaaattttttagaaaaaagcgacgtaaaaaggcattttttaaagtaaaaattcgtcgcttggcttaaaatcgcaaagacgcccggggccacacggcatcgcattaccacccgtcatgttgggtggtgtgccgaggcggtggcggatgaactgagcaaggcggctttgctcagccgtcaaatatgccactgacgcacggagagcggtgagctccccgtgaatggccacgaggtccacgtcggctttgggcggctgcgcgttggcggaagttcccgcatcctgctgggcgggaatttttttgattggggcaatcggccccatgcatttcagaatggtgtccatcgggaactggcggagggttcga

SEQ ID NO: 13432 - DNA, 2935 bp, Heterodera glycines
  misc_feature (2104)..(2104): n is a, c, g, or t
  misc_feature (2117)..(2117): n is a, c, g, or t
tccccaaaagcccgtgctgtcgatgcagaaactgttcccggggaacatttctgtctccctcagctctcgggatggctgtggagggtcggacttttgtacaaaagtctccgacacatgagccagcagacggacatcgtttgctggctagggaagcgatctcgtatgatcgtttccatgccttggtgaaggcttggcattcgagggagagtcctttcaagatcacttgaagggttcccaaaatgagaccatcatcggtctttattgacaggacattcggttgtcctgccgggagaagcgcaagagtcacgcttcccttgacttggcacattttagttgtgccgttgttgagacagctctctgatttggccattatggccactgtctcaattcccccgtgtacaaacgggagagatgccatgacaagcattgccatttggctaactcggccactggtccagtttcttgttgctggcctgggccggcgtattcgtcggtgaggatagaggaggttttcctcctcctcactcaatacccatgtctcttttcgcggcttgaataagcgcgcgaacaagactgagaaaatccaaaaaaggattctcagtcctgccatggcgtatcccaccatggaacacatggtgaagatgaagcacaggaggcttagggacaggcctcctgccagcattgccgcaatgacgggctggcatgttggattcacaagttgtgtgaaacaaaagtagcagtcgatgagatcacattcatcgactgccgggcgggtcgtgtttgatgtgaaggtgtgctgtgagtcagtccaaaatctggcctcacagtgatgattgttgagtaggacttcgattggtagttcgaagttcaaggctttgatgccttgccgaactatgcagctttctgcacagcatatttcgaacttttggatttcgggtggcactgttacgacgattcctttcgtgtaacaagtgaggccacactcatcacatttcccgattgggaaaccacttgcaaatggaagggcgaagtgtcgaggagggtcgatagccaccactggaagcgatttccgagtgagtttggcttttcttctggtgaccgtttggtgtcccggcactcgagcgagcttgggatggttttcatttggctgttcggttgcggcaacggcttcagttcctgggtccgtcatttcaggacccgcttccaaagggaagatgcggttcactggacgagtaaggactgtctttcgtggcatgtcctttggtttcttgttgttggtccctcggacagggatttcaactttaacacttcggatggctccaggccgtccgtgtgtttcaacgattcgtcccattggccattgattgcgaggaacgaggtcctgagagattaggaccaccatcccctttcttcggttcaccgaagttttggtgtcgtgggcctttgtggtcctactgggctctttctctgagtaatgttaaatactcagagtgccatttggcccagaaaatgtcgttggcttcccggagtgcttgtattcgggaagttaaacgttcgtgtgtggaggaaaacatttcctctgaatcaattgggtccgttgttgtttcttaattgatatgaatctctggttgtaagagattgatgggacgcagtggaactggtccatccactgcgtctgagaccgcggtaatcggtctgtaattgagggtggcctccacttcggccgcgaatgtgttgagttggtcgaaggaaagaatccttcgacccaaagttcgcttgaagcagtccttgactagcttcacgaggcgctcgtaaaagcctcctgcccaaggacttatttgggaaatgaatcgccactggattcggttatgggtcaggaagttttgtacttcctgatccggccccggagcactgagaagctccagggttttctgagcgagtttgaaggtcgtagcgttgtcgctccaaatgatgtcgggttttccccgtcgacttatgaatcgacggagaacattgatgaatgattccgatgtgaggtccaatgttgcctcaaggtagacagcgcgcgttgcgaggcatgttatgatgaggatccatgcctttnattttttctccgncccaacgaaatttgtcgttggcccgagaaagtcaattccaatcgactgaaatggagcgtgtcggcgcactcgctcacccggcaagggtggcatggttggtaatgcaaactgttgtgcattcattcggcgacaatggagacagtcccgaagagtccgtttaacatttaaacgggcacttggcatccagaattcactcaagaattctgtcagagtggtgtccactccaaggtgatgccttttttggtcccgatccaaaatgatcagctttgccaaagcggaatgtatggcgagaagaatgggatgagagaagctgtatggcttctcactcatctccagtctggttttcagacggagaattccgtcgtctccaatcactgttttaaggtgctggaattcttcagcgtcatccatctggtctaggcggataagaactcgctctgcgagtgagaagtcttccgccttgaattccccagacttggaaatttggcgaatttcctttctgtgcttctcgagtgaagcaattgtttcttcgccccttttgaacattaaagcgaggaatcgtaatacgaacattgttgttcgcataaggcgtttccatgagctgaagcgtgaggggtcaattaagacctgctcatttggctgctttaagtgagtgtatgcgagaaacgcaccactcgggccaacattctccgagatttgttggtcagactctgttacttggaaacagagtacgttgggccaaagatggctctactgtgtgagccaagctgaccctttccaccagagatgatgtttcggagctcccaaggaggtgctcc

SEQ ID NO: 13433 - DNA, 1282 bp, Heterodera glycines
  misc_feature (1109)..(1109): n is a, c, g, or t
  misc_feature (1116)..(1116): n is a, c, g, or t
tgttggatttcctccccccgattttccacccttttaacgatatctgaaatacttcccacgttcgaccaacacctttttgaccgcacttgactgatggccttcgcgaatattgtgcaacactctgaaaaaaacaataaaattaaattaaaccccatttattggcgcttaattaacagttatggattttgaattcttttttctaacaaatcatggcttttttttagttggaattttgaaaaaaacccagggtgcctcaaccatttttttagaaaaaattgcaagccaattgagtacctacgccctttgttgttcaatagttttcaaaatccacaattttaactattgcccctgctctatgtgtacttgtgcgtcatcaatttgctgtccatgggcggaaaagtgacttcaaattcccccagggggcaactttggaacattttggccaacgctccactggaaagaatgttcgttcattaattggtttatttgtgtgtgattttcagcttactctccgcttgcaatggccttggccgcgtcttccgtggaaaagccgcggtccatcacaaatttaaggaaatttttgcgggggtccgacgcattagaagaagtcgattgttcaactgcagaacaatcggcagcagccgaggctgagggaatgtcgtcaaaatattgcctcagtcgatccatttgagcagaagcatcggccagaaattggcgaatgttaatcaccggagaaatgtaaggcttttcatcgcttttcaaaattttatccaaagacatcaaaaggctaaaatgggtttagaaatgggcaatcctgcagaatggatgtctaatttaactttgttattttagctaaaaatgtttgccattgtctaaactatgattttattactctgacaagtagggtggggatttatatggacataaaatcgcaaaatatggccataaaatatggaccaaaaatcgcaaaatatggatataaaatatggaccaaaaatatggacataaattttaaatatggagaggtaaatcttatccatatataaatttgacaatttctgtctgtgtgtccgcggtgtttacgcattttgaatttgctcttatagatngtatgcncatgttagaatagaaaatgatagaatgaaatatattagagtccggtaaaaaaatttccgggagcgggatcgggagttcaaaattttccgggacgggagtcccgaacgggatcccgtaaaaatcccgctccctaaaatcccggtcattttttaacgggagccccggg

SEQ ID NO: 13434 - DNA, 1716 bp, Heterodera glycines
  misc_feature (46)..(48): n is a, c, g, or t
  misc_feature (53)..(53): n is a, c, g, or t
  misc_feature (73)..(73): n is a, c, g, or t
  misc_feature (96)..(97): n is a, c, g, or t
  misc_feature (105)..(108): n is a, c, g, or t
  misc_feature (118)..(118): n is a, c, g, or t
  misc_feature (134)..(135): n is a, c, g, or t
  misc_feature (138)..(139): n is a, c, g, or t
  misc_feature (142)..(143): n is a, c, g, or t
  misc_feature (146)..(147): n is a, c, g, or t
  misc_feature (150)..(150): n is a, c, g, or t
  misc_feature (156)..(156): n is a, c, g, or t
  misc_feature (160)..(160): n is a, c, g, or t
  misc_feature (162)..(162): n is a, c, g, or t
  misc_feature (165)..(168): n is a, c, g, or t
  misc_feature (173)..(174): n is a, c, g, or t
  misc_feature (177)..(177): n is a, c, g, or t
  misc_feature (179)..(179): n is a, c, g, or t
  misc_feature (184)..(185): n is a, c, g, or t
  misc_feature (195)..(196): n is a, c, g, or t
  misc_feature (204)..(204): n is a, c, g, or t
  misc_feature (206)..(207): n is a, c, g, or t
  misc_feature (225)..(225): n is a, c, g, or t
  misc_feature (229)..(229): n is a, c, g, or t
  misc_feature (236)..(238): n is a, c, g, or t
  misc_feature (246)..(250): n is a, c, g, or t
  misc_feature (258)..(258): n is a, c, g, or t
  misc_feature (267)..(268): n is a, c, g, or t
  misc_feature (277)..(277): n is a, c, g, or t
  misc_feature (281)..(281): n is a, c, g, or t
  misc_feature (284)..(285): n is a, c, g, or t
  misc_feature (300)..(300): n is a, c, g, or t
  misc_feature (317)..(317): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (338)..(339): n is a, c, g, or t
  misc_feature (343)..(343): n is a, c, g, or t
  misc_feature (347)..(347): n is a, c, g, or t
  misc_feature (351)..(351): n is a, c, g, or t
  misc_feature (355)..(357): n is a, c, g, or t
  misc_feature (369)..(369): n is a, c, g, or t
  misc_feature (380)..(381): n is a, c, g, or t
  misc_feature (390)..(391): n is a, c, g, or t
  misc_feature (394)..(394): n is a, c, g, or t
  misc_feature (408)..(408): n is a, c, g, or t
  misc_feature (414)..(417): n is a, c, g, or t
  misc_feature (420)..(420): n is a, c, g, or t
  misc_feature (424)..(427): n is a, c, g, or t
  misc_feature (433)..(436): n is a, c, g, or t
  misc_feature (438)..(438): n is a, c, g, or t
  misc_feature (448)..(448): n is a, c, g, or t
  misc_feature (457)..(457): n is a, c, g, or t
  misc_feature (466)..(468): n is a, c, g, or t
  misc_feature (474)..(474): n is a, c, g, or t
aattttaactattgcccctgctctatgtgtactcctgttaagcaannngctgnccatgggcggaaaagagacncccctttcccccagggggcaacnnaggaacannnnggccaacgcnccacgggaaagaaggnncgnncannaannggnctatcngagngngannnncagcnnacncnccgcnngcaagggccnnggccgcgncnnccggggaaaagccgcggnccancacaaannnaaggaaannnnngcgggggnccgacgcannagaagaagncganggnncaacggcagaacaancggcagcagccgaggcngagggaaggncgncaaaananngccncagncganccannngagcagaagcancggccagaaannggcgaaggnnaancaccggagaaaggnaaggcnnnncancgcnnnncaaaannnnanccaaagacancaaaaggcnaaaaggggnnnagaaangggcaatcctgcagaatggatgtctaatttaactttgttattttagctaaaaatgtttgccattgtctaaactatgattttattactctgacaagtagggtggggatttatatggacataaaatcgcaaaatatggccataaaatatggaccaaaaatcgcaaaatatggatataaaatatggaccaaaaatatggacataaattttaaatatggagaggtaaatcttatccatatataaatttgacaatttctgtctgtgtgtccgcggtgtttacgcattttgaatttgctcttatagatgttatgccaatgttagaatagaaaatgatagaatgaaatatattagagtccggtaaaaaaaatttccgggagcgggatcgggagttcaaaattttccgggacgggagtcccgaacgggattccccgtaaaaatcccgctccctaaatcccgtccatttttaacgggagtcccgggcgggagcgggagtaatttcgaaaatttaattaaaaactcccaaaaatatttttaatgcacaaatttaaagggcaataaatttattaaattaaaaatatatagaaaaatttataaaggagaaatttgaaataaaaaaatcttatttttgagtcaaaaatcagaaaattttttcaaattgcttaaataaattattttttataattaattcgaacaaaacatttattaactttatatttttgactccctttattaattttacaaaattttttgcggtgtatttcttgaaaaaacttttaaaaaattttgataatttttaattgttatataaaataatgaatattttttggttttataaatataataaacaacgaatttctaataaatccttgaaagaaaaacatattttcatttttaaatcaattattttatttaatcggtttaataccagtttttattttttaaatcatatatcctgttgtccttcgaatttttttatcagaaggagttaagaattttttttattaaggattttagggagtaaatcacgtaaaacttaaacaaaacttaattttgatcatttaaatgataaatatatatttacaattttttaaagtaaaaatttttatcaaaaaattacattttttgttattttaaaaaaaattttcattttaattaattttatctgatgtcaacgtgcttatttgtgttgttactagacctggacctggatccaggcctggatttttcctggatacaggtccaggt

SEQ ID NO: 13435 - DNA, 2284 bp, Heterodera glycines
aaatatataagagagcatcaaaaggaattatgtgcggaaagttattttgaattagctgaatggttggaagatgaggaccaaagagaaaataaaaaattgacaaagataattttaccgtcaagcgtaaccggttcacccagatatattgaacaaaattatcaagacgcaatggcaatggttaggagatttgggaaacctgattttttcctgtaatccaaaatggccagaaatagttatgaatttgtttccaggacagcgtctagaagatcgcccagatttaatcgttaaagtttttagactatacatgaaaaaattaatagatgaaattgtaaaagataaaatatttggtaatgtgcgcgcgtggttatatgtagttgagttccaaaaaagagggttgcctcatattcatttattgctatcgatgtcaaataatgataaaatcagaaatcctaatgatgttgatagttttatcagcgccgtatttcctgatcccactaaggatcataaaggttttgatttagttaaaaaacatatggtccatggaccctgtggaggtttgaatccgagttgtgtttgcatggaagaatatgaagataaaataactaaagttaaaacaaaaagatgttcaaaaaattatccaaaagaattttgtatggaaactgcgatggataccgatggttatcctacatatgctcggcctaataatggcatgacagcaattataaatggaaaagaaattgataatcgatgggttgtacctcataacttatatttacttaagcgatatgactgccatattaattttgaatgcgtgcataatattaaatcagtgaaatatctttataaatatgtgcataaaggacatgatagagcagagattgaaataattaaacaacaagataacgatgaaataaaagaataccaagatgtaagatatgttactcctcctgaggccttatggaggatttttggttatgaaatgcaaaaaagaagctattcaataaagcgtctgccaattcatttgccccaaaaacagatagtgtattttgataaaaattggagcgaggataaaatagaagaaaagcttaagaaaccaactgagctgatggcttattttgaattaaataaaaaaagaccctgaggctagacaattgttatattatgagataccggaaaaatatatatttaaagataatcaatgggttaaacggcttaaacattttaatattattggaagaatgcattttgtaaaaccacacaatacggaattagtttgtcttagacttttgctttgccatgttaaaggagctacaagttttgaagatttaagaactgtaaacggaatcctaaacaaaacatatcaagaagcgtgttttagaattggtttgctaaaagacgatcaagaatggattgattgtattaaagaagcaattaattttgcaatgcccaatcaattaagaagcttatttgcacggattttggttcattgtaacccttcaaaacccaaagaattatgggaattattcaaggttgaactttccgaagatttcagtcgtcataataacaaagaaattgcattaaaaaagcctatcaggatattgcaaaaaaaaatgaaaaacgaaggaaaaccacttgaaaatttccctgaaatggatcaaattgaaattaatgaagaagaagaaaaatttgatatgttaaatgaaaagacacttggtaaagaaaaatatgcaaaattgacaaatgagcaaaaattaatagtcgatacagtttttgaaaaattgcacaataaaaaaagaccagcattattttttattaatggtgctggaggttacggcaaaactttcacttacgaagttatttgtcatttggcaagaagcgaaaatattcgtgtgtcggtaatggcacctactggtatagcagctattttattacctggtggtcaaacaattcatagtaggtttggtcttgatttaaaacttacacgatcagcaattaactcaaatcaaaaagaatggaaagaacttaatgattctgaaatctttataattgatgaagcaccaatgatgcataaaaaaatacttgaattaatcaatgaaaaattaaaagaaataacaggtataaatgaactttttggtaataaaataataatacttggtggtgattttcgtcaaaccttgccgattcaaaaatttgcaacaaaatctcaattaattgatctttcaatcaaaaaatcacatttttggagacagtttcaaaagtttaatttatcaaaaaatttacgtgt

SEQ ID NO: 13436 - DNA, 2568 bp, Heterodera glycines
  misc_feature (1440)..(1440): n is a, c, g, or t
tttgttatcattcgatagctcttcagattctctccttttactgcgcaatttcaaaaaatttcgtcagtttacaaaacctttatgaccagaaacctcaaaaattaactttttcttggcttttgcggcgccgcgtagcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccgaagtgaccccgacccgtttgaatcccatatttcgctgaccaacgaaatgtccaagcctcgaaatgtccaagccacgaaatgtccaagccacgaaatgtccaagccacgaaatgtccaagccacgaaatgtccaagcctcgaaatgtccataagggtaaaaaacacgaaatgtccaaaactcgaaaaagctcataaaaacccggaaaaggagtctaatttagggttttcggggtcgccgaatacgaatacgaccttcatatcgccccttacctaaccctggacccaaatataaatataaaataccaaaataaactaagaattctatacacgatggcgaccaaaattcgaacaaattttttgagttcgcaagtgatccgaattctatcactagacaaacttcacaagttaaatgaataaatttattaaaaatacaataaaatttataacggaacatggacaatcgaatcctcaaaattctcgaaatccttcaattttcctgaatgtccttcaatttgaagaccgatcggcgtcacctggccatggatttcaccattgttgttgcattactcgtccggcaaaattcgcataatgacggcgtcctgtatgtgtatcgcttttgtcacatgcgaatgaaatggcgagcagctcagatcgggcagcgtccatccatcagtcggtgttttcattaattttacagatgaagtccgggagggcagggtggtggcagagacctttcaaacatatttttttaaatttgcctgtagtaaattaaaaaacaaccataaaatgcagatgggttgcctccagtccgttgaaatttttaatataaacgacattcgtgaaaaaatgtatggctgaaggcgctgttgaagtcgatagcgagctcaacgaatattgaacaggctgttcttgtggagtcacagtggttagccatatagagttcaaggcgccggtgagccgatgccgaactgtattggagtagccgcgtagctgtgttctgaatgatggtcgaaattgttgtcactagttcagcttaaaaataattaaacttttggaaatcgacgaaaaaatacgaaaacaaatcgctggaaggcaaaagtggcaaagaaagaacacttctgaaaaggaataattttagtctatttttntgcgtcgcttcaaacataccattcagccataggcaatgtcccccaaaatatgtttttccgcgctcaaaggttcattattgaacttcagcctcgttcaaagtctgttgttcaacgttgtcgaaaattatcacggcattcggttcgcaaagctccactcccaaattcacggcatcctcatttgtgtttgaaatgtctgaaatataacgcttcttccgactttttgtagactttcaagcttattacttatcatttggtctaaatgaatagaaaaatctaagtcgtcagtacagcacatattttaaaaatttttgaacttatttcttcttcgggtggatcaagggttagacaaggggcgatatgaaggtcgtattcgtattcagcgaccccgaaaaccctaaattagactccttttccgggtttttatgagctttttcgagttttggacatttcgtgttttttacccttatggacatttcgtggcttggacatttcgtggcttggacatttcgtggcttggacatttcgaggcttggacactttgtaggggcgccccttttgatagcaaaaaattttttctatgatatttgccaagtcataaaacttgttccaaggagttttcgggatcgctgatcaacgaatatggaaacggccatatggaatgaccgatatttaaatggtcacaccatcccaaaaaacgagatgtgtaccaataaatagagagtgcagagaaaaaaaggcgaaacatctctttttaggggggggggtaaacccaactcatccatagcacgatacgagtcgtcgccgtggcatttaatgccacgactaagaccgtacaaccaaaaaatgccacgaccgagaccgcataatcaaaaatgtccacggtcaagaccggcataatcaaaaatgtccacggtcaagactagggttcggaccccgtgggcgggggtggcttttcacgggggcgggggatggcgggggtcagagtcgcgggggcggggacgggggcacgataattccgcccccgcgggggcgggggcgggggtttgatttgagttaactccagaatatgtaactgaaaatgacttttttatgaatgacgcgctggctccacgttccttgagtcaatgt

SEQ ID NO: 13437 - DNA, 1098 bp, Heterodera glycines
gcaattttccaggaatgttcgagtttttgccaatgtacaccaatttcgaaccgaaccgaacatacgaactgattggaacttatgcgcccgtcagcaaaattgacccaccacaatttgagacaaactttgtgattatgcacaaatctgagcaaacgcggcaaacgatgaaatggtaataaaattccaatttaaataaataaataatgaaatttcaatttaaatgaataaaatattaaatttaataaataatttaaaattccaatttaaaatgataaatatttaaacttcgaatttaaatgaataaatattaaattttataaataatttaaaaatattaatgaagtatttaaactttgaatttaaatgaatgaataatttaaaattcctttttaaatgaataaatcatttataatccaatttatataaataattaatatttcaatttaaactagagtgccacgggaccgggaccgggccgggaattcccggtcatccgaggtcccggtcccggttcccggtcccgggttttgaaaagctcaggtcccggtcccggtcccggtagggcaaccgggaaccgggaaaaacaagcactggtaagaatgggggtctgagtgaaaaattagtgaagaaaattggagtcaaagggaaaaataaaaaataataattaatatattctttaaaagtaacactgcccaagtgtgcaaatggcctaatggctagtctccttgactttcccttcttctttcccctggttcaatccctctacagaaattagattattttcaattttttgttttgtatactcgtgggtttcctataaagaaaatatgattcctcatagtttttttaaattgatacatattttatcattttttaaatgaaaatcctaccaattgagcttaataatcgcaaaaaccaacctttttttgttgaaaatctgttaacaaattgcacccaaatttttaaaatttcccccggcggcgcctatcggcaccgccggaccccctttctttcccaaaagttttttgaaaaagcgctccgaaaaaaagtgatgtgaaaatcaaatctgaatttctattaatattcgatgatttagtc

SEQ ID NO: 13438 - DNA, 3586 bp, Heterodera glycines
  misc_feature (3499)..(3499): n is a, c, g, or t
  misc_feature (3507)..(3507): n is a, c, g, or t
  misc_feature (3528)..(3528): n is a, c, g, or t
tattggaatgggcatggcaaagacctaaaaatatttaaataagtgccttttataacaaccctaattaatgaacatcgcggtttttttagtaaatttgtcttcaaaattccttcaaaaaatgttttcactaatttcgaaatctttagcccgctcttccatttaaatataaaaaacaatataataaatgaaatttcaggatattctttctataaattataatttaaacgttgtgttcgttcaccttgaaaattgcctcgtccgtatttcgttcatgtcgaagaagtcggcactcaaatggtttctgctgattttgcgctgcttctgctcctcctccattattggcaaactgatttccgatacatcttaacataattttaatttatttttcatttatttttcgcttttttcacctttttccccattttccgaatatttttcctccattctccgcccatttttgtaactccgcgaactcagcgaacaacgcacggcactcttcgccacattatttttattaatgatatttctgtgccgaaaactttctctcagattttgtctcccattttccaacactccgcacactttttttcgccaatgtctgctgataagcaaaaaatttatttatttaatattttaaatacagttttagtgatgactctaggacaaataaatattttttgattttattttacattaaaacattttcataaatgcaaaaattgaattggaattacggcacgaatgaaaaagccttggcggttgattccccccccccccacccgccactttaactatgaaaatcgtatcgcttcgctacctgtgcaattgttccgaggtgaggaactgctcgagttcgtgccgtaccgccaccgcttcgtccgtcgggtcgtttgagttcggcgtggaagcggcggcgacggaactgaacagcgaattcaaagtgtccgggtcgaccacaagcgaaggcggcacattctgacgagccatttggaacagatgctcttgattcttggcaaagtgcgcaattgtgtactcgaccatgacagctgagaaaaggcacaaatgaaaaaagaaataaggaaacgaataaataataaatggcccacaattttattatgaatctaccactttttgatcgtgtgcttttgactaataatattttatgtttagttctttttcccacttatggattttgtgaagggagtccattaaattacattttgggtgttttaaaatacataatttaattttaattgtatatattattaaaggcaaacccatgtctgtatggattacttttggagctttcgaaaaaaacattattttgctacttttatgttttcataaatattttggcgattttttgaaaattttcattgaaaatgtaataaaactaaaacataagaaacgacagtttggaaatttcaaaattaaaaattatataataccaagattgtaaactaaaagaaattattcgaatttgataaatgaatctttttgctctggtgcatccgatagcttttaaaggatttgttttttaccgaacacaaatgccatgcacatgttcatccacgagtcaatggccttcatataggacacttcgggcagcgaaagtttcacagcgtttgcctggagaataaaaattgaaaatattttttttatttttaatactatttaattttattgaaatgtacaaaaataaaatgcacttgggtggcaattgtgagaagtgttgtgatggacagagaaacgcgtgccggtgccgaatcgatgtccaaccaaaaattgaacctaaaaaataatgaatggcacaaatgaaaaggtggcaagcatttggtgaccatgaaattatgacgatcagtgcggtcggcacatacgtttggattatatggtggagcatggcacgctcaacttaaaccaccaaatgccattttaacaatcacttttattggggtgcagctccaattctcttttgattctgtcctcaataatccatctcatttaaattcccgacttttttcggcctacccaacaattagcaattaattaaaaaataatcgtttaattaccgtaaaacactgcagtcatacaactccaaattcctttaaaatgatttgttttccatattttcttattgttccttccttaccctccacatatgttccgttacactcccccgtttcaattctgaccaaattcatgtcttaagaaaattttgtatataattcatttaaattttaattgtcactaattaccgggcattttaatgtccatattcctgtcaatcgctgggttaatccgtgtggaccatcgaaggcgcaagtgcgattcgggataagcatctgaaggagaaaaaagaaaagcgaatattttcaaattaaaatataaaaatatttaaaaaattattaaaatcgcacagcttaatattctcagctcacaaatttgtgaatcaagcggatatttccacaagtccatcatgcaaattgccaccagcgaaattcggcaatcgtaccaaaccctggcccaaggcattgtaaaacaaaatttgaaaattcgcccaccttccgctagggtaaatccaaaccataaaattgtcgtccgttatctcctggaatgatgcttgtttggcgtttgcaaaataaatgtccggatgccaaagtttctgttgtccaatatttcggcgataaaaagtcaaaaagattattggcctgctgtgctcaccttgaacacctgcttgtcccggataagcattgggcccgtcccgttgtgcttcaaccgttcgtctttccattcctgcaattattctaataatctttttctggaattatgaaagaattaaaaaaatttgcaattttaaagttttgaatttaatttaaaaatattaattctcttttttggttaagttaaatcctcaatggcaattaatgcctattccctcgacttctaatttttaccctcaaattactcattcctaccacagaataatccgaccccgtcggaattgcaaatcatttttcaataaatcttcaaatttggtaaagccaggcttctcatcttttccaatacatttgcactacctgatacatgtacatgtccaaatggtagtccatggtctgagcactgaaacttgaaatgccctcaataaacatcgacatggaaacattcgttgcaaatcctaagtttcatttaaataactggatatttaaattccaactttaaaaaagtctttacctttcccttgcgttggcgtggcatatttattataccttttctcatcgtctaacaatgcaacgaattctaaatttttaattggtcaattatttgtatttttaatttaattcaaatgaatttaccgcctgtcagcggcaccattttttcatttgccaaaacaatttgatgaaacaaaaggctgaagaacggaaacaaccgaaagaaggtgacgaaataggacattttaagaggatattattgtcgaaattataaaacaattaacaactanacttttanaacaatttatttaataataanatttttgataaaaagcaaaattaaaaaataatttgaaaatagcaaaaataaattcagt

SEQ ID NO: 13439 - DNA, 1053 bp, Heterodera glycines
agttgtatgaatctcaaaatttagaaaacatataaggcaaaaccgtaaccattttaagatttatttcactaagataccaaaagtgatgtttagaagattatttttcagcatttccataaattattttttgaaatttgacgatgacaaaaaagacttttttgtttaatttttaattctcataagtaatttcacaacgaaaccgtttgatagagatggttaatttgtgtttgtgtgtgctcaatgtgtgccaatggtggcatgacaaaatgccatggaattctcgccataattggggtgggggaagagagagtgcctttcccggaggcattggatgagcaaacaaagtccgacgatattattacgaccaaaataattttctcgacattattattttgtttatgattattatttgtgtgatgcctcgggcagcgcactgagctgcttctcatttttcattagtttggcccgccaatccgtcaccgatggatgacgacgattttcatttttcactgctttggccaatgctttagggaggggggggggaggcattttgtgccattttgtcccacgaatattgccttaacagtattaaattttgagaaaattttgtgacctaatgaaattaaattattttgtataattcaatccgcggaaaagcggtgaaagtacaaagaaaagctgagacaattattaattattggaattggaaaatgaaatgaacagcggcgggtgagaaaaacaataattggaaaaagacaatttacgagaaaattaaaaaatgaaacaaaatctgaaatcacattccatttaaaagaaaaacttaaaaaaagatgaattattatcatatccattggaaaatgttaagcttcgcaacaaacagagctataattatgcacaattctaagaaagatgacaattaattcttttgacaatgagtgtaattttggaatttcaattaaattatagacgttttttgacagattttagaatgaagacattttataaatgaataaaaaaagatgaaaaccaaaaaaaaacgaatgaaactcattt

SEQ ID NO: 13440 - DNA, 1637 bp, Heterodera glycines
  misc_feature (189)..(189): n is a, c, g, or t
ccccccccccccccctttctcattttacattttgcggttccgggggctttcttcatttttggctttttgtgttggtcacattcttttgttccggccggttttcagtgatttttactcttttttattaaaaaatcgaaattatccaaaaaaacaatttatattaaatttgcttatttatcatttttctcncactgaattttcaggctgcagggtggcaggacacgtcttataaaaatgcattttacaattacaaataatgaataattaaaaatggaattgacagccattttctcgcttttggtcctttttcaaaggcccaaaaacggaaaattattcaaaatttaaattattaaatgggaaattaggaaaattgatagagaagaaattcaaatgcaaattctcccaacccattaatgaagaagcagtttaaaacctcaaaataatatgtgtcatttgcataaattacctttttgtggaaacagttggccatgggaatgaaaaaggcaacgaatattttggacatggaaatttctgattaattaaatgaggaaatgaagagaattcttcttgtaaaaatgtttaaatcaaaataacaaaaaaatataaaaaaaattaaacaatctaaaaatagttgaacattggaaaattctttcatttttaaatgccctaattaagtaatttgtccttttttgatgagagtattttttaaaatcttttttggggtaataacaaaagatttcgagcggcgaaaaaagaattatgaaacaaaaaaatcgtaatttgtactatggcacacatgaacgatggactgaattgggttgggtcacgtcgagagtctcgacacttgaaaaacaattgaggaaggaaaagacagacttggaaaatgaatttttgcaaattaaaaaatgaaaatactcaaagaatttaaacgatcgaaagaatgtaaaataatgaaccgtcaaaaagggagcatcgctttagaaaaacaaagcgaagaaacgcagaaaaaacaaaaccattcgaacgaattattgagagattgctattttgaagttcgttagcttaaaaaagggctgaccttttacttccaggagcctataaaatagcgataagcactttagaaaatgagcaataaaatagagcataaattttttatttcagaatgcccctataaggtttgaaattcactccttataaatcagaaattcgcattctctgttaaaatttaagttctttttaaggggtgttactataattctagaaaaaggagcagtcacatgtctgatactgctgaaaagttaggccctggccgaaaaacaaagaaaatgtgtgccaagcttttaatgggtatttggctaaggtttgaacttatattccggttttaaaattcgggatttaggattaaaggtgagcaagcttgtcctgtacattagcgtgtatccttttcccatgcggtaaaatgaacgaatttgtaaagcaatatgacaatttaaataaaaacaattgaagggggtcggtcctggtcagtttcccaggcacagacttaaaatctcgtttcccgagatcattcggcctggtttcacgactcattgtaatagcatttttaacacatccatcccacaatcacttgatgcttt

SEQ ID NO: 13441 - DNA, 3882 bp, Heterodera glycines
ccgtcacaaataattaaaaataaattgtcaattactttttggtctaagtaggtcagttaatcgatggcatagcaatggggaggggatgtaaaggacaccatcactgggtgcaatgggaacgcgacgccatcgcacaaaacattgcctcccaagcttatagcttacaataataaacatctttttgtattgttcatttttcatttttatccgtaaagatttcccaactcgtgtatatatttattattcatggcggaccaaaatttaccggtcaatgaatgtaattttatttattattttcaacgatctaattttttttctcaaaagggcctcatcacacaaccccaacggaccaacaatatgttttgttctgtgaattaaacaattaaaaaatcatcattttgtctctcattttaatctattccctactctggctgaccttcctttgtgttggtcgtccagagtagggatccttattttctcacaatctttttaagttatggctgaccttttttcatattggttgtcctctcttattaagattgtttcattaatctcataataataataataattttataaaattcactggtatatgatgaaaacgttaggcagacaacaacaacaacgacggaggaaggcgggacgaaaatgggaatgcaagaggaggggaaaaagacggagggaggacaggacgaaccaaatgatggaggtgaaaatgatggaagaagagagaacggaagaggaggagcaaaacaacaacaatggaaagaggggagaaaaagagaaaatgaagggagataagatgaggaggacgagggaagaggcgaagaagaaacacaagagaaggaagagacaaataggtagaaggaagagaactgagagaaccattgaaaagaggcgaaaaaaagaaggaagaaggggagagaaaggaggaggaaaagaaacaaatagagggaggcgaagcgaaaatggaagaaaagccaaagaaggacgaggaggaggagcaggcgagaagaaacaaccgctgcccgggtcaaaaatggttcaacatttaacaattatttttatttactcaatgtgtattggccatcggaagtcaatcctttatgagtattggctaccgaagggccgggtccgtgggagtgttggtcgccggagggccgagtccttgggagtattggctactggagggccgagctcttcggagtattggatgccagtgggccgagctcttggggtttttggctaccggaggaccgaactcttagggatgctggctattggtgagccgagctcatagaggttttgatttccgaagggccgaactttgggttttgtgcgaattgtcaagggaatatgaccaaaaaaatttcttttaggataatggatcaaaataatataacaaaaagaaaagaaggaaatgttggagatttttgggaggggggaggtgtgcaaaacacatccacgctcatacattattattccaattatttaaaaatggaccctcccctttccacatctgctctacacttcaaaattaaaatgtttattggtagtcaaaattatccaaatgcgaaaaatttggtgtattattcggtggttttcggcttcttcttttgatcagcaatcatatcactgacacagcaattgattctggcacattcttcacacatctcgagtccaatcgccactcgcccgtcttccagccggcgtgccttgtctttgttgtgaaataaattgttccagtcctctgaaagctgtcaattaatttggtcgtcaaaaatttgattaacctgagcacagccgaatcgcaagcacaaattggccccgcgtgattttccaaagaaatcgctcatcaacgtgtggcttcttagctttcacttgttgctcctccgcagtttcgggttgtacaaattgttctgccatttgaggatgattttgcaagaatgatttgattgtgcgagaaaatctctgcttaaatagctttcaaaagtgggcgtggcctaattttctgggagtataaaagccccggcaatttgtcagctatgtctcatttgttctgctacaatggtccttgtcatcgaattttgtgcccaaattctcggctgttcccctaaatcactccgcgacaagctcaatcatcccgaggaccgagtgaaggcattgaaggagctggtcggaaaaaaggttcagacgacatacaaggaccggaatgggatgcagaaaacattttttgtcgacggaatatcggaccatggagcggctttgaccccagcatacggcagacttcgacaaccgtacaacattaacattgctgcccatttctacgctcgccaccgaatcaagctgcatctcccatacgtgccatgtgttgtggaaaaatacaccggttgtggcgaagacagatactatccaatggaactactcgaaattgtggatgacgactacaccaacaaagagcgatggcttggcaaattgtttaccgaaattgaggacgatttcattcctgtcaaacgccttggtcgagttgacgaagtcgaagaaattgacgacaatgatggtggtggtcgctacgaatgcagtcaaccgtcttacgtttattggtaaacacatgtatgttaccttaataatgcacttttctacctaaaaacgacaaattcgtttttaagtttatacaaattgtatcttccactccttaataatttacaaattgtgtcttctttctcttaattctgcacttttctacctaaaaatgacattcccaaatgcttaataatttacaaattgtaacttccattgcttaattctgcatgcatgttcactccttaattatgcacttttctacctaaaaacgacaagttcgtgcacataataaaattgtatcttccactccttaataatttacaaattgtgttttctttctcttaattctgcacttttctacctaaaaatgacgttcccaattgcttaataattttcaaattgtaaattccattgcttaattctgcatgcatgttcactccttaattatgcacttttctacctaaaaacgacaagttcgtgcacataataaaattgtatcttccactccttaataatttacaaattgtgttttctttctcttaattctgcacttttctacctaaaaatgacgttcccaattgcttaataattttcaaattgtaaattccattgcttaattctgcatgcatgttcactccttaattatgcacttttctacctaaaaacgacaagttcgtgcacataataaaattgtatcttccactccttaataatttacaaattgtgtcttctttctcttaattctgcacttttctacctaaaaatgacattcccaaatgcttaataatttacaaattgtaacttccattgcttaattatgcatgtatttttattaaaaacgcaaataaaatgacaaaattacacaatttttggtataaaacatgaaaaacaaaggtggtacatgcgtgtgtacgtgtgtatggggtgtgtatggggtatgtgtgtgtgtgtgatacaatgaatgataaacgataaatttacaaaatgtgtccaaaattgagaacatcataattagggcccactatccctttgcctacgtatgggcgataacatttttggagggggcctgaagtgacgtgtccgccacccttaatgtccggtctcaaaaagttggggtacatcacatttattggctcatactctccggtttgggcatatcgcaacacttcttctttgaatgtgtcgtagcatagggattggttctgcatcacgtcgtagttcagtgtgatgcccctcagcttcagtacaaattcgtcctatccattacgccggagtttgagtccatactgaaatgataaa

SEQ ID NO: 13442 - DNA, 1323 bp, Heterodera glycines
tttattaaattcaaaaaaaaagagcggcaagagataatttaatttaattggaaacaaaatttaagcaaaaaaacgaattttatagcaatttatgaaaaggaccaattgagaaaattataaattccaagtgaatggaaggagtcaaaaataataaattttggaaattaattttaacactttgataagaatttgagaacggagaaaattgcatacatagataaatatttggctaaatggaatttggttgatttttgaaaagctactctggcggccaccttcacataacccataacaccaattttattcaccatctgtcgtcagcctgaagagtttctcagtgtcctgactgagtaaagctaagtgtttagtgtgttcgataattgccaaatattgcaaagtggcacaaatagatttagtttaagcataaatatgatttttttttttaaattcaaccttaatgcttcaacaagtatattgatataaaatcattggaaaattagatttttgattttttcactttttgtgaagcgcccaaatttgcacttttgtgaagtgacctagcaccttatcaaacattttcagtacggtttgtggaggtaacggtaatttgaaaaattagaatacaataattacctattcggcatgcgcaatgcgcatgtctatcgtgactcccaaacgtttaattttgtattgcttatttcattgcaaaaatgaaatttagctgggcatcgtaaaaatttcgaaaagtcacgcaatatttcagtaccaaatttccaattaaataataaaacaaaaaaatgtaacaatggaaaaaattgtgtataaatgtcaccgtgtcacacacacacacacacatcattggtaagtagccaatttcaaatgtaacgaaaatttcacaaattttcgcaaaatttagacaaaaaatggcctcaattaacaccagctctgacgcccaggtaaaagaaaattaattttttttttctattaattttaaaatatttataatttacaattaggaaatttatgcctattcacaatgtgaaattttaaagataaatcttccaacaaaacccagattgaattgaattgatatttttattataaaatggttttctcaaaccatacgcttatttttcgatttttgtgcttactttgcttttctgtgtttgatttctatggttaattaacgaattttatgtcattcataatacaacaacaattattaactaatttaattaaaaaggtatttaaattaattaagatttatttgggcttccgttttcgcggtccgtccgccgatttgattgtgccgccgttgcgctg

SEQ ID NO: 13443 - DNA, 1503 bp, Heterodera glycines
tcggcgccgcaagtgtcactttgggtgggcgccgcaaatgtcggcgccgcaattgtcattttggctgggcgccgcaagtgtcggcgccgcaattgtcattttggctgggcgccgcaagtgtcggcgccgcaaaagtcgagccgcaagtgtcggcgccgcaagtgtcactttgggtgggagccacaaaattcggcgccgcaagtgtcactttgggtgggagccacaaaattcggcgccgcaagtgtcactttgggtgggagccacaaaattcggcgccgcaagtgtcactttgggtgggcgccgcaaatgtcggcgccgcaattgtcattttggctgggcgccgcaagtgtcggcgccgcaaaagtcgagccgcaagtgtcggcgccgcaagtgtcactttgggtgggcgccgcaaatgtcgggccgcaagtgtcggcgccgcaaatgtctgcgccgcaaatgtcggccaatcacgacaccaatcccattctttttttacaactgattcccgggttttcccgcgggaatcccgttcccgccgggctctacttaaattcaacacatttaaattgcaccttttctggccttaagttgaagattgaatgtttcgtggcaccgacaggagcactaaacctcttatgtgcccaaggattcgcgtctttgaattggcatttcaacatcacatcctgttgccacatgacacgtcacattttccaaccgtaactagcattcatggctacggtatcatccacagagctggccaacaaactgagacgaaaatttcctgaaatatgcagcactgaactaagtcactgtacaaagatgatggcacttctgtacgcgaagccggaagccaagctcgtgtttaacccaacaaattggtcggtttgaatacgcatcgcgtattgttccaattttcgaaccaaatttggctccccattacactccccgtaaaaatgccataaaaatgaaaattctgtaaatatagacatttgaacaacatataatattttaaaccaattaatataaaaatgcactaaaatatgtaattaaatcaatgctataatattaaagaattcaaaatgaatttgcatgtcgacaaaaatttatttgatggggtgtaatggaattatgttcggtttgactttgattgtaccaatgggttgaacagctaaaaatagtgaaaattaattaattctaaagcattaaaattattgaaaaaataaaaatattcaaaatatttttaccattctttttaaagaaacgatctttcactgcacgcaattccttcctaaacaattggcgatattctgtgcttaaaaaatattttaatgaaaagttttaaaaagaaaaaaataaattttttaaattaaattaaatcagcaaattaaatattttaataaattaaatttggacctgtttaaaaaaagaataatagcatttgatccggcaacaacatttaaaaaagtgtaagcacaaaaagtaaattgccaaactccaatt

SEQ ID NO: 13444 - DNA, 1036 bp, Heterodera glycines
cttgcatgtttttacaataaaattttaatgaataataattaccagcatttaatccaattatgaaccgtccgatcacaaataaccaataaatgttgacatatttggcggctgtcagcaaactgaccccaataaatgccaacaaattgttgtacagaagggcttgtttccgaccaaagcgatcagctaaccgaccaacaaagatggcaccaaacataccgccaacggcaaaaatgcccacagcaattgccctaattaaccaaaattatgcgtattaagaaataatagagcataaaaattctttaggtttgtaataattattttttattaactatttaaatattattataaatttattttaatgtccattcaacccaaaaaatacgcctttttaaacaaaattagttttgctataaaaaaaatcatgcgaaccatatcagttccgtttcctcagcagcaattggaactccatacaacttttcatgtgattcaatgaaccaattccgtattaaatcagctaataaattttaaaaaataaatataccatttagtgttattcgaaaccaacgatttcccaagacagaccaaaaacccgagaatttttttgaaaattgagactagagaccgagtccttaaaaccagagaattttttttgaaactgttactagagatcgagaccaaaaaagctaagagttttctcaagaccgaaacttttaagcagcaataatagggaaatagttataaaaaacaaatcatatataaattaaataaaaaatgacctggtaaattaatgcatccgcaatggtacccaaactgaaaagaacttccaacggtacaagacaaaatttcaaaaattggcgttctttctgtcgatttctgataaaaaaaatagtttttatttttaatttaatttattttttctaaccacttgtttctcgtcagaagttttttcaagcaaattctccagctgttgttcatcaaccgaaattgaaacgttttcccttattttctttggcaaacattttttgtaaatattttt

SEQ ID NO: 13445 - DNA, 1605 bp, Heterodera glycines
caaataatggaaaaggtgagcaaatttttgttaacaaaaaaagttgttttagcttatcaaaaaaatgcatttgataaaatttgtgtataaatcttaacaagtaaatttttttattattttcatattcgtaaaatattaatagttaatcctttaattatttaaattttttattactttttcatattcgtaaagtagattttttattaaatttgttttataaaaaaattaaacgagtcgataaaacaccatttttacattttttttttgaaataaaatcaaaaaaccgattgaaaacatgtgaatgcgcctattttcattgtttgaagtatccaaattaatatttttccattaatattacttttttaatattcacaaagtaggttttttaaataaatttgctaagaaaaaaaaatcaatgagtcacaaaaaatattaaaaatttttttttttgcttttaaggcctgtaaagccaacaaattctcattttacgataatcttattgggagtgttaaaaatgattattgctaatttgacatttcttatcacagtcatttggacccactccttcccaaccgtttttagcggcaaaagtgacgccaaaaaatggtaaaattaaaaaaataataatttataaatctaatttttttttatattttatgtcgattgacacggtacatgccctcaattttgtgcatcgtcaggaagaaaatagccgaaaatcaaatagaattgatgaagaaaatcaaatttcatcaattataaatcagagtaaccctgatcccaagcattacaatcttggtagtgatcagggtactcttggcattcattttttgattttttatcttttaatttttaattttaggaaatttgcgcaaattcatccttcaatttaatgataaaatttcaacgcaaaatgaaaaactgatggaggccaaaaagatagccaaagatgaacaaaataaaatgcacgaaagatttttggtatgtaaatttaaaataataaaaattcttaaatttagtaaatttagaaaaaagaaatcagaagcattcagttagaccatccatttcaaaagtacaacataatcacaatggtattacgtgcacaaaacataacaattggacgttattttcttgcaaattttctcaatggaggaaatcaacagcaattgggaattgtaaaaattttatttaaaaatttacttatatttttaaatgaagtatgaaatacaaaaatccaaatcagtcccaaattagaggtaaatagcatgcgaagtaattatttgtcatttatcaaatacgcagtaattaggcgaccttagtccctattcttcaatttgaatgacgctcagaaaaggaattttcgcacatttgctaaatttgcgtttaatttattccaagcatcaattgccgttttgtttgttcattttgacactcgccttttatgaaataaattattttcaccaaagttttaggtggatttgttgatgaattttctgatatttacaaattaatttaattgattttgggttttaaaaattatttttgtagattgtccgtgaattgcaattgaaaaataaagtgttggaccatgttcgttatacagaa

SEQ ID NO: 13446 - DNA, 975 bp, Heterodera glycines
atagcacactcttttgaaaacccgaaaaatgataaattttgcagatttatttttggttttaaaaattcaaagaatttctcatcgtcaaaaaatgttgaaaatttaaaaaaatttataggtctttttttctaaaaatccttagggtttgttaaaaaaattataatttttgggtaatgaattgtaccagcccttctccctttttctcattcctcccatcgttccgggttcggcacccacccggtgctggtccattttcccccttctttttccttactttttttggctgacgtcgcgtcggctgctttttgcatcgccactttcgttttgaacctggcgaacagtttgtccacctcgtcgctaatgtggcgttgaatgcgcgggaaggaccataaaaatagaaattttcgaaaaatcaggattttttttcaagatttctaaagaataccgaacccccaaaaatgcatttttcctcaaaaatagaaaattttcacgaattttataaaatcctcgcccctatttttgtacctgtctccgggtgtatcggcgaaagcttccgccggcggtgaattcgacgcgtccgtccgccaaaagacggaaggaattgtctccgacgaggtggaacaggtcgacgaagaagtcggcccacaatggacagtcttcgatcaagcaatagcgatcacgacggttgacaagaattggtcggacaaattggcactgaaaaaacaatggggaaagattttggaaaaattcgatgggaaatcaaaaaaagagagaggaattttgaaaattttcaaaaaaacaaagccgtaaggcgtttataaatattggcttttaattttcaaatttttcttgccatacgtggggccattcaaaagccgaatgggtcggacaattttttggccaccatttttccgaaaaattttttttaatttttttttcaaatttaaaaccaaaaaaaaaccccccaaattataa

SEQ ID NO: 13447 - DNA, 2695 bp, Heterodera glycines
cattttcccccttctttttccttactttttttggctcatatagcgtcggctgctttttgcatcgccactttcgttttcatcttggcgaacagtttgtccacctcgtcgttaatgtggcgttgaatgcgcgggaaggaccataaaaaatagatcattttcgaaaaatcagaattttttttcaagatttctaaagaataccgaacccccaaaaatgcattcttcctcaaaaatatagaaatttttcccgaattttataaaatcctcgcccctatttttgtacctgtctccgggtgtatcggcgaaagcgttccgccggcggtgaattcgacgcgtccgtccgccaaaagacggaaggaattgtctccgacgaggtggaacaggtcgacgaagaagtcggccaacaatggacagtcttcgatcagcaaatagcgatcacgacggttgacaaagtattggtcggacaaattggcactgaaaaaacaatggggagattttggaaaaattcgatggaaaatcaaaaaaaagagagaggaattttggcaaattttcaaaaaaccaaagcgttaggtcgtttcataaatattgtctttgaaattttcagacttttcttgccatacgtggtgtcattcgaaagcctaatgggtcgggactattttttggtcacccatttttcggaaaattcttttctaattttttttcgaatttaagaccaacaaaaaaaccacccgaattataagttggagaatacatatgtattactggatagcgcaggtcgatttcgactttgaattttttatagcgaggtgtaaagtaaaactaaaaagttatggggcctcaaaaattttaaattttcccttgtgttttcccgttggactcgaaaaaacctcgtaaaccacagaaaaacttgaaaacaaaaaatttatgaaattaattttttaaaccaaaactaaactttaggaaactcggaggtgccatttccgaatttgccgtcagaaatttggaataaaatctttgatttttaacttttctttttagggggtgtaaaaaatataacacaacccaaaaatagggcaaaaacgaacccggtgatgagcacagagttgtcgaagacgaagaatttcatgtgctgtaaccccacaatttcgttggtccgttcgggcaacgcacttttgaggaggccgcgcaatttgggcgtatgaaagagacggacctgagaaatgtcgaaaaaataatttccaacgataaaaatgtgagcgttttgaaattttatgaaatttttcaactttttttgatgcaatttcgtagcccaaaaacgcaactatcatccccaaagaatgcactgaatgtcaatacaaaaaagaagcaattttgttagagcaaaacttgaaaattcgcggagttaaggcataaaaactaatgaatgctaaaagcattgaggaatttttgattaaaaccaaaaaaaactcacattttttcaaccccttctgctgatagtatttaaagcagtttattccattagggattgaaaaaaacttaagtttgaacccgtttttgggtcataggcgcaaatgtcgggtaacagggtgaaatgtagtgaaccccctggtccttggtggtcgtttatattttttgcttttcactctacttttatgcggagcgttcaaaaaaaattcagcaaatttttcaaaaaaaggaaaagggggggggggagggtagcaaatgaaaatttacacacctccacattgtcgtagatgcacagcggtgccagcattgtcgtggacgatttgccgtcggcggttgcgccgcgtgtggcacggaaaaagtcgagcaaaatgcgaactttgacggggcgtttggtcgccacagtttttgccgcgaccgccaaccgatggaccaatcgctgctccaacgcgtcggtgcccaaatagagggcggacagcacaacgcgacgctttgcggactcaacgcgttgctgaaaaagcgggggaattttaaaagcaaatagaaaaatcatgggccaaatctccgaattatggctggttgggaattaaaaacaataaaaaatgaccagaaaaattttcttagatatatgaattaatatttttttagtgtttctgcacatagacgcaaatgtcggggctccgtaaatactattaaattttttttggaaaatcctaattttgaatttctataaattttgttatttaaaattttagaggattggaggggcatccattgcaaaatttgcaaatgtttccaaggctttaacggggtcgctgattaacatcccgacatccatttgaccaattctgaatccaggacccgaattcgaacaaaaagtcgaaaattaaaatctttcgagattcacatgggggggggggaagaaaacgaaatgagaaaatcacgaaattggatttgatgaaaccaaaattaaaaaacatttgcaaatacatcggaaaaacggaccagtaatgtgttgtaaaaatggccgggcgaacgcaaaaaatggacggacgacgaatggacggggaaacaaaggttggaatcatcacaattgaacaatgaagaaaacaatggagaggaggaggaggaggaagacattttgaacttctactgatgggacactaccggcaaaggtgtagaattgacagaaaataaacttaaaaattttatttttgtttttcctgggatgaaa

SEQ ID NO: 13448 - DNA, 3459 bp, Heterodera glycines
agagaaagaaagagaaagaaagaaagaaagagaaagaacgaaagaaagaaagttattcgtttattccgcctaagggcattcgaaagatttcttaacgggagagaaactcattcattccggcatatttattggtcgaaggacaaaatcagctttaaggaaatagaaaattgtaatttaaaagtaattaaagcatcccaatttatacaattagcagtttttctttgagagacaaatgtcgcattttgaatcaattgaattaaagcacacaccttctttttcattaccattttaaattataaattcgcttctttttctctcaatttcttttctcggctatgtcgacgtcaggcgcccaaatttctattcgatgcgatgctcaggaattgctcatgggaatgttgccggaagggatcgaaaataatttggcttattcgtctgacgagaacggaatgccaaattcggtttcagaataaaaattataaaagagcacggcctcgaagtgatattgctctgtcactttaggttcgtacagcgcaaagaccggtggtcgtaatggtggcgccggaaaagcaaaaaaacggagaagagacaaaagttgggagagaaaaggacgagcaaaagcagcagaagcaaaagcaaatctgtggggagataaggcaaaagctgaagttggaagaacagtgaaaagagagcgaaacgatgggaggagagaagggaccgaagcggagggaaatgccgacgaggaaaagcaacttcttggacccggaaacagacagacttttggcaaacactctctgaacttagaattctgatgagaacgcggaaaacatctcatcgattaaaattcgatttcaaatgatagcccattagcggaaattattaattttaaatcaaatgtatagtttaatccaataaaagaaagtacttgtgacggagtcatttgtcagtttttgcgttgtttgttcagtgttaagattcattgtccatctgtattttatatatttagggcacagcggcccaattttgggctctcagtgcaaataggtttattatttatttagtaatcagaacgccaaaactttgcaaaacttaaaatttttttggaattttcccttgtaaaaatagaagagccgatctcgagttaaaaactagacagctaaaaaataaactgtgattcgatagagggggacaaaatatgggcctatacaaaatttcaaaaaaagttacccacaggaaaaaattttttcccatggcaaacagttcaatactttaattcttttttagccaagtgcgcaatttaaggccaaatcaaataaaactaacaatattctctagaattttcccttcaaaatgagcataaaatggttttatttgatctagtattgacaaagttataggctaaaaaatttcataaaaattatcgatgctgtacgtaactaactcattgaaaataatttttttttgacacgaaaacttttattaataaaaaatatttctgccttctttaaaagaagaaattgaaattaacacacaacatagggaggacttgaacctgggaccccccttttggtgactaactcacagaccactaagacgacaaatccagcataattgtacttggagcccaaaattgggccgctgtgtaggggcaaacgaatataatggcccattgtcctccgcttgatgagtctcaattagtaaattaggggggggggaagcctttgaggatgtgccgaaataaaataaaaggaaacaaagacgcggtagggaaaaggggcaccataaagggacaaagacacgacggacggtggaagaacaacgaacaatgggggtgattctcatttaatatgattgtttaaaagcatatgttcttgataaagtgccgatggtcccccaaaaaattgtcttcgacgtccccagtctctctgctcgtgaatatgattctttctgactaaattcgaacccttaaccataaaaagaatcttggttttttgttcgagtacaatatgttttataaatttgtcggactgaatggctaattcgtgactactatttcaaaaaaggggggctaccatcgactgtattaccatcatttttacccaatcgccaaaggcaatccctttcttccacagcaatgatgcattcatagaaatatcttgatatttattcagacaaattggataaaaagattaacgataaaaaggctattccgatggtggaaaaggaaaaaaatgtgtaaaataaaagaacaattcgaaatgttgtaaccaacatttttaaaataaaaaatttagttgaatttgatacgaaaggataagaaaaggtggttcatttcagttgtggagaaaggaaagaattcggtcacatttatagcaatgcgagttgtaaaaaaagcacgaacatacacaaaagaatgggatgctaagaaaattaggaaggactagcatcaacagacgaaattccccaaagctcagaaaataaacgaacgctcccatccaaaagaaaacccccgaggggaatttcgtcaccaaagaaagtcaatagactcattcacaaagtcgttctattcacagaacagagagagaggaaatgacaaaatcgtatggaagatggattaaagtcattcatcccttaaaaaagcgtttatgccatttatttgaaaagtgtcgacaccacggacgacggccctacagctccgcaacgtctttgacggacgatggatttcttaggagttggcatttcctcaggaaacagaaacagggaacggcgtcttcgactgtgcggcgagtaatccgcgatagaaccgacgtcgtttgagtcatcgcaaagatcggcttttttggcgtgaaccgacgaatgttttcgcgttgataaaaaatctgaaaatgaaataacgggttacctaataaaatggtttacttttaacataattaccaatttctattttaatatctctgtttcctcaccagtaactcgtgtctgtcccaattcgcttcgtcgtcttttcggcgtttgaatgctcttctgttgaagttttctcaagactgcgccacctttctctgtcctctttttgttacgggggcagtgaccagcttccgacccaaattctttcccttcgattagcatcggctcttcctccacaaaagcagagtgatgattctcggtgtcgctgttgcttgacgacaaattcaatggtgagagtgcgttcgaagcgcggtagaagccggggactgagttggcaggcacagcttcgaattcaaatcggctgtcagcactttccagcggacgttcagtttcaaagtcgaagccccacttgcatttgtaacgttcggaaagctcattgagaagtcgctggacaaattgctaaataggcaaaggtaaacatatccattttgcatttccatgccaattcttacttcattggtttcctcatctggcaaatcttcttgaaacagtcgt

SEQ ID NO: 13449 - DNA, 2219 bp, Heterodera glycines
tttgtccctcattttcttcctccacttttttcaccattctttcctcccccactccattcgtctgtcccataattccatccaaaatgccctttcatccaccaattcctcccttaaagactttattccaccaacgccccggtgaaaactgtgccaatgtcgcttcttctgccgtggttcggtctttctcgccagtgtggtcagttgcgtcttttgctcagctgtcgaagtttctttttagcaaattggtggccgaattcgtcggcactttgctcttcgttttcattggtcggtcttttgtcttcgtttcgccattctttcctttgtcccgttttaggcattctttccgccgtctcttcccaacattcggacagtgtccccgtgctcagtgtcgcttttggccatggtcttgccattttcgtcgtcatttcctcgttgggtcatgtcaggtgccctcttcgcccctttgttttttgctgttagccttccctcaatttccagcggcgcccattttaaccccgcggtttcgcttggcattgccctctccggcaaaatgcgccctttcctcgtccctttttattggttcgctcaactcagcggcggattttgcgccgcttttctcgtctctgttggtggacatcttcggctacatcctttgataaattattccttcagattgttaccaccaaaaaccaattccaatcggtcgccggtggcgccaccattgtgccctcgggcaccaatttgtggcaggtgagccgaagggaaaaagagagagggccatcgggtcttttgacactgtctcttccttcccccaggcactttgtgccgaggcattgctcaccgcactgctcgtcctctgtgtgctttgttgtgcaattgatgcaccagcacaaaatgctctgtttgccccgctggccattggaatgtccatttcagcggcaattctcggcgggtaggcatcatgaataaaaaaacgccaccaaaaccctcccgggcctagcgcctcaattagcggcgcctcactgaacccggcccgttcctttgggccatgtttggccgcttcgctgttcattgacgaggtaaggcaatgccaactctcctcttcaccgtccggttgtttaatgttctctgtttcccttagggcgccggttccattggcacaaaactcaccgacccaatttggtcccttcactttgtctattgggtcggcccctttattggcgctgcactctccgcctttctctacaggttttattctctcatgtcagccggccattcactaacaatggcttggcattttccttaggattttcttcgccagaggggataatcgtcttctcaaccgatgacaacgaaaaacttaacaaaaacagaaaaacccaaagaacgcttatttttgatcatacatataatagccaggtcacaaatccaaaatccggacaattgataaatcttttaaaaactcgtaaaaacagataaaatcctccatccaccttatgtattattgtattccgattgcactttttgtttatgtgttttgatcattcaaatttaaacttaaaaacgaacgacgaataaataatgaggtgagaataaagacgaaaataagcccaaagtgttgggattggtacagaaatacgactgatcaaaagaggaggaaaagcggggagagggggggggggtgctaattaaagtaattaaactgaaatgtgagataatatttcaatcattccgcccccttcccccgcccgattccagccgatcggtctcaaattttgcgatttcccccattttgggccacccccgagccgatcaagtccgcgcttctcgggcaatttcgataaatgaatttgtgcccatttggagacaatccctcgctttatttgttgggcggtaaggagaacatcggcaaggggtcgactgaagtctgaagggcaaaggaatataccaaaggaattgtaaaacccaaaatgaaaagagaaattacttttaaaatagaagtgctcttattgaaaacggaaccccgacatttgagcctatgtctaaattctgactcaaagctgaattttttgaagccttaccctacgtttagcagatgaggagggtaccgcaaaagataaaagatggaactgcctcgccatattgtgcgtcaaaattactcgtcctcaacttttcccttactcgacataatcctgcagaattttaacatataatttctc

SEQ ID NO: 13450 - DNA, 1502 bp, Heterodera glycines
aaaaagaaaattataaaatgtatatcggaaaacgacttaagtcatccggggaggtactcgagaaggagcagggggaggggaaattggacagggaaaatggacaccaaatttatattatttttaaaataatattgcaaaaactctatttttgtagtatctgattttagatgtgtgggggagggaaggggagttgggctgcatcacgacatagacaaacccttggcttcggaggatccccgagcaacgacttttttttttggcggcgtctaccgcaagttttttttactcctcggcagggctgatttttgtgctttgatgacgttctttccaaaaataaattctcaagaggaagtctcgagaaaattgctggggaaattattgaaaacccaatgcttttttggatggttaaaatgagaggggaatacaacccatgcacctcctcctgataacccgtcctcctcccccactccattacctcctggcaactcgcgcttccaaagccgcgttcaggtaaaatgccacccgtcccttttggccaagcaaagatgacactccactgcctttcagcgccgactgcgacagtccgttcctaccgatactcaaacgattctgaaaattactaaatgttgattgcgagaagggcatgttttcaatttttgtgacaattcccccattaactgtacgatttttcccaatcgcccatttacaggagcagaagaagcgattgaggaacgaacatcggttgaaccgtcgagatcgaaaatgtcttaacgggcgttgggtaaaaacaaaagcaacactaattatgaatgtcaccaaattcgtgggtcgtcttcagtccgcccattttcttccaattctgccaacaatctccgcacagacttaaacaaccattggaaatgagtaaagttaaaaccaaacgaaccgaaagtgcaaatgcgtcggtccccattggtaccaatggtcagattcttcattctgaaaacgtaatgcaaatcgaaccaataaaaagcaaggaaacaccaaaagtgccgaccttgcaactctcacaagggtttttcgtcggttgggcgttggccgcgcccagcaaatggacgctgggcttgttgtaggtggggatgtacacctgcttcagcttgttttctgtcgtgggagtgtgcatttgtccgatggttctctcactgtccatttctttgcccacctttttccgtgtgttttgtctttttcaattcggcgtatcgtgacgaagtcttccacatgtaataatactcaacaatgtcccgcattgacttccatggaagctgaacagaggcattttatctgaggggagaacgcccaactgacacagtccagtctgatgtcgtggaaatccttcccatacttctcgatggcgtcctcgaacagcgtcgattccgccgccgaccattcctccagctgatccctgcacagaatcggacccccaaggctcaccttagccaaacgaatttgcaagtgaccaaaaa

SEQ ID NO: 13451 - DNA, 2535 bp, Heterodera glycines
ttaaaaactgattaaaaaacttcataaataaacacccataaattctttaaaatgatacattatgagaatgattattgatctaatttatttgatgaataatttataattatttaaatatatttactatttaattaatgaagtaagtttttttaattttatgctgatgaaaataattttttataattatttaaattataacttatttttcaattaatctatttttgttcctattcaaataataacgcaaatattttgttttatttatttccacttcttgcgctcagctgtttaatatctttcaacagttgcactcaattgctttattttttgtgttattttgatttataatttttctattcattttcattatttgagcattagtgctttttaggattgagaataataatataagaattatttattaaattgaaagttttcatttgaatttaattttgttgacaaagaacccacaattaattcaatcagtttggcgttttttgtatttaatttttgtttgtgctattttactttagttaattatagactttttaaaataattttccattttaaatattaaaaaactaatgaataaataattacttttttctgtgatttctattcctttaaaattttctcttcataatataaattttattcgcatttgaaaaaacgaaaaggagaatgattaagattcatttatagaaatttgataaataatttaatatgattgagttgaaaatctgaataagtttcaaatccttcgatttataataatatttcatcgaaaatatcaatcgaactaattagttcagttatgcttatttaatgatcctcattgcagcttaatattattcatgtatgaaagataattttacactcaatataaattttttaataaatttcatattaattttagttaggcattatttttgcttaatctattttcgatttttaaatttatattaaatttattatttgtaatttttattgcggtttaattaatacaataatatttttatttggaacaatatttatggtaataaaatattttttctatggtaataaaataatattatttttaacaaatattattattaaaacacgcatgatttatcaaattttgtacaacttttattagttttcgattacaaaaattttgtcaattgtttttatttttattttggacttaatgaataagctaagttttttatctgtctattgaaatcgtttttcccactcaccagaattcgtatctacgttacatagttacgacattaaatacctatttttgcttttttccaggtaaaaatttgtttcaattaataatttaacaattagtatctgcgcttataattgaaaataaatttttgagggctaattatttatttaacaacctcattttcggtaaaaagcctcatttttacaaatttgttcaaaacacttaaaatgggtgatgcgacatttgcggcgatgagacttgcggcgttacatttgcggcgcccagtcaaaatgacgacatttgaggcgccgacacttgcggcgcccccataattaatgctaaaaaattaaatctcaaacaccctattgttttccttatgaccataataaattctttccaaaagtaataaataaccaacaattaaatatttcagcggggctttatgcttttgaattttgccgattttataaatttttaaggctgggcaccaacgggattcgtaaggtagaagttagctgaacgcggaaagcggcggtaagaggcggatttgcctcagaaaaacaatggccaattttccaaagaactggatttccaccactggttaacattttgcctatttctttattgaaacggaggaaagcatggaataaaataaacttttttggtccggggtcattaattctgcgccgcaaatgtctgccaatgttaaatgttcatgttatatttttttgattataaatgatcaatttaagcaaacttttgttagaaaaaaacattttgtcaaattctgagcatgaaaagtcgaagttgatttttttgcggcgcgttttttccaaaacttttggagaacaagagtggcccggcggtgccgataggcgctgccgggggaaaattatttagcagattttcattaaaaaatactaattttgtggattttgggaaaaaaacttttatgcaatttaacaaaataatcataaaatttataagattctgacgattttccccaaaagcctcaaaattactcaaaaagccatataatcctcataataggttattaattttgtgttaaatattataattatttaaaaaaagaagaatttgattatttatattattattaataatcaaaaatattgttttgaatttaacattttaattaattaattctctcgatgaatgtgtcttttggcttggcatccatgtccacttttttggttaaataaaaatattgtaaattttctgaatattataatatttttttctacatataatttaatgtttaacaaaattaaatatacttttttatatttttctga

SEQ ID NO: 13452 - DNA, 811 bp, Heterodera glycines
  misc_feature (58)..(58): n is a, c, g, or t
  misc_feature (786)..(786): n is a, c, g, or t
  misc_feature (799)..(799): n is a, c, g, or t
gccacataatccatcagaagtaccgagaaagggaggcgatataaggaaatattgtatnaatctgacttgccatttccaatttaaaaattatttaggaaaacaattttttaaaatttaaataaagaacaatttctatataatagacagacaaaacctagaaacaatgttcgacggtacctatagacaccaccgctcatcccccttctgttccttaaaagtttttttgaaaaagatagccgcaaaaaatggtagtcaaattcgatgttgagatcgcaaaaaattcggttaaacctcctccccctttccatgtatttttaaaccagggcttccatcgaaaatttttaaaaatataaacagaacaccaaggccgaaaaacaagagtttagggttaaaaataagaacattttgcaaaattttttcaaatcagttatttttacaattatttgatcaaaatgctatcaaattttatatttttaatgatttttatagaaaattttttatatttttaaatattttttggtaaatgaatttcttcttttattgttttttgtaagtttctctcggctttttccaattagcaacgactttattgataatttttttaaattcacttattttatctctggcttaaataaatcttttttttcaattattaattaaaatctaaatttttaatattttggtttctttttattcgctaaaaattttaaacagaaattgaaattgctgttcataataatgatatggtgtaataatgatttgatttagcattattgaattttcaanttatattttcaanttatattattct

SEQ ID NO: 13453 - DNA, 3988 bp, Heterodera glycines
  misc_feature (21)..(21): n is a, c, g, or t
  misc_feature (3930)..(3930): n is a, c, g, or t
  misc_feature (3938)..(3938): n is a, c, g, or t
  misc_feature (3951)..(3951): n is a, c, g, or t
tccaatccaaaaatgttcttncatcggtcgaaaacgaagaaaatgggcaaaagcggcgtcgcatggggaagcggacgctttgcggcgcggttccgtgcgtcggcatttccccgtgccgctggtgcgcttcgctttgctcttcgtcggctttgtctgcaccgtttccgctccgttcgctgaccacggcagtgtccccagggcacgcggcgccgtcgcccgccccggcaaaaaattgcaattcccttttcagggcacgagcccaactctgtacgactcggaggatttggtggtccaattggacgaccattccttcaacgacaccgtcttttgctcccacgccgacgcggccttcccaaaggagcagaaatgcacggcaatggtcgtcaaattttactcggattggtgcggacattgccgaacgtaagtgaattgaagtgaccaattcgaatatttatttattttatttttcaattgttttagctatgctcgcgtgtacaaagcgttggcggatgaccttcgcagttggaacggcatgctgaagttggccgctgtaaagccaaaaagtggccgcacttcccaattggccaaatgcacgtcccttgcagataaactgcgcggatccgatcaattcgatgacgtgtcgcttcagcggaatcacccattacccttacattaaagtgaatggacggagtgccgatcggactgatcagccaaaagccccaatttttaagtatttcccccggaacagcacgtcgatggacgcggccgaaacggggcgactgctccgatcgcaccaaagcatggccgaaatgagagacggtgagggggcgaaaggaatggcgatagacagagggcggatgagagacttcgactgactgtttagagatcactcgcgcccttttggacgaatgggagaagggccgttacgcggattggcccgacttcgaaccgttgggcgagtgagtccccccccccccgcgcagtgattaattaaaaatgccgaaaaaaagggtggagacgcacagcgaattgtgggaaggagtcgacgcacacattcagacgatggtggtcatattcgagaaaagtgtcgactcactggtcggacctcaacttttgttggacatgcaaaaacacagtgacaaaatcgttgctcgaaggcacgtttgactgagttggcttggcttggcttggtttggcttggcttgggttggttttcctgggttggcttggcttggcttggcttggcttggtttggcttggcttggcctggcttggcttggcttggcttggcttggtttggcttggcttggcttgggttttggcttggcttggtttggcttggcttggcctggcttggcttggcttgggtctggctttcctgggctggtttggccatgggaccacattccgtcgatttatcagtcccttccctgtcatcgatcataatatcaataattatctggacattaaagatgtgtcgaaaactctctcagcacggcccttcaaatcgtcgacttcccaacttttgccgtttttcggcgtggcgagcgtttccccgttttcgttgccgagtgattccctctttttctgtcactttccttttctttattttcttttttttatctttcggctccgtcgtgtgctgtttaacgagttcgagcagtttcttcgcgatgaaagcacaaatgcgccggtcgtagcacttccgcgcactttttcgcgtagaaagggaaacggcggaggagcggcgcaacggacggaaagtttttgcgagacgaaccccgaagagtgagcaattggtgtcccagtaggagcggggccaagcggggtacgtactgcaaaggtgtgaccgcaaatattgccatttggtccctccctgtggtacgtacccctccctaatgccaatgggagggaaaaggaggaattaaccaattcatgtttaggtgcaagaagttatattttacatccgagttggacatgctgaaaagcgtgcgaatgggtgagctcagaaacgaatgaatgaatgggtggtgggaaatgtttatatatgtttataccgttcaattgaaccatttatcgcttttcaaaatttacagccctcttcaacgacctccaaatcgtcgaaggctctcatctcagcggttccaatcttagcgcccttttcaattttgtggatttattggccaaagtcaaacaaatgaccaattagcaaatgctaattaatgttttcttttctttagcattttccgtacagcacagaagaaggagaagaagcggacggaaatcgcactgaggtgaaagaaacgaatttggaggcgaatgccaacaatcgcttcagcgctttctgaacgcaagtggacgcgcccgcgttgtgttcagtcatttgagggattttgttgagagtgtcggattagacggatcggtcgctttggacgattggaaaagggaatttctgcgagcagaagttagcaaagggaagagggattaatcgcaatcagcttaattaccaccgatcattccaatgagtgaaggccgatcaaggaagcccttttcccgtgacggaggaatgggaacactgcaaagggtgagaacgaaatggcaaggcaatggggggaggggcactatttgaacagtgatcagtttggtcggaaggtgatccttctgatcatcgcgatcggggagtggtccctctgatcactctgctccgagcgtttttctttcccatcaattttgagtttctgtccaattttctgggccctcccccccctcgccctttgaaatgtgcgaccgttttgcagaagttcgcccattctccgcggcttcacctgcggcctttggatggttttccattcgctgacagtcaatgcttttcggcagaacagtaaatgatgaatgtgtgaagtgattgtgcattctctgtgctttcgcaggtgatcagcagaagcagttccatccggtcgccgttcttctcaccatcaaagattgggtgactcatttcttcgcttgtgaacactgccgcgcccatttccatcggatgaccacaaaaacggccaaaattgaggcggcggtcagtcgttttcccaaaattcctctcacttttctttgctaaggttcgccaaaaggaggacgtctttctgtatttgtggaaggcgcacaatttggtcaatggtcggctgaggggccgcgagacggaggaccccaaattccccaaataccaattcccgccaaagttcctttgccccgagtgccgcaggggcgacaaattcgacgagggaaaagtgcgcgaatttctgctgaaatattacggccgagtgagaccaattgatggagagcagcgaacgacggagaacggtcgcggaaacggggaacacggcggaggaggggaggaaaaggaagaagaagcggataagcagcgaaacgaacggatgccaaaagtgatcgggggaacggcggaggaagaaaagtgatcaaaggtaaaagcagaggagaaaagtgatcagagaggaaaaacggaggagaaaagtgattggaggaacggaggaggaagaaaagtgatcaaaagaaaaacggaggataaaagtgatcagataggaaaaacggaggagaaaagtgatcagagggaaaaaatgtgatctgaggaaaagcggaaaagaaaaagaaaaatgattagaggaacgatggaggaagaaaagtgatcaaaggaaaagcggaggataaaagtgatcagataggaaaaacggaggagaaaagtgatcagagggaaaaaatgtgatctgaggaaaagcggaaaagaaaaagaaaaatgattagaggaacgatggaggaagaaaagtgatcaaaggaaaagcggaggagaagaaagatatagcaccacatttgatttcatttgcactttcaccaaagcatcgtttgtattctcttttagagaanacttttanaataaattcccanatccgtaaacttattctttatagtgtctctgagtctg

SEQ ID NO: 13454 - DNA, 2300 bp, Heterodera glycines
  misc_feature (2134)..(2134): n is a, c, g, or t
ctatgatagtaatcctgcttagtacgagaggaaccgcaggttccagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtacaagtacatgagaagggaaggctctcttaagggagtcaaatgcctcgtcagtcaccatgaaattaggtagaataagttcttgactttgcttttttttccatttatttcaatcggctagtgctttagggttttgtgttttgactttgcttttttttccatttatttcaatcggctagtgctttaaggttttgtgttttgactttgcttttttttccatttatttcaatcggctagtgctttaaggttttgtctttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctagtcgtatgtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcngtctgtgtgttaaagaaatttggcgagttaattgacttgtgtaaatgttgcctaaggcacaaatgctgtggggaactcagcactggggatgctgaacctaaagtctggtggttggtgttggtatacgagtgagtgtcgtattgccatggttgacaagccctatgag

SEQ ID NO: 13455 - DNA, 4117 bp, Heterodera glycines
  misc_feature (37)..(37): n is a, c, g, or t
gcagctctcggtggaaatccacttgcacaaatggctntggtagaaaaaatcggaagaccgcatcattaaaagaaatatctgaaatatcattcatctaaaggattttttagggctatcgcttcgcgaacggagtggggacaaagcaaaactgcgaaacggcgtgagaattacgccgcaaatggaaaaaacaattaaattttgaaattttagtttaatgtggtacaaaaaagtagccgatcgagttgcttcacaagttaaattgactggaactccttccattcagcgcattcgaatacctgacgaattagtatttgttatatcattttgatccaaaattggttgttttttcataaaatttcataaaggagtcttcctcgattacgggcactttgctggacaataacgttttttcctattacaaatatctcgcggaaacgggcgacatgcaagcgattgtgagtcgttgtcagtttttaactgtggtgggattggtgttttagctcggcttggctcagctttatctaaccggcgggaagggagtggcgatggatttggtaaaaacaaagaaaaaaccttaaattttttaaaaatttaagaattcagcagctaaatattttacaattgcgtctgaggccggcagcagtcaagcgaatggatatttgggcaaaatgtacttggaagggacgcacgccactccgcagaacaacatcaccgcctttcagttcttcaagaaggcggcggacaaagttcgttggggttgtcaagaattaactacaataacaaatttggtttgtcaattttggcacctttttatgcaaaaatagcgggcaagaatttttaacttaacggtaacatgtgattcactgaaaagggaaatcgactactgacaatttcaccgtgaaaaaccttcgcaaatttttaaattaaacaacgattgtactagtaaatagccttttacatgtccgtaaaattttttagggcaattccatcggtcaagcgggccttgggatgatgtttctttacgggtacggggtgaaacaagagccacagaaggcgttgaaactgtttgcacttgcggccgaacaaggctcacccgatgcgcagttgcacttgggacaaatgtattacaagggattgggcgtgaaaaggtcgttttatggacgaacattaatgaaccgacattgtttttttcagggatttcaagcaggctctgaaatactttcagttggcgtcccagtccgggcacattttagctatttacaatttggcacaaatgcatgccaagggcaccggagttctgcggaactgtcgcgtggcggtcgctctgtacaaaaatgtggcggaaagaggccgctggggcggacgctttatggacgcgtatttgcgcttccaaaacggtggcgctgtggatgaggcggcgtttcgttatttgtttttggccgagtttggatatgaagcggcccagacaaactttgcatttttgttggaccgtgaggacacgcatttgttcgcaaaggaggaggcgtaccgcagggcgttcatgaactggttgagagcggccaaccaggactacccggtagcccgtgtgaaattgggcgactacaaatactacggactcggcagcgagcccagcatggaggaggccgcggagcactacaaattggccgccacttcccatcagagtgcgcaagcgatgttcaacttgggatacatgcatgagcatggacttggcgtgcaaaaggaccttcacttggccaaacgctattacgacttggcggccgagacgagcacagaagcggtgtggccggtggcgatggcactgatgaagttgagggtggagtttatgctcgaataccttttgatggtaaacccggaaagcgagatttgagcaaacaaatccccggaaattcagaatttctaccaccgcagtccgtcgcttgatctgctggacgccgttttgggccccgactgggacttgtacctgatgagtctgctcctcggacttatcgtctggctggcctattgttacttcaggaacagacaaaacggcggaggaaggaattagcgaagaattttatatcggaaggtgtacactgacaaatgagtgactttttctgtgatttgctatttattttatttatcagtaaaagaaatatttgcattttgaaaagaactgttgccgattacttatcatatctttgtttacctaaatctttgttgatttttaaacttttgattgttacaaaatccatcaaagcttaaatttgtctccgtccctttagttgtattttattggccattattttttctgttacagttcgatctgaagtttgaaaatgttagaacggcttccgtctcagttagtgtcacgaagcgcgagctttgtccaaactcggatgacggcaaacaccgtcaattttttcatgcgtcgaaccggcgacactttgtggaagacggtgacgaacgtgtccatgggagggatgaagcgggggagggcgcggacgcggcagcccatccgaccgttgccccaattttaccgagtcggcatgctcaagtcgagtcagtcagtcaggcattgacacttcccaattggaaaatgccgtcattcattaggtccgatgcgcatccgttaccctgggttaaatgcgcccattgtcccgcaaagtgttgccgaattggcctcgagaccgttttttgttgaggaacagtcggagcaggaaagggaggaggtgctgcactttgtgaggacccaagtggccaagaagagcagtcagaagcgccatttgtgcaaggagcgcctcactccgctggagcggggcttcagcggcggcactttcatgggccaacgcatgggaccgcccccggacatggacggggcgaacatggccgacttcgagtgcatttgtctttttgtaagtaacaaaacagcgcgtacatatgccgaatcacttaagaccgaccgaataacggaaatgcattcgatcagaggacgtgttttcagcacgagggcactcgtttttgtcggcaatgggaacaaagttggcggtgagttgggaggagggcatttattgtgcaaatttgtttttcgaaaggttttgcattggcaagggcttccggcttcaaagtgaatttggcaattgcccgtgccgtgaaaaaggcggcgcgtgaccttttccacatcgaattgcacgaggacagaacagtcttccaagtctgtgctgctgcgtttgcgttttgtttttcctcacattgattattttaggactttttcgccgagtgccgatattcgcgcattttcgtccaacgggaagcgccagcaattccaacgatgaccaaaaaaagaacgtccattgaattgtgcgaagcaacacaaattggacacagggaagaacttggccaattggtttctccaaaaccagcgaccgatcgtacagcaccgaccgccgatttcatgtaaaataccaaatttcgatgaaatggaggggggggggggccctttcccattgccatataaattatgcctttaaatcgttaagcagaatgggcctccatcaaagtccatcgatgccgccaatggtgatgaaggcactagcggcaaacgacaatgatttcacaatttcttcaactgcttctgatgaggcagcaacaacaacggaaggcaaactgacaaagtccgcaaccggtgcacacatttccgccgacccaacactctctcatatcgtcgacattggcgcacaaacgtcaacagccgtacaaaatgcaaattttcctcgaggatcacgaaatcgccaaacttttcatggacatatacaggtcagtagcaaaaatgaattacaggcagcagtaagccgaagtgatgtatagaaaaagataattcgaaagttaaaagtatttttaatcagattgccaccctggtgtttgctgttcttctctttaactcttttttcgacgttggttctgcgcaaagtccgaatgtcacccaaaatatctcagcgagtacaaaggatttacaccatgaagcacaacccggcggcagcagaaacggtggaatgcctctctggtcttggttcctcctcagcggcatcattttcatcgttgtttggttatctaacagttt

SEQ ID NO: 13456 - DNA, 4008 bp, Heterodera glycines
  misc_feature (26)..(26): n is a, c, g, or t
  misc_feature (35)..(35): n is a, c, g, or t
  misc_feature (46)..(47): n is a, c, g, or t
  misc_feature (50)..(50): n is a, c, g, or t
  misc_feature (78)..(78): n is a, c, g, or t
  misc_feature (118)..(119): n is a, c, g, or t
  misc_feature (3947)..(3947): n is a, c, g, or t
ttaattatgcacttttctacctaaanacgacaagnttcgtgtattnntanaaattgtatcttctattccttaataatntacaaattgtgtcttctttctcttctaaaaacgacgttcnncaaatgtttaataattttcaaattgtgtcttccgttgcttaattctgcatacatgttaatgtgtttaattatgcacttttctacctaaaaatgacaagttcgtgcacataataaaaattgtatcttccactccttaataatttacaaattgtgtcttcttgctcttaattatgcatttttctacctaaaaatgacgttcccaattgtttaataattttcaaattgtatcttccattgcttaattctgcatacatgttaatgtgtttaattatgcacttttctacctaaaaacgacaagttcgtgtattttttaaaattgtatcttctattccttaataatttacaaattgtaacttctttcgcttaattctgcacttttctacctaaaaatgacgttcccaaatgcttaataatttacaaattgtgtcttccgttgcttaattctgcatacatgttaatgtgtttaattatgcacttttctacctaaaaacgacaagttcgtgcacataatcaaaattgtatcttctattcgttaataatttacaaattgtaacttctttctcttaattctgcatatttctacctaaaaacgacgttcccaaatgcttaataatttacaaattgtaacttccattgcctaattctgcatgcatttttattaaaaacgtgaataaaacgacaaaatgatacaatttttggtataaaatagagaaataaaaggggtccatgtatgagtacgtgtgtgtatggggttatgtttatgcgtgtggaagagagatacaataaatggtgaacaaaatacaaaagggtacatatgtgtatgtgtgagagagatacaatgattggtgaagaaggtattacaatgtgtgctgacaaaatagttacaatgaatggttaagactataaacattataatcggctcctacaatacccttcccaacataaggctgataacatttttgcatagagcttgatattacagatccaccatcacgaatattgggtctaataaagtttgggtatattacattaattggttcaatctctcctgtttgagcataacgtttgacttgctgtttttatatctaaagccttggttgttgatcacatcataattgagtgtcaatccacggagtttaagcacgtattccatttccgcatcatgtagaacatttatacgtcttaaagccaacgcatactattttgcaccagcagtgtagaattctacgatttccatcaatgaactgcttatagtgtcgatcttattcagctaaaaagcatcgcgtagatgtgagaaaacaagactatccgtgtcggtggagagtacttaacgccgcggctatatcatcatttctgaatagttttattacccactttttttattttcgtaggtaatcaaaacatgatacacctttcaatcctcgatggccgaactattatcccaaatattctccaaaatcaagtacatcattattgaagtaaagtctgttaaaggctgtaatttcgtaaagaaatatgtcgcacaaattgttcaagcatagtttaacaatcctactcttcttggttcacagctatctttgttgggttaagatttctaatttctctttgcactctcttacaaattcagcttccttctcacacatttccttttatgtcagtgtcaattggtaaactagcgggtgcgtgaaccgtcggatctggcacagggataaagcgcttcgcgctttgggagcttcgctacctaggctgtaaagcgattcaaattgattgaattggttggagattttttttgaatttttaaaaaattaaaagaagttcaacagtgattaaggccgcttcgcggcctcagacgggcgcttgcgcccgtttctaaatgtgggctattaatgccgcttcgcggcctcagtcgggcgcttcgcgtcggtttttcaatttttgttggccttggacgggcgattcgcgcccgttttttaaattcgtttaactcatacgggcgcttcgcgcccgttttttagcttgttaggccgcttcgccgccttggacgggcgctttgcgcccgtttctaaatttgttgggcgattaaggcagcttcgaggcctcagacgggcgcttcgcgcccgtttctaaatttgttgggcgattaaggcagcttcgaggcctcagacgggcgcttcgcgcccgtttctaaatttgttggactattaaggccgcttcgcggcctcagacgggcgcttcgcgcccgtttctaaatttgttgggctattaaggccgcttcgcggcctcagacgggcgcttcgcgcccgttttttagcttgttaggccgcttcgcggcctcagtcgggcgcttagcgcccgttatttaaattttgaggtacaaaagtgattaaaagaggtacaacagtgattagaagaggtgcaactatgattaggagaggtactacaacggtgattagaagaggtacaaactgtgattagaagagcaacaattttcaatagacgtaaaagttgagtaaatcaataacgcacaccatctcaaacatgagaatgtaataaacagatggcatataaaaaaaatacaaattatggacaataaaattaattaatttgaaacaaaaaatttattcatcaaaaataatttaatttaaatttaaaattatttattaatttttaataaaacaaaaaggttcaaattaattaaaaacggtgaaaataacttaaaatgcatagaaaaataatatacgccgcccggattcgaacttccccccccccctcaaaatgatgccccagaatccccaatcacacagggattctgaggtcttaacgatgtcaaaagtaaaatctgatcacgtattcgtgatcagcgtcataaaatagccctaatgacatgttttttgaagattttttgtgaaaaaatttttcaactcaaaaatcctatgctcacccctttggtctggaatcccaaaatcacttttatttttataacatttttcaaaaaagtgataaaaatgtgaaataaaatttataaaatagagctaaaaattgcggatttttgtagcaatctacttttcctgaatatcttttctgaagcgagttataaatttttttctgaaaatccgaatttttccagaatttctggaataacttttttatttttgaagacagaaaatccaaataaataacataaaattctcctgatttttctctatttttagagcttaagttcacttaaattgaccaatccttcactgtgttatgaattttccaatattcgcccaaatttcagagggtcgaaaaattgccaaatatttttgaatttttaaaaaattctaaaattttctaaactgaaaatgaacatcagatttgtgctaagcaccttaaaaatacccagaaaaaaatttttcaccctatttttcaaccaaaaaaaaaattccgaaaatttctagggggcctagctcgaaaatttttgaaaatttccggccatataatacactattcgaagaagaggtacaaaagtgaaaaagtgatagaaaagtgattagaagaggtgcaacagtgaatagaagaggtgcaacagtgattagaagaggtacgacagtgaaaaagtgatagaaaagtgattagaagaggtacaacagtgatcagaagaggtacaactgtgattaaaagaggtacaaatttgatgaagaggtacaaaagtgattaaaaaaggtacaacggtgattaaaagaggtacaacagtgatcagaataggtacaaaggtgattaaaagaggtacaacagtgatagaagaggtacaaaagtgattaaaagaggtacaaaagtgactanaagaggtacaaaagtgattaagagaggtaaaaaagtgataaaagaggtacaaaagtgatta

SEQ ID NO: 13457 - DNA, 990 bp, Heterodera glycines
tagaagaggtacaaaaagtgattaaaagaggtacaaaagtgactaaaagaggtacaaaagtgattaagagaggtaaaaaagtgataaaagaggtacaaaagtgattagaagaggtgcaacagtgattagaaaatcaaaaaaataaataattaaattctttaatgtaaaaatttttttttaaataatctacaacaaatcttcagattagttaaaaacattgaaaataacgtaaaaagtcatagaaaaataatttacaccggccggattcgaacctaccgcccccccccccccacagaagatgactcagaatccccaatcacacagggattctgaggtcttaacgatgtataaacaaaatctgatgtcagattagtgatcagcaccctcaaataaataatgaatttatattatagagaaaaaaattgtggatttttgtagtattttacttttctcaaatttcttttcagaagggagttctgaatttttttctgaaaaatgtaaaatttccagaatttctggaataacttttttcatattgatgatagaaatttcaaataaatcccataaaattctccttatttttctctatttttaaagctttattatagttaaatcgatgaaaccaccaccgagttatgaattttcaaatattaggccaaaatcccgagggccaaaaaattgccaaaaaataaagaatttttaaaaaattccaaaaattttgaaacgaaaaataaacatcatattcgtgctcagcacctcaaaataccccagaaaaatatttttgacccccattttcaacccaaaaaaaatttccgaaaatttctagggggcctagctcgaaaatttttgaaaatttcccttcatatagtataccattagatagagcttaaaaagctctacaattttgctctaaggcaatttttggataagatcaacccccgatgagttatgggaccgggactcaaatgtcccgctcaggccaaaaaattt

SEQ ID NO: 13458 - DNA, 1334 bp, Heterodera glycines
tcttttgtagtcggaagctgacttttgattttttttaaatctaaaaattaatcacattaaaaaatatgaaatataaaattactgtactcccctataccgtactgtatataataaattgatgtcgtagcaaagggaaaaaaatttggataatttcttaacaaattcgttaaaatttcttaaagttttccttgcgggccccaaaaattcctgatttcgcttaaaaaaaattggctcaaatcgcaaaaaatcagacttttttaaagtgaggcggcgatgggcaaaaataagccgaagggttcaatgattaaaaggcggtaaaagaaaaagcggaaaaaaccaaaaccaaaacaaatgctactcaaaccaagatttttaagtgcttaattaaataatttttttttattggacaaattttggagcaaattaaattaaaatcaagacaaaaaatagtatttcttatgtaattggaaaccgacttttgatgtcttgaaaatttaaaaataataaaatcctgattttgactaatttcttatttgttagggaaattcctgaaaagtttggctatttcttaacaaattttcgtcaaaattattaatgtttttaccccggtaccttgaataatcccgctaatggaataaggggaaagggaatgaagcggcgcaaacaaatttacattgaccaggatatgaatttaaatgaaataccgtaattcctcgattataagccccggggcttctattgttcaacccccttccaaagggggcttccattcgagggggggggggcgtataatcgagtaaatacggtcggtatatgctagtcggaacaaccgccatccgctacaatatttgtgtgctatttctcatcgtatggctgaacctatttagaaaaaaaaaaattcaaaattcattgtttttaaaaatctaagtttggtgtccgattttcttgaaatgaaaactttctcttgatgtcggattttccgccgctgtcgcattttcagtgagccaaaataattgttccgaagccgagaaaaaaagttcagtaatttttaaattgggagccgaattgaatcgatcttcttagagctccgaccaaattatattctgcttcttttttagaacaatccaaccaaattatgcacaaaaaacacaaaatgtagaattgtggaatagtccgattagtgtttcataaatgtcaaaaggattggaaaataatgaggcaaaaaaaggaagcacagcctcggggatcatcagtgggacttctccaattctcaatggtcgactgatcagtagccgggggcggtgcggggcggtgggcagtggtctgaaagccgg

SEQ ID NO: 13459 - DNA, 1361 bp, Heterodera glycines
cactcacagcattggccactggctccctgtgctccgagctgtccgggctcgccaacgcctcccgggttgccgggtgcgccggggtttccgccgtcgccagggtatccttgagggcccgggccgccaggctggccgggctgtccattctcgccgggctgtccaggctggccagggggtccttgtgggccaggcggtccgacgacgggcggaccctggctgagtttgccgggctgaccgagttgcccggactcgccgggatttccgggctgtccgtcgggtccaggaggtccctaaaaacagcgggggatttacaaaagcatgcataaattattcaggaaatgctgacaggttgtccggggcggccaggcgatgcgggcggtgccgactgtccaggttggccaggctgtccctcgggaccagggggtccaggcggaccggggagtccgggctgggcagcatcacattgcggcacgcatccgccactgggcgggtacgggcgaggcgctgcctggcctagagaagaatttacggtttcatgaaattccaagtaaaccctttgtggacctggtgcaccgggttgtcctgagcctccgggttggccatccccgccgggctgtccctgtgggccagggggaccgggcaggcccggcggcgacactccgcaaccacagcagccgcccacttgacgcttgtgacggctgtcgtgcgtcaccttggagtaggcctgggtgcgggtgacctaagtttttagaattttttgtttgaaattttccgggtctttccgcccttcgccttcgttgattttacctcgcgccacatgttgccggagcgcattttgcagaagtccacatcgttttgcatttgggcgccaatctgctggaagtgctggtaggcgaacggcacggacagcacagcgatcaccgtggccacggttgacaggcaaacgccgaagaatgccaatgtgcgcagcgactccgcctcgcgctgggcagcatttttgtcaaaatcgaccatctacatagacagaaatttagactggaattgaaatttgaatataaataattatatttaataattgcatttcgaatgttttttttgtctagctcaaaaaatcaaaaaaattgggattgaaattaaaatttaaaaaatattttaaattattccatttgaatttcaaagatttgtctcactcacttttgttttttcttctgctgctgcgttgattgaattgcaactaaattgttgtccttctcccacttctcctcccctttataaaggtacgcggcgatgacacaaaaaaagttcggccgttggaaattcgccggaggggcaaacaaatgggcgaaaaatgaaaataaaaa

SEQ ID NO: 13460 - DNA, 2625 bp, Heterodera glycines
aaaaaatgattttttggaaaattttccgggttttgaggccaaaaaggacaatttatgtgttgggggccgttctattagaggtttttttggaaaaatgccaaaatatggaaatatggatataaatcgtgaaaaatatggaaaatatgtgtagaaatccatcctagaaacttcaaatcagactaaaaacatgtttttcgtacgtttcaggcctcccacagtccagaaaaaaaatatggatttccatataattttataccctaattataaaaatgcctaaaatgaagaataaaaattaagaataacctgactaagaatttttgatataattgaaaagcattaggaaattttcaaatgacttttattgagtcgtaactttaatttaatttattcgtatttgaataattttcatctgcaaattcggaaaaaacataatagttaatatagatagacttacaaatctacaaaaacttgtatagtgaaggaaaaatacaaaacattttaatgcttttttaagccccggagggcgtccaaaaattgcacatggcaccgctttcgcaggccaaggcgggtaattggtaaaagttttcaatcagcaataacagcagctcggctaggcctcattgctcgctgtattgcccgagcgcaaggctaaagaaacgaaggaaaaggagagggaacaggcaaatgaaataaaattttaagatggggttaaaaaagggagagaacgacagagaaaaggcacaatctctcttcccactactctctctttccctgtgatatttctctcccacctattttcttttccatttctcatcattattatatcctttcctttctgtgactttttctttttcagcgaacaaaaaaattaaaggaaagaaaggcgcctttcgcttcgtttgttactgcacataaagagagatgggggcaagaaaacatacaaaaagagaaatacaatggagcatttctctttatccctcctctgttataaccccatcataaaattgcttttctatttccaaatatcttccccattttccaattttattatccctggtccctttgtattcggacgatgaaatctttcgccttttactaaaggtttccgtgcagggggacgcttatgggttaaacccaatttttggacagcgccttctccagggagggcgcgaaaaagaatttagtccattttatgcgttctttcgtcttatttgtgcaattttgaattctttaaccctttgacaaatttttacggaataaagtaaattttgcttttacttttaaaataattatggattagtggatagtgcttcgacagtaacagtattttttgttgtgcgttcgataaccggttgcgttttcttttgaatttatattttaaagtgtttttacaagatacagaagaaaaacaaaaatttatcggtaaatcttattttttgttgttgaatatctgttagaaaatcgagcttaaatttcaaaattcgcccggccggccccaccaaaaacctatttgtttgttaaaaaattggctcaaaatccctaaatttggccattttatagacaaaatttgtgcaatttatgccaaaaggaattgaatggaggcgatagcgactaaaggaatgtggagccaaacacatcatttttaaaattattataatatttctgtcgaaatgtcctttgctgtcgaaaagtccggcgcccgcccccgcgaaaagccagcccccgcccacggggctgtaccctagtttaatgtaaaatttgttttgttgataattttgtataaataatgcacatcaataataaaaaatatacatttttaacccgatttaggaataatttacctgtatgaacctggaccgtctcaccacacattgattctccattcatttttattttaatccctcattttgttcattacaaatggaacatgcagcaaatgatgtttgtggcggagaaaattgctgacacggcattcattcacaaaattttgaaattttatggcagaatgtcactattttatcaagaaaatgtaaggtttgcgcaaaatttggttatttttaagaaaaacccaaaatatgtaccaaatatgtaaataaaatttttaaaatggttatttttttagaaaaaaaaattcttcggaaagggtgaaataggcacaaaatgccataaaaatgacctaattaggcctagaatcacattttagtattttaaaaattagtttggttaatttttatttttcacaagaaattttaataaattttcaaaaattctcaaaatatgtaataaaaatatgaaaatatgtacgaaaaatttgccgaaattttggattttttaatcctaaaaatatgtaaaaaatgtatgaaaaaatccgaaaaagtccaaaatatgtaccaaatatgtataaaatatgtaaaatatgtataaaagcccgaaatatgtaaaaatatgtaaatagaagtcccaatttttgctcgcaaacacaaaaaagaaagtgtttttcctgctatttatagcatggagaagccaggaaaaaatgtatttacataaaattgacagccctagtgatcatcgtcaatttgcggctgcgttttttcctcattgtagcgctccagaatcctcaaaatt

SEQ ID NO: 13461 - DNA, 2630 bp, Heterodera glycines
  misc_feature (69)..(69): n is a, c, g, or t
aaaaagaatgttataaaaaatattttcacccattaaagcttctgtgagatttgcttaaaaaaatacagnctctaatcaaccttttaccatacctaagacttgtcttcagggcaaagagaaaaaaacataaaaaattaattgctaattattaaatgatatttagtcgttgaatctcaatagagaaaaaccaaaaagtagaataattttatattataaacaccagataaaaaaccagaaaataataattgtcttttgtttaactttcactaataattttccaaaagtttattatgaaaaataaatctttcaaagacgaaaataacgaaactttgcatataaattatgggattataaatataaacatgagctttagaaaaataaataattaaaaaactagaaaacgaaatcatagacataaattaacagtaataaatatgggacaaaacaaataaaaataaactaataaaagtttatatatggaatacacatttttcccagattttattgagtaataaagtatgaatattgaaaaaacaacaaatttaaaataatattgtaaaactaaaataaacaaagagaaaaaccattattacacgcataatctaaaggttgcaagtttttttctaataaaaccttaataaacatgggcagaactccagtgagggtacaacattacatgaggtaagtcatattgcagctaatgatataaaaattgaaaaaatgtatcatgaaatattaattttataaatataagttaaatagattcttttaattaattatatcgccatattatatgaatagaaaaaatgaaaatttaattataggacaaagcaatacaaggaatgatatgggagcaacaccttcgtcggggaggaaattttcataaaaagtctaaaaaaagaaaaaaaaatccagaacaaaaaagtcttaaaactcatttaaagatacatccatcttatttcaagtgcaattcgactttcgtaatttcatttcccgaaacatgtcggggctgaaccctagtttataatatcaaataaattttattaaaatttttatctttttggtctttctgccgataggtgcaacgtaaatttttttggaaattaatgcaataaaaatattttacgactttaagctttagcaaaattagtaaaaatactattataaaattcattgtcaccccttttgaaaaaaatgttgaaaaaatattaattttccctaaaaaaaattaaagttataaataatgatttaattttatattttattacaaaaaatctcataaaaaattcattagaaatttatagcataaaatatatttttgagaatttttcatttcttaggggtgggtatcttttcgtttttattaattgaagtacattaatgccaaaatatttataagtttaatttaattttgtttaatgttatgttgattgcaagttctattttgccataaaagtaagtcaatgataatttattcgttatttttaaataggtttaattacattaaatttctctatattttaattttaattttgttatttctattcagtagtagttttaagttttcacacatattaatatataatccattaaggaacattttaatgttactgctcatgatttgtaatttttattattttatcttttagattctaaagactcgaaagattaaaatttaattttaaaaattttttattttattctattattaccatgttgaaataagcttggttttgttcgagctgcgctagatcattatttaagcttcttttctaattgtttgcggacagacatttgcggacaatttcaggaaaaaataaaaaaatttcttgaaaaattaaacaaaaatttttgtaaaaatggattggaagatttggcttcgctattatatcatttctaaatttcagatatacagaaatatattttaattttttgagacatgcttaatcgcgaacaaaatttacttgcaatttcaaaatgtgcagcatattatataagtgctgaacaccagctgtactaaattccgattcccgtcattttttgggcctcggaattccgatttctttacgaaaatttttgggttatcggaatgttatcctcgctgaaccctagagcaagatttatctagggttcttccccgattctattggaaagaaaagtaggggagcagatagcaaatccccgacaagacttgtcggcatagctggagaaatttaaaaaatgtaggcaaatactcttcgggaagtaaatctttttaaattccaaaaaattaagttaagagacacaacagcatctcattttgacgattgaaattaattattaaaagttaaaaaaagatttgaggccttataaataaaaaatttttttatttgttttgcagtcgtctccattccatgttttcataaatttttttaagaaatttttttatttttttccgaatttgtcgccattgtcccgttcgcagtgtccgtcccgcaatgtcccatttagagaaatataatatttgaaaacattttttccccaatcacatatcatagacgatgcgtaaatttcaatttatttttgttaaaaatactaatatttaattataataaacttttttttaaaaaaaaattgattttgttgcttaa

SEQ ID NO: 13462 - DNA, 3827 bp, Heterodera glycines
  misc_feature (2490)..(2490): n is a, c, g, or t
  misc_feature (3749)..(3750): n is a, c, g, or t
  misc_feature (3752)..(3752): n is a, c, g, or t
  misc_feature (3755)..(3757): n is a, c, g, or t
  misc_feature (3759)..(3759): n is a, c, g, or t
  misc_feature (3761)..(3762): n is a, c, g, or t
  misc_feature (3764)..(3765): n is a, c, g, or t
  misc_feature (3768)..(3768): n is a, c, g, or t
ttgatcgcttcattttgcgatcgactgtgcagctctgtcccttccggacgatttaaagatgaaattgctaatgaggaaattgtctagcatgagtgcctccgcgcagtgaagaatgacgacgaagaatttggaatgttcatcaaccggcagtaaaaggcttttacgagacttcaattttaagaaattgaacgaagagcaatttaattgcttggtcctttggatttaattaaaagcgccgaacgaaagcattctacggtcaagaattttggcaaagttggcggcagatggcgatcaaatcaaatgtgacaatgtcgtcgaagatttgaaagtttattgttattttttatcgctattttttacaaaaaaataataataatagttttttgttatttttttatctttatatttacaaaaaaaaaaaaataataaatgttttcatatgaatttccaaattaaacacacatagaaattgaagacagccaatttttaagagtttgactacgatttctaataattcctaagacagaaaaagagcaatcacggaaaaaaaagtgcagcagaaaaatttaaagaaaaatgattccaaaaatcactttattggaattgatgcaaatttctttttccatctgatcagtgtttgagacccaattcccaatttcttggcaattttttcatcacttatttttggattcatttctttgattttgaagtattgtttcatttttctcaatttttcttcattggaatattgtgctaaaataaaaattaattaaaatattaagttaaaaaaatctcttacttttatgataatttggcagcaattcttttttccattttataaatgttctttcaccaatgcccaattccttcgcaaattctttctgtttacgttggccatataaacttttaaattcatcaaatcgttcaatgaattcattctttttcccctcataaaaactctttttcattaataaatttaattcttttttccatttgtatattttctcgcgacttgcgcctaataattttccaatttttgtctcagttttggcaaggtttttccgattatattttgccttttttctcaatttttctttaattttatcaaatttatgaattgtttctcttttttgttgatcattaatttccatgttttcattatctcctccgtattgattaacataattattaatttctatactttcattttcctctttttgttcagttttaatcatttctgcttctctttcatttgtgtcccattcgtcaccaaatatttcatcaaaatttggtaggattttgccggtttcaatattataagtaagaaaaattattataaatattaaatgccataaattcatttttacagcgaaatattctagcaataaaataatttttaaaaaatgtttatacattatatgaagaaattatttaatatattattaaatcaattttttacgataataaatcataatgcatgaatatcaaaattcacaaacattttaaacgaaaaaagtaaaatgaaatagattcacttccaaatggacacagcttaatcattttctccaccaaagatttttaaattcttaatgtttaataacttttgtttagagaactagaaatttttcaaatttcgaaaaattttcataaattttacgactttctttaattagttaaaaatctattcaaaacatattaagatttattatttttgaagaacaataagttaattgaatatcaaaaagcccgagtatcaactttcttaataatttatcttttttgttgaatgccaaaaaaaccattttttctttggaaattgggtataataaatatcattaaatggaaaaattcagcaaatataatttttatattttaaatcaattttttactattttattgattcttatctaagctcagtagcgctgaaaagattttcgcctcattttttgaagagttggccgtcccattacccgactgggccctccccgaaaacaaaatctcatctctttcattttctcatcgcaactcaaaacttaacaaaacttcgagctacgtcatcgggatgccggcatttaatatggttattgttctcattaattttaattcttttgccacttgtcatcggtaccaaacagaaagcatcatcaaataaattgtcggataaattaattttaaaatttcataaatccagcaaatggtcaaagctcccaataatataaagctgtccaatttgttcaaaattacaaaaacattttcgattctcttttaagtgacacattccaaaaatcacggggtcaaaattcctcttacgaaatgtaacgcgaccacaaattcattgaaaatttataaaaaaatataattttacgaatattgctttaaatgaatttgtttaagttctttcgctttttaattatcattttattgttttttcgcttttacaaattgatacaaatattaaattgccacaaaattccgagcattttttattanatcaatttttactcaactcaattaaaaaaatatatttttgcaaaaaaatgaaaatagtaatattttttattttttaaatttaatttgttattgttttagtcaatatttattgcaatatttcttgatttatcattgctccgctaatcaactactacacaaaatttctttattacataatacaatttaactttatggcggaaaaggcaaaaaataattctcacttatggtaccgttgaaatgtattatgccaaaatttagaaatcctggacagaaacttttaacaatatgttattgttctccaccctattttggactctaatttaaagttattcgaatttttcaaaattttgtcacctttaagccgagcacctctaattttatgtcttcactcgattaacccactaacatcgaacataaattgaaacaaactgattaaaaagtatgtatgtaaatttgaaggaaataattgctaatgggcgtttgggctttcgacctattttgttcacatggaccatggagaacgttgaaggaaaagatggttttatgattttttcaagattttacattaaaataaacattttttcttatattaggtgaaaattttcaaaaatttagaattttacagaattctttaaatgaattttttcataatttcaagaatatttgtgagtttacattgtattgaacaaatattttttatcaaattaatgaaaatatccgtccatttttgaaaatgacaactcattcataactctaaatccacatatctttcataagtctcgtctcttctatcatctatcattcatattcgaccgttggcgccagctattctacgttggccttaaaatacaaaattttgaaatcatttttggcttttagaaattgactagtttttgctaaattttcttttttatgaaactttttttcgaaattttggcaaatttaaagttttttatacaatggataacaataaaaattttgatgttttgataaacctttttttatagttttattgtgtttaaagatttacatttatttattctggcggcgccaactgaatgttgcaggcatttccgtttccgggcaccatggtaaccatcgggaccatttggaagtttttgttgccgttgcctcgtcttctgcgccaaaagaagacaatgagggacacaaccggtggagccgatggtaaggtccaaacaattatattatttgagatcggcgtggtggtcgtcgtggtggtgggcgtgggggtcagggtnntnctnnncntnntnntcntcgtagtggtcctatgaaggtggtcgtcgtagtggtctcttctcactagaatgttttgt

SEQ ID NO: 13463 - DNA, 1150 bp, Heterodera glycines
atacaatggataacaataaaaattttgatgttttgataaacctttttttatagttttattgtgtttaaagatttacattaattatttggcggcgccaactgaatgttgcaggcatttccgtttccgggcaccatggttaaccatcgggaccatttggaagttttttttgccgttgcctcgtcttctgcgccaaaagaagacaatgagggacacaaccggtggagccgatggtaaggtccaaacaattatatatttgagatcggcgtggtggtcgtcgtggtggtgggcgtgggggtcgtcgtggtgctgggcgtggtggtcgtcgtagtggtggaaggcgtggtggtcgtcgtagtggtctcttctccctaaatgttttgtttcttaaataatttaaaaaatttctatttcttaaatataatttgaatattatttatcatttaaattaaaaatatgcattttaccttaatcttatctactcctatcgcggccaattccaaaagagatccgacaagagcggcctcgcctgtctttttaccggcggttttggcaaacttacgaagttttagcccgcgcttggccataacgtcccactcggccactgaggcaaaaatcataaaacaaataatcaatttattcattattcttctactaaataattatttattaattaattttaagcatgtttcttaataacgatgaacagggaaaggcaaaaatatttttaaatgaatacggaattttctctctaacaataactgttataaaataatttgatcaaaatgaataatttatttttactgatcagtcaaaggcctactaaaatgggcgatgtccgatgcggcgggtattggaaaaacaaaaaacagaagcaaatggataatgcaaatgaattttttatcttcttttatttttataagaaatcaaatagttaatatatactcattaaattaaattcttggcggcatcattcggcatcgtaacatttatattttgaagatttttggatattttttaaacattagaataatttcttaaatgatcccaaatttcaaaaatttccgtccacatttggcccatctgtttgctgcgtttgtcataaatgagtcattagcgctctgcggaagctcattgaactgaatggaacatt

SEQ ID NO: 13464 - DNA, 1599 bp, Heterodera glycines
tgaatttcaaaaattatttttttttaaaaaaaggggggggggacaaaccctactattaccgaataatgaagagcaattttaaatttaacaaaaaaaaacattgttggtttgtaggtttattcgtcgtgtacacatgaattacacattaatagttacggtacatgaaaacagtacacttatacaaattatcatcatcaaatcatcatattacataattgccatcatacataggtgtttatttaatcgtcattagctgtttgtgtgtcaaagtgtggtgtcgtgtaaaaacgtgaaaattgtgtgatgatcggtcaaaaaatttctccctcgaggccttccaatgtttcattttcattccctcccatttttctcatccatttttcctagcgttgctgctgctgctgctgctgctgttgttgatgttgctgctgttgcttgttggccccggtgttcggatgttccgtctccaaatgccgttccaacttttggtaggaggtgcaacggtatgagcacacatcacagcttcaaaaaaaaccacaggaatgattagagtgtcgttttatttttatttttatcaacgaatgatgcatttaatttgcttgcccattcgtcgagcgccacccctcggtttttccaaaaaaaataaataatattttttttttggaaattccgtttctaacattcaaaaaaaaaaaattttttgttatttatgtgaattaattttcaaccattttgtttgaacaacacacgccaaccaacctgtacattatttctgctgagcaaagcttaaaaaaggaagaaaatgtatttggaaagccaatttactaaaagcaattaaataaattaaattatttgcaattataaacatgtaattagcatactttaatctggtgatcggagaccaaatgttgcaaaatgttgaaggcgtactgcttgctgcacagcttacaccgtcccgagtccgccttgcgctgcgcttttgccaacaaatcggcagtgacgagcccatggaccatgaccaaatgccgttccaaacctaataatgtgtagatgatgtacaattgtaatcaagggagtaggacatgatggacaattatagatttaaatcgcggagcaagtcgtttaccgccctattttttttaaatttttaaaacagaaaattgaaagaaaaggatttttttaaaatttccagcatttttccaaaaaaaatttttctaaagcgctaaattttttattattttttaatttttggggagaagcgacagggagaaaaagaagttcatccttcagcagcagcaccttcgtatgtccagaaacggtctctgcagcgtgagcacgccaacggtgcaccgctggccatttccgcgttgttcttccccaacagttgacgatgtgcggactgcaaatgcacccggtactgctcgcggtcggtcaactgtgccaagtcgcaaatttcgcacacataatggtgttggtgttggtgcgggtggctggtcggagcagcagcaccaccaccaacggcggtggcggccgagtgcgcagcggcggcggcggcggatgttgcctttagctaaaatgaattacaattttttaatggca

SEQ ID NO: 13465 - DNA, 1372 bp, Heterodera glycines
tgttgctggtgctgctgcctggccccgttgttgatcagtgccctctgttggttggccattgtcgccgccggtggcaattttgcggccgcagcagccaaaatttgatgcgatttcagcttttgttgctgttgcaacagttgcgtttgcatggctaaaattttttgttttgtttgtttttggctctgttcaattcaaagaattggcacacacacacacacacacccgcttggatcatctgtggcgttatgttttggcccttgtcacgtgccatcctcaaaatttggccaaccgatgggcccacctgaaaattattttgatattttaatagtgccatttgaaaacttccaaacttttaaaattaatggggcaatgtgctgcatttccaatgaaaatcaaccaaaaaaaaaaaaaattttttttaaacagaaattcaaggactgtactggaaaatgaaaggaaggcatttttgaaagcgttttttcaaaaaaaaaaagtcgtcgacttgcaaaaaaatcgcaaaatttggcagtttttgggtcaaaatctgttaacaaaccgcactcaaattttcaaaattttttcccgacggcgcctaccggcaccgtcggccccccccggttcaccaaaaatttttggaaaaagtgcgccgcaaaaaaatgggggtttgaaaagcaaaaaaaaaaggtcgtcgatttacatggccgggaccatttcgcaaaattggccgctgaccccccccccccccctccagaccatttcgcaaaaattttggttgacctccccccctttttaatgtatgaattggcataagatagccatacggggagctataagtcaatttctcgccaaaaactttcttgatttatcaaaaataaaaacaattcacttgtgccgattgtgcggacgggaaccggttggcattgtgcacagtgccggcaccaattagtcgagtgtgtgccaccgttgccaacgctgccgcaggcgttgtgccgccgctgaggagccgttggttgcgcaacagttgttgctgttgctgtttgagctgtggcgttttggtaatgggggaacattgtaagacagggttcccaaatgccacaagaaatctacatatattatcgaaggttggacaattttttgggttccctggtgcggtcagaccatcaaaaatgtatcaaatttatgaagggtcccaaaatccattaaaaatataattatttcgtgtattttcagttatttcgaagaaataactgacaataagtcgtgacttttgaatgtgccccaaaatggtcaaatttaagtgttttcaactccaaattttttttccataggtgatatcaggatgtgatttcaccccggtaacttcaatgctatt

SEQ ID NO: 13466 - DNA, 3553 bp, Heterodera glycines
  misc_feature (46)..(46): n is a, c, g, or t
tttttttataaataaataatatatcttcaatttcttccactagctnttttaaaaaaattacttaaaaaggtttggttctttctttaatttttgttaagagaattttctacatttttttttaatttggatagaaaatccaaaggatttgtaggattttctagttaatatcccctaattcttgactgatcaatagagatcataatcataaatattcccggaggcttagaaatgccgtaggggggggggtattatttcctccaagagtcttgacatttttggcattttttaatttgaaaattttcaaaaaatgaaacggacggaccaaatatggaaacattgtgcaccaaagtgccggcaacccttcccattcgtacgtccgaaagccaccaaaagtgtaaaagtacaaaagccatggcaaaccaagcagaccagtcaacaattcctgaaaacgattattaaaaaaatggaaaaattttaaaatttaccgcaattttaaaaattatttaaaaaaattctaaattttaccgttatggccattgcgccaagaacaaaatttgttggagtgcgcagagatcgatgggagagaacaatgacaatgaacgaattggtcttaaacagtgcgccaaatttagagggttttaaatttttgaaatttttttgacattccgtctctaagcatttttgtatgtaccgtatgccactttcaaggcaactacaccacttaccagaatggtgatggcaacaatcagcggcatcaaaaagccgtacaatggcagtgcccattcgattggcacctaaaaatgggggggggggatttttgaaattttaattttttccaaaaatttccaaccctggcattgatatggacttcacggcattgttgcggcgattgttgcagacattccggcacggacagatgaacaacatcaacaacaggcttttccatggaaaaatggcggcaaaaaataaatcacaaaagcagaggagtttttgtctgggattggcggggggcggatgaaaaaattaggcagcaaaaaatgccaaaaatgacgaaagcggcggcggtgtcgatggatggcatttttgcagcattttgtgcccgcgtggcattttattctgtttctttcctgcgtacatattattatttttttgttggcaccgattaaatggatgctattgtttttcatatttgcaaaaacaaaattgtcggggggggggggggggggggaacagtcttagacaaatgattggtaaaaattgggcaaggcaatgccgtgccggggggggagagaaaatgccaaagcccaattaattgaatggcacaaattcgatggaaaagtgggcgctgttctagagaatgaatttgcacaatttcagcattttatttcgggtatttttcgggattatgattgtcgagatcaatgccgaaaaagccgaggttgaattccattattttcgcggcattttagggtcagaattctgatttaaaacattttttgatgtcatcagttttaaataaattcatatttttggggcgtcagctcttatcacatggttcaaaattagtgggcgggggggggggcgccgaggcgagaaaatgccaaagggattgaatggcataaatggggggggggggagggacggcaaatgattttaattatgcaaaaaaaagaaatttgaaaaatgcaaaaaaaaacatggacaaagtataggtaaataggtagatagatttatagacattaaaattatggaaaatgaacgggcaaataattaattgcttttttgaagtcaaattggctatttaaaatttattttttatggcaattttaatatatttttaagaaattcgaggaaattttctcttttgccaatccccttttgagcattttttgaaaattcgaaaatgcaaaaaaatttaaaaaagtacaaaaattttaactgattaatctgttatatttgtaagtaaatccaaaattaggcactaaaaatctatgaaaaaatttaaagattggccgtaattggcactttttctgctgatgttggcattggcatgcacattccgaaaaatatattaaaaattcatttgttggtgaaattttacaaaaaaaaggaagcgcgtgggattaaaaatgccaatgattgaggggagaggggaagcttttgcccattttggccccgcggcacggcgggtgccatttcattgaagaaccatgtaattttgaacaatgggcggtcggccacttcataaaatgcctttttggatgccatggcacttttcagggcactcattagccaaaagcgaagtgccgttgaaagcattttgtaactcaaactggtggaaaaaatttggctttttacatccgccggtggacccccaaaaaacgtcgtcggacgatttttggaccaaaattttttaattggttaccaaataagcattctaagcattcttggatatgtttggctaggcgctgttgtgtgtttgctattattctacaaaatttcaaaaaaaattcaataagctacaaaaaatctgattttctgaatatttttggcactaatttgttaaatcaaaattttttaaattttacgagttaattgcgttgtgaagcgctttcaaaacaaataagaacagtttttatttggttttgagaaaaaaaaatgggtggtcaaaagtgccatcatatggtgccattttatcattttattgggaaaattttttatagaaatgggtgggataggcccaaaattcacaaaaatagccaaaaatttgatggatctcaagaaaagccgtctgggctccggttttaaaccatagcctttcaaaaaaattgattccaatgacgtaaaaaaaattcaaaaatgaggaaaaacggatttcagtgcctaaaatccattcacaaaccagaaaatccgaatctccggcaaccaaaagcatcggaaatcattggatattctcggcctaaacctcttagcttagccgaaaacggcaatttttgttgaatgtggcgccaaattgccgccattaaaaaaagtcggagcaacaatttctcgactcggtggcacccgccccgctcatgagggaatcgatgccgtggattgggattgccggattttttcaccaacatcggcctctccctatcccccgcaaatcctttacccgcaccgcacacggcactcaatgccaatgtcttcatctcctactccccgcccgtctgtgtttttccccttaaaaacgaattcccccccccccctcgggggggggggggggggggttaatttttaatgttaccccccccccccccgagggtctcttaaatttttaaaatgccggccgcgtagccgctgcggacggacggtagagcttattttcatttaaggctcataacttttttcgttttctttttcaaaagcaaatgcaatgaattgattgatataactatttaaaaaaattaacggcccataaaaaattaattggctgtttttcgattttgcctattttgcaattacataattaggtaattaattgtttttaatcgcttttgagcaattagaa

SEQ ID NO: 13467 - DNA, 1491 bp, Heterodera glycines
aatatttaaatttttttacattccatttcttttcttatcaatcacaacatcttcattaaaaagccaaaagagcaaaatcaaacagcaaagaaaaaaggttgaaaagagtgaatttattcatttaatttcactgtttgtcacaacaaatttcctcactttatttgttttttggtcattaaaaagtgacgaaatacaaatgtatttggggctttcgctatttcgtcactatttctgtacatatttggccaatgtttccattataaattcatttattagtgactatgtttttttggcgtttcgtcactttgtccttgccctcgtcatttctccaccactgttttgccctttcggccagaaatattaaaaatcaatcaataattggccctgttcattctcgaataaacaacaattccactctctctctctttttctccccattctctctctctctctcccctctctctctctctctctttctctctctctctctctctagcattctcttttcttctctctctttctccctcctctctctcttctctctctcatcattatgtattcccgtctctctgcctcatttctcgagaattcgcttttcttcaactcatatttttgtgttgctatgggcggtttgttggcatagcgaaggacaatttgtgaacttatttttttatgtttaaaattgaatcttttgcctaacggctgaattattctaaaaagaattatcattggcagttagcacaataaaataaaaaggggcaatttatattttgtttatcaccaggtattttatatttcaatttcatttatatttttaataaaatttggaaacaaatttaaatcaaattaatcattgcctttttttgaccatgatcattactcaaattgggaaattttctaaatattattttaaattacaaaatttatttcgtcttaaaattccccctccataatataatacgcatgaatcgattccttaattggtttcgtaaacacaaagcatttccagtcccttctatcagtgatgatggccacaaaacatttgataacaaaattttcttcaccacttttagtcatacaaaataaaatgcagtgattattttcttgaaaatgccaaaaaaaataatttttcaaaataattttccatttaaaaaattatttccttacaggaaataattttttcaaaaaatgtcttccaatccagcgctaataaaagaaggctttgtggagaaatacaaaagcggctttttgagcagcaaatggaagtcggtgttcgcccgcctctattcggactccacattggcactgtacagtgaccgggtacggtacaacacaaatatactgtagttcctaaaatttgttcctaaatgaataaagttgtccggtgtggtaatacggtatatcatatattaacattaaacaccctttgttcttcatataaattattattgttttttaggccgattcacgtccatcggaaaaaggtttcct

SEQ ID NO: 13468 - DNA, 2714 bp, Heterodera glycines
aatgagtaggactgggatttttaagaccaaaaaccccgaaatagttacctaaaaaaatttttttaattaaaaatttttgccaagaaagtaaatttttgagaaaattttttttcatttcatatgagtatattttgaaaaattttagctcgattcttaggggtgtattttttggttttattgcatttttgttaaggaattttccaaaaaatgtcgaaatagtgacgatacgccaaaatagtgatttttacctttcttcaaatcaattgagcaaaaaatttagttaaaacctaaaaatcgcatccctagtgattattttcttgaaaatgccacaaaaataattttccatttaaaaaatatttccttacaggaaataattttttcaaaaaatgtcttccaatccagcgctaataaaagaaggctttgtggagaaatacaaaagcggctttttgagcagcaaatggaaatcggtgttcgcccgcctctattcggactccacattggcactgtacagcgaccgggtacggtacaacacaaatatactgtagttcctaaaatttgttcctaaatgaataaagttgtccggtgtggtaatacggtatatcatatattaacattaaacaccctttgttcttcatataaattattattgttttttaggccgattcacgtccatcggaaaccattttcctcaagaatgtgatcccctatgtttgcattggctttatgacagaccgaatgccggtccgtcgtccatcacttccgccgggcactgcggtgcaacgtaaattaaaattttcaaaaattaattaatttgatttactgtcttaattaggtttgattggcattggcatggacccgagagcagagaaagtccattggattttgttcccatctgagcagattttagagtaaacgcctaattatttttcttttataatttgttgtttttgttgaagggagtggcttaatggcattatgtcgacgctgccgccaccgccaaatccgccgccgcaacagcctacagtaccacagcaaaacattggatttggtactgtaaaactaatttactataaaaaaaaaagattaattttttataattaaatcttgaattatttcatgtttcagttccaccaccaaaatatcctgaccaaccgccaccctatggtggtcagccgatacaaccgcaacagcagtcaccgtattacccgcctccagcggcgggtgggtacggtgcacagccacagtacccgcagcaacagtacccggcccaacagactgtagtcattgacaggacaacaacaccgagcggaggctacggagggtaaacaaaagagcacggatatagaaaagcaggacccgcccaggatttttgcatgtgccctggtcttgtccctgcatttttgtggaaaattggagggattgcagtcccaaaaaaattaattatttttttctctggttcctgtcagcaccattttcaagtctttgcattttcaagctttcggtaccattgaaaattgccaataatgtttggtggaaagaggccagcagatcaaaaatcttggccgatttgaaatattttggaaaacgaataataattttaaaaaaaaacttgatttccattgtctcatgaatttaaaaaataaaatacgcacttagatcgtccggcttcggcaccggtctcgcagctggcatgggcggtgccatgcttggctcgctgctcggctacggcatcggcagttactttgcaccccacgggggttggggcggcgggggatggggaggcggcggatacggaaatggcctgggcgggggatacattcaggtggaaaatgagggatatttaaaaaaaaattaacaatttgcaggataatgacacttacatcaccaacaattactacgggaacaacgatgactcatcaacgcctacgcaaaacgccggaggcaataaattagcgctttttgaaattttaataaaaattttcatagattattcgacgcccgctcaaaatgactatggagacagcggaggcggtggcacatgggacgacggcggtggcggaacatgggacgacgggggcggatttggggacgggggattcgacgggggagggggcgagatggtgtgagagaagcgacggacgaccaaattgaacacaaaacataaacaaaaataaatgcaaaattgaaatgccgaaataggcacaaatccattctaaaaactacgcattgttttgttgtttttcttgaagccacaaacaaacaattttgctgaattcaccttttgaagttaagcatttgccagaaacgaaaatgcaaatttttgcttatgttttttacctttttgtttcattttatcaaaattgaaatttcctttcagtcgctttgtcaccttttattggaattaataaaatttacagaaatgcttgctgcactttttcaggagggtttttggtttcgcacaaattggcatcggcattcgttaagtgatgaaaatgtggtggtggtgatgctttgttttaaaaaaaataattttaaatttaacataaaattcagcaaacggggcaattaattaacgaattcgccggcaaagggagaaaaaaggaaaaattattgaagtttgaaaacatatttccttaagaaaattcatgaaaaatcccctaaaaaaaaatttttttcccggcggcgcctatcgatgccggtgctaggtcgtttct

SEQ ID NO: 13469 - DNA, 2040 bp, Heterodera glycines
atgttcaaggctggacaattgttaaaaatttttaaagcattccccgctttttaggtaaaaattaaaaaaaaaatttctcgaaattatcaagaaaaaattttgtaggagtttttcctttgaaaatttctaatttttgaaatttttttattattttcggggggggggggggaaggctgattattacagccaatttgctacaccaaaatgataacacttacacttctgctcttggccgagtagtaaaattcggtttttgggtcatggtaaaagccggttgccgggtcgtagaaatagcccgagctatgctcatattgaaactttgctgggtcgggctcagctaaacaaaaagcaattaaaaaacaaacaaaaaatttcatacaacaaattggcaaaattccaaacggagtgttcactgaatttgcggtggaagacgaagaactctgattatgagttgtttggtcaatgatttggacatctgaaaatggaaaaaatttgctaaattttgtgtaaattatggaaaaaaatccaataaatatgcaaaaccttcttgcgtttctggcaacaacttaatgcgcccttcgctcaaaactttggccaacgaatgacgagaaaatgagacaaacactaaagtaaatagtaatattaaaaacaaaatgatttattgatggctttcaatttttcatatttttagtgtgcattgaagcaaaatcaaagtcaaaaaaaaaaaaaaatttttttttgaattttcgactctttgttcgagttcgagaccggggttcggagttggtcgaaaatggacgccaaattgtgatcagcgacaaggaaaaccgcctaattgtgagacatttttcagggcatttaaaaaaaaatttttttttgcaaaatgacgaggcaaaagagtaaatcttaatattataggtattacacgttttctaagatacaattagacttttgattaggtgcaattactagaaatttgattttttgaaaaagaggacagaattttcggggaaaaggaaacttttttacaaaagcaacggcatttcgacagattatagccaattaaaaaaggaataattttttggttttcggtaccggcacaattgtcgatgtataaacatgttcgttgcagcttatggtgggccatttctgcgtcaaacagtgaccccatttgaatgaatgcgaacagtcgcgaggcggccaaacggacgttcaatggctcaacatcagtaaaacggacaaccgcatgacggacagacaaatcatcggcactcgcgggcagttcacgaattaacaaagctaaaaatggtgttttggacctatttacaaaattacaaaaaaaaaaaaatcggaaaaagtgaataaataataaaaccaattcacccttggaattttcaaagtgtcagttaaatcgtaaaagttcaccaggctatttttgttacataaactgtcataaaaacattactatcgcatggaagggtgccaaccatcgtcaagcccttggcgtccaatgcaaatgcttcgcccctggcccgcagtgtgccacatttgaagcagttggcacggccattgaaattgttgataaagcactaaaaggacaataaaaattccaccaaaaaggaatttggtgttttctcaatttgttcatttttgatcaaattcgtagcaggaattttccatggtaaaacaaattccgctaaaattctcaaaatttctcggtggaaatttgctggcgctaccatagcctaaggaagtatgcaataattgtcagtttacaggaccataaaagaatttcttacaattagagctatcgaatgaaatcaagaatgtttaatttagactcttctgagaaagccatggtgcattcaagttgccaaattgtttatggttatgtccttttttgtgattgtgtgagtctttttttttggacaatttgttaaccttgtaacaagtccattgttcattgtcggacaaacgattcggctccccagcatttgtcaaatagcgcaacggagaatgcgggttattcatttattcaaa

SEQ ID NO: 13470 - DNA, 1191 bp, Heterodera glycines
  misc_feature (1140)..(1140): n is a, c, g, or t
  misc_feature (1160)..(1161): n is a, c, g, or t
tgacgaataaaaaagacatagcagcactttgatcaaagtgaataaagaaaaaaaagaagacaaaaaagaaatttttaaaattccataagagagagaaacagcagatcatcaacagacagttaacgaatttgaagcataggtaaatttaagaaatttttgttgtcgacggcacattcaattgttcgccgagagaagagaccatctcacggagtttggaacattcgcgaccactaaaaattaattaaaaaagagtgaaaaataaaattttaacaaaaaaaaatgctgcctgcttttacatcgaagcaactaattttttttttattctcttgaaaatagtccgaagtcctaattgtgatctattagctacatctttacaaaagtacattcaaatttttaaaattttcccggtatgcaaaattctatattgagaactgatgaatcttcttggacaactgcttcacaaaagacttttttgacgcttgacgattaattgtttttttttaaatttcattgatgcggagaaagattgattttttttattattattattattagtgtggtcagtaaaaaactataaatttgttgaaaaactaggcctatttttcatcgcggcgtcagtttttgtagcttaaaagcaaaaaaaagaaaaaaaggtctcactggaaaaaaatttgaaaaatggtcgatcgtaatggaaatgggctctgacccccccggggggggccaaagtcgatcgtaagacctcttggctgaccccaccccctcttgcacaggtatgatatgttccatcatcatctatttgatgaccaaaatcccaaacagaatccaaatcggcatcagataaataaaaaataaaatgcctgcgatccatggaccgcctgatcattgaaaaagaaatgaaagttgttgaagccgagtttagtcgttaaccggtgcaccattttgcccagcgttcgataggtgcccatgagacgagtcctgccatcgatttggcacaatttaatttttcggcatttaatgccgctaaacaattacgacgggacaacaacgtacaagagtgggaacacggtccgatccgtgagttcgtccaccattgcggttgtggtgaataccggtacaccgccaaccccccaaaattgngacatgcgcgcaacttgggnncacgagtacacatagggcaggcccatcact

SEQ ID NO: 13471 - DNA, 858 bp, Heterodera glycines
tgatttgttatttaaacactttgtgcaattcaccttcgctgtttgttcagcgcatttgctcaatttgtgctgcacttcgcccattttgtcaaccgccgtttgttcagcgtttgttgttgggaacaccaaaaagtgcattgattgagcgatctttaaaaaagaaaaataaataaatttgtaataaaattaaaattcaacggatcagataattgaatgagactgacccggacaatgcgctgttcagccacccgaacgcactgctgtcgttgtctgattttgggcttcagctcgttcaattgacggaaaatggctgtcaagcgttgggtggcactttgccgaaacagttcaaccgcctgcaaaagagaagccgagccgagtttcgctaggccgctagaaaatttaggttaagaaaaatagagaatttttgaacgaaatacaccaacgatttaaacccgataatttgattaaattttcgaccctataatttccgatgtatcggttaagaaatgtactgttccgaatcgagtcgagttttctatttcgataccgtttcgaagagcgtaatcgaatcgcgaacgagaacgagcgggcgattggccttgagagcgagcacttgatcgaattgactgttggacgaagataacgaactgagaaagcacgctgttgagagctgcgaaagaaattggactattggagagcgcttttgttcgatcccacctgttccggctcctcgtacttcggccgttccgccgtttttgtcgacggcgttgcccgcggcggtgtcggcgaagatgcacgacggcgggcgaatgactgaggcgacagctgttgtggagcggaaccggcttggtgttgggc

SEQ ID NO: 13472 - DNA, 3206 bp, Heterodera glycines
  misc_feature (42)..(42): n is a, c, g, or t
  misc_feature (54)..(54): n is a, c, g, or t
  misc_feature (66)..(66): n is a, c, g, or t
  misc_feature (158)..(158): n is a, c, g, or t
  misc_feature (179)..(179): n is a, c, g, or t
gcagaaatgctccaaaattattggcaagaggcatcattcgtncgtctatgtctncatggcaagtcncattgtgatgtcccaaaacgtgatggaacgttacgtttttgtgtggactacggggctttaattcgatcacccgaaaagatagttcccgctcncaaatatcgacaatactcttntaatgcttggaggacgaaaatacttcagcactttagactttatgtccggatattggcagataagaatggatgaaaattccattgaaaaaactgccttttcgactgagtacggtctttacgaatttacagtaatgccatttggtctaaccaatgcagtggcaactttccagcgatttatgtcgcgtctctttgagggaatgattaatgactttctgttcgtttacattgacgatattttaatcgcatctaaatcctttgatgagcatctgaaacaccttgaagcggtcttttctcgagttaaagcagcagaattaaaactaaaatttgaaaagtgtcatttttgcacaaccgaattaccatttttgggccacatcctcacaagggaagggattaaaatggatgcggataagctaaagcctgtgatggatttgcctatgccaacgaccaaaaaacaactccattctctgcttggttttctgacttattatagaaaatttatccattcattcggcacgattgctgctccgcttttcaaattgataagcgaaaaagctgaattcaaaatcggagaacaggaaaaacaagcaatcgaagaattaaagtcaaaaatcattcgagatgttgtgcttcattttccggatttcgatgcagcacagaatgacctaactaggcagtttataatcatgactgatgcgtgtaagaccggcattgcagcaattttatgtcagcctgatccggagaaacagattaggccaatttattttgcctcaagacaatgcaatgtccatgagtcacgctacagtgccaccgaattagaggctttagccgtcagatttggtgtaaaaaagttcgcacaattcatcactatgattccgactcgggtcattacggaccataaagcactaatttggatgttccggagtaaaaatgagacaggaaattcacgtgttgaccgttggcttcttgagttaagctctcgtttcatcctaaaggtggaattccaaccaggaaagaaaaacataattgctgatgttctatctcgttcgggaaaatcgaatgagagcgtcactgaatccttacaggaggaagacattgcctttattgggaaagttcgagtttttgaactcagtaataatgtcgaagatttcactgaacaccgggaaaaatggattgaggagaccaaaaacagcgaaatgcggccaatttatgagtttttggagaaaaaaattatgcctgctgatccgcgaattcgacagagcacaatggacaaatgccatagatttgtgttaattgagaagtttttgcacctttgtgaaaatgacggaaaacttagactctttgttccattatcatttcgtgaaaatttggtgaaagaacggcatgaaggaaagtgttcgggccacatgagcgccaaaaaattgtataaacaattggcagagttatatttttggccaaacatgttttctgattgcattcatgcacataatgcatgcagaatttgtgcacatacccgaaatgcacgttcaaatgaacctcccttaaaagtagttcactcatcagaaccattggaattggtctgtatggacattttggacgttgggccaagtcagtcaaacttcaaatatatttgtgttatcatcgatcatttcaccaagtacttggtcgctgaaccaatcccgaataaatcagcagattctgtagcaaaagtatttgtcgaaaaatttttgttaatctttggaacgccgaaaaaaattcactccgacaaaggaaaggaatttatgaacaccattttcaaaagaataagcgaaattcttgggtttgagaggtcctttacggctgggtatgacccacaggcaaacggtttggcggaacgagtaaatggagttttgattcaaatattaaaaaagtctacagcaagtaattggacgtgggacgaacgattaccgtactcagtttttgcttacaatataacgccatccgagtcaacgggtttttcaccatttcttttaatgtttggcagatcagcgaaaattccgatggataagatcaccgaaatgaattttaaccccttatacacaattgattatgaaaattattttcaattgtttttggaaaacctccttaatattcaaaatgaggccaaacaaaatttggatgagtaccggaaaagaagtaaagattggtatgatgcaaaacctcaagtgaaagccaataaatttgaaatttcggaacgagttatggtggcttttcccggaatgcatcgcaattcacgacacaaaaaattattgtggaatcattttggcccttacaccattacaaaaatctccgaatcgtccgccgaattagtcccagttgataaaacagctgctgaccctattactgttcctttggaaagactcataaaagtgccaaaggcagtccctgacatcgcaacattaccacggggaaaaaacccgtataaaaatgtgctaaatgcaatgattttcatgatttcggcccaactgaattttgaaaatatgccaaaacgtgcgaccgaaaattggcaattggggacaattgctaaagaatgtgtgagggcggataaatatggaaaggaaaaaagtagtgcaaaaattctcagaattaattgcctaaacctgaaattgaaggtaaaaagggaaagaaaggcgaatttttcaggacaaacgcaaacggacgccgggatttgttggacttcggtttgcagtcaaaaagatgccgagcacgaactctgcacggctctgaaattgggcgaattggaccctgttcttggacgagtctggcccaggcgccgatgatcgtacgagtcgccgcttcaagctcttttggccgtttttctgcttcgctccggcacgagtcacttcaaacaccgcgagcccgaacgttcgtcgaaatgatcgttaaaagtggaccacaaatggaaatggccacttattcagagaagcgaggggattatgttggcaccgagaaattcccacaggaaaatgaccaagtcaaagcgcccgaaaa

SEQ ID NO: 13473 - DNA, 982 bp, Heterodera glycines
attaaaattaattaaaaattgacgtctaattatgtggacttataatagttttcaccatttttcagttcgggtcgttttctgtacaagccgttgatggaccgcacgtgctgtccccagtacaccatcaggtggttgggtggggtggtcaccaactgttggggacagtctgccattcgatgccgtttctttaattatcgctctttttatataattttacgattttcgctgctgcttttatggaattgactttccttgggcctattaattacctaattggggtgttgcgttctcaagtgtttttttgctcccatttttcaatttcccaattttttattggctgcgtttattgcataaatggtgccatgataatttgtccactgtttcaggttggacgtgcacaaatttcgcctctctcgcacccaaaagcgcgtgctgcgcacaatgcgcgactttttgcgcacggaccaaaggccgaaagagcgccggtgggcggacgacggcgaaacggcacagggaaaggcgccgcagcaaaagcaaagggacgacgaaaggggcgggggacaggcgcagaagcggcgccgaagacgcggcagcagcgctacggcacagccgacgacggcaccgcaaaagcaacgcgaaacgacggcaccagcgaatggcgccggcggagggatgggaacggaggaaaatgaacagcgaaaggaaaagcaaacgcagggcaacacaagcggaggaggcgaaggaggaacgacgtaaagcacacgaatagttcgaattttcctattcaatggctcaaattgggagaaaatggggtggggcggtgtttttatgttttcccagtcgcccgtaaccagaaataatttcgggaggggcaccgaagagttttttgcttgaatttaccaattttcattaaaaaaattttaatttttcatctcgaggggtggctttctacggacctacgttttcctcttccaatagaatt

SEQ ID NO: 13474 - DNA, 1082 bp, Heterodera glycines
ctcgacggtcgtctgatcgccgtcgctgtcattgatctgttgccccactgtttgtccgccaaatacttcttctacgacccggacttcgccttcctctccctgggcacatattcggcacttcggttggcctttttgtccgcattactctcatttttaattgttttttttgtggcatttttcgtttttaaattttgttggcatttttcactttttcaattcaatttcccttgcgttcgttcagtgaaattgcgttcacccaacagttggcccaacatcgtcccgacctccacttctattacatgggcttctacctgttcgactgtccgaaaatgcgttacaaaaatcggtttcggcccagcgaattgttgtgcgaccactgctttaattgggtgaacaattcaattcaatttttgccatttttgttggggtttttgtggacatttatttggaaagggccccaattttgcctctttttcctctgttgaaatgccaaaaatagcgtttaattaaataaatatttttcattttgttaggtccccgtgacggaatgcgaccgaattctcgaggcgaacggcggccgtttcagcactttccacccgtccgctgagcccactcgtgccgagttggacagtgcccaaatggaccaaattctgtgccttcacggcgaccccccgcggccgttgactttcgccagccttcgcaactcattggaaacggccgctgctcatccatcatcttccacagacagtcaacgacagaacggacggggcgaggggccggagatgggggtgggtactgtcaaatactgtactctaccgtatagtgcattattatttacagaagagtaaacggcatggcgaatttagaattgtagaaaatgcaataaaccgaaaaatggattcaaagatatttttctggcggtggatctaaccctaacgacttttctaaaactggggctatttgctctgtggcattctcctcccgtctccgtttcagcagcatgacgcctttttgaccgtcgatggcattggccccggcgctttgctgcgccaactgacggacaaagtgcgcacgtacgtccg

SEQ ID NO: 13475 - DNA, 1258 bp, Heterodera glycines
tggtcctttggcggctaacaatgaaagaaaaacgacaccgcctcccccccccccaatttgacaatgtccgtccgtcgtggtcattccgctggctgatgcttttcctccgctgctgctcctttgacattatttaaattctcgtcactttctgtttagtcgccttccggcgtttctcgagaaagttaactttttggctggcgctgtaagattcgaccaaattgaacttgtttttggaattttatcattcgatgatccaaaatttgctgggggttttaaattggcaagcccaacaatttcagtcgcgatttaaaataaaattcagaaatagtcctactgtacaatttacccttccctccctccctcaaatgccaaaaatgtgccaatttctctcgccggtgcctttcttccttttgcttcttccgctttttctgccgtcgctttgtccctccattttggcacatcagaacaatgcttttgcagcagccgaaaatttgaacgaacatggccaaattgagcagcaaaccactaaaaacaatgacggaatgttgggcaaattgcgcgtggcggtggcgaacgaaaatggcaaaatggtggaaaagcagaaaaagcaacggcaaattgagggggaggaggaaaagcagaggcagcagcacaagttgatgatgaagatgagagaaggcgccggcactttgactgataaaaatgatgcaactaatgatgacaatgacaacaatgagcagtcggtggagacggaaggggtaaaaaggaggggggggggggggggaaaggccctagggggattaatgggaatggggaaaggctctgaggtgattaatggaaaaagccccggtgcgactaaagggggaaggcccggggcgggattatggggaacagccagcagggggaggggagggaatggggaaaggcccaggggtacgagtgattcgaggagaactcggtgaaagctgcgatgagaattgcccaagaaggaagcgttaaaactccaaggagtgcctcgaggggagaaatgctcacggggagggcggacaaaaacggacaaaggccccggggagcaaaaagagttttttcaaatcagttttcaaaaattgagatcccacatgcgtatggcaataaaatcaaagaatattttttgtcagattttggaccatttggactatttgatccgcggtggggtggagaaaccgcaacagccggacacggaacagccgcgggggggcggcggaacgcgcggcaacga

SEQ ID NO: 13476 - DNA, 1157 bp, Heterodera glycines
  misc_feature (19)..(19): n is a, c, g, or t
gtatgtttttaaaatttgnagatttttcaaaaaatttgttacacatactcctgatctgaaaaacttaaatttgacatcgcataattatttttttgtccaacaaacagctttgggacgagaacggtgacctcagtttacggctggacgaagcactgatgggccatgagcaactgtccatggagatgaaggagttgcaggaacggcacttggaactcagtgccattctgcgcgaaacggatgaggagctgaagcagtaccgggaccaagtgttgacaatcccgccacggcgctgcaacagcgtcgactcgttgtacgattcgttggccagcgagttggagggcgccgattcgggatgttttgggacaccaatgttttcggcacggtgagagaggagactatttgctcaacattttgtatcgacccgtgacaaaatttttgccaccgaaatttcgacctccaaattttctaaaaaaaaaaagtttcaaacatatttttaagatcctaaaaaatagaaattttttctagcgattatttggaaaattttgaaaaatgaataattcatcataaaattagaagaaaaaagacgctagaaatttttttcccttgaaatccgtttcataaaattttcttttaaaaaattttccaagattttaagattttttcttgtaaaagttgctaattgtaagtttgaactttgaaaacatgactatgatcacttgtatttcccaagactgcccttaatttttggcatgcaaaaactgtcacgtttttggacggtgtactttttgaataccaatttttgattgcacatagatatggaccatcgccacattggagttccctgagcaacgccaacaacaacagtcgaagctcttcggaccaacaacaacaacaacagcatcaacactatcaacagctcccgtcctgctccaactcgggccgaccgtccgacgcggccgaattttttggagtcgctgctgaacagtgctcactgcaccatgaacttgcacttgttgctgaacacatgccgatgatgaacagcaacataatgacatgctgatgatgatggacggtggcagcggcggcgcacaatcgtacgatgtgccgtccaaggcattgtttgaggccgtgtgcaggacatttgaggaacgacgaca

SEQ ID NO: 13477 - DNA, 1373 bp, Heterodera glycines
  misc_feature (28)..(28): n is a, c, g, or t
  misc_feature (65)..(65): n is a, c, g, or t
  misc_feature (90)..(90): n is a, c, g, or t
cacagtcgcaaacaagctttgccccatncgatcttatcacaacaacaaccagactgtcgtcgtcncaacaacgagctccacaccaacaanccactggtggtgtgttgctacagatgtccatcatcatgttgctgctgaaggtcatcattattcacattcgcatcccatgggcattttgcgtcgatttgaccagctcgaacttggtgggcacagaatgtgatgaaacacgcccaataaattgtgcacatccgttttgtctattcattcgttttattgttttgtattgtatcctcaagcgcaaccagtcatttctcttctcttttttccttggcaattctctgatttggtccattaattgttttgttttaaatcccgcaattatgtattgtattcttaaaacgcctctcacttaaaccccatcaaaatggttccaaaaaaccaaaacattttgttgtttctcctttcaattcaattgctttctctcgtcacggttcattcactgctgcttaacgggatttattgaaataaatgcatttttctttttatatttctccttcgactcgaagtaaaatattcaaacacaacaaacaaaaaaagtttatctgtaaaataacaacaacaaaagcgtgccgtccgctgcacatcaactcatcgcaattgtttccgaaattagatcattttttcaagcaatttgttgatttggtcctcgcggtttccgtagtcgcctccctccacaaaatggttggacttcttcttgaacccgcccacggggttgctgagtttgaagggccacaaaaagttggtcacttgcttgaagtggggcccgactgtccaaatctgaaccgagacaaaacatttgaactaaaagacacgagacatgcatcaaacagtgtttcacaattgatacacaaccgcccgggctattaaagaaatttcaaatttggtatattggtgcgattcattccccgccccgctccccatgaaattttttataaaaaactttttcaaacaaaaaaaaacagtgaaaaaaacccatagttgtttgttcacctggtgaatcatgtcctccacacagatcacgtccgatttgcccatgtttcgctcaacaatggcattgtccgtgatcggaatgcgctgcccactctccttggcataaccacgcttgtacaccaactggcgaatgatcttctgactcgggtagccccacgcaatgtacgggtcagcaatgcgcaacatctgaagaagaagaagcaattgcataaattaattttacacgacccaattggagctaaaaattgataaattcatccaatttctaacctggattgtcgctttgttcaacttgacgaatacgccgttgttgatctgacgca

SEQ ID NO: 13478 - DNA, 1534 bp, Heterodera glycines
tacctcttctattcactgttgtgcctcttctaatctctcccttacctcttctaatcactgttgtacctcttctaatcacttttgtacctcttttaatcacgattgtacctcttctaatcaccgttgtgcctcttttgacaaatgttgtacctcttctcattgttgtacctcttctattcactgttgtacctcttctaatcactgttgtacctcttataatcactgttgtacctcttataatcactggtgtacctcttctaatcacttttgtacctcttctaatcacatttgtacctcttcatcaaatttgtacctcttcatcaaatttgtacctcttctaatcacttttgtacctcttctaatcacttttgtacctcttctaataactgcttcggatccaacaattactcacaacccataaataacgggcgcgaagcgcccgtcttgagcctcgatgtggactaacccataataattttttaaaaattcaaaaaaaaatttctccaaccaaatcgatcaatttaaatcgcttcacagtctaggtagcgaagctcacaaagcgcgaagcgctttttcccagcccagatccgacggttcacgcaccgctagtttgaacttttatgagtttgaccacttcccatgaaccagttgagctgaatttccactaatgtctttatatttatggaacacccgtttttaggaaaaaaaattcgtaaaattttttaccgttgtcatttcgccttctcactttagaatcttaatattttcaggattgttacgtgcatttaaaatttcaactcgatcggcccatgggaataggatgtctttatattcagcgcaattgtataatgtattatattaaaaagttatacgaactgaataattttattataattaaaatttcatagtgctgagcaaagttattatttttttttaattaatttttttgaaagtatttttcatcaattaaataattattttctttaactaaataagtaaatatcccttaagattttcgcaaatttattataatcttttacttgcctcattgcggaaatcaatatcaatgttacaatgacgacttcactgaattatttacggtaaataaacttaattatcaaaagaaagtatttattttaatatttttaaatttctttggtttcaaaaaaggtaactcagagttgttgcgaatcaattatttgctcttcaattattgattatttaatttatctattcaaaaatgttatctcattaagacctttatgagtttaaatattttagtaatatgttcaagtgatgagcttttttttattatattagattatatattttttcaaatgatgaaatcagttttcaaatgcaattaggaagccataccgtttctgattggaaaaacttcatgagagatgtgacatcatagttttactaaagtactatctttacccacagcactctgagaaaattatcgagtcatttggaatatgaccgaataaaaataaaaactaacgccccagaaaacttacacattttaatg

SEQ ID NO: 13479 - DNA, 2843 bp, Heterodera glycines
  misc_feature (1950)..(1950): n is a, c, g, or t
  misc_feature (1980)..(1980): n is a, c, g, or t
  misc_feature (2813)..(2813): n is a, c, g, or t
aattcttttctcatcggcctggctcatcttcggccaactttgtgctaatgtaagcaaatttccttcacaatttctcactttccacatctgccaatttacattttattttttgtgcgccattttcctttgtgctcacttttcacttcacaattttctgcccgatttgttgtcccattttccatttcattcacgtgtcgtctgtcactccgcccattttcaaaattgtctatttaagcggccccgaccaaggggtcgctctcttctcttccttccagcccgagggggcctcttccttcggttcattccctttcggatcattcattttgctggacttttcgatcaatttcgtcgttacacatttttaattcgtcgatcgcttcgttaataaattttgttcggaattcgcttgggggaaatacggaaaggagggaaaagaccctcctcacttcatcaaattcggcaaagtctcgtgcgaggccaaacgaaggcgcccactgtcgcgacaacgcgaaatcctaagataaacccaaaaataaaaaagggaaaaataaaaaacaatagaaaataaaatggggaaaaataaaacataaataataaaaaatattttttattttggaaaaataatattataaaaatctatcgaaaatataattacataaaaatgggaaaaccttttgaaatgaataacggaaaattgtttgaaaagggaaagtgcatttcctcaggaatgaaaggaacgaaaattaattaatattaaatgattaatatgaaatggcgaattctgttaaggattccgttcgtaaacaaattattaatgattaataaaatataataaagaaatggaaatgtaaagggaaaaatggaaagcaaacaattaatgggaaaatggaaaaatccaaatggataaaataacaaaaacagattttaattaaaatgataaattggagcgcactatgatacaagaaaaccgtataaaagcggctgtgtttttcagtgattttcagattcgaggttccttccgaagattccacggcacccgcctgccgccattcagcacacccagcccgcactgctccctttccatgccattgcccgagtgccctccctttcccgtgccattgtctgggccccatttgaattgacgatcctgagtgccctcccttttcccgttgccgttctgaccttttgatttttgccatatttttccatttgtgattttttgcccctttttcgttcacattttcatgtttgccccactattttgttttcccctcaccgtcccgattgggacggtttaattacccaagtttgagcctgacaataaggtggattattcctgcgcacttgctccttgggtctttattccaacaactcgctctgaatactctgacatccccgaccccatcccacaaattaattgttttttatttttgccgcggttgcgctgagccgtgaccgcgacaaattggtgccatgacccgggacccctcccggctgttgctgagacaactcacttctgtcgctgagacgacaacttcggtcgatgtgccgacaaccccctcggtcgctgagacgacaactgccttcggtcgctgagacgacaattgcctttggtcgctgagacgactacaacttcggtagctgagacgacaactcccttcggtcgctgagacgactacaactttggtctctgtgtcgacaactgccttcggtcgctgagacgacaactccattcgatcgctgagtcgacaactttcggtcgctgtgccgacaactcccttcggccgctgaaacgacaacttccttcggtcgctgaaacgacaactgccacacacacacagacacacaaaaaacacaatacacatacacacaaacaaaaacacacacagacacacacacaaaaaacacacacgcacacacacatacacaaacaaaaaaaatacacacacnaaacacacaaaagcacactcacaaaaccanattttgaagtaaaaaactattacccaaaattaagtggatctaaacgaaaaactaaaactaatatactgtaataacaatatcacaaataatgtccgaacaactccgtctaaaaatttcaaaattaaacagtgaactaagttatttaatcgatgaatacaaagacggcaattttgctaacaaaatcgaatatgaacagaacaacttaaggcaatgcaaaaaagatttctccctaacattaaaattcattaagaaaattgaaccaaggattgagaaattgagaaaaaattacaaaaaatggaaaatatttataaaagaactgagtaccaaacataaaagaattgaagaaaaaatcgaagagattttattgaccaacaagattatgagcaaacattaattgatgctaatgatagattggacaatcgaaaagaaatttacttgaaagcaaagagagctattaaggtaataaatgaaaattatacacaaaaccaatacgcagatgaagaaaatgatagagaaagtgagcaaatagatactgaaaacgaaagtaaagtactatatttacccacagcactgagaaaattatcgagtcatttggaatatgaccgaataaaaataaaactaacgccacagaaacttacacattttaatggactattttctcagtggttttcattttgggacgacatttccagttctattcacaatgacccaaatttgaccaatatacaaaagtttaaataccttaaaggcttactgcataaagaaccatatgaaatgataagtccatacccgcttacaaatagcaattaccttatctgtgggggattaaccanaaataattatttgcagggtgggggaattga

SEQ ID NO: 13480 - DNA, 1667 bp, Heterodera glycines
ctcaaaaccccgatggaattattttggattttgtttttgactttcggtttggccaatagatttggaaacttggccaaaataaacatggccaaaaaattttgttttttctttttcagaaaaatttctttcaggctttttcttgttaagctcatcaaatttcataatctgaccaagttttaagtcgttttgacaattttaactcaagttatggacgttggtgtaaaatggtagccaaattttgttgaccttacccaattttttggactgtaactttagatataaaaggacaaaatcaaaatttttggcaaaaacatgacgagaacattcagataaaagaattacacacaaaaaagacataacaaacgttaatcaagtcttaaaaaaagtcattttgaaaaagcgcccttttttatgcaacgacctagtatatgaaaaaatcagataaaataaaaaaaattatttcgtgccaagaagggctaatttgcgtagcgcagcccaccgcttctcgtcgttgttgaacagcgccggctcagctgctgcgcacccggcggatagcacacggatgcagaccgtgtggtcattgttgcgcctccagcgtcgtcggctgtcagcaaaattttcgtcgtgctcattcgctgctgctgctgctgctgctgatgcttctgctgtttgagcgccatttcacgtgacggcggagagatggatgaatgttttacgtcactgccacctaagcacggcgtgccaaatgagtctttctggtaggccgaattcaaaagcggcaaaagactcaaacgaaaagagagagactgaaggagttttttcgatggccagaaagccaagaactgaagagagagatttggctataagcataaagctgaatgagatgagactcaaatggcatgatacttcgatggacataaagccaaagagactcaaatggaaatagactcggggcggcaagagtcgaatggctttcaaataagccaaattaaacttaaaaagccgaattagactaaattagcctgaaagccatgagactcaaattttatgagactcaagttgccgcaaagccgatgagagtcaaactgcacatgaaacggatggcaaaaatttaagcaaaataattccaccaccagcagcggcacctgatgaacgtcgtcgttgctttaagtcacctccttggcccactccagcaacgcacagtgtgctgctgcagttgctcggcggcgctgacgagccgccgccgatgcacagctgcatttgggggcgtgccaactcgcgcatctgtcgggggaaacggtaagttctacggtatttagcctcattagtcacatcgtaaattttaccgtaccgcttcgcgcaggcttaaaatggtagccgccggagctgccgacaattttccaccatattcgagtggaccgaccagctcaaccgaaccgcaacattcatcggtgccgctatctgttatgaagaaaaaacatttcggcttaaactgcgtgacagagaagtaaccctgctattagggctgtacgagaaatgatttttaccgagaatcgagaaccgagaccgagaagcgaaaaacccgagaactcagtgtttttggcaagaacatttttcttaattggtcaatgccctacattttagtatcaatttaaagcctgaagtct

SEQ ID NO: 13481 - DNA, 1592 bp, Heterodera glycines
ttaaattggcacaaaaaattgtaaaaaaaaagtcggcacgaaaaaacagaggaatcattgaactttcaactttggcattctttcttttccgcatgattggccccgaattggccggaaggaggtggggaggtgaatgaaagtgtgagcagtgaagtggatgggtggtttcatcgccgcgtcaaaaagtggcactccctaacggcgggtgggggacggcaatttcccctcgggggacgctgtgggaatgccatgccatgaatgacttcatttagccctccaagtccctctgcctcccccagcatgatgccctcctcgactttgcgtctcgggctgtgcccaaatcgaatttgtcgctggtcacagtgccccgccaggggacacaagtacaatttgttgccgaagacgccgtgccgtcctcctccatcgtcagcggcgcgggcactcgtcacggagagctgagcagattaaaatggttcttcgtcaccgcgggtgggggctgtggggtgagggtgttctcggcacataaatgggcaccccccgccccccgccgcccctccctttgtgacaggataggaggaaaagcggcttttcaaatcgcggttctgccgacgatgcttaaaagtgtgccgcactgctcccaccaacaaaattcaattttggcaaatacaatgtgccgttttgtccgttcctctctctctctctcccctttttaatggcatcgctttgtgtgtgtattgtgatgcctttttggaacataaaaagggaaatgaatttatgaatggcttttcatttgcatgggaatgtgtaagtgatggaaaatctgctgggcgttttaggaaaaaaaattaatttttttcaatacaaattacacttaatgttgctattacgtaggcaatgaaaaaacctaatttgcaatttaggaaatgtatctgaaaacagtcattatatgtcctaaaaacgccaaatatgtatctatatgctaaaaaccctcaaaatatgtcctaaaacaccctaaaaaaggccaaatatgtctcaatattgaaaaactgctcaaaaaatgttaatttttcaaaaaatctcattatttatccatttcgctgcacaattgcaaatcaaaatcattttgactcattgtgcattattttttaattcaacacgctactttatacaataatttgagtgcaaaaaaagatatttttgactaattttttagaaaatcgccaaaatattaacaattgttattttgataaattattgcaaaatgaataagaaacaaagtaataaatctttatataatattaaatttgcaaaaataaatttaaataactatataaaataaaatctaaattaatttcttcacaaatgagaaaagcattaatgcacttgtcgccaattttctaatttgcgatgataaagcgggtgccaacccgccacagcatgcgagagtggtggtgttccacgaagaagaccccgacggaaagctaatcgggaaagagctcgacaccagcagggatgtgcctaggtttcgcatttcgcctttcgcattttttggcctttcgcatttagcttttcgcttttggcgcaaaatgcga

SEQ ID NO: 13482 - DNA, 904 bp, Heterodera glycines
atcattaagcttttagcgtgcatcttaaatctctggagctgcgatcagcccacaaaagaggtctctaaatttgtattccaaatgtaattaacaccctcactcatagccaccgcggcccatcattaagctttagcgtgcatcttaaaatctctggagctgcgatcagcccacaaaagaggtctctaaatttgtattccaaatgtaattaacaccctcactcatagccaccgcggcccatcattaagctttagcgtgcatcttaaaatctctggagctgcgatcagcccacaaaagaggtctctaaatttgtattccaaatgtaattaacaccctcactcatagccaccgcggcccatcattaagctttagcgtgcatcttaaaatctctggagctgcgatcagcccacaaaagaggtctctaaatttgtattccaaatgtaattaacaccctcactcatagccaccgcggcccatcattaagctttagcgtgcatcttaaaatctctggagctgcgatcagcccacaaaagaggtctctaaatttgtattccaaatgtaattaacaccctcactcatagccaccgcggcacatcattaagctttagcgtgcatcttaaaatctctggagctgcgatcagctcacaaaagaggtctctaaatttgttttccaaatgtaattaacaccctcgctcatagccaccgcggcccatcattaagctttagcgtgcatcttaaaatctctggagctgcgatcagcccacaaaagaggtctctaaatttgtattcaaaatataattaacaccctctctcatagccaccgcggaccatcattaagctttagtgtgcatcttaaattctctggagctgcgatcagcccacaaaagaggactctaaatttgtattc

SEQ ID NO: 13483 - DNA, 1047 bp, Heterodera glycines
aaatctctggagctgcgatcagcccacaaaagacctttctattttgtattccaaatgtaattaacaccctcactcccctcaccgcggcccatcattttgctggagctgcgatcagcccacaaaagaggtctctaaatttgtattccaaatgtcattaacaccctcactcatagccaccgcggcacatcattaagctttagcgtgcatcttaaaatctctggagctgcgatcagcccacaaaagaggtctctaaattttgtattccaaatgtaattaacaccctcactcatagccaccgcggcccatcattaagctttagcggcatcttaaaatctctggagctgcgatcagcccacaaaagaggtctctaaatttgtattccaaatgtaattaacaccctcactcatagccaccgcggcccatcattaagctttagcgtgcatcttaaaatctctggagctgcgatcagcccacaaaagaggtctctaaatttgtattccaaatgtaattaacaccctcactcatagccaccgcggcccatcattaagctggagctgcgatcagcccacaaaagaggtctctaaatttgtattccaaatgtaattaacaccctcactcatagccaccgcggcacatcattaagctttagcgtgcatcttaaaatctctggagctgcgatcagcccacaaaagaggtctctaaatttgtattccaaatgtaattaacaccctcactcatagccaccgcggcccatcattaagctttagcgtgcatcttaaaatctctggagctgcgatcagcccacaaaagaggtctctaaatttgtattccaaatgtaattaacaccctcacttatagccaccgcggcccatcattaagctttagcgtgcatcttaaaatctctggagctgcgatcagcccacaaaagaggtctctaaatttgtattccaaatgtaattaacaccctcactcatagccaccgcggcccatcattaagctttagcgtgcatcttaaaatctctggagctgcgatcagcccacaaaaga

SEQ ID NO: 13484 - DNA, 4398 bp, Heterodera glycines
tttttcaatttttcatttttctgagatgcaaatgactttttcaattatatggttttcttttccattgcaattaaaacaaaatgagactattttttgtgttggttaaaaccactacagatttgttagaatttgatggcatttatcattgttattatgaagacggtaagatattctacaaaaatagctttgtgttgtgccataccacgcttctcgactacaaaatgcaaactaaaagatgagagattttttaattgttattgttgttgttgttgtctttggcattgttttggttagagaccgtactggaaaatgtgtcctttaattttggttaacatgaaatgcaagaaaaaatttaattttaattagtaaactttaattaaaaaaaaatcttgaaactggaagatttcgtatggatttgaaaaattttcttgtgaccgcgggagcctgtctattcgtgccgtacctgagattgggagcttttgttactgtaactctggtggacaataaatgcaaaaaacaagccaaaattggttttgcttattcatggttaaaaaattatcaaaaaaggcacaaaattaaattttgttccatttttttttgcaattattaaccaaatatttccccaatcatcacaatttatggcattcttttaacattgaaaattggctaattttctcttttttgcataaacattttggcatactttttgtcaaagagaattcatagaataatctctttaattaagaataacaaaatgatttttatatagattatagacttttgcattttaatttacaaaaaactttaaattaacagaaactgataaatattccttaaaaattaaaaactaatcaaaaagtgcatttttcaaatatttcctattagtaaagagaatcccaacttttaaaatggtgttttctgtggagcatacaaaaattattgaataatcgaacattgtctggccataaaaggacatggcactgtgacttcttgttggacttaagtgcattggaaagagaaaataaaaattattttattgagagcataaatttataaatcagaagattaccaaataagggcactgagaaatctgctgataattgtctggcatcgatgatggcatcacgcacaatgaaatggaaaagttcaaatgttgcattggaattaaaaatttaaaaaaattttttgaagaattttcattttcgagtgtcgaattaaaaatcataaaaagaacattaaaaccataaattaaattaaaatatatttcttataaatgtccaaagtttctctttcgaatagtaaattcaatcaaataatcaatgaattattgctaaatttttgcattacatcattaaacggtgggtttgggaaggggctttttattgccaaatttggcaaaattggcatcacataattaaacataggaattgacaattgattgctaaattttaggggaggagttgcgttttattgccaaatttggcaaaattgcatcacatcattaaaccatattcatttattttataaattaatagcaatttaaaaatatcactttcgctttttcttctattgactgtgaaatctttgtaaaatttaattataattgggccttcaaatgtctattaataataatcgtgagattttttttggaatttttttcctattttgggaagttatgccacccgaacccttttttgcaccttttaaatgaataatttctgatcaaattcaaacaattaattttcatcaatgacagaaccgaacatttcctcacccaaatataaccgaaaattaattttcgtcaaagaaaaaatcaaaaagcttccccgagaggaagattaatggatcaattgaggcaacaattgatcctatatggtcgaacaaagtggggagctgctggagaaggcagggtcggtagttcagctggtagaacactggtccggaaagccagagacgccggttcaaagccggcccgccccatagtttttccctcaaaagcttccccagcagctcgttcatatatttcactattatatttttcctgtctctatttcttaacccatccaaaacttaatgtccccaaccaaacatcctgcaaggttaataaacaaaaattttcagacatgaattcgaccatttttctgtccacgatttgctgcttcctttttttggctttcaacaatctccaaagtgtcgctgctgtggtaaagcaagtgtgttttccaggcatagaaaactacgaaattagcatgtttaatgatcgagatgagtcgatagaagaaatcgaaacagaaacagttgtaacagacggcggaaaacaatgcttaatgcttaatgcagataaatgggatggatatgaagaggatgatgtgatttgtttctatgttgaaactgaggtaattcaaaaaaatttttaagcaactataaaaatatacaccaaaatcatttttgaaatcacctgttatttgattaagaatttaaaatttagcctattaaaatatttaggaaattttattatattttatattttttcaaaaaattccgatttgtgacttccgattcccgacgttttggggtcggaattctgatttccaactttcgaaaaaattttgggccgcggaattcctgtttccgatttccgaaaaatttttgaccctcggaattccgatttccgagaatttttagggtcggaatgccatccctgcccacggtactacacgaaccaatcgcacttctaatattccgtgaaatggctctaaccaactaaaattaatcaaaaaaataatttaaaaactaaatttattttataattttttatttttatctaaattcttaaacttagaaaattattttcaatttgtaacttctccaaaatttctattttttattttttgtggttgggaaattttcgtaattaaaattaaaaagaatttttactttttatgattttttcacaaggctttagtttcttttaacaaaaaatttccttttcttctaatttattttctctcaactccctcccccattcttaccattgcttaaaaattttggtttttctgcccaaattccaaaattcgaaatgaaatgatcaaaatccctgtgctactcgaaccaattgcacttctattatttcgtgaaatgctctaatcaacaaagctacaagattactttatttttgtccaggctccgccagtctcgccttgctcaactctttccgaagtctttttaaaccccaattttattcgagaggtaacgaattattatttttttgctaacttttcccaaataatataaaatgtcttggttgtttcagatgttaggttccgctccagtttctttattgagaactgatgatagtaactatgtcttagacttttcggaaggactgcgacattattattattactttaatcctgctattggtgggatggattttggattctgaacttggaagtgaatgtgcgatatcttggtgctatgacgtcactcaaaaaaccatcaaaacgacccggcaccgaaatctttgctaaaaatattatactctgttgatcgaattctttgctttgttgatgcctatattggcctgttgcataaaagatttttaaaattttgtatgcaattttaatgcttactgattggagcttcagtgattgatttggggatctgcagtgaaattgcaaaaatataaacaaaagggaaacaaaattttatagtcaataaaaggcttacctaagtcagaattttttggccaaaacttttaggacccaaattacattttttttttgaatgtttaggttaacaaataactcaaaagttatcaaatgacatcattaattgtttggctcaattgaattttaattaactaaaagtttaaagcctataattatacatagatacatgatcatagctaaaaacctacatattttttatataattttttcagatttaacccattttaaacattaaaaaaattacatttaatttcaaaaaagtttcggccaaaaaatctgactcaatgttttttgaaaaattttgactcggttatagctacaaaaataggctaaattcggttggccacgaggagagaccgtattcattcacttcatcataagaaaaatgctaaaacaattgagttcccttatgattcgttaagttcgagagtctcggtctcatttagtctctctcgaagacagcgaccaaaaaatccgagatttttctcgagtctaggctcgagaacgagactcttgaacaccacttatcaaaatgtaactagattgctaatcttttttatcgaataattttgtgcttatttttcactatccattgccccacaacgtaatgtcttttattttcaggctgattaattaaaataaatataacataaatatgtagaaagaa

SEQ ID NO: 13485 - DNA, 1587 bp, Heterodera glycines
gaggaagggagggtgccaagccatcgcattcccaagccaattctctccaccccatagcccagccatctttcgttcatcatttgatcatttgttcgtctcctctaagttagcagcctcccaacaatttctctccccccccagcaaaaagtgatccctcccccactcaccggcagcaaaaaatgatcaaattccgtccgaagaacaaaatcggacaaaaaagaaaatgttctaaaggcttatgaatagttcttaaattcgaaaacataaactaatcataaaattcagtaacttcgttttcgcgcctcattctctctcccccccccccaataaatttgtgtgttttccgttcgattggtcattcttcgcctccggcgggggtctctgccactttaagcaaaagtcatcctctccctttccagcagtttgctttgtacaattcgtttccaaagggcaaatgtcccctttactctctcccctcgtcgcctcgttgccccccgcccattttccccaattttctcccaatcattttttgttcctttccatcgttccagctatacaaatttagttgcattccaaaagtcttcccagctatttcagtactaatcggtttatgtttcaacaattggtttttgtcggttgtcagtctctctcccccctccggctggtcacttcctccgtccccttctctccccctcgtttttccttcttttgccccactcctcactcattccttcatttcctccaccgctactcgtgacccttttctgatcggacaactttcccaccatatgtccccccatatccctctcgtcctctgatcaatccattatctcccctctctgatcagttttgtcagcttttccctttcatccttcgctccccccgtgcccattgttcataaaattgcatggataagtcagtcatttgtttggttggcccgtaatattggtaaaaaggcccggtaacatcgcccgcctcttcgttgtctgccggaggtgctttgcaagtgataccccgcggggtgtcagttgtcccccgccccctcctccgaaaatgtcacgactcggaagatcccccgggggaagccacgaaatggccaactccgacccaaacacaccaatccccggcggaaagacaaatttagcggaagaaagaggccaaaaaattatgatgggcttatgacatgtccgtcctccctcgtctatcattcacttttccttttccgtcgattgatttgcccaattgcccccacccctccagcgattcgtccgtctctccttccgccgatcgcttccgtctgtcttcgtccgatctccgatcagtgccctccgccactgaccaccgccgccgcccttcgccaactctgtcccgctctttgtgtgagatttccgccgatcgcaaaacaatgcaagcagccctaatgaggaggagggaacctgatctgtactcatccagcgaatatgtcagacacaactacggcaccagcggaagagcggcggacatttgccacgaaaaaggcaaaaaaagggggaggaaggctaattgacttaattaagaggactaatgatgacataattaaggcgatgg

SEQ ID NO: 13486 - DNA, 1639 bp, Heterodera glycines
cagcattttccccaaattcactcagatggaaatgaatgcgcgcgacgcgcaaatcctccgacgcctcgaaggcattcaattcgaactgaatggagtgctgcaaatgagcggccaaccgaagcggagaccgaaatgaaaaggaaacgaaaaacacgcgcctttggcattctccatttttggctaataaatgctttaattaactctttttatagtccagttacaatgcaaatatttccgatcacatttttcatttgatctgatcagattcgggccttcaatttgctcgggtccagcaccgtcttcagcttcatggctttcattatgttgccccgtattttcatctttccttgcatgaacgcctaaaccttctcttatcaatgaccatgatcagcggtcccctaactccaatcggttatcagtttcaaattgataggcttcctgtaccaataataccctcattggcaagatacccatgagggtaccatccatacaattttcgaattttatgcttcctgtaccaaggttaccctcatgggtaagatgccaatcaggatatcattcatacagattttttaattttattattgttcgatttcgggtcaggggttcggaattagcaaaaatggatgctatattcgtaatcagcgacctcgagaaccccttaacacttattttcattaattcctgaaacacatttatggcatctgaaaaagaatgtagaatctgtcctgtaaactagagaagtaccatcagttccccctactatgatcagtgactcgtttttgtctgatcagtgttctacatgtttcttagatccgtttctctttctctgatcagtactttttgtccatttctgctgatctgtcccattcttttccctttcttcgattgacctgatcaggtttcagcttgccagcagccatttgaatgaaagtgtcgtcagacagtgcaatttcgacgtcggctttctctgtctgatcagtggcagtttttttcccaacaaatggcggcgaattcttcagatcgaccgtccattcgcgtttgtccgcgccccgactgatcacaaatttgaaaatcgatccgatcggctgttgatcacccaactccgattccttttaattttccttttttctgaattatcctctcaaattccgaaccctcgtcgctctttcgcgaatctcttcgaaaatcgcgtcacttttgaaatcccttttgtctccgtcttcaacacctttcccgtgtccttcgtctttcttttggtttatgagttcgggaaagcccaatttgtaaatggcgacgacgcccgcgccaccgatgcctaaaaaggggcacaatgccaagccgaacaaaaaggaggcaattcaaattccggcggaagttttaactcaagtaaattaaaatgcaagaaaagtggtgaagcattcattgaacggaatgaattgggcaccgttttccggcgacggctgtcggtccgcacggattacaatgcgcgagcctaaagggtctctttcagaagagattttgcacgaagatgagcagcagccgaactttgattaagcgaattgggcgaagaaaagcggagaaaaaagggaaaagcaaaacgaaaaagggaaaatgaaaaccaaaaagcgaaatgaaa

SEQ ID NO: 13487 - DNA, 1237 bp, Heterodera glycines
atataacattttatatatttatattgttttatttttttgaaatccctccctctggtgcccaaacttcatgtcgcctctccgtttgagtgctcaatttgtttttgttttttcgcttcttttcaaaactcttttggcttttaattattttatttaaatctactaaaaatatttttgggacaaataaatctttagcacaataaaataaacattttctgaacgaatttcgtctggtcctacggaaaatagaagttttctgcgtcgaatttcctttgttcgttctgttttcttccgtttaatagcccggggcggtgcgtggcgttgggcagtggtcgcatgtgcccatatttccaatttcgccggcaactcccggaccgccgttctctccggggtttccgggcgtgccgggctttcccgcgtcgccgggctgtcccagccccccgggctgtccaaacgagccgggcagtcctggttggccaggagcacctgggtaccctgaaatcccatgaaaattaagtctttttgacaatcttttcgctttaccgttgggtccgggtggtcccgggggtccgacgactgtcgggccgtaccctgtgattctgccgggggctccgggttggccagactggccagactcaccaggttgaccttaaattgggaattttgcatccacgaacaatggcgactgttggagaatgatgtacttaccatcaggcccaggtggaccaggcggtcccagcggcccttggcctccgttcgggccaggaagtcccgggtttccggaaggaccgggaagtccgggcgggccaggcagaccgggttgggcaggctgacattcaccacagcccgcgccaaaggatccgccaccactcgcaccggcttggcctaaaaaaatgtcaacaaattaaggctccatgaattccttcatttggctccctcttttgaatttgtcgccccttcacttaccatttggccctgtttgtccaggtgctcccggcactccgtcaaatccgggctgtccgaccgggccgggaggtccgggcaatccgggcggggacacgccacagccgcagcagaggccggcttgcgcggcggaacccgagacgcccgcttcgccgtaaacgaggtgccttgccgttctggccttggctgcgccgttgccacgtgcgtttccatgatgccgaccacttgggccagcgtttgcgtacgcgttagcttaaatgattgttaggcactttgc

SEQ ID NO: 13488 - DNA, 1664 bp, Heterodera glycines
tcacggagtatgttccctgaacgctgcttgcaaaactcgagctcattctgcattttggtcacattctgctggaagtttggtaggccagcggcacgctgagtatgcaaatcaccgtggcaaccttaaattttaaaaaagctcgccgatgagcgaccgttttgtttccctttccgattcgcttttaccgttgacattacaacgccgaaaaatgcgagccgtcggagctcctcggcctcctttttgatctgctgcttgttggtctccatgctgctggttgatttggttggtttgtcttccttcggtcggatggatcactcactgactgatgctcactttcggtggatgtccctttaaatagggcaacttcgccagggggggcatttgatttgcccggccgactccccgggccactgaactgattaaattggcaaaaaagtgaccccttctatctgcggctgcaaatgtcgggcaaaaaaaaaactgcacaatgtcttaaaagattgccgtcccccaattccgtcaaaatgtgcgcacagttccgccggctgcgcactttccacactttctccccggcgtcggactgccactgattaatttaatttcatttttatttttgtcttccatttttttggtataatcgcaatttttgggcgacagcggcagagagagagagagagaagagaaagaagagatcggagggccaaaaggggcggagaatggcaaacagagcaaaacgccaaccaacgccaaaaccagtgtcacgatgatcgtgtcatgttggacgactgtccaacgacagataaaccgacaaaaaaccaaatcagcaaagcgacgaacgacaagtgtttgttgcgtcccctcccccgtccaaaggggggggggcactgctcaaaaaacagtgcccgaggcgatgctccgccgattgcccattatttatttatttattccccccccccccgccaatcgcacagcaattttcatttttatgtgtgctttttcgcggcaaaaagttgcgaaaataattaatttcctttgctttttgccaccattggttggaggcgcagaacgaacggacgaccgaattatacaattttcgggcctattgttgcgggagggggggggggggaatccccggcggcggggaaacgatgaaaagcggaaacgattcatttcactaattaatgaattaattaagtcactcttctgaaagagcagtgaaaaaatggaacatttggacaggagaaaaaaaaggacagaaattatctaaaatgagcaaaaccatggaccaaaagagtgcttattgcttatccaattagacaaatgctcaaaggaaagtccgtccgtcccaaaagactaataaaaacacaaaaaacaatgcctttttttgtcgacggttccatggattaaatatttgttgtcctttttgatgttccttctgtttatttgtttcattctttttttgttgaaaaattacggttaaattacatttaattaaaaatttaactgtcaaaaattctaaaacaaaacaaaaaacattttgtgtctttctttctatgggcgtgcttttctcttccttttcccccctttctttttttctctgcgctttttgtcgtttctctttggtccattgtgccgttttggcgttcgaaattctgaaaagggat

SEQ ID NO: 13489 - DNA, 2621 bp, Heterodera glycines
  misc_feature (41)..(41): n is a, c, g, or t
ccaaaacacggacaactgagtacaactgagtaccgaggtcncggttttgaccggggaccagttcccgggggttttcccggttttcccagccaaaaattcccggtttttcaacccgaaaaggtcccggtcccggttaagcccaaaattcccggtcccgctcaaaaaaacgaacagaaaatttatttaaaatttataaaaatcttgtaaaagtaaaaaggaaaatctgtttttcgcgtactatataaaaacaaatttaacaaggcaaagaaaattatcagaaatcacgggttcatgacaattacgcgaaacgcagcgatgaaattccaaataatatgcgcctttttctttacgtaataaaattttttttattttataaatgaaattaccgtatttgctctttttatatgccatggtatattatttttcaacctcctcagaagggggtagataattggagattggtagactaatggagactgggagattatttttcgatgatttatttagtggaaaatttttgaaatttattttaaacatgtcgccaaaaaatgtcatcgcgtcaaaaaaaaacatttttattgcatttatgttaaagaacttctgaaaatgactccaaaatgacaaaaatctatcattttcttgcttccggtatgcataaaaattggaatttttaatttgaagaaaggagctcaaaaaacgtattttttcgttgaaatttttcgattctgatgtcactatcgggcactagaaatcactacctattttggcgcttcgtactaaaatagtgaaaatttactatttcgacatttttaggaaaattccttaacaaaaatgcaataaaaccaaaaaaatacacccctaagaaacgacctaaacattttttcaaaaaatgcacccctgagaatcggtctaaaaaatttttcaaaaataccactaagaattggaaaattttcttaaaaattcttcccacaatttttttttcttgacaaattttgattaaaaatgttcagtattttgataagggaatagttcaaaggaaaagtacctcatttgcaactccaattagtgaataaaattattttggcttaatttttgactgaaaattaggtcactattcgtcactatttcggactttttgccactattttggaatttttactcactattttagttaactatttcgagattttccgtcactaaaagtagcgacccaccctactctaatgatgatgcagggctggatttgttcatttattagccccttttactgttgaattgatttttttggaaaatgtgccaaataaattattaaaaaattctatttatcccccctggcacataaatggagactggtagattattttgcaacctcctcagaaaggggtacataattggagaccggcagtttaatggagactggcacataaaaagagcaaatacggtaagtcaatgacttttttttctgctgattcgaaatgccataaattatttaaaaatctacactttgtttaaagcttctaactattatgcattttttttttctacttttaagaatttttttgcaactttttgattttttcgtgaatttttagttgacttttgatgttttttcgcatttaaatttctatccctacttttcgttccggcctaaaaatacacagcacagttaccagaattggtcgtccaaatttgaccttttttccgagttcgggttgcgcatggggtcgaaatgggtctaaatggatgacggatttatgatcagtggccttgaaaacctatgcatttttaatttaaattaaaatgaaaaattgttttgagttaaactgcataagagctgccaaatcgaaatcgaaaaaagagagtgaagaaatgagaatgaataaattggtactttactgttatgtgactaaagccaaatttcaaaaaatcaacaaaagggcgcgcaaaattcacacgataagctgatccatttgataaactttatcagcgatttttacattttttcctcccaagtgatgctgctgtctgctgtgcgattttcgcgcccttttgttgattttttaatttcgagttgtgaaagtccgggctttttgtttatgatggaaaatctctttgctgatgaaatgctataaggaatcactcggaaaaacaaagtcaattatataaaaaagcttagaatttgcggatattataaagcaaaattatattaaatttacgcctaattcctcccttttatcttttgggaaaacgagcaaaatttcaaaagaatgaaaattaaattctatttatacctacttcgatggattatttttttaaatgacaggtctttgaccacgatgttaaccggcaaagggtcagccgtgcgcaattgcccgcggtgattgacgagatcatgaacgaagcaaatgaaggcgccagggcattcattttggcgaatttagagaatgtccgaaaggttaatatggggttaaacggtcgggaaggctcggtcaaaaagaattagtaactgtatcagccacgggtcgcagtcgcagtctttctgagaatttttactaaagttttttattttttgaattggcaatttgcgtccaggtcgacgctgttggtatcaactagagtag

SEQ ID NO: 13490 - DNA, 1794 bp, Heterodera glycines
  misc_feature (187)..(187): n is a, c, g, or t
aatcaagccctaacgagttaaaagctgaattgaaatgtccatctaggccaaaaatttaatttccgaaaaatcaatattttttctaaaaatattaccaattaatagagcttgaaaagttttggcttgaaattggttcgttttccctgggaattcattgaaaataaataaggttcaaaaaccaaaaaanatgataggcaagtttcgacatctacaattatgcattttattttattctggtctgcgcaaaactctgagagtagtacaaccgagactgaattaatttcggggtttttagcgccatgtacaaatcacattttaacgaaaaggaacctgaatttttgcacaacgttttggaagtctaaggtaggggatacgaaaaccccaaaaagttaaaagtcgagttccaaaacctaggaagtctgaattaaaaatgacctctgatagagactggagacgggctattttgatgaaaatctgttaacaagtcacaacaaattcttcaaaatttcgcggagggaatttggacatttgtatgaaattggtttcggcagccccccccctccactagcagttatcgtcgttctaaatgcgaacgagaaaggcggtaatttgcgttttcccaaaaaaaaaaaaatttttttttgtaaaatttttattgttatatctaagagaaaaaaagatgaaaagctaagaatcttgtaaatttttaagaactgatagtagttagcaggaaaaattggtatcttcggcacaattaataataattttgaaacaaatgtctatttgcctataaatatataaggtttcgtaatccaatttttgaaagtagaactgagcgggaccgggaattttcgggttgaaaaaccaagacatttctgggtggtaaaaacggaaaaaaacttggactagtccggtcccggtcaaaatcattaagttctagagtttcggtttatttaaagaaaaaatgtagaaacaaaaacagacagcaaaacacaattatttgtttatttttaggtggcgattgagctgaacgcgatgaaggtgatcagaagggcgaagatggaggagtaagttactatttttttaaatcacacaggcccaaaatgtgcctatataaaatacgaggctttttaggccaaaaaaataacaaaagtgtgggtcagtcgatgccgacaaataccgccggttacaaattatgaaaatctgtggcccatttctttgcatatttttactaaaatttaaaaatttttgtatgaatcggatccgtgccaaaattactttttggtttttttatttgtattttctcttctaaaatgatttttatatcaatatttagtcattctcgagatttattttaaaattatcgaagaagttttgagaagttttaccattaatttggaaaaattaatgtgcatatttcacttttatgtgcatatattgaaatttggtagtttatattttatgcacatatttgcgctttaatacatataattccgaaaccgattctaaaatgaaaaccgagaatttaatccgaaaaactggttttaattaaaagcctgtggatatttttttaattatagctttctcttatttgtttatcagattgttgggaccgcaggtggcagggggccagctgaacgatgatggtgatgatgaagaaggagaggaggaagaggggtcggatgatgaatgaggaggggagaagggagggggcggggaattgtttagtttaaaaggaccacccgaactgaaattcggaaaatgtatatgcattatatagagccagggcttatt

SEQ ID NO: 13491 - DNA, 2826 bp, Heterodera glycines
ctagtggatttttcaattttagaaaaaaaaacaaattactatattttctactgaaatttcacccaatattttcgtaaatttaagttcttcattcgtttccccataaatttcatgcatttttcccataaattttccatcatccctattctttttccactcaaaaattattctgcatttattaatggtacgaagctagcatttaaaaaacattgaagaaaagttgaacctcgaattttaaaattattattaatattcaattaaaaaatagctttaaaataattcaatttaaatatttttattgacactgatttgtgagactattttcaaaatatgcacataaaaagtaaaaaatatgcacatacctaaatttttccaaattgggcaacattttcacaaattcttcaaattcgttaaatttaagctaaaaatctcaaaaatagctaaatgcaaaaatatagctaaaatttattaattttgaagaatctgagtaaaaatagaaaatttttaatttttggacatattttccattttttaaatattaatattttgaaaaaccccaaaaaatgaaatttttgaaaatttttcggtccttagagatcaaaagtttctgttccttgtttatgaattttgcaagctcttctcgtcatttttgtaccagtgttatcccatgaattgaaacagaaggaagggcacactttggtaatcgttcacatcattggtcccataaaaaaggtcgttttttcgattctaagaagtgctcgggggttatcgatggcgctgatcacgaatctgacatcagattatcatataaatcatctaatctatgatttttcatcaagtgataacgtcaaaaaaaatttttgatggattttcacttttactgttattcattcacaaaaataaattccatcaatatgtatgtagctggaatagttgttcgagacgaatgacacaagtcaaaaatccaactttcacatgaaaacattttcgacaaattttatgttgtcaattaattttatgcatattcaagtacatacataaaaggtataaacaaaacagtatattagatgaaagtttttttagtgggtgaacaacggtaaaaaagtgaaaatccatcataattttgacatgaatttactagaattaagcagaccgagttcttcgagagctaaccctccgaccaaacagacgcaaaattttaccgccctcgccaccctcttccctacaaaaccatctcaattgaagcacaaaagagcatttattataaacacaacaacgacaacaatacaaagtacaatcaatcactgggattggggcgggaaaaagtgagtggtaaagtggctcgacgtcttcacttccagtaccgcgcccgtgtttgtttggcctgtgtaggcgggtgcagagaaaacggtgatgagtcgttggttgaacattggctcaaatccggattggatgaactgcaaatggggaaacattaatttctgattaaaacgaaggccgcttaaactcacttggtgcgctcggatgatgcacgaaatcttcagcagctggcaagttctgataaccacatcttcgccgaacaggacacctgcgcctcgtggattcggtagttgtccttgcgcttccatcgggtcggcccacataaggtcaatgtgcagactatcggtcggcggtagcagcatcgggcgttccaattgtttgagctgttcaatgcttcgaattttctcgctgatgcctccatgcatgcctgaaaattgaaaggtggagaatgaacaaaaaaaagagcatctcacataatattttttggccgattagcccggtcagcggcatccacgcgaaggtgtcattgaagctgtcgaacagggcttgcgaatgggccggatagcgttcctccagttcctttttgaagccgtacctaaaaaaagaggggggaaaatttaaatatgaataagtgtgagaaaaaaaacccacgttgcgttgatgttgctcgtctcgtggttccctctcagcagcacaatcgatgtcggatatttgacctaaaaatggaaacgtttctttagtattggctgaaaaagccaaaccacaccttgtagcaaagcagcagcatgatggtctccacggattgcgcaccacggtccacgtagtcgcccaggaacaggtatttcttctccggcggggtcccgaggcagttgaagattctcatcaagtcaggaaattggccgtggacgtcgccgcagaccataacaggcggaaggatttcgaccagcgatggttggcgtttgaaggcgtcagttgcggcagcgcacagttgttgaatttctccgctggaaacctgcaaaaagggatgaaattgacaatgcaaaactcgctttttcacctctttcggaaactccatttgtttcgaccgtacaattttttggatcaaattgtcggggaatggtctcggagcttctgccatcggctttgctggtgctgttgttgttgccgcttggacgcacaatggatttgattatttccataggacaataatagggaatagttaggcaaagtggcgctatatggaaagtgaccagttttgaaaattttttcaaaaggggggacccttttgttttgcaaaatttttttgtgatagtcataaaaatttattcatcttaggtttttggggtccccgatcacgaatctttcaattattttgatcaattccgatttcctaatctaaatttgaacaaaaaatcataatttgaaaaattcaaaatttcgatttttattcgagttcgggattagaaattagtcaaaacacatgtcagattcgtgattagcgacctt

SEQ ID NO: 13492 - DNA, 2949 bp, Heterodera glycines
accctgacgtaccgtatgtacttcctcgaatatagcctttctcctcgccaccctcgaatatagccctcttttaagggggttaaacaatagatcccctggggctctattcgaggaaatatggtatgtactataaatgcttaaaatgagtttaaatcctaaaacgccaaaaatgattaaaaatccaaaatcatgctagccaggccaggcccgtaaattgttttgagattgaaggcgatctcttctgctgctcgcggctcaattcagcaaaaaatttattctttattattcattttgctgaaatggcattttggccattttacactaatttatgatttttctgttaacatccaatagaattggaattttaattaaaggaaaattatttaatcattattttatcaattggcaattcttttggtaaaacaaaaaaataaaattattaacaaagattttattattatttctttgtaattaagtaggatattaattgttccattaaatgagtagggttatgcttttctgactgcttttgattcagaaaaaaatcatttttattcatttatatgcccaaaaaatatatgcgatttattgaagaaaaaaaccaaatttggaaaaaaaattagttaatatctttaattaaatattaatttttttttaacatggaaaaaatttatttgctttttctttataatctaataaaaaaaaatcacctccaaaagactaaattttccttaatttttgtaaagaattgaaaatcatttgtataaattaaaatatgccttaatttttcggcaaaatccgtttacaaatagcactcagattttcaaaaatttccccggcggcgcctatcggcaccgcctgaccacgcccccagttccccaaaagttttttgaaaaaagcgtgccgcaaaaaaatgctaaaaattggaggcgaaaaataaaatattaatatatttttaatcgaataattttaaaataactgatttgaagcaatttcgcaaaatgttctgatttgtgaccccaaaatctgattttatttgactaaactcaaaaattaatggtcacgaaaacctggatttgtttttcgatcacggtcagggtcaagcttcacgggacgaattcacggtcacagtcacgattcacgggttttttcgtccagttttatttgtttaaatgacatgaaattttacagtttaattatttatataaatacatcggcctgaaaaatttcagaatttttcgcccaagtacaaattttttttttacaaaaaccggcatgtttgtaaaacatgaaaaataataatcaaattcacgacactcccgagaaactttcaagttctaaaaatatgagaatttttgtaaaaaaaaattctaatctattaaatttagcttgcagcagatagcctaatattaagttctctctgcaaaatttcaagtcaatcttaatgcgccagctaatggtttcattttttttggaattttaacgaaactttctttctattcagagaagaccccagaaaagaaccgacgaaatgatttaaaatttgaattttattcacaagtaacctaaaaaatcatttgaagaaattggaaactttaaattagaagcaaaatgccaattattaccgcaactggatcggatcctgtctggatttttctcgaatcctgatccgatatttggaattgatcaaaaagattttctaattacctagaaagaatttatgaaaaaacatttaagacaaatattaagtgaatgcttaattttgtcataaattttgctttgaatatacgtttaaagaaactgacattttaggaattttcaaactgacaaatgagtcacagaattttttgagcgccccaattctggtcacccacaacgacgactcgtctcattaaacaattcattttcgcataaattaaccaactcaaaaaatatggcacagtgaaaaagaaaaagtaccgaaataatagataattaattttaggtccggtcttgaaaaagccgggtatccccgggtctgggcccggtcgggcatcgggacccgtgcaaccctagaaaatacatatatgaaatttaaacgttaacaatgttcatgtgaaaattaaatataaatgcttattttttttattaattctgccggatttcctaatcattttgattgattttattaatttatatatttattcaatttaaaaatttctttagttataaaatgcaaataaatttttaatacataaaatgcattttcatttgtaattcctattagctatcatgaaaaaactatcaacaaatattatttattttttattaactgttaacgaaattttaacagtttcagagaatttatttgatgaaataaatgaaattataagtaaaataaaagtatgtgatttattaaataataatattcagttaaaaaaaataaaataaaaaaatacaaggttaaggttgaaccaacagcagatgaaccatttattttcgaacaagaaccaaattggcaaggaataaaaactgaaggtaaaatgaacggtgctgggacgttagtcaaaaaccatcaaaatggaaaatttttgacagaaaattattcataatttcgcataaaatagatcaaattctataatctagatatttttcgatagccctaagtgttttctactatcttgcaaaatttttaaaaaattctttaagtttaaaaaaagttgtgacctgagaagctcaaaaacccatggttttttgaacattttcagtcataactttcttgaaacttaacgaaactttttgaaattttgtaggctaatagaaaacacttagtgctatttaatgatatcaagaattaaaaatttagttgcttttgagcaaagttatatcaaaaaatattttcatttgatggttttttgactaacgcccattatgatggtttttgactaacgtcatagcaccaaatgaact

SEQ ID NO: 13493 - DNA, 1913 bp, Heterodera glycines
  misc_feature (136)..(136): n is a, c, g, or t
agaaatttctgaaaatgaaaaaagaactcagtgtgaatggggataagcgacgtatgggcgagaaatataaagaaatatgcgcgaaacttggcgcaagttcacgttcaatttataaatggaaaaggaaatttggctntagtaagttgaaaaattagggccttaattttattaaataaaaagtcataaaaatgcgtataaaataggaaaatcttatgaattttaatttgaattcaaatcatgcagaggaaccaacaaaattaattcactgaccagtcatttttcattcctacacatcctctccttacaaattagtcaaaataggtccttatttttgtcattctgtgcctccatttatacaaaaaataaaaaaaaataataataataatattttcgtaaacaaatttttttcaatacttttatttttaatatttcctaggttaaattttttttattaattttaattagatctttttggctccaataaaaacgcatagattttaaaatttacgaaagttcgggttttcttgaaagtttttgttcttatatagccaaaaatgcctaaaatgtgaattcttcgtaaataatttatgagaaatatgtccaaaactcgaataaaaaataaattttcatgaaattgagtacaattaaaatcaaatgttcaaaaattttagaggcaaaaggacactcaaaaaaagaaaaaattgaaataatgaaaaggtatcaaaagctaaaaaaagaaggcaagaaattggatgaaattgcaaaggaattaaaaatcagcaaatcgaatttgagacgatggcaaaaggaattgaattttgaaattggaagtaattaaaaataagtcaaaacataaaattactaattaaaaaaaataaaaataaaaaataaatgccctttaagagaaaaaattaatttccaatgaagaaaggttaaaaataattaatacttttgacaaaattgagtcaaaattggtcctccgctggactatttgccgagatgttaaagaattaattgccaaaaaattgggaattgaactcagaacaattaatcattggagattaaaattcggcttaaagagtaaggcaaaagcaattgaatttaaaaaaattaattaattaagaaaaaataaaaacaaaaaaagaaaaaatcgaaattttggaacgttttaataagatgaaaaatgattatccgcaaatgacgaataaacaaatcttgagagaattacaagtgggcacaactctgtatcggtggcaaagcaaattcaaaattggaaatggaaatggaggtgaatttattaaatacttattcaaatcttcagaaaattgttacgatgattttgtttgggacaggaaaagcaccaaatatttttaaaaattggaaacgattctttggaaaataatatcttttagttttttactgttttaccaaagtgaatgtcatcgaaaatttaaaaaaaatcgttggtataaacaaaaaatagctaatttttgaggtgatttaaatgtaaaagtacaaataggtgatgtgccgtcgtgcagatagtcagcgcagtttttatgaaaccataaaatcacgaaaaattgctttacaacaaaaaacgaatttttctttcttttcgcgaacctagctaggagcttgataaaaactgaatttttattatcttgaaattaaactccgtttttcattgataaaaataataaatttttttagaaaaaactatcctttctgataaagaaaaaattaaaataattcacaaatttgataaaatgaaaaactcatatggaaaagacattacacaaaaagatgcaaaacaaattgcacaacaattgggctattgcatcagaacaatttataattggaagaaaaaattttagaaaaaatggtaaattaaaaaaacgataaaatattaa

SEQ ID NO: 13494 - DNA, 1585 bp, Heterodera glycines
aaatttgggcgtacaagttgaacagttcggccgtgaacagggacgcttctgtgccatctgttccgctaaaaaagccaattttaaatttgaacaaaaaaaataattcaagtaagaaaaagttgtgactaaaaatgaaaaaaatcatagccatttaaactgttttttgaatattttgctgaaaattttcagttattttttaaaatttttaagaagaaattaagcaatttgtcattaaacatttaaaaataggttataaattttttaagccaggcccttctactgaatatgtccatttttgatcagatgtaaagaaaatgtcttcggttttgggggcccagaattggaccaaaaagcatttttagttttttttgacattttggtcacaataacaaaaattttttcataattttaaaaaaaaatttcaattttatggggaccagagttgtacaaaaatttttttttatcttttcacagttttgactataatttttggaaaatcccgatattaaaaagttattttgtgtttaacgttccaataattagtcatattttaaaagaaaaaaatttcttttttttttttgttttagaggctcataatccaactaagcatttttgaaaacacccaaagttgtatttttggtttgaaaacgcccacaaaatatacttttgcacaataaaaacccgaaaacgtaatacagaatttttaatacttcaaaaatataatagaaattttaaaaaaaatttttggtttccgaaaatgaggaaacctacaaagtgctgctggtcgacgcgtctttttgtgtgtgagctccaacctggaattgctggttgatggactacgtgttcacgtcaatgccgctcagccagcagccgtagccgggtgggactggtaccagccgaccacctgtgccctatttaagcaaattaattcaaaatttttaaaaaatagtttttttgctaataataaggttttgctggacccattatccaagatttagttgaacaacatcaaccggaatttttataaaaaaaaaattttgaaaaaatcgagctttttttgaaaatggtccaattttttagggaacctttagaattaaacaccaatcggaattttgaaaaaacttttttgtaaattttgacatttttggttaaaattgatggcttttgtgaaaaatcgagcttttttgttgctataaattaaagttttctggcctattacccaaaatttgttgaacaacatcaaccggaaatttaaaaaaaaactaaaaaatttgaaaaatcagcaaaactcaacaaaaagtttgcattaatttttttaattttcaatgtaaaaaaaatttagtagcaatgataaactcacaattagcgcaggtagtgcttcttgagaatgtcgacgattacgcagttgaacattgtgaggccctcgggaaattgcaaagcaacttaaaaaaaattaaaattttcaaaagaccaaatcaaattcccctatgtgtgtttattaaaattttggattgaaataacccaaaaatttttaaagtaccttcagaacccaaaacaacccgaaattcaaatataaaaatttttt

SEQ ID NO: 13495 - DNA, 1092 bp, Heterodera glycines
  misc_feature (1045)..(1045): n is a, c, g, or t
  misc_feature (1077)..(1077): n is a, c, g, or t
tgtgtgtgagctcctaacctggaattgctggttgatggactgcgtgttcacgtcaatgccgctcagccacaaggcgtagcccggatggaggtggtaccagctgaacacctgtgccaaaaatttgaacattagacaaaaaatctaattttttttttcaaaaaataatttgtatttgtttgtaattttttccgggctttaaaatagagtaaaaagggtcaagggttagtgatattcaacccacaaaccatacggaatttgttagaaaatttgtgaaaaaactattacactttgttcagttaccaaaaaaccccgcaatcaacgaccttttaaaactccaattttttaaaaaagagattcagaagcttaacaattgcttaaaaaatttccattttccattcctctaaagaaacctttaaccggcagcgcaaaagcgtccagcacaatgattgtgttggcgtccacccggcagttcatcagacccataatttcgatgttcccgccgctgcgccgtgcatcaccattttgagcaggatcaaggccgaaatttagacttcctaaaatttgaacaaattgagcgtaaaatgacagaaatcgtaaattgaccccaaaaaattttaaaaaattggtaataattcctccgttggtaggcccctcttttaaaaattttttggaaaatgtgaaaaccacaattgtacacaaatgccttaaaaagtcactaaacattttgtagttttccaaaggcattgaatgtcggagtgccgccccataaaaatgaaaacccgcagtaaaaccttgaaatagtgcgggtcctgctcccattgcttaacattgcgtatcattcgctgctcccgctggtcatacttgaacatggagtcggtcattttgaaaatttgaaaaaatagtaaaaatctaaaatagaaagtgcagaaaacattgtattgatgacgtctgttacccccaccaccaattatcttttttgactgtattctagttttcgtgtacattcaattgtttacgcatctaataactgactattcttactttntatataacttttttcatacttgggtaatccanacattctttgtatca

SEQ ID NO: 13496 - DNA, 2317 bp, Heterodera glycines
caatgctagcaaatctaggtaattgagcctcttttataagcatatgttatatgtgtattaatgtttattgttagctttggctctgttttttggtgtcttaaaattgtaaaattcaaaaattacaaatttctcctcacacggaatggcgcggacggcgccgctgcaaagtgtgcacagccgactctccccccccccccccccggcgacatttggccccttcctccggcgcacggctaattatttacgcttgttaaaaataaacaaaaaaaaaattggctaaacgaggtgctgacctgtgcacattatttagacaatgaatgtgcattttggtcattgttttggcactacgattttttgacaaaaatgcttttaaaatattaatatgcttttaagtcacaaattgagccaagagtaacggcataaaaaagtgaaaattagttaaaaatttaatactgttaaatttatatttatatatcatcataaatttcatacagaatatctaaattttagaaagttttaggaaagttaataaatttttcagctaataaaattatttttttaaatttcttttcaattaattaaacacaaaaggcaccaaaaatgccaaagaaaaggcaatttatttttggaataataaaaattcattcccgtgttctggcattcattcattgtctgtgtttacattccaattaattaaatgttggcgcgcaaatgccattcatctgtcaaaataggccataattattcgaaagcaaatgccaacaaaagtcaaattgttcgacgtgggcacaaatgtttctttaggccatagattgtgctgtggtttttccacatttggccaaaagatcaccgttatgctattaatattgttctgtttctaaaaatgccatggcaaaagaaatgccaaatgtttgaatgcttttcacatggcaccgcaatcggttgcatataaatacgtcagacggagacagccaaacaaatcattctgactcaaaatttgaaaaacttttctttcctaaaaccaaaaatgtttgccccaaaatttttcttatttttctggtctgtgttgcttttgccattggtcatccaatgacatcttctgaggacggcgatgaagcagtgggagaaacgaaacatgggaaatcggcacgaaaaatggccaaaaaccatctgccaaaggacgagttcaaacaggtcataggaaggaaaatattgaagcaccagaaaatgggttaaagtttttgggctagaaaaatgaacacccaaaaaaatttacctgaaatagaatttaaaaatgaggctaaattactttttgttttactttttgaaaattaagcataaaattgacaaaacccatgggaaaggaaagggttaaaaaattaatagattttgaaatgcattaaaaataaatagatttatttccttttttttatatttttctaatttttcactcttcttttgattctcaattttctgattactctaattttaacgtacaccgttcaatggagttattacagtaaggttattttcgtttttaccctttatcttttaatggattaattttaatattgttctcatctttatctaatttattgtcatcttcttcaggctttttcgccattggtgcccatcgaacttgcgcagaagaagtttgagcgccgcattgatcagatggagaagcagctttcagaagtgatcgccaatgtgcgcgaggacaattgtggggggaagaaaagagaagaagaagacgaagaagaaaagtgaagaagaaaaggaagaaaagtgcagaagaaaatggaaaagaaaaaaggaacaaaaaacggatcaaaaatgcgcaatttcttaacatcaattcactgcctatttaatgtatttgctgaagcatctttttaatgatttcataaatagctttggaaaaattagcaaatgtgcaaaaacctaatcaaagcaagcaaaaaatgaagccaaaaaaagaagtaacaaatgttggcatacggcaaagggtgtcatggcaactcgtacaattgcttaggtatgcctaaactttaggcctgcttgggcctaggctttgttttgtaaaatatgagtcgccttttgtacaagttgcaaatgacccaccgcaaattgccttatttcatgaaattgcttgagcttaaagcatgttgaaaccgttctggtaaaatccgccagttgtctttttattatcattgcatgaatagaaaatacaaaataaagcaaattaagtgatttattatattaaacaaaaatataatttgtcttaaatttgacagtttcttcaatatatcaatgaatc

SEQ ID NO: 13497 - DNA, 2327 bp, Heterodera glycines
aaaattttcaacccttagactaggccttaaatccaaatttttctcgagtccagactcgaattcgacaatgttgatcgaacaccacctgtagttgcgacaggactcgtaatcattctcaaatttccaaaattaagctctaaaaattttaaaacttttctttgtatcaaaaaaaaactcagaactaatgtaatttaaattttaaaatttgccagcggcgcttgtcatcaccgctgggcccaaaattttattatctttttattgatataaaaactctgtgtttttggataaagtccgtaaacacatttatacaaaagttcgaattttccccggcggcgccttcggcaccgtcggaacccccttaattgctaatagtttttccagtaaatattccttttaattaaatatttaccaagtttttccgcaaagtcctgcattgggatgagcggaattcgaactttaaagaatgctgggccgagcattttgcgacgattttccaccgaacattctttgcccttttggcgaagttgttcatcggaccaacgaagtacctaattatcaaaacaatcaaaatttaatttttaaaacatttaaatgctttggaaaggaaatattttctttgtttattaagctacaaaagatctagagaattaaaaagattaaattaattgttaataaaaccaataacacaaattatttcttttctttgtttttaaattagaatttcaaaaatttgtgcccaattaatttaccgcattccaaatgacaatttcaccgctgatgatcagctgatcacggtccaaaatttcacacaacaatttatgctccatttgcaaaaattctttggagaaaagcacagcgcccacattccggtcaatgtattcccaacaacgccgtgaaaggtcctaaaattaaaataaatataaatttaaaagcaaaattaaaattttattttttattatttctcttgtcctaacctcctcctcataaaagcgagcttgtgctagcacaaggaacacattggtcgggtccaattttgggtagttaacacacgccttcacgagcccaacaacgccatattttttagctgaattatattttttattttagaattaatagtcatattttaaaatttatacatatttgaacagtgagtgtacaaatcgtttctaaaatcacttttgtgtagaacatattcagttcgaaaaaaaataaaattgcttttttgatcatagcctttttaattaacattgaatagatgaataatacatataaaaatgcttaattttagtgttttcgagaaaagttatacattttttgaatcggacaccaaaacaaaaatgattcataaaaaataataaattaacaaataccataatacttatataatgtttatagaaaattgataatttcccaacccgcataaagaacggcgaaaaggttgtccccattcagctcccgtaaatcttcggcataaatgaagttcaacatcagtttgaaagctccaacttccacatccggcacttcgacaggctttatctcactctgcgggtcttcaaatttgattaagtttaaataaaataaatttttcaattcaccctttcctgaagccttcaagttttccgtgtcaaatcgaaacattgcctcgaacacattggaggccgtcttcaaaatcagtttatgcgcaggaagaagctttaattttggggcaaagggaatcaaatcataggaagtaaaatttttatatttttattataaataatataattttatttatttccaatgattttccaataattcgttttcagtgccaaattaatcgtaatctctgatgcctaatttataactcttctttttggcattttcctcacctcttttttgtcatcgctgccaaccaaaaagtgcacatccgcgtcattgcccgtgttcagcaaatgcttcatccgctccgtcaaactgatgtccgatggaggcgccgttaccgtatgcgttgttgacgaccctttcacacaggtactgttaccgttgttgttgttattattagtattaatagtgttattagcgctgcttgttgctgatgttgtcccggacattagtagaacagtgccagaggttgttgctcctccttttttggtagaatttcacacataaacagaaaaatggttacactaccaaaaatcgtataccatggttttgagccgataaggtacaaatggcatgggtgaagggttgaaattcaaaggtcaaagatttgattttggatggaaacataaataaacaagtgtatgcttgctttaagttcgtccttaaagtatggacaaatgattatc

SEQ ID NO: 13498 - DNA, 2775 bp, Heterodera glycines
tatttaaattccaatttttaaattccaatttaaatttcattataggcggcggatgggatgagcgcattttgggcggtcgtgaataataatgcatggagagaatgagtgaagaagaagaagaagaagaattcgggatggatgccaaaaaagtaaacattcattttcaattcaaactattgaacataaacaaaacaatgaatttctttcctggtcattttccaattaaataaattgaaatatttaccacacagaattaaattaaattctttaagagagtttaaaaaatattggagtgaaaattaaacgaatctcttcaaagtcattaaatttacattatttaaagaaaaaatcataagcatttatttttcattttttgtgccttgagaatttatttgctcagaatcccgagatgccattgtaccatccataatagtacccagatgggctccttaataaacaaaattcatcgttgataaattgctcagatgcaataaaaacttacttattcggtcgatacggcgcataagtgtaagagccatagaatgagcatggcttatacccactcaacgaaaaagggtaactgagaaaaaaataaatataaaaaaatacaaataaaaatgtgtaaaaatgacttgaaatgatgctcgggccaatttgaggagtgtttgtcgtagggagaagcataagtctaaaaatgataagacaatcattgtggggttggttctaaatgataaagcatagtttaataataagcaaggatgcatggaatggatggattgttttgtccaagaaattacggtaagtaattaaactaattacctacctaatgcacataccgattaatttaacgagaattaattgatgcgagaataaatattgttaaaaaaaaagtaaatatgaaaaatgttttaccacttgattcttatatcgcaacaacttactcgacaccgattgtattggtaggacggatatcggttacggtaaaagggatagtaatagaagtagcagaatttcggcgacccgctaacatcgtccattgacgtaatacggtagttgcgctcgggcaacggtggagaatggtgcaacgccgacacggacaaagagcggaaaagcggcataattagctaaaaaggcaacaaatccaatttacggcattttgaagaatttttttatcaaattaaaatagggcaattaattcaaagaaaaatttaaaaaaaatcgaatggaatttcttgaagacaaaagaaagaacagcaaattgagttaaagcaatgggaaagtgttggaagggatgggaacagatcaatcgcaatggaacaaacatttgttatccaaacagcggacggatttccgatcgaatggctcagctaaaacatctgccgacgaaaatgtgtgggaggagggcgaatgacagagaaaatgtttaaagctgaatcgatcggttcattaaacaattaaattttgaattaattgaaaagaaaaatattaaggttggtattgtatagaaaaggtgccctcaaaataaaataaagcacaaaaagtaattgataaaaagaaattggaaaataaattcatccatttcttcagaccgtaacttccactgaagctgaattccgtccgcattgtgaaacagaaaaagtcggaagcatttgcattttgaaagggactaaattattcacaataaaatataaatttttaaatattatttattttctctcacaatttccaactttttttttgattaatttaattattctggtttttaacatttctatttgtgaacaattgaaaaaacgcatgactaactcggattggcataacacttgaattggcatttctttcttatttatgaaagaatgaaaaaattgtgcatatgacaccaaagaaattataaatgtcaaaaaatatggccatataaattgcgattaatgcttttgggttttcaaaataaattttcaaaaataattttccgcttttaataatttcaaataattttccgcttttaataatttcaaataattttccgcttttaataatttcaaataattttccgcttttaataatttcaaataattttccgctttttccaaatgttccatttgcgtttcgttgtgcttcttctgctggtaattgtcggccttttcattggccccaattttgtttctgctgattgggataaaaaggtggccggttgggacgacaagaaagtgaacaaaggctgggaggaagccgaagcaccgctcaacatccgtgcccgtcgtcagttttttaatttatttaaattccaatttttaaattccaatttaaatttcattacaggcggcggatgggatgagcgcattttgggcattcgtgaacaatgaatggagagaatgagtgaagaagaagaagaagaagaagaattcgggatggatgccaaaaaagtaaacattcattttcaatttaattccccctttccgcccccatttgagcccctttttccaaatttcaattatcaaatgcataaacctgttctttctctcccaataaatgatccgattttgcctattgccaatttcctttttttatcacaactttcatcgttcgttcgcttcactccgtcgccccaaatttggtgaaaatttgtccgtccgtccctttccatccgtcgaccaatcccagcgaacacagcgcaattccatccccaattctctctccgctcaattcgattgcaatatattaaattttatttataatgatgagtaaacattggccatcaatcggtgagaaaattgg

SEQ ID NO: 13499 - DNA, 801 bp, Heterodera glycines
ggaggtagcgggggtcgaattggacaccaaaaaaagcattaaaatataaattaaaaaggcaatcttattttaattaaaatttatcattctttcagttggtacaacccgaacaatccattccgccgtgacccccaactccgtctgttcaccatcccggcactcgtttgtctgttccgtgccggtgccaatggcagttggatgaacacagcgaaagacttgtgccaaatttacgagtcagaggaccactttgccagtgtggcaacgttggagcgcattctgacaaactttttagacattgcagctgaacgccaaggaatgagtgtcagtgagggacgataaaaagcgatggaatgccaagaaattgcaaatattttcaaaataaaataagcattttacacaataatggtaaaaccgcatagggcaaagatcggttagagagcgacggagccaatggtaaagataaagccaaaaacaaaaatgaattctttggcattgagttgagcactattaaaattataagggcgttcctgataagttccgtttgtccgggcttataaactaaaattgaaatattttttatatgcaattgctatacaattttccaaattcgttttttccatcgttggcatttttagcttaaaaaaattattgctcaaaaatgaattctttggcaaattgaactctgctgcttccctgctgctggtattcattaaatttacctgctgactttaagccaaaagcattttcatagaaataaaatatagatttctctcaatttaaaaaataaagcgtatattttat

SEQ ID NO: 13500 - DNA, 2024 bp, Heterodera glycines
tcgttgcaacaatattcagggagtttttccttaaggttaaaaggttggttgtaattattattgtaccatttgtcaaatttctgttgatcggggattttcatttgatcaggacagtattgttcacgtggaggaagatgggagagaatgttgtcatagtttgatgatttgttgaacatgtgtggaaaatgttgtttatcttttatatgaagcccaaatgatttgatgaggccagataatttaatgggcataaggttgtagctgtcgtgaagaattgtaagcggtccatgttcattttgattaattttgagttcgtagagtcggttcccttgtttgatgatgtccggattgtgaattccttgcgccaaaacctccttgatgatcatcgtcatgtcgtagcgccccccaaagtgtgcaaacgcgactgttggaaactttttgttgtggtcaaaaaggagccattcaacgaattcgcgtagcggttgttgagtgatgattttttggtcgactgttgtctccgtgtagtcaaagggtgaaaaggtgattgagcggtgaagaccgcaaatttggcacttttttccctgaagtgatttgttccagtcgccgttgataatgcaatcggtacaaatgatggtagccgctgcaaagtttacctcgtgttcgaatttattacctacttttttatcctgtgtcgcttcaaaatcataagcgatgatcctgtatggtttaagtttatggggttttaggggttggatgaagcagctactgcacggattatcctcatcatcctcttttacatggaattgcttgcaaagtcgacaaaacttttccccgcattggtgacctacatttccgtgatactttacattataaattaccccacagtcctcgcatcgctgaaatttggtgcatagatccttgtgtaggtgacgttcatagcagaccttgttgtagaaattgttgttgcagtgctcacattttttgaagtatccctgttgtggctcgcatgggtagtcgacgccaacctcccgacatccatggcagagtgaagagcaattcattgaatgttgagatttgcgctcgtagacgctttcacaagagaggcaatagtaacgtttattgaagaatttggacagggttttgatgccgtcaaagtggttgttgttgtggtagagaagaatggggaattggtagtcggtgacatcagatttggtgattggtcgtatctggtaatcgttaaatatgaaaattttgtactcaccgggatatttgacgttccataacccttgcacttgatggatgtatatttctgcatcgtattccggttcagttgtcggaatcccggcatcgcggagtaaaagtagtactttttgacgaagaacagttgtttgattatctttgagccatctaaattgtttccttgaaattactcccctgatatataatgagtagtagcgcatcagttccagtgcataaaaaaggcaatagttgtcgttgttgttaattttgaaaatgtgtgattgggaagagtgaattggaggggcacttcctttggttgttcgtcgtcgtggtaggccttcagtgtttagaacagttacggtgacaacaaaaggggccccatataagttgacgtgtttggacttgctctgctccactttacaaaactggttaaaaatggtgtccacgacatttgatgtaattggagttataggcatgatgatgtctccctggtctaaaagttccgaagaaattatgacacctaccttatttgctcctccaagtgtgttctgtgcgtcttgaatagcctcctcgaccaccttgtgcacgcatgaacgtaattcagcctgtggatctgcacatttttcaatttgatcaataacaaatttagatttggaacggataaaatgatgtttaagacttttggaagaaattggtcaattttacgaatgcatttaattgtttgagattttttgggggagggagatgaacattgtgatttgggggcacgcttcatatttatatttttt

SEQ ID NO: 13501 - DNA, 2108 bp, Heterodera glycines
  misc_feature (66)..(67): n is a, c, g, or t
  misc_feature (2088)..(2088): n is a, c, g, or t
aaatgatgtttagactttggaagtaaatggtcattttacgaatgcattatgggtttgagattttgnnggggagggagatgaagattgggcttgggaggcacgcttcatatttatagtttttatgatttgattgggtaaaatatgtatatatgaataaaggaaaatttttttttaattttatgaagtaaagtttttataaaaattttatgatttaaattaagtttatttgagtttttttatattttttaaattgagggatttatattaaaattaagtggtgaaattggtttaaatagtgagcaaagaggaaaagcaaaagcaaaaaagggtaagtaggtaaaagatgtaaggatacgtagaaaattaaagtatttttgtaattaattatttaattgtaatattatttaaattatattgttataggtttattggaagattatggaattatattttttatttggtgaattcggtttaaatagtgaagaaagagggaatgcaaaaatttaaagggatggtaggaaacaaaaggttatggttaaattggtttaaatagtgcacagagagcgaggaagcaaaagggaaagagcgcgttagtcgtttgcagaaaaatttcaaaatttccaaatgaatggaaaaaatgcacttttgctggaaatgacaggctatttatactccaccgagtaggcggggcatatttttcggctgggttaaatttggcaccttgccaaaagaggcagctgtctcaagcacagaatatctgatgttgggttttgcataggcacaactgtcacaattaatcattgactcacagcttgacctctatttccagtggtatattaccgacacttccgtgggcattatacagtcaaaatgcatccaagggattattaatgaccattccattggctttggctcggtcagaaatgcaccaaaagaattcccaagggataattaatgaccactagcttcggttggacagacatgttcacaaaagaatggttaatggcgctcagttggcttttggtacaacagactccacatttcctaaggggatatttatgacactttcggaggcattagttagaaatgcactcaaaggaatgattaatgaccctccgtaggcttaggcttcggcaaaaatgcactcaaaagaattattaaagaccctccgtagactttgggtactcaataggctttgggtctcagaactgaaatatcccgtgggcactgggagtgaaatggctaaacttaaaaaataactctggggctcaaatggcggcactgtaaaaataactctggggctcaaatggctgcgcagtaaaaataaatctggggctcaaatggctgcgcagtaaaaataaatctggggctcaaatggttgcactgtaaaaataaatctggggctcaaatggcatacgcgagcgtttaaatggcacacacgcgggcgctcaggtggcatgcgtcccttccctataaggcatgacagctgacgcctatcctctgcctccctttccttctctaataggatttgacctcgggttttatccttcagatgttttttcaattatttacctcttctgggattggatatatttattataggtgttttttaaaggtttaaatttggtactgaaatgtccctttccagtgggactgaaatggcggggctgaaaattaagggccaaaatctggtggggtaactactccggtaccaaaaaaaccggtaattaccggccagtaccggtactggtaccgagcaactctaatacgaattatagaattgaaaaagatgtaaatgaaatgcagttgttttttatgtaaattgatgcaaagtgtgtgttgaacgaggcagggcggtgggatgggtgggtggaacgaccttttcttcacccgagcgaccagccaacgccaacgaaccaccactgattcatctcatagtagtatttgttgtccaccaatagaaccaaaaacattttgtccttttcctcggaattaaatggcttcttcatctttttccaaaaatcaaaaaaaaacaattttttgataaaaatctgctaaaaatttgcaaattttgtaaattttggacanaaataaaatgaacatcaaag

SEQ ID NO: 13502 - DNA, 1574 bp, Heterodera glycines
cccccccccccccccccccaatacccagagaatacattttaagattttttatgataaatttttgtaagtgctgccccccccacacctctttggtttttaaatgattttcaaaaaatgccaataaaacttgggcattttggccacccatccagcaaaaattcaaaattttttaccaacataaacatttaagattttctaaaaaaaaataattgattcagctagaatataaataatgcttatttgaagatcgacatttaaaaattcgatctaacctaatagagtatactaattagggctgtgaaatgcgggaatggggcttcttagtcctaaacatttttttaacttattacggttataccgtatatacatttttttaccgtactcaggcacaaatgcaacaccaccaccaccaccatcatcatggcacggcaccatccgcattcacgccactccaacaacacaagcaacagtcgccagcggcaacaattgtgccacaaggtgagagaatatgcttaacgaattatcgaggctgatcattgatcagaaatttggcatttttccgtggtaatcaataacctccccgagtactcatttttctggttcccaatttcctaaaaaaaaattttcaatgcccaattttctgtgttgtatattcacatacccttttcttctattctaggtaccagaattttggcgtttaattatccgtaattcctcactttccagtgccaaatttgaagaaaatttggcactcagttttccccgtactcaattctctgggtgccaatcagttgtcaaagaatctttggttatccggcacattcaatttgtggcacccacccaatttccggcactatctctctctgctgggaactgtccggcccggctgcgaaaacttcatttctttgcacgtggcgtttggccaatatttttttatttgttggccataagtatgtccatgagcttcttttcaggattagctttttgcgttatgttgccttaagcagccccccatttgcttactcagccacataatccgcttctttgcgctgcttggccgacgatttctcgtcattttaatgccactttttctccttggcacaaaaatctttttttggaattttgataattggaataaattgcgcaaaatttggcaacatttttaatcatggctttatgaaggacgccctttttggtaaccaaggacaaagcagaaaacatatacgcgttttaaggacatccatgtgccacccattcaacgatgcttctttgccccagtttttggggtggtttttaaaaattgtacgagtttttcgaaccatcattttttcaaggacgctcttgtagataagtaaggtcaggcccgtccccctccccgacattttcttatcatttggcattaaaatttccaaaaactttccccgacagcgcctatcggcaccgccggaccccattgggccattatttcttcaaaatttgaccccaaaacggcaaaaattgtcatttttggcgcaaaatcgcaagaaattcctgctttttcgcccgtgcgctaaaaatttagaaaaataacactg

SEQ ID NO: 13503 - DNA, 1241 bp, Heterodera glycines
tcagttcggccctcacggttcggccccaactgtttttccaatataactttctatatactttttttttgccatccaaatgcaaatgttggtatcattcgaacgcttaacatgtttagaagctttttctaagctattgcttcgctttagacaattaccaaaaaagttatacatgaaaattgcgaaaagtcaaaattttgaagttttttccaaataaaattttttccagtcttgaaaatcttttcgctttttgtaaggctaatagagcatctgaagagcttttgaatgataccaacaatgttggatttggatgataaaggaaaaaagttatagtggaaaagcatgttggggccgaaccgtggcgccgaaccgtgggggccgaactgagcgagtccgctactcattaagtctcggtactcgttttattcaatttgaaaactggctttttcagtcttgagcaaggggccaaatttttaattctggatcttcattcttgaaatccgggattaacgatctcgaaagcctttcactataggttttcacgttcccaaacttaggcacatttaaatcctagtcctattttctgtatatttcattatgatttagtttctttgaatcccgagcaattgaatctaaggcttctaaatttcatgatttagttttcaattcaaatggctctgaattttctcaaattatccgaaattctccccacccttgctcttaattttctcaaatttttcggtattccaaatccaaaatatttgaattttcagtccctaacttcgacaatccgtctatgattttggctttttatgtcatttcaatatttttgagtccccattcccgaccaattctctaaactaatttttggccttcacctgtcttttcgcggtttttgagtcgccattctctcctccctcggctctctcgataatgtctcaattcttgaaaccacaaatttttttttcgccaggcatcataaaatggcaccacaaaaatgggagcagctggttaatttatggtgtgccgtgccaactgtgccgccggtgttgccatggtgtatatagtgtatcatatttttgttgtttttgatttcgtctcatttatttatcagccaccattttgtttgtttctcattagtgattttgctcattaaaccaaaaaaggcatatggaattgtgcccgttttatactccgatggaattattgtgccatgcccctttcatgttccgcttttcctttta

SEQ ID NO: 13504 - DNA, 1776 bp, Heterodera glycines
cccccgccccctccatccattgggcgatggatcacaaaaattggtctctaaaccacatgtattcgagagatgggagcagtggcttttgaggccttcgtgacggtggctttttaataattattttggcatttttaaataaatgccaaaggattcataaaaatagtaattttctctaaaattgtgccgttttatattccgatggctatgtgccatgccctttcatgttctgcttttccttttattaattgggctttatcccgcgcctccccccggatgaatcacaaaaattggcctctaaaccacacatgtatcgagagatggcagctttggcttttgaggccttcgtgacggaggctttttaataattattttggcatttttaaaataaatgccaaaagcaaacgaaaattttttttttcattttctcgtttttatgtaattttgagttttataaagtatttacattatatttttaggaattttttgggaaaatttttatttttttgcgaaaatctttaacaaaatgaaaacccctacctatatctgcttcgaaaaattcaaaataaataggtaaataaatattacaggcggtgcaatcagtaaaaggagccttgaaaattttgaaaatttctgagacaaattttaaaaaatcaatgaaaaaattgagggttgcggagagtacctcgtgtaccccctcccctcagggaaattggcactggaaattttgacactttagaaaaattatcatagaaatgcaattaggtaattgcattaacgaattcgcaaatttattttacccgtaaataaattgttgtcataattatggtgcccaatattctggaggtgtccgtttttctgcaacttttccaatttctagtgccaacattcgctctccccctttggatatgatatatcttcattggatatgatatatccctggaaattttacaaaaaaaaaaaatatggaaaattctcaaaaaattgacaaattggaataatacagtaactgttacaataggatttaaaacttttttggcattatttatgccgtgccattttggttttgatcattatggctcataattttcgcacataaacctgccaaaattaaaaatgtgcattcataaaacattttccgtaccattcgcgcgtaaaaagtcagtgccgccacttttctcacggcactttttttttgacacattaccttcaacataattattttattaatttacaaaattcacacgccgcccagttctttgtgatgccatgggcccattcatttgccaaaattaaccaaccaatcacaaccaattttctcattagatgacgtccgcaattagagaattggcattgacatttcctacctaatgaccgtatcacttccattttggcactattaccatcattatcatcgtcattgtcaacagcatcattccatctcttcgagagtcccgttctcgacgcgagaaaagtctcaattttcttgggttcgatttcacgcgggatttcttacacgattcccgcactgaacagaatcccgtcccgtatattttttatgtttacctaaccctatgaattattcccaatttgttgtacgtcgaccgtagtcttgaaacactgaatctcgtggcaaggtcttaatgtaaacctgcgctaagtattcacctatatcccggggcatatggcttcgttttgaatctctggacccttttaaataaaatttcggggcatttgaaggtcttgaatccttgggcttggctcggtcttgaatttcgg

SEQ ID NO: 13505 - DNA, 1053 bp, Heterodera glycines
catgctaaagaaatgccaaaaataataatgaaaataaaattttcacattctaaaataaatctctcaagagcctttttagaggcaaagcagtctaaattttcaatgagttcaattatacgacaaaaaattataaaaaatttttgaatggctgtcaaacattttaaaagacagcctgagtgatttctacttaatataattgtcagcactaataaatctaccaattcatgctaaagaaatgccaaaataataatgaaaataaaattttcacattctaaaataaatctctcaagagcctttttagaggcaaagcagtctaaattttcaatgagttcaattatagaacaacaaattataaaaaatttttgaatggctgtcaaaaattttaaaagacagcctgagtgatttctacttaacataattgtcagcactaataaatctaccaattcatgctaaagaaatgccaaaataataatgaaaataaaattttcacattctaaaataaatctctcaagagcctttttagaggcaaagcagtctttattttcaatgagttcaattataggacaaaaaattataaaaaatttttgaatggctgtcaaacattttaaaagacagcctgagtgatttctacttaatataattgtcagcactaataaatctaccaattcatgctaaagaaatgccaaaataataatgaaaataaaattttcacattctaaaataaatctctcaagagcctttttagaggcaaagcagtctaaattttcaatgagttcaattatagaacaacaaattataaaaaatttttgaatggctgtcaaaaattttaaaagacagcctgagtgatttctacttaatataattgtcagcactaataaatctaccaattcatgctaaagaaatgccaaaataataatgaaaataaaattttcacattctaaaataaatctctcaagagcctttttagaggcaaagcagtctaaattttcaatgagttcaattatagaacaaaaaattataaaaaattttgaatggctgtcaaaaattttaaaa

SEQ ID NO: 13506 - DNA, 1728 bp, Heterodera glycines
  misc_feature (1713)..(1713): n is a, c, g, or t
attttctgccgggtccaattttttcggcgcgtttttccaaaaaaaaatagttggggaaaaatggaaagggatctggcggtgccttttgaaaatttcgtaatgatttgttaatagattttcacaaaaaaggcagatttttgcgcttttgagccattggcgacgacacatttagtttttttgcgacgcgcttttttccacaaacttcttgggaacaggggggagggatccgggggtaccgatcagggctgggcgaaacttcgggttttttgggcttcgagcttcggacttcgccttcgaataaaaattgtgcttcgccttcggcttcggctttgagtgtaacaaaaagggaaggtccccaggtgtccgtgggatttccgaatgaaatttggtgggtggatagagcacccacaggttcttaagaaaagtgattttattttttgcggaatgaactcgagtgccgagttatgacgtgccaaagtttttggttttttctaattaaagaaaagaaataattacttcactacgcaacaagcatctattggtgtagaggtagtgcgttagtcaaatttattttgtgtctcaggttcgaatcctctgcatgctaatacattttacaatttttatttttgcttttctggtgcagtctattattaaaaatattttttatgaaatagttattttaattttatttcattaacacccaaaaaatatcattaaagataaagacgcaataatttaatttaaaagatacacacctttctgttaaagatataattttatctaatatttttattgaatatcttatatgttaaaatggtaaaaaaaattagttcataaaaaaacatatttgattatttacttttgcataaaaaggcaaaaataaaattaaaaaatgagtttgcatgtcagggatccgaacctgtgggcttaaaaaacgaggactagctcactaccgctgcgccattagagacctgatgagggcgcaaataaattttaatttatttattcactaaaaaacttcggcacgtcataactcggcactcgggttcattccgcaaaaaataaaatcacttttcttaagaacctgtgggtgctctatccacccaccaaatttcattcggaaatcccacggacacctggggaccttcctttgtgagtgatttctacttaacataattgtcagcactaataaatctaccaattcatgctaaagaaatgccaaaataataatgaaaataaaattttcacattctaaaataaatctctcaagagcctttttagaggcaaagcagtctaaattttcaatgagttcaattataggacaaaaaattataaaaaatttttgaatggctgtcaaacattttaaaagacagcctgagtgatttctacttaatataattgtcagcactaataaatctaccaattcatgctaaagaaatgccaaaataataatgaaaataaaattctcacattctaaaataaatctctcaagagcctttttagaggcaaagcagtcgaaattttcaatgagttcaattataggacaaaaaattataaaaaatttttgaatggctgtcaaacattttaaaagacagcctgagtgatttctacttaatataattgtcagcactaataaatctaccaattcatgctaaagaaatgccaaaataataatgaaaataaaaatggcacattctaaaataaatctctcanagagcctttttagag

SEQ ID NO: 13507 - DNA, 3673 bp, Heterodera glycines
cagaataaatccatgtctcgagaagattcaaaaatgaattcgctccagatatgatggggcagaaatccaagtcaatcatatcaataatcatctaatcacttgaactcgggatattttgaaaaaagcctgaacttgtgatctggattttgccgacaaaaatccagacccaagaaaaatcgaggttgcccaaaaatagcctgggcctctagatccagggaaatccaagcctttcaaaaaatccctattaataagcccatagattgggattttatttttcagtcccaatctgatcacttaatgcttttgcccacttctgtgtttcgacgcttctgatcttcgcctctcttccgcgcgagttaccaatggaagcaaaaaaggcagctgatcgacttcctttttttgggaagaaatataattgtagaaaaaaatagtagccattttaaatgggatacaccccaaaacgtcgccgccgaaacgtcgccaggacatacgtcgccgcaaaaataaataaaaattttctagatttcaagaaaacttaaaagtattttagttttttgaaaatctaagtgttaataaaaactaaatttgctgaattttcggaaaaaaaccaaaaaacttgaaaatttttttttaatttccttgaattttcttgatagaaattttttttttgaatttttctagaatttttttcgtattaagctagttaactaaatttatcacaatttttctagatttttttttataaaattaaaaaaattttgcggcgacgttatgtcccggcgacgtttcggcggcgacgttttgtcctgctccctttcgtctttaaagagggtcaagagcgggaattgatctagcgaaattcaaaaaaaaaaaacccaagacccaaaaaaccgagaaattcacgagtccgggaaccgactcgagacactcgcatagccttgtagaaagaccaaaaatttcaaaactttaagttttctttaaaaaaatccggcattttcattttttcccccaaattttgtcaacacctccggcttttcctcctgctgatcagccaaatcgaacattgacacattgaaaatttggtatagcagatcaaaattatccatctgctgctgttgttgttgttgcggcggtgccgtcgtttttgttgtgccaaaattggcgattgaatccgaaagtgaggacgacgcatttgccgttgccgccatctgctgaaattcggtggtgtggttagtgattttgttatatccgaaaatttgcttcgcatatgctaaaaaccctataaaatccaggcccgaaagtcgagtaaatccaaaatttcatgaaaaatccattcctagggaagtccgatcggaatttcaaatttaactcctcgagaaagtcctgatcaatcaatattcgactgttttacagtgccattttccttaccatgctacgcccttttgccgttgtcggcttaaattggctttttgccaataatgacggcatgctaactgtctttggcactgttgttgtcgttgtttctgtgccaaatcggctaccatgccgaatgtcgagagtctccagcttgttgatgctgatatcgtcattgtcactgttgttgttgtcgttgaacatgctcagtgtggccaacaacggattggcacgcatcatttgtgccaacgttgttggcgaaggaggagaagcggctatcaccggtgccaatacttgttgatgatggtgatgcagtgccgatttgcccacaaagagacgtgccctgggaggacgattggctgaaagcaaaaggggatggacaattagcggataattaatgagggcagcgggtaattaagaagatcaaaggaatgtgccgacaatctagtttggtcctgggtttgatagttttggttttttgtgtttgatcgataggcacaatgtcatttttgttttgtgtccttgaaaagtgtcggcaaattcaaaaaaaaagaaaagaaaaaaacgaaaaatccccgaatatttgacattttggcttcatttgagcggaaaaacaatcagagaccgaaaaaatttgccgatttctgccccgatcaaatcgctgtccttattatgtccttgaaaatttgtcggtagattcaaaataaaaataaaaactcactgaaaatggttaaatcggccgccgtttccaagtcggattgggccaacacggggccataatgattgtgataattgttcgatgtcatcaagatgagcagggacatgatcagcagcaaagtgaattcactgggcacaaaaatgggcggcatttggcacaaaaagggtgggacaaaaaaagtgccgtcgtcgtcggtcaattcatcggcgaaatgagacgatagtgataaagcgcaggcagcagcatatgccgagtgatgatcagcttttgaaatggcacagattgcgattagaaatttctcaatttagtgttcgatcagtgatcagagagtggattgattaatgatgcgccagccatatgaatcgatatttgatcaatgaattcaaaaaagcaaaattgatcgtctctgattaaactagggatggcgctgctgacctcgaattttaagaaattggaacccaaaagacggttgcaaaaaagtttttaaaataagtcgcaccctccgccaaaaaatcataaattttaattaaagaacaaaaaatttttcgataagtcggaatttagcttctcctcccatgccccccccgcgaaagcaatgatctcccttcttcattctgctgatggcaaacaaataaaaatggatgaatcataaaaatgccattccctcaaaagcgtcgatcaaaaagcgaaaaccaatggaatgaaaaatgaatgaatgcaaatgaatgacaaatgagaaatgttagcgcgaaatgacacccaaaaaaaagtggcataaaaaattggttgtggcacctcggcttaaaattggggggaggggggggggggatttgttggttttaatgggaaagggaagaagcggctctttcactgtgacggcggcggtggcggcgatgaaatgaaatttcttccaatttgccccctcctccgtcccgccacgtccttcttcctcccgcccccacccaattcctcaatttaaccccgcgctcttccctcatcagggaaatgtcgcgccgcgagatgggatgagaagggatgcaaattgggggagggggatttgagaggaatcactcgtcgtggtcaacgaggggagaaaggtgatcggagttgactttcccgccgcaggcagacaaatggagggatgggaagaacctctcttcctgactgggtatagctaaggatgatgaagtttagatttagtggtgggcaggaggtagggagaaaattgaaatgacggaagagggaggagggggagtaactgactgactttctcttacctctctccctcattctctctatctctctttcccctctctctctctctcgcactctctactgctctctctgcttttttacctctctcaggcggttggaaaatcctatgagatttttctctcagtgtagggatgccttcacagataggtgcaatgagttaaggtaggagcaataagctcaacacagggatgagcatgaacacaaagcataattattttgagactcggcaaaggtagggaagtgaaaggaacatgaaagtgggggtcg
